United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 13

SEQ ID NO: 336 - DNA, 1399133 bp, Homo sapiens
ttacttccacatatgtgatgaaggcaaaagaccacagttgcatacatttgcatagttatcctcgagactggaaatgtcagtaagatgcaattgattgacttgctgattgtctttcctcatgtgagcgtcttttccatgttcatgacccaccactgatattctgtggaactgaactaaaactatggtccccgaagccttgttgggggtgtggaggaaggcgagagagtggaggggaggggacggacacagtattcctgtcagggtgcagctgcagctctgctccaaggcacacttttcctctggattccacagaatttctcccagggtcatccttctccagtagcagcccctccacctggagcatcactggtgggcagttgtggcgtcaggcactgtctctgccctcatctgctctggctggggcagcaggattgatttcattcaaaagacaactggttttcatggcaggggctatagtgagcagagcagagaacaggcacttgggcgtcctactggctttcttcttgcctgaggctagtcctccttgagccaatcctatgtctcctagagcacttagttgtccctctgtactttcaacctctggctcccgccctatagtcataaatgtgctagaggcttaaaacaaatgcctcaccaccaccttttatctcgcctaccaacaagtaccccccaaaattagggttagctgagcatggtgtctcatgcctgtaaatcccagcactttgggaggccgaggcaggaggatcacctgagctcaggagttccagaccagccagggcaacaaagtgagaccctgtctctagaaaaaaaaaaaaaaatttagccaagcatggtggcacacagctgtagtcccagctacttaggaggctggaggaccacttgagcctgggaggtcgaggctatagtgagctgtgattgtgccacttcactccagcctgggcaacagagtgagaccctgtctcataaaaaagaaaattaaggtcatatttgctgtttacttctctatcttccattcatttctttttggtgacagcttaattgagatagaatccaacatatcatacaattcacccattgaagtgtataattcaatagttcttaatatattcacagattgccatcaaccccaaaggaaaccctgtggccattagcagtcactcccattccctcctctgctcagctgtaggtaaccactaatcaactttttgtctattctgtaccattcatataaatggaatcatacattaaattcatggtcctttgtgtctggcttctttcactttgcagaatgttttcaaggttcatccatgctgttgaaacaggttttatcattcttcatttaaaatatccacatgtaaggtataatatatgtggagggattcagttctttgggccatttgcaaataatttagcttatgcacatgtagtacaagcaaaattaagtacaactaacgagtattaatatagagatgtagcaaggcataggaaaggaaatccagcagttgaagaggttttgtggcctgaaagtcttcatagagttgtttgatcaaaaaggccctgagatatcctcaggtacatcatcggatctgcacagtgaccatccatgccaccacctggtgtgggagcgcctggtgatagttcactcactaatcagacccatttgaagacattcaaatcagcagaagcaccttcaactctcacagaacacctggggcaccccggacaccatcaacttctctaactttaaggactacccaagtggagactgtagcgtagccatattccccacgcgaacctcagtaaaactccctaccacatattcacaaaggaggccggtcgatagatttctattggccttctctcttttaagtaatgactttcatttttgtctttgaaaatgaagcatccttgtgataaaaatattcaagtgatatggaaaagcataaagaagaaaagaaaaatcaccccaaatttcaccaccatccaaaaagccagtatcacctttggtaagcatcattcctgtcatcaatgttggccaagcatacagatggaagaatagatagatggtggctagaaacccaaaaaacaatgattttattttataaaaaggcgatcatactatacggtgctctttttttcatgttaaataataatttttggctgggtacagtggctcacacctgtaatctcagcactttgggaggccgaggcaggtggatcacaaggtcaggagttcgagaccagcctggccaacatgatgaaaccctgtctctactaaaaatacaaaaattagctgggtgtggtggtgggcacctgtaatcccagctattcgggaggctgagacaggagaattgcttgaacccaggaggcggaggttgcagtgagctgagattgtgccactgcactccaacctgggcaacagagagagacttccaaaagaaaaaatatatatataaatttttgtttcataggaaattagaagaaaaagaaaacaaatgaaatggactggactgctaaaattatgtaagtatttcttcagattagttcgcaaaagttgcctctaatgttacgtaattaaaataacaacaaaggggtcaagactctatattcttttagccacaggtttaaattttagacaatctggatcaactctgctctataaaacctcttccaacctctcttccccagcctcctaatttttttttcccttatgtactgtaaatgtaattcctccagggttggtttgtttgctgttatttaattatttctttgggttcatgccctgggaatccacgttcaccttaagccatggcttctgttcttatcactgaaattataggttcatctctcatcagattattaatttggaaggaaaatatttattctaaaataacaagcaattagagatgtacttctaatcttgtacaagtaggttaacataacaaattctcttgagtcatttctttacaattttaagctatcatctgaaattattattttgaagggtctatttattaaaaatgattcatcggtaacacaaagagctacataaaaagtatttctaggacttctctcctaagattcaagtgtttactgaacctgaccgttggaggtctcacagaccgtgagatttcagcaggtgtaaatagagccacctttttcctgccacccccgagtctcacaggcaaacttggctctggctctgctcctgtgctctgcagcctggctcatgggactccaggcccacagccatccaagaagaacttaagacatatcccagaatcctctcttgctccttggtcacatcctttcattacataaatggagacttatggcctgcaaagcctaaattatctactatctggtttgtacaggaacatttgctggcccctggaatggactatgctttctagtcttcatgaacacacttgagttctgggattctctgatttcataatgttattactaaagaattttcagaccagcatcgttcccttgcatgaccatggcatggcgaactttgcaactgtcattcctggaatacttttttccctatcagtgtcaccatcagggacaggaataaacatgcatgggtgagccaattcaaataaaagttttgccgtatctatgaagcaggtctgggaaccataggacctagttgctgtcaccttgtaactcactctttcacatgaacctgctaagcaatcatgattctcctaaggggttgaatgaggaggccagcatcctctgacataaatggatgttgctgttgataggtcactaccagttatcaactgccaggcatgcttccaagtgcttcttggtgtttggtgacccacagtagaaatgagctatgttcagagttacttacttacaaggatgtgattgctgtgtgtgtctctgaattctactgtggtgtctctgattcccatcttgtgccttattcctggtgcttagagttcttgcaaacacttgaaactgagtggttttgcatttatgtttttgctattgttgaaattatgctgccctaggggttgtcaactactttcagagagaaaaaaaaaaaaactggtgggaggtgctgcatcccattcttcaaagagaggtatctagtatttgctaaaccaactaggagacccattttaactaacattgtttgggctaccaagatgataaaatgaatgaaaaagcttggtgactaaaaaacttcacctagaacaataaataagcaggaaaggcaagaaaagaaaagcaaatgataatgacttttcaattacacccaaattaaaaggaacgatggcagtttttctaaatgatagtttcattggtggcacttggcatgtgtggttctacaatcccagtttccaattgttttgcacagatccaaggtgagtgggcaatgaagggggtggatgagccccttagctgatgactgttgatgactggtctctacttatccatgaaatcaataaacacagcaaggaactgccctcatggagttagcactctagctggggagaccaggtgagcactatagatgtgatgggttgacctgataggccttcaggaagggaagaagcagaccgatgtgtgggaagagcatgccaaacctagagacccacggggagctcattccaggaaaatcagctggagaaaatggagattcagtgatggctacatggaactccagtgaaatcatgaaatctaaatgcctttgtgaaaaatggtcctgaagataaagccaggtgctaaaagagagctgtttcagaattgagaggttctcaaataccacgtggcaggtcctttgggagtatgaagccttgccaggcttcagttgatcctgtttttagtgggataaacttctttgggaggcatcagtattggaagtgtcagcctcttgattcgtttggcttgagggaggatgggggtaaatttcagagatgagtaggagcttgttaagtaagcaacttaaaccaaagggtgccgagcctacaagggggcctgtgagtgcacgttgctgcttgggacctgctactcacaggcagggtgaccaacctactcccctttgcccctaactgtccaggttttattttattattatttttttgaaatagagtcttgctctgttgcccaggctgaagtccagtggcgcaatcttggctcactgcaacctccacttcccgggttcaagcaattctcctgcctcagcatcccaagtagctgggattataggcgcccaccaccacacccagctaattttttattttttgtagagacagggttttaccacgttgcccaggctggtctcaaactcctgatctcaagtgatccactcacctcagcctcttaaagtgttgggattataggcgcgagccactgtgcatggcctggacttttaaattagatatggaaatgtaaaagagacacttattaaattaattagcatacagtaggtcataatgaattcctgaaaaaaatgtcactttagaaatctattgacatggaaagatgctcatcatatatttttaagtggaaataagatgcaaaattatttctagatggtagtttttatgttttcttttttgccttttttactttctataatggacatgtaaccatgtaataataattttgtaatgaaaaaaatataggccgggtgcggtggctcacgcttgtaatcccagcactttgggaggctgaggtgggtggatcacgaggtaaaaatcgagaccatcttggccaacattgtgaaaccccatctctactaaaaatacaaaaattagctggccgtggtgctgcacgcctgtagtccaagctacctgggaggctgagacaggagaatcgcgtgaacccaggaggtggaagttgcagtgagcagagatcgtgccactgtgctccagcctgggtgacaaagactctgtcttaaaaaaaacaaaaacaaaacaaaacaaaacatataaagaaaaccttacagggagaaatgctgagtgctgatttgatgctaaacagcatctctcaaaaaagacactcttcgagtttgaaattaaaaatccaagaattgtggatgaaacaaactgtccacagaaacacactagagtttcattctgcacatgcaatgggagctttcaggaacacccagcgttcagctgagatgacctgaggcactggggagctgggggaggagctccacagcagatccctttgaccaggtatctcagggactctttgagataagattaccctagtctgagagcaaaggtttccagtctgtgctagacttatctttgtaatggaatttttttttttttttttgagatggaatctcactttgttgcccaggctggagtgcagtggcatgatctcggctcactgcaacctccacctccggggttcaagagattctcccacctgcctcagcctcccgagtagctggggttataggcgggcaccaccacacccagctaatttttggatttttagtagagatgcggttttgccatgttggtcagactggtcttaaactcctgacctcaggtgatccgcctgccttggcctcccaaagtgctgggattacaggcatgagccgctgcgcccagcctgttatggaaattggtgcatctgggcaggtgacactattcaataacatgatgcagttaacgtcatttagctctgagtctaggctcaacaagaaagctttccgctataattttattttccacatagaactgctcagaatttaaaaatgcagtttcatagtgatagagtgtggtctatgctaggcatggtgctaagtatacaacagtgagtacacagctctcttcttctctgtccctaggggagcagaggtaagtaaataagtgattaaagtgttgcacgttcaatgctacgattggggaagtaagtgcgcaccaagagcgttaatgtagaccaggagtttagcaaagatttgcgggacaaattcatcaaactgaagcccacaggttggcctgtcaaaaggagaaggcaggggttttaaagaatgactccagccagatggaaaagcacgtatgaagcatcaggagggaagcttctcatagtaaatataaactgtaaactgacgttttagcttttatgccccgttctcttaagagttaggttagcgttagtcttttggggcccagtcacctcttgatatagtgacaaaattggtcctatgcagctgaggatgagatcagcgagcatggtgggtccctcaagccagtgccacccatctgtatggtcaagcaggtcttcccggacaatactccctgcttttttttttttttttcggcatgttatttaaaccacagcaacatttcttattttgtgtgagacagtttattcacagtggattgaaaagaggctcaatgttgttttgaaataggattttcttaaaaaaactgaacatcgatattctccacactatcagaaatgttctagtaagggcagatggagatgaggcacgtccactacccaaacagggattgccggctttaccccatgtctaatgctgtcttctgcataagcatttcgcatttgtgcttattcatttccactcacaatattaacccgaattcacaccctggacatcatctgcacatatagcgtgcgcgcgcacacacacacacatacatacacacaaacacatacacacacacacacagctagcatagcaacttacctttataggaacacttctggggctgtctagaagataatacaatatacgtatatgcaacatgagtcacccgcctctaacacgaatccctaaatctacaattgtgtgctcaaatagatattcctggcacttgtcatcactttgcattagttttgtgttttctgttattttattctgtagtttccaatgactggttcattttttaacaatagcgaacaattacacagtgcttcgtttatcctacacactgttccaggtgctttaggcaaattaattagttgtgacaacaacctaacgtggtgcatgctattattgtccccgaagctcttacacaggtgcgttttggaggtggggttcccaccctggcacccagagctcacccactttctctgcccccttttgctctatcatcacctgggccaccattcccatgacctttgcatatcctcggagtgtttcctgtggctactggcacccagaggacctcagtgtgtacttctttgcctaatgttgtgcaggccctatctcggaatgttccattccagatccctccaccatgggctcattgtgaaataaacaatgcatggccactaaagcagttctttgaaaatgcagcgtcaacacacccacattgacagcaatgcaaagtcactgaaattttctagaatgacatgagaaaaaatccttatagatagtcttttccaatgcaaacttctcttttaaacacttttattagaaaagtttgctagtaaggcaggaaagtaacttttagatttttatgaatgagggtttgctttttggaaccctttcaaattttgatagccttaaaaaactactcttatttaacaaagagaaacagccagcggtaatctggagcttggagttgatatgagaatggctatttcatcaccaggtaattcctccaggtcactgaatggctatttcatcaccaggtaattcctccaggccacaagtgaggcccatggagtaatacagcctgtgattccctccgtcacccttcacattgattgaaaatgtatcttcaaagacagactcagaagctcttttgatgctttattgacaatttaagtacaatcttagagttgtcagataatctcaacacacttcagagaaaaacagactttttctgcaaagactttatttctattttttgatacattcatattttgttacacccttcctgtgcaaataatactgtgattcatgttcatgtgtagtggatgatcttgcttttttgtttttgttttttttttttttttgagacagagtctcactctgttgcccaggctggagttcagtggcgtgatctcggctcactgcaacctctgccccccgggttcaagtgattctcctgcctcagcctcccaggaagctgggattacaggtgcctgccaccacgcccagctaatttttgtatttttaatagagacggggtttcatcatcttggccaggctggtcttgaactcctgacctcgtgatccacccacctcggcctcccaaagtgctgggattacaggcatgagccaccgcgcccggcctgctctaacttattttaagaatcactgttctattctggaaagggaaaagaccaccaccaagaagggaaaggagaccatgctggacagcctaatagtctaacaggggatcctagggtgcctgagctcatgggagcaaaccttgttcaggcaccgcaagcccaacgcagcatgcagattgggaaggcgcaataatgcaaacaccatcaggaagaaagctatggatgatggaaaacactgtgtgctccacgtgacagaagggagccacctgatttgtcgcatcgggccagtgtaaggaagtgtaatttagtgggactgccagtgacactaagtcaggccttgatcagggtctggactcagtatggacacgagccactgggtgcagggggctcatgcctgccacctctctttttttcccttactatagagactttgatctgtccaccatttctatgtgagctttgggcttcctgtcacaggtctgttgtcaccgtggggccatgttggagtcggtagattttcagacagtgaagccacatgaagctgtgaatgctgatgtggctgctgcagagcccagtctctccccggtgcagggcctctgagacgacgggactgtcctcagatggttggaagaaatgggttatcttaggcagttaggaaaagagggacaggtgtcccaggatgtggaaaacttgagttcatcccctctcttccctccagcaaggatttcagtgctacatctaaaaagagaagccctgttgccgatttaataatttacagtctctaaatccaaaagggcctccatgtgctagtgagactcatgccctcagttatgttcacgatcttcctgagaagtcagacaatacaggtagaacaaaagatagtggttgtactttctcttctgcgtagtgtgggtaagagcatgcggtttgccgcatgcagtgttgttaatcttttgattgtgttgtgaatggctgaaaaaaaagctgaaagtttgattgaactgaaatccaatccatgtcaacataaggaatattctagtgagtttactgtcctaagagaaggtctctcctggggaacccctggtatgcagagctccctgggacttgcagattggacagagagggtgtgccaaaggggtataaacccttctgatggagagagtcgggcgtgtcttcattttggtagttctggaaaggctcctctttaaagattctgatttaataatgttcacttttgttaagattgaatatcattttgaaatcatttctaaacgtgtttcctttataggcactttatctattaaatttacagtggagccaaatgtattagcaaaatctccaagttgcaaaatgaatactcagaatcaaactatagattttttggtgatactttcagaaaaacaatttctttctaaagttgcaaatcatgaaagggaatgaaagtacattaacttgatttcttccctgtaattcaaacattcaacattcaaattaactttcataatttctcactttgtgacaagttgatttacgcatagttggtatttcattaatgcgatttatatagatggaattcttaaggataaacaaatgtttttgactattgcctggggttctttgggaatagatgctttctgaaaatttaaataagaacattactgttaaagccatgaatctagtttggagaacccactgcagttcattttacagagaaacaccttgtcaatggcatcttcatggtgtttactgaaggtaaaaggcaggatattaaatgtgagaactctctctccagctactgattctgcctgtctcgaattcaggtgagaatgacccatacagatacatggattgcacttgaatctgtgctctggtatttgtgtcatccggaggctgagaacgcctgttggtggtgtcgcagatggctctgctgtcttgtgtggacaaactgaaagggattcaggagcttcttctgtaattttactctgctgtttttcatggacatagtgaaagggatccaggagtttcttctgcaatttggctgtagttggactttgaaaaaaacttgaagagtgtgtgtgcgcgcgcgcgcgtgtgtgtgtgtgtttgaaaagagaattagaaaatgaaggtagacactgggtatgctcccccaggatgtggcgatggggcgcccggccgccctggctacacgtcgaaccagtggtcccccatgcagacgcggttccactcgcagccacagttccagcaccactcgagcctgcactggggctgcggacacttcatgtgcatgcagcctcctgttgggggcagaaaacaaaggtgtggtgggttcgcagcaagtacctggaaaacacgcattcccaaaccagcacgctagcctagacatcactttctgagcgaataatcacaagcaatacaagggcagagagaaacttaactgaggggaaaaacttcataaagcacaatagggcagctctaaagtgatgatattcattaagaaatgaatgaaattgaagcatgtcacttttgtcgggaacaaattttatttgtaaatctgactttattctcctgaaaggggatttagagacaaacacttcatgtttcatagataggggtcaattcctcatttaaatatattcaaatattaatatatttatatttaaaatatataaatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatataaatatattttatatatttatatttaaaatatatataaatatattttatatatttatatttaaaatatatataaatatattttatatatttatatttaaaatatatataaatatattttatatatttatatttaaaatatatataaatatattttatatatttatatttaaaatatatataaatatatttttatatatttatatttaaaatatatataaatatatttttatatatttatatttaaaatatatataaatatatttatatttaaatatattgataaaatttgatgatataacctaatataatgtataataatttaaatatattttgatttatttttgctctttctatagtgccacttacttggcttggccaaattcataaaacaggaactgggatagcatattgtaattattattatttctatttttttttttgagatggagttttgctcttgtcgtccaggctggagtgcagtggcgagatcttggctcactgcaacccccacctcccaggttcaagtgattctctggcctcagcctcccgagtagctgggattacaggcgcccaccaacatgcccagctaatttttgaatttttcgtagagacagggttttgccatgttggccaggctggtctcaaactcctgacctcaagtcatcctcccgcctcggcctcccaaagtgctgggattacaggcgtgagctaccgcacccagccagcatattatttttaatagggaatatgttccttaatgctatccaaaattttaattaagatgagagggatagaaaggaagtaattaataatgctaggtgttctatgtatattatctcatttgcttcccaaagcactttgagataagagcatcactctgctatagaatttccccaaggtgaagcacttttaaatggtgaagacaatgatctcaccaaggtctgtgtgattccaatgtcctgtcattcacagaacaggttattttcagcataagaggaaaagtcccttatcttggaacttattttggaattattcacctccctcacttgttaaacatagactccatgagtttctggagtgcacacagccctgcttcagtcgctgtgggggaactgaagggaggaggaagtgatttgtatgaggatgtacagagaactgtttctgtccaaatttcctggaaaaccccggcaaacgcagtttctttgcttgaatcccacctagcgttgaaggtgctccattactcactcttaccaattatcttgttaattgatttttcctgccaaattttccaagtaattggttcggtgctgtctcacttttattattagaaacctggcatgagaactttcactaatttaaaatatttatgaatatataggaataggcatttgttttaagataacttgccgacatgcaaaatctcctgttttcctaatcctttctggcttgttttaaagatcataaattacagatctgtggaaaataaaggagaaaacttacaacacttttatcttcatactttccacttaggtttgtgccattttcagcacatattgcatggttgtatatttatgatgtaaataatatgttatatggtgtgacattataaaaccacttgtttctctaaaatatcataaatattttatcatatcataaatatatcattattatatcatgtatcgtaaaatatattcaatcaaaattattgagcaatacattaaaacttaatgaactattaaagcaattctaaatgaaagggtaagaaactttcctattgtgatatttaatatatataagcatatataaacacaaatatgtatgaagagtgtgtgtgtgtgtgtgtgtgtgtgtgtgtatatatatatatatattttattttattttattttatttttttgagatggagtctcgctctgtcgcccaggctggagtacagggcgcgatctgggctcactgccacctctgcctcccgggttcaagcaattctcctgcctcagcctctcgagtagttggaattacaggcacctgccaccacgcctggctaaattttgtatttttagtagagacggggtttcaccatgttgaccaggctggtctcaaactcctgacctcgtgatctgcctgccttggcctcccaaagtgctgggattacaggcatgagccaccgcgcctggctgatagatgtgtttttcatacacagtccctggcttataactcccatagctcttgttacagtcttttgtcataatgttggggcaattcaggcctcagaaacaggcgccagaaaagagaatctctccctccgacctttccttgccctccttttaccagcccagggcaggactggaaccatccgcagctgttctgactgtgggttataagacccggatttcagaaagagtcctgtccatcccctggaggaaggaatgctgcacagggaggccaagaagaatctagaccggcaggccttgcagggtctccccactccatcttttagcgtgagatcaaagcctttctgtcccaccgcatttcaacacggctgtccatgcttccatcgtgcctatcccaggaagtctccatagagggccccagaggacagggtttggggagcttccaggttgctgaacacatggaggtttctgatgggcggagcacccagggaaggcttggaagctccgcgacccttcccccatacctcgccctctgcatctcttcatctgtatcttttgtaatatcctttataataaactggtaaatgtgtttccctgagttctgtgagccactgtagcaaataacagaacccaaagagggagtcatgggaatctcaacttgaagccagtcgatcagaacttccggaagcccagacttgagaccggtgagtggcagtcctgtgggactgagcccccagcctgagggatcagacactatttcctggtagacagcgccagggttgaagagcaggacactcagccggtgtccactgcagaactgattgcttgcttggtgcgtggggaaaaacccccgcacattccgtcacagaagtcttctgtgctgactgttgttattgaatgagagaatagaagaagcatgttgtttgttctacacttagaccgaatgccaaaaattaataccaagcatttaatgaatctgggatactagcattgtaaatgatatcttggtacagaagctagaattacaatggcctggtacagtaagaatggaaatgggaagagaagatattcacgtcattagctttcttttctccctagggcttaatatacacaaggccatagagctagacccaggccatggaggagcatggaggaccgcaattctaaaagctttgccagcttaaaagtaagtgcatccaggaagcagctgaaacttcacgcagatttgtggatatagacatgaagggaatatggcttcctttgtagtgagttctgtctgcagatggacactcaaaccatgaaaagctcagcctacgccgggcagtcgacatcgtggctccggccagcaattcttccactagatttaatgagagcgtggaagtccctgaacaacctgaaggcacatttgaggagaagcacacactcagtcagggaatggagccagaatttcatctgcttgagatggaagtgaagaaatttctggagactggagtggattataggagaaagtaccagggtttagcctgtgcttaaaatggaaattcctcgcattctcatttcagcttctctgagggaggaagggcattcctgaaacacagctgagtatgtaacaggccacgaaccttggtgacaaccaggtaacatccttggtcatagaggctatgtcggtttcggttacagtgatgcacttttaaacagtttaggccatcgctaataagcttcaagtctcagcttttctgtttgtaagttaaaaatttggaggtaaaaaattagtgctttcatttatagtacatcacaatatttccaagaaatagcccgacagggagaaactttcctacagtcacgaaccatttgactcctacaactccatctttggaggctgccagcatgttctgagtccagggcagatccgatgaataattttcctgcttctcatcctagaatatctgcctgcctcacaggatcaagtccaagccccaaacctgccattcagggacctcaattctgcatcctacctactgcttcagctgaggctcctgcgtgcggtgcctggaacacgagcagcaggggctgcctccgcacaccggcgcgcgcacacccggtgtctttgctcatgcagtcctggggcctaggacgcctcctcctgctcttccttgccttgctcatatctgctcattcttcaattcttggctggtatcatctcttccaggaagcctcctcctccgggtctgtgtgccctgatagcttgcttcctctatgttattttattaaaaagatcggtttatgtgtatatctctaaactttacaagctaagtttttgtgtgtttgtgttttatttattctttttgagacggagtctcactgtgtcacccaggccgaagtgcaatggtgcaatcttggctcactgcaacctccacctcctgggttcaaccaattcttgtgtctcggcctcccgagtagctgggatcacaggtgcctgccaccacacctagctattttttttttgtatttttactagagacagggtttcaccatgttagtcaggctggtcctgaattcttgaactcaagcgatctgccagcctcggcctcccaaagtgctgggattacaggcgtgagtcaccacgcccggcctacaagctaagttttaattcagcaaatattttttgtccgggctctcttctgggattggagcctagacggtcaaggtccctgatctcaccggcttatgttctaaagagcgacagatggggaacatgtaaatgaacaaattaagcaatgatctgggaaggaagtggtgctatgaaattattattaaactggtgggtgggactcgttgggtaaagggggaagcagacactgagatggaaagggaggagggcagactgggcagaggagaagcccagctcgggcacagcctaagaggcctgagctgacgtccaggagctctggggatggggcagctctcagggtggtcctgaatttcgttagtgggttgggtattatgaccaaccagtagtcatgggacatgagctctccggggaaggggagggagccagaactaattgtcttggcagaggtgatttcccagagggctcaaggccatccacaggcaggccccctgcagagggaatggcagtgcctccccctcgagagatgggatggtgttgacagtgccccccaacaggagggcaggggtctttggcagggtggtaaggggcggtctgactgagaagaggtcagctggggtaagatctgaaggacaggaaggagccagccatgggcagtgacgacacagaagcgtcctggggagaggagcgggactgtgtggttgcaatgtcagtggggacccccggggggaagggcaggactgacatggcctttgagaagtctacacgtctatgtagaggacggatcataaatatgcgagagtggaggcgagagcccttttgggaagctgtgcttggaagaggaggcgggcaagcagggcactggctggggacgtggagtcagaggtgggcagacgctggatcagagcacggggaaggccgtggtgaccggggattgaatgcagggtgaggaagagcatggaatgaaggatgagctttagcttagcggcttgaggaactgggcggtgctgttgactgaggtggggtgcaccctagaggaaaaggttttctaggagcagctagcactctgctttgtgaaatttgagctgtccattgaacaatcagtggagacactaaggaagcagctggctattggagtcggaccgaggggcgagatgagggtggggtgtagatttgggagccatcagtatgtggatagtatttaaggccacaagactgggctgtatgttatgtgtcacaaaggtgaagtgtctcaggtgtccccacaagccgacagtaagtgctgaaccaaacaaccacggaggagagaaacagaaagcaacaggtccaggttcgctgaccacttcctttttttttttttttttttttgagacagagtcttgctctgtcactcaggctggagtgcaatggcatgatctcagctcactgcaaattccgcctcccaggttcaagtaattctcctgcctcaggttcccaagcagttgggactacaggcatgtaccaccatgcccagctaacttttctatttttagtggagacggggtttcgccatgttggccaggctggtctcgaactcctgacctcaggtgatccgcctgccttggcctcccaaagtgctgggattaccggtgtgagccaccactcccagcctcgctgaccacttcttatcttgcaaactgccaccaccagagtctgggctaccgaggaggccactaaggcatggaccccagacctgctgggtaaattctccacctgccgtgcctgtgacgcctgccagaagtgggaacatgggtgggtgtttaaggatcccctttccctccccactgcagacagagacctggctgatttttactaattttctaaggttatacgtcacacatgtttattacagaaaagcataaaaagaaataaagtcctctttggtcctgttatgcctagagctactcactatgacatggtaacatcttgtttccagtctttttcttctgattctattttttcccacacacacatttgtttcaaaacagacatatgtgccacttgctttgaaattctgatttctcactgaggatggatgtaaacctttccgccatgccttcataaccttcatccacacgaatcagagcacgtctcacggagcgtgtttgatgcaccgtctctgttactcctcctgcccatgctgtgaggaagtcccattgaaacccatcttatgaacgagcaaactggtgctcacacagccacagtccatggcagagtcctaactcctgcaacactgcagtgccgggctgtgtgaagctttaccaccgatttatcacaaaataaaccaatctttctcatactgaggcctttagacacttcgatgattttcagtttacgctaatataaataatgctgcagttggcaccttttttcctaaaatgtgtgtgggggtgtgggtgtgtttgcctattatatatttcaggttagtcctttaggatagattttcaaaggtagaattattgggtcaaataatataaagtctttatataggtattgccaaagtggtttccagaaaagttacgctaacttatgatgtcctcaccaaccttgagaattattattaaaaaacaaaacaaacaaaaattaaggccgggcacagtggctcacacccgtaatcccagcttggctttgggaggccaaggcgggtagatcacctgaggtcaggagttcgagaccagcctggccgacatatagtgaaatcccgtctctactaaaaaatataaaaattagctgggtgtgttgcgtacacctgtagtcccagctacttgggaagctgaggcaggagaatctcttgaactcgggaggtggaggttgcagtgaaccgagattacgccattgcaccccagcctgggctacagatcaagactgtctaatctctgtgctttacacccttgtcagcgaaataccaggcctgtttatcccaaaccatcacatatcttctcctgggaagggcccttccgtgttctttccctcccacttcccagtgcacccagtggtggtggagactagagaagctctttccttccatcccatcagtgccttctgctcttttttttttttttttttttttttgagatggagtctcactctgtcgcccaggctggagtgcagtggtgcaatctcggctcactgcaagctctgcctcccgggttcacaccattctcctgcctcagcctccagagtagctgggactacaggcgcccgccaccacacccggctaattttttgtatttttagtagagacggggtttcactgtgttagccaggatggtctcgacctcctgaccttgtgatccacccgcctccgcctcccaaagtgctgggattacaggcgtgagccaccgcgcccggccgccttctgctctttataggtgcatgccaatcccttcattttctaggagcactgctgcatgcaatggagtaataaggacacgctgggtaaattatttattttctctgcaggaagccactgatacagcactaaggacttgtactgagctaagccagcacctgcggctctgggatgtgttcaagcaccgtcttgtttgtattaatgaaaacttcctgaaggacataactgaaaagagagaggcttgagtgcccatcctgggatggccgggcttccctcccgcaagtcagctctgggcaacctgccagccagggcgtagctgatgctcattaaggagaagctgggagaggctgcgcctggcttcgtgtcattgctcatctgtgatggtgccgctgactctgccttgcacacgtacaagtgcatcacattgagaaagggctctcggaccactggttgtgatggctttgccctgagtggcatgtccaggatagacagcaggaagtcccccactggtactgtgagtcatcaggggcaggccacagggatctttaaatatagacgagggtttaattttgaataatgttgcaaagctggggaaggctacagactgacggccggcagacaacagggtcatacggtgcagccatcagcgctggggaaggtcaccagggaggacagaaaaaccacagctgcctcctgactgccacttatcctcaaccactttccatatcttggttctagtttctatatttattccctttccaaccacataaatgctaactgtgtgcctcacatagccatggaactactcactcattaaatatttctgtgtaacaaaaacaataataatagtgataatgggtaacattaatcgaggggttacccaacacaccaggcaccttcagacagcatctcctttaatcctggaatccctgatgggtatgattctcccccaaagagcacacgacatcctcattctctgctcagcacagactcaccatttttttccactggtacatggcagcggggacagggcttggtggttttcttgatggtttctttggaggctgcttcccaacgagcctgctcggcggctctttcatcgactctgtaggcctggggaaacaaagaggaaaggcgtttaatctcagctttctattactgggatcagagtttatgttccctgtacgtcggtacaggaaattcttgaagacaggagtgccttcgggcaagaagcctaaatatcaatgcacttgacaaatgctagacagctactaggcggatggggacactctccctggcatgtggcgtatgcgtaggagcggggaagagattgtttggttttgtagtgtgagctcctctattctgttgttttgcataattgtaataaataacacctatcaggtgcttaaaatgcaggcaaggtgatcaatgctcaaatacacttctcattagacacttcatcagatgtgaagtgaggatctagtttttattccacattgaggattcgatgggtgaaaacatggcccaaagctggtaagtgggagtatcagtgtgactctggaatctttgcttttaaactttgctctacatcttgttatccttccttgcacctggcaaatggggaactccaaatgttgtcacagaagggacaggagcaagaacaggaaatgaagtcgatgtgccagagagggcagtgggagctgtgagtgaagactgtggccctggaaccagctgtctggttcaaatcccagctctacccagacgggtgactctggaaacattccctaagctctctgacagtctttatctctcagatgaaacaccttgtgcattgggggtatggaggattctatgagttaatttcttcaaagactcagaatgactccagtgtggcaagcttttaatacatttgctgacattattcatgtcaccgagagctgggtgctgcctgcaccatcatgtataaggaggttttctggtgggggtggaagcaagaggtcctgggctagctgtgcttgacatctgtgaccttaaggaccagccattcgctgattatccccagataagatgcagcatcaccaaaaacatgaatccaaactttgtcatttcactttcgaattccaagcctttttgaaatgttaaagtttttgagtctttatagatgaagtattatgaggaaaataactgtactgcatttaatagtttctttaggaattagtgttcatgtttctgttatttctgtggaaagtcaattcttccagagccaagatcacatttgagacatcctcatatccccagtttctggcatagaatctggtacacagcaggcgatcagtacatttcaggcaagtgaatgaatgaatgacgcagcccaggaaggcactaaactttcaggggttaccaaatttcaggggttaccaaactttcaggggttaccactaaactttcaggggttaccaaacatccaaaataggaccccgtgaaatgggcagggcacatgggtggtatccctgacagtggtgggggcaccacagacaagctttgcctagggctggtcactgggtgaagccaatttcgtttctgttaatgagccatcatgggcacaaaggaaacacccttgagaactgccagggtgtcacgtgatttgtgaatactttgctagaataacgtggagtcagctgctcggaggcaacggtaggtcaatgagtgcttcctttgctaagatccactcacggcagaggcccagtgagggcgctgtggttagtgagggccatttcacaacttggtaactaggtatgcatcttcatggcacgccttccagtcaccacagagtcttgggtggtcctaaccgtcagtgacacgtggcaaacacccatccccccaccgacctgcaccccaacgccaccccggcctcatgttccacgctgttctttttcaggtctagggctctgtagctctgcagcaatggtttagattgcttgttggtggcaagttggtaagtcatacaaattggagaaaaatacaattttacttatcagaaaataatttcaaaatgccattttttagcaacatggcatactgcatgtgaagggcaatttctcccaggtccacacacctaaaaatgctggatcaaatatggaaaaaaatcttttttaaacgtacggctgatagggtgggaaggcaaaggaaacccttaaagacagcaaatcctcctggttcgggaggaaggaacctggcatttgctgtggggctatcttcttagtcccgcgctgcccatcatctgggtcttcccaggccctaagggcacaggcaggagacaaagcctccagccagagccaggtgggaggtggaatccagttttactacacacagaggacctggactcctgagggtgacgttctcagtggaggaagccagggcaaaagcccgccctgaagagataattgacagatatgtgctggtctcaggctgggttctgtgaggcagcaggtttggaaaacatttttctgaacattcctaaccatcaggcctcggacacgagggttggtgaaaagaattcatcctatctgattagctttaaaaaacctcaagtcaaaaattaatttgaaatattaccagattggcatataccctggaaccaggcggaagcaaaaatatcttttgtggagcacagcactttaaaaagccaaacctcaaggaaattacacaaataaaattctaagaaatctgggatcataataaaaaagttaaaaagtcacctaatacaggagaaaactagctacatgagtgaaagtcacagaattacagaaactacagaatctaaccagcaaaggttgtagatattggaatggccagagacagagtactggccaggcatggtggctcacacctgtaatcccagcactttgggaggctgaggcaggtggatcacttgaggccgggtgttcaagaccagcctggccaacatggtgaaacctcgtctctgctaaaaacacaacgattagccaagcgtggtggtgtgcacctgtagtcccaggtacttgggaggctgaggcaggagaagtacctgaacctggggggcagaggttgcagtgagccgagattttgccactgcattccagtcccggtgatggagtgggactctgtctcaaaaaaacttaactgagtataaactaaatatgtttgttatatttaaataaataaataaaggtgatgataatggaataagagactgtcacaattaaccagggagatgtaaaaaagaaacaaatttctttgttttgtccatttttctggacatgaaacactaataattaaaattagaaactcagttgatgagttacataacaaattagatacaaatgaagagagaatttgtgaactgaaagatggagctgaagaaattacataaaatgccaagaagtaaaaaatatgaaaaggagattaagagatggggggataaggtgagaaggtccagtgtttttctaagtagagttctggaaggagataacaaagagcatgagagagaaacagtgtttggagagagtggcaaaaaaacacacaaattatctacaaagaagttacaattattccccccagctgatttcttaatgcatgggtgctggcagacagtgatggtatcttcaaagcactgacagaaaataccagcccacttagaattctatccaagcaaaattaatttttaagaatgagcataaataaaaacacagtaataaaaaacagcatttcccatcaacagaagttcattaaagaaacatgatttggggccggatgtggtggttcacgcctgtaatccaagcactttgggaggccaaggcaggcggatcatgaggtcaggagattgagaccatcctggctaacatgctgaaaccccatctctactaaaaatacaaaaaattacaaaaaattagctgggcatggtggtgggcgcctgtagtcccagctactcaggaggctgaggcagaagaatggcgtgaacccgggaggctgagcttgcagtgagccgagatcacgccactgcactccagcctgggcagcagagggagactccgtctcaaaaaaaaaaaaaaaaaaagaaaagaaaacaaacaaacaaacatggatgtgggaggccaaggcaggcagatcaccaagtcaggagtttgagaccgtcctgaccaacatggtgaaaccccgtctctactaaaaatacaaaaattagctgggcgcggtggtgggtgcctgtagtcccagctactcaggaggctgaggcaggagaatcatttgaaccgggaggcggaggttgcagtgagccgagatcataccactacactccagcctgggcaacagaacgagactccatctgccaccacccgccccgcaaaaaaaaaaaaaaaaaaaaaaaaaagaaacatggaaataggaaaagtccagaaggagccaggagctgcaagaagaaactgtgagaaaagaaaaagaaaatgggtaacgtatggtaaatcacaggaaatactgattgtctaaaactgtaaacgatgcttaatttgctggttaaaaaaaaaaaatccaagtaggctgtgtgtggtggctcacgcctgtaatcctagcactttgcgaggccaaggcgggtggatcatctgaggtcaggagttcaagatcagcctggccaacacagcgaaaccgtctctactaaaaatacaaaaagtagctgggtgtggtgcccacactactcgaaaggctgaggcaggagaattgcttgaacctgggaggtggaggttgcagtgagccgagatggtgccagtacactccagcctgggcaacggagtgagactttgtctcaaaaaaaaaaaaaaaatcagagtagaactagatgccggacaagaatagcacagaagtgtgagaattggatgattctaatgcgctggcatgattcaggcagagggtccttagatttttttacattaatatatgtttacattctagggtaatcaatacaagagaaagcaatttgcttctaaacaaggaaaaatacagtggaaatggcaaacaaaagagtcaaaagaaaggcaagaagtaaaagtaaaactatagaaatgtagaatgtaatagaaagtataaaataaaatggcagaaatgactgcaaatatcccagcactcccaacccgtgtggacagattatcattgagggcaggtcttgctaaactctagagtcttagcacttatctgggaggccttgtctgcaagaggagcactcaggggctgaagtttctggctcaggtgtgtgcacacctaaagcctttgttacatgttgccaagttaagagcattttcaactgggcgaatacaatgtttattctaacaaaggatgttatactcagcccaagagaaagattcagagctcaacttgaagaaacctcctgcctgtcaatagcacattactggagaggaattacaaactggaaaattgcaaatttatattaatatgctttgttctgtccaggaagaaagattaaagttacagcaaaagaagagaaataattacttttcaaaataccaattttctctgacttccgatcccccgagcacacaaggcagagtgggtataacttgcaggcccaccagaaagccactaggatttccccaaacggctctggatgtaacacctccagcagcaagcgtccttcaaatcaggacactgcaagtttaatacctaggagtgattacaaaagactacccgtgtaaacatttccacactagtgtgcactgagctactggatgggccagttcactcaggggagagggaggtagctaggagggtttgatccttagactggaagagggaaaattgagagcagcaatttctgttttcacctgcaaggatatgtacccttatcatttccttcacagactctgcaactgggccaatgttacttcttccccggatcgatatgttgaaatcctacccaccaaggtgatgctactggaaggtggggcctttgggaggtgattaggtcatgagggtggagctcttatgaagggattcgtgcccttattaaagcaaccccagagagctctcttgcctcttccactgtgagaagatgcagtgagatgccagcagtttgcaggaagagagacctccccagatctagagcctgaggttgaggcttcctgggctgagctttggttcctgtaagccatgggcagcagcgtgggttaagaggcaccctcatgtccacaggacaccagagctgctgaggggccgaggcacacgtgagccaaggagtcaaggaccccctcatggagatgcccacactgaaggtcagagacagagaagaaagcctagggaagagaaaataccccaaaccctaggaaaagaccaaaatgctgatgtcgcaaaatggtttttaatactgttaaagcaaactaagtatggcctaagaaggactccgtacttctgtatttgagtccttgtggtcgaacttagccaagattgaaaacccaacttaggagtgtgtctgacttaatatgtagacaagattgaaagtctaactctagagtatgcaactgtaacaacagctgggtcttggccaatcccagcagccatgcttcagccactcatacactgctgagtgttcaaactgtgttcaaatgaggccgacaccaacttgtaaccagcccgggtgtttctgtacctgacttccgatttctgtccatcacttccctttttgtctataaatttgttctgaccccgaggcacccttggagtctctctgaatctgctgtaattgtgaaggctacccaatttacgaatcgcttttttgttttttttcttgctcaattaaactctgctagatttaatgtgtctgaagttttttggggtttttttgtttccttttttttttttttttttttttttttgagacagagtgtggctctgtcgcccaggctggactgcagtggcgtgatctcggctcactgcaagctccgcctcccgggttcacgccattctcctgcctcagcctcccgagtagctgggactacaggcgcccgccaccacgcccggctaatttttagtagagacggggtttcaccatgttagccgggatggtctcgatctcctgaccttgtgatccacccgcctcggcctcccaaagtgctgggattacaggcgtgagccaccgcgcccggccgtgtctgaagttttaacagtaccaagctaggggagggtgttttagccggcaggacagctacccactttcttttgcagtgggggtggggttcacgctgacctcctgggactgtcaagggcccaggcagatcttggccttgattggagagttaggggttacggtgtagaaaactaataagatgtgtcttttcttttttttttttttctggtagacagtatgtgctcaaaggttatggttttattcctccatagggcatgaagcagttctgttatctaacttagaagtcaaagttcagcattcctttcccaatgaacgacatggcattctgttcctcaaacgctacttgtgctgattttcccattaatctgatgactcagacctcggcacgggctaacacagagctgtgtaggcatggcgctgggacagctgcagggtgttagagggaggggcggccggcgggtccgagaccctgctgcccaggaggggaaggctttgaagaagtaaggacgcttctgttacatgaggaagggcactgtgcggcaggggctctgcccacatcacagaatgtagtaactgcgcatccctgaaggacggagcttgtcattaactatttcagctggagagatcagtctcagaaaactaaataacttcagacccaggccgcctggcctgcgagcagtcggttcagaatcggagccccgagctgcctgggttcatactccaggcccctgcagccttgatttcttcctgtcattatcaagtcacatgctacaaagagggctaagggactaaggctaagatgctgtcatggagatctggaagtccccggggacttttgagagcacagttttcaaacagcttgtggccaggcgcagtggctcacacctgtaatcccagcactctgggaggccagtgcgacggtcaggagttcaagaccagcctgcgaaacatggtgaaaccctgtctctactaaaaatacatataatatttatatatatgtatatatttatatatatttatatatatttgtatatatatttatatatatttgtatatatatttgtatatatatttgtgtatatatatagcaacctcagtcttgatatatatatatatatatatatatatgctgggcctggtggcgcacacatatagtcccagctactcaggaggttgaggcatgagaatcacttgaatccagaaggtggagattgcaccgagccgagctggtgccactgcaatccagactaggcgacagggcaagaatctgtctcaaaacaacaacaacgaaagcaactaccaccaccaccagcacccagcttgtggtaaagacagtgggagaagccacccagcccccctcccctcactgcagtggctcacctgccctccacttgcctgcttcccctggcaccagcactgcaactccactcccagctgcccacccgcccttctgccctgggccatcgctgctgcctggccggttctcccttccccaacctgccgaaagtgctttcaagaaggacaccaggaggccacggctgccaaagctcatgccctttctttgtcattgtctccaactgtcccactgcacctaacatgtgggaaagggtcaccaagaaggcccttggagttcctgcccttctcagcatcacagctcttcctgtgcttcctatcctcacccagcggatccacggggagggaggggagtcccagacccagtgactgctgccactgctgccagccccagggacctggggggcaggagaagcagctctatgacaccccgggagtgggcggtgcccaggccactggtttagacctttgactgccacttccgagaggggatttctaccaggaggagcacatctttgctttgcatccttcatgagtgtcttaatgctgatgtttaaatccttctggagtgatctcaagcagtggctgggtgcccacaggttcaagatcaccaaagcgattctaaaaatgatcccaaggcttgtgtccagactctggagattgggattcagtaggtctgtggcggggtacagaaattagaatccctaaaaatgccctaaggggttgcgaggggcgggaggtttgggaaccattcatcctctggagggcgattctccctttgcgcctgaagaggaacatggtgagctgggtaacttaccctctgttcccgccttagtcatcaagctctaaagcaatgcctgcttattgtgttgccaggaggggaaggttttgttgtgattcagcatcaccgcccgattgtgcaataaagtgtggctctcacggggcagtgtaactgttaggtaattgcatagaattctgtgcctgtctactgctcacccgtggcaggaggaattgcatgcatgcatgtgtgtacgcacgcgtggtggaggtgggggtggaacaggacaagtctctctcctaatatacttcatggctgaaaatagcgatttcataaatatatatatgaaacatctataatatacttatatatagatgtttcatatatatatttcatatgattataggaaatatatttcatatacatatagagagagacagagagaatcaaaattccctcagaaaggtaaaggcatgatcgtccatctgtggctcaagaggaataacctcacaagggtcatcgtgagtaagatcaacacacaaacggcttagcacagagccaggtgcaccctgaatgctaaccgtgtgttttctatgatcaccaccattattactttgttattgtaatcatcacgatcatctctaaagagatgggaatatgaccctgtgggagtttgtacacatggaaaagaccactgaaggcctggattggccttaaatctcctttaaaaacacaagtatgggaggccgaggcaggaggaacacttgagtctaggagttcaaggccagactggtcaatataatgagaccctgtctctataaacacacacacacacacaaaactccactggtaaatcaaaatgtacttatataggttttaaaagctgaattaggctgggcacggtggctcacacctgtaatcccagcactttgggaggccgaggcgggtggatcacgaggtcagatcaaaccatcctggctaacacgatgaaaccccatctctactcaaaatacaaaaaaaaaaaaaaaaaattagccgggcgtggtggcaggcacctgtagtcccacctacttgggaggctgagatgggagaatgacgtgaacctgggaggcagagcttgcagtgagccgagatcgcgccactgcactccagcctgggcgacagagcaagactctgtgtcaaaaaaaaaaaaaaaaaaaagccgaattagcgcctaggagacacattgatatacattgaagctagaataacttaaggaactgcatatgtgttatctttcctgctttaagagaaactcatttgtgacacctgtgtagccaataattagacaagtctattctaatcctaaaaatccatttaagcctgttttccaaaaaagagcagttgtcattaatcatgaaaacagagttggcttaattcagctatgaatgctttcaggtgaatgacagcttttaaatgtcagctttctcatcaacgctcgcctctcttctcacaaacactgaaaccttccacctttgcagacagcagccttcctggctcagtcaagcaggtgggccagttgagcactgctgcgtgtgagcagcccgcctcctgctggtgagtaagaaaatggcatcacttttcaggggccttgagctagtcaacgttactgcttggcaacgggtgtcaccaaaacatgttttgttgttctcacattgtcttatgactatctctttttggagaatatgtatatatgtatatatttaaatgtattttgttatttttttttttgagacgttgtttcgctcctgttgcccaggctggagtgcaatggtgaaatctccgctcactgcaacctccacctcctgggttcaaatgattctgctgcctcggcctctcaagtagctggggttacaggtgcctgctaccacacccggctacttgggaggctgagggaggagacggagtttcaccatgttggccaggctagttttgaactcctgacctcaggtgatctgcccgcctccgtctcccaaagtgcttggattacaggtgtgagccactgcgcccggcctattttgttattttttttaagagaaatcatcagagtgttgggatttaatggggtgtctagccaagggctccggggaatacaaggctacactgtaagcaatacaaggctactccactaagctccaaactccccaagccatgctttagaatgcaattcagaagggcatttgtttttatttatttatctatttttgagacggagttttgctctgtcacctaggctggagtgcaatgacacaatctcggctcactacaacctccacctcctgggttcaagcgattctcatgcctcagcctcctgagtagctgggattacaggcatgcaccaccccacctcgctaatttttgtatttttagtagagatgggatttcatcactttggccaggctgatctcgaattcttgacctcaggtgatctgcctgcctcggcctcccaaagtgctgggattacaggcatgagccaccatgcctggcccagaagggcatttttgacaatgattctaacagtggtgatttctgctaggagtggaatgtgtgccaagtgccacagacgagatcttacagagtcttgccccatggggccctaaatgcttcctaaaggggaagtgaattaaaataatatctatcaacctattttgagattaatgggggaaatggaacaacataaatattaagtagcagaattattaataggtaccatttattggttattttaaaagtgctttgtgttcaactattgttacaagttgacatatgggaaaaatctacacttgagctagaaaatatgctgatttgtatttttgataatgacattctctagtttttggttggcttaggtcagcagtgaccaaaattatccacatagatgggattctgaatgcggaatcatcactaataggatgtgagaggggtcaaagccgaccacagagcctaccttttgtgcaaagtatagttattctggcacaaagtagactattatttttgctagagtgaatgcagaaatattttcattcaagaaacatgtgttgggtgtctaagatgtgccaggcactgtcctggaccctggggatacatcccagtaaacaagagagatgacaaatagcaagccaacaatccctgccttgtggagcttccccattagcagaacggcggctctcagaccagcggcaccggaagcgcttgtgctgtggctcccccactacccctctgggtctgaatccataggtctgggattgcgctcaaggactggcagttcaacaaattcctaggtgatgccgatgtcgctagcctgcagagcttcggagaactactgctcgcagaaggtctacatacactgtggtcaacaaagacagagagaccctattttttttttttttttttttttgagacagggtctcactctgttgcccaggctggagtgctgtggcaagatcatagctcactctagcctggaaatcctgggctctcgagtagctgggactacaggcacatgcttctgtcctctgctgatctttaaaaaatattttttgtagagatggggtctcactttgttgcccaggctggtttcgaattcttagcttcaagtgatcctcccaccctggcctcccaaagtgtggggctgccggtgtgaaccaccacactcggtagggcagaatttttctcttctctgggaaaccgaggtctttgctcgtcaggccttccatggactgggtgaggcccacccacattatagagggtcatctccttgacctcaaagttaactgagtatagatgttaaccacgtctacaaaaataccttcacagcgacaccttgactactgctggttccaacaactgggctgtgtggcccagctacattgacacagaaaattacccatcacagctaggctgaaactcatgtttaagactagatctgtttgacttcaagccccctctgcttgtcttggattcctcagacacgggtgggaacacctagtccttgctgaaagaaggtaaatgcaaccctggagaacagcagtgctgagcctaaatgggctatgcctctgtgcttacaggggtgctgagtttaaacgagctatgcctctgtgtttgcaggggtgctgagtttaaatgtgctatacctctgtgctttgcaggggtgatgagttaaatggccatgcctctgtgcttgcaggggtgatgagttaaatgggctacacctctgtgcttgcggggtgctgagtttaaacgggctatgcctctgtgcttgcaaggaacaagtgtagagcaggtgaaccgttttcctcacacatggtcaacatgcttttctgtggagtgacaatattttgtcccccctgccagccccgtttttaatgaaggaattatgggggccaggatccagctgttagcttttcaaatctgcacacctctcagaaatgctcctcctggggacacagtccttcgattccctcttgcctgttgtcggctgggccactatgcaggcgtggctggggtgcctttcaaagtggcgttcactcccttttcccccaggtcattttatttttgtttctggacaaatccagcattttccttaagggtttagcgccatctggtgcatcagaggcgcactgcagctgcttccctcctgatactgagtggggtgtgcagagaattgccaggggcgctttcctttgaggagctccaaatgcccgtggggtatgcggtgtgtatgtgagtggcgagtgtgtgcagtgttatgtatctgtgtgtggtgtgtgttctgtgtgtatgtgtgttgtgtatatgcgtatgctgtatgtgcagtgtgtgtggtgtgtatgtatgtgtgtgtggtatatgtggtgcgcgtgtgttgtgtgtgtaacgcatggtgtgcatgttatgtatatgtgtgcgccgtgtgtgttgtgtatgtgtggtgtatgtggatgtggtgtgtatgtttatgtgtgtgtggtgcatatgtgtggtgtgtgtgatgggtgtgtggtgcatatgggtggtgtgtgtgatgggtgtgtggtgtgtgtggtgtgtgtgatgtatgtgtggtgtgtgtaatgggtgtgtggtgcatgtgtgtggtgtgtgatgtgtgtgtggtgtgtgtaatgggtgtgtggtgcatgtgtgtggtgtgtgtatgtgtgtatgtgtgtggcatgtgtgatgtatgtgtggtgtgtgtgtatgtgtgatgtgtgttatatatgtgtggtgtgtatgtgtgatgtgtgcgttatgtttatgtgtgtggcatgtgtgacatatgtgtggtgtgtgtgtgtgtgtggtgtgtagctgtgacaataagtttctataaaaatattttccacattgcgaacttgttctagctgcttgtttatggagtctagtacacagggtatacagggtatagacttgcaaagtcggttcagaatttacattcagaccttttttaccaactctgctgggatcctgaaacccctctggaatccaaaagccttcaggacagcatcattttcagaggagggtcccatgtgtcaggccaggcaggcatctggtggaggctgcactgtggccgtgcagaggaagactcaggggacccgcaggctgtgacccctacaggtgagtgagctcaggggacccgcaggccgtgacccccacaggtgagcgagctcaggggacccgcaggccatgcccctcaaggcagaactcctgggggtggagggaaccccccgggggtgctgaggctcctgcagagggaggacgcccctggccggaagctgcaccccagggaagtgcgttgcagagccttggtgctctgccgtgctggagtgacagtccagaagagaagaagggtttctgcagtgcaggagagcgcttggagagccccagccccaggtctgcatggtcaggatcggcctccaggggcaggcgtgtggtgtcactgtgtgtgtacccacgcaagcatgccttcacttgtctttcaatcccagtcaatcttatctttcctttcctctctccacagtgcctgacagttttagcattcagccttaaaaacccaaacccccaagtttcaccattttgtaatactttgcaacttacaaacggcgaaacacacactcatttcattatttatagcttggtagatcttactggctctgtgtggcaggcgacgaaaaggctgtgagcctttgagcaacttgcctggaagaggaggaaatgaaaccgggcctttgacgacctgccaagggccatttctgctgccccagagcaaaccttcgcacacaagctgagtgccttggaaacgcactgcagaggggcgggtgctgtcctggcactgactcagcttttcacagcgcaaggccgagcccgaacgacgcgctggctttaatggagatctgtcgcagccgttccatcccatctgcacatccacttaggcggcgggtccagggtcatggattcaagagaagtggcatcaaacctgctttacttaaaccaacaagcagttcagaaaatacactcccaaataaccggggatctagatctccgggaataataaattacacccatctcccaatactgggactgcatttgtgtgtgaaggcagtcaatggctgagagacggctctgcggtgagatgctggggcaaaatagatcaaaaaagatctcagctccctggagccactgctgcttcagtgtcctccactgagggaggtgcacctcctagcctctcctggactgtaactctgaaggggtgggtgtgggtgtggggagcatggataaggggcagttcgttggagattgtcagtcttgcatcttgatcgctggctccagcctggattctcctctgaggtggtctaggcatccactcctttccccactgaacccctagctgagatgtccacaatgaatgtgtgtctccccgaacaacctgcttttgtttctgtctcctcttccagccaatggcaccaccatcgttctaagctagacattcatgcatcaacattaacccgtctcctctcatcctgtcttctaatccactgccaagttctgcagatccgacctcaagcccatcccctcctctgtattccctggccggattcctggtgcctggtgtgtctctggtttggcccttttagggggtgctctgctctgctcccagtcccaccaccttgggactgaggtcacaccgtcacatcacggcgatagggcagctcacgcccagtggtggagggtggatgcgaagggctcacctctagcctcctacctctggctcccctcagtcttctgtggcaaccgcactgcagtgggactccacctctgcccaaccctgcttccttctcttcctgaaggtgctgttgagagcaccccaagacactccctgcctgcaagtctcagagcctgttctcctgggaacctataacctgtggcacttggtgcctggatagtcctaggaagcaaactctaaaatggagttagagctggaatccctcccgccagtggccaaagaggagcctgtcactgttggaagaaagtgctggaagctctgagtggggccccgaggagcaaagggcagggtcaggcggcatgcaagcgccctgtctctgcggctgtgcacgcaggcagaccctgtggattccaggtgtctgtggagggaaaagaggtcacgtggggctacctgcgggccaataagagcatcccagcaaagattttgggggttcagcagctgagaacgatggaccatttgaaagagagcccctggcacgctaccgagccctgtggagttggagcatctgtgcagcaattgtcataagacagaagtggggcatctaggcccaggcccaagcaggcccacggggcgtgagcgagctgcacaagcaggtcctcagacccccgtgccatccacaccgtggcatgactgcctctccttgggctcacaaccatggccccacggtggtagtggccgggctggggagattccttatgacacactgagggatccaagcttggttcacaattgagttagcttaacatacggctgcaagccaaaaatgcactgtcgctatcctgtaatcctctttagggttgaaagagtggtgaggggagaccctgtcaataagcagagccttgggcaacgcaactgctatggtccgagtgtttgtgtctccccagattcctatgtcgaaacctaatcaccaaggcggtgggattaggaggtgaggcctttgcaaggtgattgggtcataagtcagagccctcgggaatgggattagtgcccttataaagagagggcattaaccagtcacctctcatcctgtgaggccccagagagctgtcttgccccttctaccatgtgagggtatagctagaagacgtcatctacaaaccaaaaagtggtccctcatgagaccccaaatctgctagtgcattcatctttgacttctgagcctccagaactggaaggaataaatgtgtgttgtttataagccagccagtctacggtattgagtgacagcagcccaaacagatgaggcagcagctgacagtggactgtgtgtggaaaggaaagagtcctgagttaggaagagatacaagctcctaagcagtggcaaacgtcttggcagcctctttaagggcagggacagagaaaatctggaagactgaggacaggtaagacaaggagctctgcagagcaggcacgtggacagacccatgggaggggcaggacatgtccgcatgtttgcacagcatggcagagctcacaggagagcacttcaacaagcagatggagggatccggccagtggaccactgccagcctccgccactggccacagcagtcctgggccagggcactcccgtgtggaggaagcgtggtggtgaggtgaagccctgccaggccccccagctcgggcatccccccatctgccacaccgccaacattcaacctgccggcaacaaagagcggcacggagtcctgtgtgtcctccactcctcgaggagaccaactaactggccagtgggtgtcaggtggatcacagtgacaccagggaagatgaagacactccatcttgacaggaagtgactccttttctgggtgtgggtttgcctttcttggcaacagagcctcagccagcactagcatctgcaggctgccggcaccctgcatggcactgcattgtgtcccagtgggtgcatacccatgggaacactggtcctgtcacacatcctactgcccagaagctgttgacctgatgagacggatggaccaggcttgcacgatgccgctggagctgcactgtgatgtgggcgctatcctctaaggtgagatttacactctgaatcaacaactaccatggtgcagggtgtgtctccagcaggtagaacgcaatggttcaggaatcaaggggtggaagtagggacggccccacttctcactcccagtggtccacttggagtttatgctctccatctgtgcaacctggccttgcatatataggggccctggcttccagcaagagagtacttttgccagagaacacagcaagagttctggtcactttatgttgcattgccaagggattagcaggctagaaagggagttgccatcctggaaggggtaactgactctcaggagcaggcagggctgcagttatagaatggggtatttaaatgggaagaatgcatttggcacccaggtggttcactgtggcatctcttggtcctcccctgcccaatgttgatagcaaatcattcagtagtcatggctttagaatggcacccaggagcctggacccatcagggatgatgtctgtgtcaccccaccaggtaagccacctagaggtcttctctaagggcgaggggaatctagaatgagtaggagagaaggaagtcaatgggagtcagctgcaacttcaagaccagctgtggcagcatgagctacatatagtttaccctgctaaccttccatttgtacatttctccagtctctctcattccacaagcaaatgtctccaggcagtgcaaggggcagacgacagcagatgctgtgaggctggccagacccctcctccaggactgatatccctgctgctgggtatgtccgcagcagacagctctctgccaagtctctacccgggaagtgcccccagctgaagaaagctgcttcacccaaagcctttcttccttctgcgggaagcccacatcgaaaacctggtctatgcatagggatgtaaggcctgaccactctgtgtccatgcacaacaactcagaaggctcatccagctccagagctccttctaggacctgctgtggcaactgcacggcagttcagccttccttcaaactgcttcatgcgattccccacagcatcctccagtacacagtctgcactcgaatctcaagcagctcagggttttcttcctggaaaacatgtactattacaattccctactaagtgtttttcatattacagccagagatctttcgaaagcacccatctgatgacgtcaatctttaaaaaatctccagatgccttctcactgccctaaatcccaagctcctgcctgtggctgataaggcccttcatttcctggctccgtctccagcctagtctgtggccacagccaccatcactttatggcacagtcaagggagtgtcttccacctccctgaacgtgtcattcatgctcatctccagaactttacacaccctgtccctttgcttaggacacccataagttccttccctgcctgaagagctcatccctgtaggtctcaaatttcacttctttcaatgaacaattcctccaaccccgtggagaactggccaggtcccacttttatgcttccaaagcatcctgaacactctctcgtgcctcttagcatacaacattttaattatttgtcaaactgtttttctacttcactagattacaaaccctatgagaacagtggccaagtccaaagtccaagtctatcttttttttttttttttttttttggagacagagtcttgcactgttgcctgggctggagtgcagtggcaacctccacctcccagctttaagcgattttcctgcctcagcctcccaccaagtctatctttaatgttgtatccaaaatgcctagtactatgcgtggtaataaaaggtgctttataaatgtgtactgagcatccttcttcttccttctttccactaattataagaaattcacagttgaaatgaggttcaaaggcacataatgtaggaagtgtaacacaacgttgcagccaaaattccacttatagatgtgtttaagatttaaaaaaatgttaattctcaacatttaaaaataaagatatttaacaaaaacgcatggattttatgctactgacatcacaaaatcacactggaaggcctggtaccattgggctcacatttctgctgggtaaacatggacctgaactggggagctgtgtagcaggtgtctccccaacaccccacaacaagccatgcccactccagtttgccacagaccacccccacccgccccagcatggggctatgtgtcattatgcttgcaggcttttgtgttgatgtgtttttgttgttctgtttgttttaataggaaaagcagaagaaaatgaaatttatctttgcatccttatcaaaatattgacaggtccatgaagcaggcttcaactctgcctcactcatttaagggttgtgttgctgttggcatttgagttggccatccctggtattgtgtttgacaagccaacaacagcccactcatccccctctttcaaaaggcagagtgaccagtaagaacaatggaagcgcatttctgcttcactgggactggagtggtcatcagtgctggctggtgcagctcccaaagacctgggtaaaataatggtctggggcttgtcaactctatgcccctgggtggccactctccctccctctcccttgcctatggacaaaatctatcacaaaaacttgagataagcctcagaataagatggtgtacgtgaaagtgctttgtaatcaagcacgatacaagtgcatatcccaagcaaattattatatttatcccaagcaaatggtgggtttatttttctaatttaggaggcagatggaaggaactgaggtttactgtggaaatctaattttcttttatgattcaaaagattactgagacataatccagccctgaagctactgtctattcttttcctgtacttacccagcttcatggtagggagggaggtgtgtggatgaaggagggatttgtcattcattcaacaaacacttaatgagcacctactctgtgccaggcactgcaggatacaggatgcgacaggcacaaaccctccactaacaaagcccagactttttaggccgggcgcagtggctcatgcctgtaatcccagcacttcgggaggccaaggcgggtggatcacgaggtcaggagattgagaccatcctggctaacacagtgaaaccccgtctctaccaaaaatacaaaaaattagccgggtgcagtagcaggtgcctgtagtttcagctacttggaaggctggggcaggagaatggcgtgaacccgggaggcagagcttgcagtgagccaagatagcgccattgtagtccggcctgggtgaaagagcgagactccatctcaaaaaaaaaaaaaaaaaaaaaatcaaaacaaaaacaaacaaacaaacaaacaaaacaaagcccagactttttgtgaagatacagagaaacgatatttcaagtgacgaatgtatcagaatgtacagttgtctgaaagcttacaggatgtagtggggagggcagatggcttctgggaggaggtaacatgatctgggcctagaatgttgagcaggaggcatggttggtaggcaggcatgggcacattcccctcagacactgtagatctattagagagagcagttgctgatccccaactacttaggtaaagtatagccactgaaattgatctcttctgcggctttagagagcaccactaaaaatctggaagtctcagtctgcactcctgctgaatagggagaggaacatcaactacctagaaccagtttatgtggcttttgcaagagcaagtgtgtagttattagcaagcctccaggggcaatacgcggaaggaactggaacacggggaggagaacaagcagggaaaaacaaggaaagcaaacgggactggactctcgttagtctgtgatggattgatcttctgtcactgctttcccaaactcccagcagtttcaacgtaaagcttgttcaatattttaaaaccaatttaaagccaatttttgagtttgctttaaagaattattgcattaatcaaaaaatacattaagttttaggtccaacagtctaactgataggaaaagctgattgggactcaagagaaatgggctctcctggctggagcatgtaatgtgcaagaacagaaaccaatcaatgctaaagggaagaacagcagaaacgagtcacaaatggctcaaagcaaagaaccctgcaactgaatggaattgaaagaaagtgtgaagagggctgatgagggtatttagttattattagcaaaattcagatgtgagaacacatctaaagccttcggttccaagggaggctgcaattgggctttcattgtgagatgtgtagagtgtcatcctttcaaagatttcaggtcaatgaaactgcagaggtcatcctcctggagaccatgctgcttgagagaaatgtagggaacagaaaataagccagctctatgaaaataaaagcccttcattctgttatcaaatcgaattgggtcatgaaatttgaagaaatagcttgtttggttcgtgccttcccacatccaaaagcagctatggttgaaataaggaaacttgggaagattggtaaattcgctcatagagaaggtgctggtaattctgtattctttcccctctctgctttgcatctggaaggctggctcccatgggctgtgcccctaggatcccttgtgtctggcttcggtggggtatggcccatgggagacattagcaagagatcggatggcaggaggcaggaggcaagatgtccatgctcactcccttcctgtgtggggctacttccaggcaacgctggatgctccgtgatgacacctcctgtcatgaggccccttctccatggctgcagctcatggggttcatgggactcttcctccccctgcctttacaggcctggggtggtcatggctccccagtgatgctcgctctgaggccctcagccctgtgatggttcctgtgtccccagcccgcctctgcaggtcatccctttcattaacatctcctcctgtgcccatctgggttggcttctctctcccgagggaccctgaccgaatcagagacgtaggaaaacatggcagcaaagaccccaattagttgctttccgttgtctggcaactgttcaccagcagacatctttttagtttggctggttggtttgctttgttttcaaataagaggaattggaggctggccctgtgatcaggaaccagaagcaggaagagcctcatctcctgggggggtctaactgcagggctgcttcatcctgagttctttctgggatgaccctgatgtggattaactatacctcctcagaattcctatcatgtcagttgcttgtgcaacctctgtggcatctattgaagccgtagaaactccatgggagcagggacgttgtcttactctttgtcccgagggcctagaaccatgcctaacatattacgggtgtttaatgcatatttgttgaatgaatgaaataatgtctcatggggcgcagtggctcacgcctgtcatctcagtactttgggaggcttgcttgagctcaggagttcaagaccccagcctgggcaacatgctgaaaccctgtctctacaaaaaatacaaaaagtagcctggtgtggtggcatgtgcctgcagttccagttacttgggaggctgaggtggcagggttgcctgagccaaggataaggagtctgcagtgagccaagatcataccactgcaccccagcctgggcaacacagtgagaccctggttcaaaaaaaatgaaataatgtctctttctttatagatgctgccatcactcaacaaaccatctattaaatgtctgtgcagcagatgtcatcttgggcctggagacacaggggaacagaggacacagtctggttgaagaggttctggcttctgcaactttgcccatgtggcaccctctgctggaatgtcctttaccacaccatcctgctgtcctgaccaactctgacccatcttctgtgacttttccagggaaacctggaagtgttttatataaagctatagagttgctaagctttggtttagcatattactgtaattacgatattcattttccagtaaatctccccccatggctcccctatgagcctctaaagggaaatacacttttcttttctttttttgagggggtggggatggagtctcactctgtcaccaggctggagtgcagtggtgcgatctcagctcactgcaacctccacctcccgggttcaagcgattctcctgcctcagcctcctgaatagctgggattacaggtgcacgccaccacacccagctaatttttgtatttttagtagagacggggtttcaccatgttggccaggctgatctcaatctcttgacctcatgatccgcccacctcggcctcccaaagtgctgggattacaggcataagccacctcgcccggccgggaaatatacttttcaatgcatttttctagagagtctagcagctgcttgacccacccaaatgctcaacttaatgtctgctaattgacactatttgcagacacagttcccccgatgctggacatctatggtttaggtcatctctaactttctttttcctatttttctgaatccaatattaaggttttaacaatttaaaaacatttaatttgggctaccttaatctttaacaccaaggctggatggttcctcttgactgaagaatgaatgggattagagggagggtcaggcgcctggatggctttaggttaagcaatgctcttctttcccttacagctactgtttccaaataaatactgtagatgccagagtatcactttgtggaagcctctgccatgtttgcagtctcagagcatatggatgtaaattgctagactaactccgtttcccagagcctcaggtatacccgcctccattacagcggtcctgaggcaggggtctctgggccattattgcttttgctgtcagtacctggtaagctcgcgtttgaatgtccctgagctaaaataaaattaacagaaagagcatttgctgcctgggctatggaaatggcaactcagtcctaaatccactcatatgctcatggctggcaatttaggagcagacgagaagacccaaattcaccagttctatttatttagttatgctaatattggataaactcatctgcagaattccatatagggatacacttattcatgctctgattttagagcattcagatctttaacattctctattgtaaaatcaaaatattctgggatttctatgtctgtttactaggttcctatcagtacaatgactaaaggatttatttgcaaagatttggtgtttaaacccttgttaacatctacattgggagaaaaataatgagcaaattcatctactgtgatgacgtttttactctttttccctgaaggtttggttgatcctaattaataaataaaataaaatgcatttgcactttcctaagactgagatagcaccttagagagtgaggctcggccaacacattctttacttaatgaggactgaaacaccagttagcatagggcatgatgctgctaaaggacaatgatatccttacataatgtcatctttctgtacatgccactcacagaggtattttcaccagagattctaaactagggcattaaaaacattgaagtagacttagtatggatttctctgatttagacactgttaagttgttttatttcccctctaaggactcctttgaaaatgctcacatgccttgtccctgttccatatctgcccagggaaaagctattttggacatgccccaagtggccactgggaagtctacactgtgccccaaggaggggagtcattctgggagaagccacggccccattcccatggctgtcagctaccagtctgcttcttgcttttttagaatggaactctccatgacctccaggaaacggctccagtcccccactgtatccggagccctgcttggaggaatgagtagggcattctgtacctgagtagttgttcctgaggcttcaaatacggcactgcactccccttcatggtacgcttctttacattcccggcagaaggcaaactgcaaaagaacacacatccattaattagggacattaggttgcatttggcaataacacatttttccttttccaaattcattatattcattcctctggcttgtgcaacagtttctgtataaaaatactttttttgcaaagagaaatcaagttatgttttgatgggattgttcactctttactcaagagtgttccaagcaccatagcagggctacagagatgatgggtcacatttccttccctcaagatgtttccagtctagtggaagacacagtgatatggtttggctgtgtccccacccaaatctcatcttgaattgtagttcccataatccccatgtgtcatgggaaagacctggtgggaggtaattgaatcatggggatgatttctcccatgctattcttgtgatagtgagtgagttctcacgagatctgacggttttacaatgggcttcccccttcgctcagctctcattcttctccttcctgccaccatgtgaagaaggatgtgtttgcttccccttccaccatgattgtgaatttcctgaggcctactcagccctgcacaaatgtgaatcaattgaacctctttcctttataaattatccagtctcgggtatgtccttatagcagtgtgagaacagactaatacacacagtaatgcaaataaatacccacagcaaagtttaattggtattagaatgtaaggaaaaaacttcattcaagacattccctttaatatttgtttacattcaatatttgtttgcattcacagaagatttatatgcccatgtcagtggacttactttcgtattaaaagcctattatggaaaaagaaatgggtggctatgggctgaaccgtgcccccacataatggataggtggaagcaggacctcagaaagtaactgtatttggagacagggcctttaaagtggtaaagggaagatgaggttgttaggggaggccttcttcaatctgactggtgtccttacaagatgaggagattaggacagagacacacggactgagagatgatgagcagcattcaccatgggactgaagacgcccaaggaaccaatgccctctacccgccatcgtacaaagaagaaagctggaagagtgaatgccagagaggctcgtttagggctgtctgtctgggatccatggacctctcctgaaagcacgtcccattctcatcgccaccagccatgctctgaagttactgtcacggttgagttgtggatcagcagtggaacacaccagactggagtcatcatcccatcccctgccacctgaaacaccttgggaaagccaccttggtttctgtgccttggtttccaccttggaaatgctaggataacagcgatagctttctcatatgacccctgggagaggtagtgagatagcacatgctgagtggctacaatcacagcatacaatgtgttctaaactttaaggagataagaacaacagggactattttgcccctactccatttcataggaaggagtttcctcaccagaaaactggtttctttcaatggaactttctttaataagttgtaggcaacatctcccacagcagaaactgtattcagagaaggcatttcagcagaggagagagtgccatccacaagtatggtgtgtggatgatggtggtggtcttagagcatagaggcaaactgacagtatcctctttcccttgagaggtgggctttatgtctcttctgctgacagccagatgtgttgagtacttgactcctagaatatggtagaaatgatggtgtaccactttctaggcccaggcctcaagaaaccagaagcttccatttcctgttgggacacttgctcttgaagcccagctgccatatggtaaggaagctcaacagcccatgggagccccacatggagaagagctgcggcctcagccgcaacaatagccctgtctgagcttttagtagacagccagcaccaacttgccagctatgtgactgggtcatattccaagtagactgttgttatttgaaatcattaaagtttagggtggtttttacacagcaataaataactgatacagtaataaataagaatataatatgctgaaagtagtgtctggaagattcaaaaatttacagagacttacaagttctcaaactaatattttatagtataagttaggaatttagcctaattttgcttaagacaggactgatttgaattgaaaaacaaaaataatagaaaccaggatataaaaccaactctatcccaaaatataccataattcctccttgcctcaaaaaagaatggcttttactcaacactatttttccttcatgttgtcttcaccatgtgaacagagttttctcctttcctacgtccaatttcttgttttaaaagttcatctgaaaagtattttaatctcaggacatcagaaacaaaaaggaaaagcattttataaggaaacaatctcttcagagatatgccacaattgatcttcaagccatcacttttagcatattatattcttatttcttctcacagcagagagactgaactcaaatttagtgaaatgtaaactttatttaaaggttggtgggacagcgtgtgtgcatcagaacgtccttacacaaatcaccaacattacctggtttcagcttctgacatcttattttctctgaactaaaagcgaattcactgaatagtgagttgagttctaggattttctcctatttttaaaaacatttatctgttaatacttgggtctgcctcacactcattcctctgctcttacatgctttgttggaaaaatgtggacgggaggcccaatcatggagaactggcaatggggtctcagcccactgctttctagagaagcaaatcttatctgttggtgtgaaagggaaaaccgttcacatcttattagctcgtggatgagatataaaatcagtttcatggtagaggaacaccctggaggctgatcagtttgtcagaataaataggcttttcctgacacaaagacattaaattccctttcacaccagtactacaaagaatggactattgagaaataagagaaagggaagagcatatcaaatgaaagcctccccactttagcatggcaaaaggcaagcaaatgctgcaggaatattccggtgatgacttcacagggaggcactggctaatttgcttctattcaaagtataatttaaatttagatctatcatgcagtggtccttcccaattaagtaacatgaatctgtctcatgtgcaatgtagaaggtctgatttgatcttgaaaatgtttgggttttcaattacattatccaggactcaagactctcaaccttcagttctcacactacgcaccagagtgccctgcggtactgtaacaaactcacaggggtgcctgggatattctagaattttaagtaaaacacagcatggctattgaacactatgtgatttattaactcaaggtagttcccagtgttaatgtagattgtgctattttccttttggtgacattgtatctttgcaaaggtgggcttttggaagttaccagaatagaaaacaaataccatgtaaacatccatttggaacaaagatgtgatttatttatttatttatttattgagacagagtcttgctctgttgcccaggctggagtgcagtggcaccatctcggctcactgcaacctccgcctcccgggttcaagcaattctcccgtctcagcctcctgagtagctgggactacaggcgcctgccaccacgcccggctaatttttgtatttttagtaaagacgggatttcaccatgttggtcaggctggtcttgaactcctgacctcaggtgatccacccgcctcggcctcccaaagtgctgggattacaggcatgagccaccgtgcctggccaagacgtgattatttttaagaataaaataaagctaatttttccttccatttgtgtgaattatcatttcagataactattaagtcgttatgacattaattcttactatgctacgtggtacaaaacctttcataaccacaactgttaggcatttcttttggcctagaaataccgtgaaaaatgtactgaaccgctaagggcatggggaacagaattctggggaactctgggttaggcagatacaaaactccttcttaagacagtgttcgggccagtttgcaaacacttcccatggcatagctgtttctagagaaaaagcttgccggggaagaaagcagacctagctccaacattttcacatccattctgctgagctgcatgtctcatatctggggcgcctggatccttctttaaccaaccatgtagaaggctgaaatttacccagggatttgctattacttaaaaatggtcttacatttgctgaggctcccttaagctgcataatacctctccaaaccttatgagtcaacattaaccgaatggaagttagtataccaggaaacatggagtcctgtttataccgtatacattttcaggattgtcttctcttgtggtggatctaacaaatgtgatccatttccgtagagttgtttttttttttcgagaaattttaaatgtctttaaacaatcataaaataatacatacttatttcattggctctctaaagtctattcccttatagatttggttagaaggcaatcaaacacatggactgtattatagtccctgtgacgagagtttatgtattaacttggctaggctatggtcctcagttactcaagcagacactaatcttggtgtttctgtgaagctttcttgtagatgtgactaggatctataatcagtttattttaagtaagagagattatcctagataacctgaagggggctgattcaatctgtggaaaggcctaagagcataactgagccttccctgaggaagaagagatttcacctgtggacagcagcgtcaggctgtgctcaagagttccagcctgcccttcctgatggccactctgtggatttaggaggtgcctacccagccctgaaaccgtgtaagccacttccttccagtaaatctctccatatatctgtgtatacacagatatatagatacaatgtgtgcctgcatgtatatatatgtagggatatacacatatatatgcatatatgtgtgtatgtgtatgtatatttgatataagcatcctgctggtctggtctctctggtgaagctctggctgataaagctcctatagaaacaaattatttttaatagagacggggtttcaccgtcttggccaagctggtctcgaaccctgacctcgtgatccgcctgcctcggcctcccaaagtgctgggattacaggtgtgaaccaccaatacaaaaattagctggcatggtggcaggcacctgtaatcccagctacttgggaggctgaggcaggagaaccgtttgaaccctggaggcggaggttgcagtgagccaagattgtgccattgcactccagcctgggtgacagggtgagactctgtctccaaaaaaaaagaaaaagaaaaaatttaacaaggtcactttattcccaatcttttgcaaaagaactgatgtaatgaaaactatttaaactttccctgttatttgcaaaattatagttcaaacctctctctctctctctctctctctctcgctatatatatatacatatataaattccaggtagccatatggcaaattcctctcagaattcaacaccaggagaaagttcaccacttccaacagtgtggtggtttcctttcatttgacaataaacatggtcacctaatacattctccttggtatgttttcaagcttgagagcttggtgccacacttttaacttaattctagtcatcagcttatcctaaatgcctaaaaggaggtatagaataaaaaaaaaaagatttaatagaggctaaattcaataagccaatttttttctattgcataatagctaaactattcttaacattgaagtcatatttttgtcttgcaactaatatgtgttgagtatttacttttaggatgagtaaaatcttggccctaggcaacatataaaagaatagcacattttaatctgtgaaatcgtgtactagatctttacatgtttaaataccagatgtagattagtgtttagaagtgaaccctttgaggtagagagacccggagtctgaggcctcttggatcatttattatctgtgtgatcccaacatctctttgcttgagcttttttgcatctacaaagaagaaataataagataaagaatatttaacacagtttctggtacacagtaaacacaacaacacaacaaatagttttctccatggggctatgatgtttaacaagtggtaagagtctgtagaaaaataagagggtagtaagcgccttgttaattaaagcagttcccagtatactgataataatgactgttatgtgaatctcgggtaaaactgacacctccccagaaatgccacacttgtaaactactcataagacataagactgctgtctagaaagggatgaggcctctctttgctggtatacatgctgaggtaagtcactgtcagcccccttagacgctctgtactaccagagagctatgtgaatggcccatcatgcctctcattcaatatcatgtcagtgcagtagtcatttgattgatgtttgagtttgctttcccatatttccataatgaacacattcaaaaggggctgtatgtgtactttctctgtggaagcatgaaaaggaagcaaatgaacagcttctaatgcaatcggaatattccagtggctgctgatcaatcaggttgagagccagtaggtacctacaagcaatgacccttaaaataaggcttgatgatgatctctctatggaagccaagatttctttgtgcctgttttctatcatggctgcatctattataaaagcattctattatgtgcatttatttttcttccacggctctgaaattctgtgttaaaagaataggagagaatcaaataccatcttaggaccccttactagagtcaaggcaaacatcaaaggcatgaagcacacatttgtacttctttgggaatagatgaaatatttttctttttggtgtgtagctttccagaagatggcagcagagatacgtaagtccagcctctgtaaagggaatctatcaagagaggaagtctccctatgagtcaccagccgctgatatatgcaaaactcgttctgacaagacagtgccacagaacggagatggtgttagattataatgcattaaaacacaattttgaaaagaagaaagtaaggttatttcctttcaagtacacaacatcttaaaatcacagactctcatggtgtgaggcaatcttaaactgtgctaagctccaaatgcaaacagacgaagacagtgttctatgtgtggtctccaaagggctaaaaagaaagaattttcaggaggctggatacagctctgtagagtacccacgttcctttgtctttcacaaattctgtactaatccccagggatattaaacaatgccaattagtttcccacaaaatattgtgacctccaacaccctgcagccctaggcttatttttgttttaggtttgctctttgaacaggtccttactttctttggtttaatttccattcttgcaagctctgaaaagatccccgaaaatccccttttcttacaccaacatctatcatcatgcgcgtgcacgtaaccatcccatctttcagttgtgcagtctgcactgacccactcactatgagtaccgtctagtaggaaactttagtaccacctgtctcagaactagggcccctcagagaagatgagttcatgcaatgaggagaaaagacccactgagcttactttcaacaggctgacctcagcacctcacattaaaagatccatgataaggtggtcctcctgacaatggttctgctgggaattaactatccagtctataattacggacaaagacatttacatttacttcctactccaaaatagttttgatttttaccataacttaaagggaaaataaacttaaaaatgtgtattggccatttatttttttcttttctttaagagcgttactgaaatatcatttgcagagtcatggatttttaaaaagtaggtattctttgaatgcaaaatatgtgcaggtagcacagattcaaaaggtacattgtgaaaaatgtctcctttcctccttggtcagctacatagcttcccagagacaatcactgtcacctgtttgtataggtattgttccagaaatatgttctgcactcaatcatcaatttatgctatttttaaacaaaaataccctataaaacattgtataatgtgctgtactctgcttgttggtttttcgtttaatgcatgctacagatggctgtctattagcacacggagagctgctccattcttcctgaacagccacacaatattccagtggatagatgtgccttcgttcatttcaccagcccctccgatcagcatttaggtccttccaatattttgccatgacaaacaaagctgcagggaatgtcccgctcttcaggtcatttcacacatgtgaaaggaaatctgtagcagaaatttctagacatgaaatagctgggtccaagggcatatggactttccattttgattgctttcgcgagccttgtcagtcacaggcttagcagcaaggtgggtggaagctgcttccccaacacgctgtggtctcaaccaccgcctttgtcaagctgctttaaaagaatatcaaatacatcccagcacttttgctaagaccttctttatacatgttttgtcaccacagagttgtgttcctagccaaagcaattactctgaccacgtttaagtcttgtctacacagccaaagctgggtcaggagtggcctgtggtcaggctcactctgactttcctcagctcaacacacatggagctggtcgtctcattctgatgggcctgaatctggcccgcctgccaggaaaggacttgtaatgaatttaagctcagcggctttaaacacagacagccaacaaattagaggtccaggttagagagaaagaaacagtgaatgggggaacggcagcttccctcacttgtggctgtgtcgtgagcctcagctttgcagacttggctctcagtgacgcttgccaggtgacctgactgcagcagtctgccagaggacaggggaagctggggtgggagtgctgtatgctctcggtccctaatcccccgcctcttttcttactttctctttactgtaaccatttctgaaaacaattcctatggggacagtccttatcttccaaggtccccagctctggcatttgtgtcatggcttaccttgttcccaaaggctaaggtaggacctggttgcaagctggaactcttgttcaatgatatgttcacaccatcctgttcatctaaacaaacttcttggcgggcaaatttcaatatctaactgagaattccctttaccatcctgcaaggcctgcccaattttgctttaaaatgagcatttctcagaccttatggagcagttggctccttctagaactggagcactggtcacagagtatcaaattcaatgccactttcaaacatcgccattcattagtgggcccattcaaatattgccattaattagtgaacatgtttgaatatggccattcattagtaaaacgcacagcatatgtcttctataatttttaactggtccctaatcctcgtgaccttatcatttacaatctgcagcaaggcactagactctgtagaaatgattacgctacgccagtaaaaatgtgaaatccaagccatatggcaatttgagcccaatttgtcccatgtgcctgtgggtatccttatgctctctagcacagcaggggaggcgaaatgctttccctgaatacctgggcccgccctgggcaacttggggcaaggccagctttggaaagaggcctgaacatgtttggggacaccctgccagcacatcttacagacttttgtctttggaggttttgcagctcctcaatgatcaatcaatcaatcagtcaaaatgatacattaaccctttattgtatgttgagcagtctcataggtgccctgcaggtatacctgttctggcccctttcccctgcagcctcagccaaaatgatcaaggtgttttcttcccaagccctgtttcttactcatacctctattaaactgtttcaccctctatatgaaactgtctccacctatctcctcttctaaagggataggatttgtatcttattcatctttgtcttcccaagatccaggtgctagaacatagtaggtgatcagtgtctctttgtggcaatccaggtgctggagtcaagtagcttacagctaaggtggatgtttataaagcataaaagagctgaaggacaattgtgtactccatgatacaatgcacaatcatgggttgaattgagtattcttgtgtaagtcttaagggtcccatagaagagatccaggcgggttgaggtcagtgggtaagagcacgtggagatagcatttgtttttctgcccttcacatttgccccttcagggagcattctaacatcaagcttaattgactgcctctcttctaacaacttctcaaaatctattccacccttcccaactcctcttttaagatgcactttgcctattgcatatttccatttggataggttgcagtcacctcaaattcaagtcacttctaattccacgtgattatcatgaagttgcaaggacctaacagaataatggcaatcatcaaacctttgcagaataaacaagcagtagtagctggaaaagcctcaacttctgagaagcagaagaggatagcacagtgctgaggaaacccagtactgagaatggagaggtcaatcctgagtacaagaggaataactaagactttctgccagggaaagtactttagtgacctcggaggccataattttggtccaatggttcaatggtcagctagattcagaggctaagatcacaggcatgatggggtggaaaaggcttcacaacagagagctctgaatcagtttgaaaacagcaaaagatgatgaaaagagagagaatgaagacgctagccagagagggggcaggatgggagtgaagtcccagagaaagtcgaggctagggagacacactcaaaggtttatggctttcaatggaggaggataaggttttgcagcaaaatcctaggagagtcacattgatgagagagttttctcaaggagatgacacccatgcccttggtcttcctaacagagcaccatagcagctctgaatcttctggagtctagggggagaggagagtcacagatagagaggaggctgaaacagttactgtcagttggagcatccatgagacatgaattgaagggacgcccatccatgttgataactaaattcacatcacagcactggctctagttagttccctagaatgtggttcccagactagcaccatcagcatcacccaggagcatgtcagaaaacccgaatttcaggccccacccaagaagtactagaccagaatctttcattttaccaggatccccgagtgacttgtatgcaccatttagagaccctgttctagctcattcattcaaccaaaagttcctactcaggaactccactcagaatgtatgctgtgcattgctggagcctgcaaagatgcagaacgtatgtaatttccagtttcagaggagtcacaattcacctctcccttgctctacccaatgctccctccattccacaagtactcatcaagcatgtactgtgtgtgaatggtaaggcactggccattcttcatggcctcacagagttcacagtcagctgtgtcctgatcatatgatggatgtgaggttccatgggagcacagtgttgaacctgggaggtgcaggttgtagtgaggagatgaggaggttacagacaggagacagggaaatattgggtagaagagggcagttccccagcaaaggcctgaccctcaagcctggaaacccatggccctaaatgggaacaggcattcctgttttcacacccaaatgttgccttttggcctgtcatgcccccctatcctgtccctatataaactccaaaccccaggctccatgagcagaagagcagcagaggagagaagagaaggaatatctgaatgtcgagaggagttctgctgcagacagttagagaggagattggctgctggacggcccaactccaggggaagatcatctttctactccatcccctttccagctccccatccatccatcccactgagagccacatccaccactcaataaaaccctgcagtcaccatccttcaagtccatgggtgacctgatttttctggatgccagacaagaacttggaatatggaaagctgtcacactggccctctgcccttgcaaaaaggcagagggtccactgagctgtttaacacttaagctgtctgcagacagcaaaattaaaagagcgcactgtaacacacagctaactgggctttgggagtcacaggcacccatccctagacactactgtggggccagagcccagaagtgctcgtcctggctcctgcacctgctcatctgcatgctccccctcccataaggagtttgagcagtggtggtggctgaactgatgagccatatgcctgttgcatgtcctgcaaccggggtgggtcagggaactctcccgtttcagcagtaagaagaggaaggtgaactgggaccaatggagtttgctggaaatgatagcccccagaaagtaccaatcccagtgctagggatgatgccagcattctagtgtaattcactctgctagtgtaattctgcaacacttttgtctttttgattttgaaaccaccgtgaaaggatacagcctagaacagtgctgtccaattgaaacagcaataatttttaatggtctagtagctatatgaaaagaggaaaaagaaacaagtaaaattaatttcaatattttacttaactaaatatattcaaaattgtatcatttcaacatgcaatcgatataaaaattggtaatgagttattttatattcatttttactaagcttttggaatcgggtctgcttttactctttcaatgcatctcagttgggactagccctattctatgggctcaggagcctcacgtgggcaccatgttggacaggagcctcacagggctagtggccaccatgctggccaccacgctggactgcgcaggtctacaaggaccctgctgtctgaggactccttgcacgatgcagagttcagttaagggtccacagaacaaaagcgacagaacacctccaatattttagaagaaagtaggatgaggtgagctggggacatggggaagattagaaaattaaacctaatcttttttttttttttgagatggaatttcactcttgtcacccaggctggagtgcaatggcacgatctccgctcactgcaacctgtacctcccaggttcaagcaattctcctgcctcagcctcccaagtagctggaattacaggtgtgtgccaccacgcccagctaatttttgtatttttagtagagacggggtttcgctttcgccatattggccaggctggtctcaaacccctgacctcaggtaatccgttcccctcagcctcccaaagtgctgggattacaggcatgagccaccacgctcggccgaaaattaaacgtattctaagacaaagaaattcagattttttttttttcgaataaaggatgctgtgtttattttcagcctttggacgacccatatgagtttcacttcacactgtgttgaagaaaagagctgcaggggacagaaaatcagtcaaattaaagaaaatatgaggcgtaactgccctgcagtgagagcatatgaatttttctgccacacactctgagtcatttgttaaagaaagccagagaataagaactgtcctgggttatcgctaactttcactgtgtctgatttacttgtttgcacactttgtcaaatcttggaccagggacagatagcgtccaggccattactcaaggggaagactgttgatcagagtacactgcaaacaaacatctgtttctgatggctgcagcaccatccttcattatagaatgagcttaataaacacgaagtcatagaaatccaccattcacgtaagttttggcctggtgttattgcagtctcttaatttagccaacaaagaaggttggctcaaagacacctgtttttgcatgtaaagtatcaggctggaaggcttggtcgggcatggttttagcaacaggactttcatttgtgatagttcagtcacgtcctggggaattgaggagaagatccaccctaccaaaggccagtcttgctttagcaccaaagaattaattttaaaagttagagttggccgggcatggtggctcacatctgtaatcccagcactttgggaagccaaggtgggcagatcacctgaggttaggagtttgagaccagcctggccaacatggtgaaaccgcatctctactaaaaatacaaaaacgttagctgggcgtggtggtggacgcctgtaatcccagctactcaggaggctgaggcaggagaattgcttgaacccaggaggcggaggctgcagtgagccgagattgtgccactgcactccatcttgggcgacaagagcaagattctgtccccactccccaccaaaaaaaaaaaattagagtactgatctggatttcacccttgaagttaagcacacactaatgacagaagctgaaataaatcccccaaatgtcttgaacactttctaggcttgtgtctctccatgagattctcagacagctgcatttggatttccgggggctggactggatctcagatgtttctggcccagaacctctgccctaaatgattattcatgaatgttctggctcaaaggaggagagagaagatgagagatccagaggtctgagatgtttgttcacacaccaatctctggagcggaagccgttaatgcttctacttatattcttaaggcctcttaaagaaggttcccagcttggggctgggtaataatggtgagagcatttcccacattatcctctcgatatgcatctctgccatgactatcagacaatggtgagagccagaaccacttagagagctgattgtcatcaccgccctgacagtctcagtggcaggccaggctctaaaggctcctctggatgcctgttggccaaagataactcatgcctcgggggtcgtgagcaggaggtgaagccaaatgccttcagtgacctgaaaaatgctatctcccagcaacatgcacaccttgcagtgtcttatgaaattataaaataaaacccagacttataagactcttcccctgcctaagttttctttttctctctcaattttattgctttgctaaggacatagaaagcaaactaattaaatgacagctaaagagcaagtgactgtgtcccagggcggctgagataatgcgcggatctcaggtgagtcgaggaaatgccacagacattgctgcctctctactaataaatagctttttggtcccataacatgagagacattctggaagctgtgggggagcaaaagatggcttccctctaccctcccaggttctttggctgggctattgattaaaatggcatataaacagattaacaggagaaagagcatattcaattctgtacacatgagagtcccacagaatatgagactccaagaagggttagatcatggaagcctacagaactatatcctagatacagaaaagaacaggggcttggggattcttgtgagggggaggaggttagaggagggcaaggagaggaattgtatggtgaataaaggttgtcttattatgtagataaacaatctctcaggtaataaaagttgtctccgagcagccctgagcagaacaggcagtagtctctccaggcatggtgtccacgtactcatcttccccggctgacacaattccctgggaggggattcacgacaactgagatccatcaattgtatttgcagagaagctagttcagagaaaggccctccccgaatttgctgttccccaagtgtcctctgttaaggagtcagcacaccaaagcatcatattttgaggtggcatttcctgaactcctgcaaagctgaataacaatggagagtgaagcatcaactgttctcagtgctgggcgcccttcctccctctcgatttagtggcacagactgttagaactgcagggccctcagagagctgatcatctgtagggtagaatactgcccctttttcttctggctctcttaataatattgggacctaatattctatatttttaaaaattgcctaacgacatagatcatggcaaacactaaaaaagcacaaaaaagccagattgttttgataataacaatgatctaactccttattctttgaaatcccatctctgtgatgagaaccaaattttcaaaaggctaatagctcataaagggccctttactgttgtcctgtggagaaacggaaaaacgctcatggggtcggttattgttccaaatcaaatcattcctttatctcacaagcatttgttgagaggatgcttctctctggcagtgcagggcctcagggcaggagcacgtaatgactctgccccatctctgtgagaatcactctctggagagccacgcttttatcctctgctcctcagcctatcttctccctagccctcctttgcctagatgacttggaatagggattgctatggtttgaatgcttggcctctctggaactcatgctgagattttattcacgtgaagtctttcagaggttattaggtcattagggctccaccctcatgaatgcattaatgctgtgaggtgggagtgggttactgtgggaggagctttgttaaaaacctttctctctctttcacacatgcctttgcccttctgcctatctgctgtgggatgatcctggccagatgccagcatcatgctcttggacttcccagcctccagaatcaagagccaaataaacttttctttataaattacccagtctgtggtattccatgtagcaacagagatcattctagggagtactctgattccccattaggaaatccctttgggcaaacctccctgaccccaggcctgggtttgctgtttctcctgtgtgttctcaccactctgtactgacctgatcctaaatccctccaccctgcactgggtatttccttatccatcatccctactagactcaagttcccagctctctcaccccatgtgttctgagagctgctatctaagtacttggccctgagtaggagcttaataaaggtttattctaggaagaaaagaaagaagaacacaggcacctagacagaaaattgtgtggcaacgcatagacgggatgacagaggttagagcagtcacagaggaggagatgattgctctccctggacagtctgtccaaattccacagccccagtgacactttgtgtcttgaagggtaaacaagattcatcaagacgcaaacaagacaactctataaattgagctaatatcatcagtgtccatgagccactgaacgcagtttcttgtctcagtgaccccaatggcatctgcaaaatttagttaagattcaaaattaagagaacaaaaatgtgtcagggtgtctctaagtttacattatctgtaagaattcatttctatggctctgtgttcagaaagacttttctgcaggaaaatttatcatggtgtatatcactccctgcacaatgacgcaagtcaaaatcaagcattttccatgggaaggctctgtttctaaggattgaaatgcttattcagataagtcactgaaatggcacagatggccacacctgcccctttattgctacagagaacctgacatcctctttcaagtcggtagcaacatacttctaaaaacagaatgcgaagccgtaaatactgcaatggaatggagttccagcagaaaagtatatgtttctgtaaagtcataaaaagggggactaattcttctcttactgggatggtctgatatacgtttaatgttttatattttcattgaaggcaggaagatagactaaatgataacattgcttcccaccttctcctccagctctgactctttaaactgaatgctgatttatctctccaaatatctcacaggcctttactttattatgggccaggaacaaatggcagtgggtgaaataggcttggtcacacagtgacaagatttacaatgggatttgggggaaaagtcattagtcgtcatttgccatcctgtgttcatgcccctctttttcaaaattgctgtttaaaagtgggtctgactgggcatggtggctcatgcctgtaatctcagcactttgggaggctgaggcaggtggatcaattgaggtcaggagttcgagaccagcctggccaacatggtgaaaccccgtctctaccgaaaatgcacaaattagccaggcatggtggcacacatctgtaatcccagctacttgggaggctggggcaggagaattgcttgaacccaagatgtgcaggttgtagtgacccaagatcgtgccattgcaccccactccagcctgggtgacaaagcaagaccctgtctaaaaaataaaataaaataaaaattaaaaataaataaataaataaataaataaataaataaataaataaatttgggtccaccataatcagcattttgggccagcttccaggagaaagggaagggaaactgagggtccatgagtgctcacagccaggcaggctcgtgttccaagtctcgtacccgttgggccatttgagaagtggcaacaggggatcagcagaagggttaactgccaagtctatgcctgttcctaccaatttggcagtccaaatagatttttcttttaaagtagacttttgctcccactaatttggaaaatgatgcttttctttgctgaagaggaatgtcaagttaatttcaaggatctaaaataaacatatatctgacactggctcagcatgggagtaaacccacctccttaagagcactgggaaagaacctgataagggaagctggggattggtctgtggatggaaatgaccctcacaatctcctggctttatgttttgttcctttatacatacgtatatatatacacatatatacacacacatatatatacatatatacacacatatatatacacatatatatacatacatatatacacacatatatacatatacacatatatacatatatatatatacacacacttgatttgaggtgttggtttacagtaaaatcttcccacttagcatctacttttctcaatttttttcaaagtcatgaagtttagtttgatgttatctaaaagggtgctgatccactatgggcacattttagctatttttctcaaatccaccaaaaacgtaaggtggttgctttcaagttcttcttttagggcgagatgtctgctcagtatatagaaactttttaaatgcttcaatcactgtaacttgataggaacttcctattttgtttctttgaatggtaccctaagttctgctttataatatcagtaaccacaggattttgagtgcaatgctctatatagcacaacaaagtggcttcttagtattagcccgaaggaaatatgttttgggttaatggcaatacagtgactttcaacaaaaactcctttggccccagtcatttccattctctgcaggcaaaatggatccttctctctttgtgttcagtgatgagcaagcatttcaaatgtacatacaacttgtttctgtcaatcagtgattcacgccgagtcatgttcaatcatgttaccacaatctggaatttgcaaatctgtaagcatttctcaggcaatgaattatgtcaacacaattgcaccatcattgatggacttggaaatgcagacagaactgaagaggagcgtctcggcactgctgctacgggtaaggacagagcttcttgctgacttggaaacatcatgagcttaggccagccaaggtttaggctcgttggatatttttaacaaaatgggacttcagagaaatttaattaagatttatttcaaattaagatcaccaaattatatttacataaaagcctctataatgagtatgctatatttgtcattaaaatgtctttatatttttataaatatggtttcacaattttttacagagtcataatctacatggaaaacaaaaagtcataccaaaattataactgctaagagagatgttaatggtaattaatcatgagtgagtcataaatatagaaacgcactgacttgataaataagaaacaatattgcttctcatttggcaaagctgaaaagggaggggctggggaagggggcagctgcactcggtgggaggctctgcacactggcacaattgtttgctgggaggtaatttaacaggactgaaatgcctccattctaagatgacattaatggtaaaaagcaccttcaatttaatagtggcttgaccaaagaaagaaaagctccatcatactaccattgtaaacatccacatcaatttacaatatcctgatttcagaaatgttaaaatacacaaaaaggtacttcttagagttgaggataagtgttggatgcaaagctgtcaggcctctgagtcgaagctcagccattataacccctgtgacctgcacatatacgtccagatggcctgcaggagccaagaagtctgaagcagccaaagaaaaaccacaaaagaagtgaaacagccagctcctgccataactgattgaccaaccttatgacattccaccattatgacttgttctggccctgccccaactgatcagttgaccttgtgacattcttctttcggacaatgagtcttatgatctccccaccatgcaccttgtaatcccctcctctgctaacaatagataacctcctttaactgtaactttccactgcctacccaagtcctataaagctgcccctctcctatctcccttcgctgactctctttttggactcagcccacttgcacccaagtgaataaacagctttattgctcacacagagcctgtttggtggtctcttcacatggacaggcttgacaaaagctttaaaaacatgcacatgctttgactctctaacttcctcttctaggaatttttctttttagagaaaagtcaggaacacaggaaaaattcggccgtgggaaaattatcatcattccgcaagatacacatttacataagtcatggcacaccctgacaaatggtcatcattaaacatggcgttagagaaatgcaaagatgtttgtgacacacaattaagggtgaaaaactggtaaaaaaaaaaaaaaaaaaagcccatcagcataaactcgtctctgttaaaattgcggacatgtgggtttgcgtatacatgtaaaacgtatctagaaagctctacagcaatgagtcaaaaatcccatgtccagccacgtgggattatgtttgttttctaggttttccttttttttttttttttggtacaatttactgacattgtctaatgagtatgtattacttttgtaataataaaaactctttcatttttccacttaacaatattgagggctgatgagcctgtgccatgggtcagggggtcggcgaggctgataccgggagtggacatgtgtggaatgcaagtaggatctgcaggaagaaaacagttgtgggaatgctgttggtggcaagatctgctgtgtatgttttgtccccatacaatgtcactagaaaccattcatgggcattaaaaaagaatccacaatgacatctcttttcattatttcattaaaataaaacattaggaaatagccaatgaaatcttatctaaaatgaggtggactttgcccatttatatgctatccccccaagtaattcacaagcatgcagcaagacttgcagatgctgtattaaggaggccacattttaattttaatttttattttttgagacagagtctcgctctgttgcccaggctggagtgcagtggtgcaatctcagctcactgcaacctctgcctcctgggttcaagcgattctcctgcctcagcctcccaagtaactaggactacaggctcccatcaccatgcccagctaatttttgtacttttagtagagatggggtttcaccatattggccaggctggtctcgaactcctgaccttgtgatccacccgcactggactcccaaactgctgggattacaggtgtgagccaccacccccggccaggagaacacatttttaaactctgtggtaatggttgagaatactcttcattactacaagcattttggacagaaaatctctgagacgatgacagcattgtgtgttctctaaagcgccaggttataacggccatatgtctccctgagtaggattttccagaagaaattaccaaatggcacacaaaaacgcagtgtgctgacactaatacataaaatgcggaaggacccagtctttccagagtgcccctttctcaggacatagacaagtagctttcctactgacagcacctctcagttcaaaggaaagtggtgtgcttgctggatatttttagattgccagaatgttcagtggaatcacataaggccgtcactataaaaatgaaagcaagcccaaccttggtgtgatgttttgcaataaacagcaatccatggaataagaatttaagacccaatttgaggtcacgtgctgcaaacccagtgttctttcagagtcaggtcgctgttagatgacaaccccttcagcaccggcctgaagaaagcgcaggcccagtggcagtctgccttctgttaattcccaaggttctcagcattcctcagatcaatagaactgtgatgtatctatataaatctgagtagcagatccattctcataaagtttaccctgtcttgcttttcaggtgagaagcagaattggaaaatatttcagggagtatttgaaacaggaagattaaattctgtctcatgtgtatcatgaataaaagtgctaagccaggcacagtgacctttcctgtacctgtgctaggatgcaaaagatcataggtgtaggctctgggcagcccgtgcatctgctgggtcagcggtctggcactttttttgagtgtctgctgcccttgaagaaggggatggggaaggattgcataagttgtggcagggggcctggggcaggtgggtggccaggaatctgaaggagagtgaacatgagtgagagtacgagcatgtctcagctggtagcccttgtcccagagctggtggcctgctgtgtcctcctccagtgtatctgggagtggtggttgatgtgagcgccatgctgagccccgctcatacccactgggcccagctctttttcagtcctttcctggcctgggggaagcacgtacaatccctgagctatgaacagtggcaccagcttttaagtaaggatgagggcttcccaaccaactgtaagggggctgctggtttgagcttttcaggtttcacagcaagctcttggtcccctaaggccctgctcctggcagatactctaaggagcccgggtctgagctggacacacacagcagcgagaggggaagggcgagctatttcctccattctggtgctcatcgtgggccatgcgttggttacaaggaagcagatggagttggggaaacatggaatggaggatggggaggatgcagggaagagaatcggggtcactgtgagggaggggcaacagtgccatgggaaatgcatcattggtgctcatgacaacggcacgccaaggggcttgatggcagcagcctcaggtatgggcagaacgttgaatcctcagaatgatatgggattccttaaaaccaagcaaagcaactcatcacctacccataagaataacagaaagggccactcgatggtttgatcatgtttacaaaatctggctaaacaggaagtttcatcctgaaaccggtttcctcaggtggaaggaaggcagttgactcatcctgcttccctgtagtagattttatttttcagataaaaaacctaatattatcagcggtgatataaaccagtgcagggcctctgggatgctggcaaactctagtttcactgtgaggcaggatttagggcctctgtttttactcatgagaccctggaggctctaggtcagtgacatggcttggctgtgtccccacccaaatctcacattgaattatagtaatccccacacgtcaagagtggggccaagtggagataatcgaatcatgggggtggctttccccatactgtccttgtggtagtgaataagtctcacaagatctgatggttttataaaggggaggtcccctgcatatgctctcttgcctgccgccatgtaagacatgcctttgctccctcattggccttccgccatgattgtgaggcctccccagccatgtggaattgtgagtcagttaaacctctctccttgataagttactcagtctcaggtatgtatttattagcagtgtgagaacagactaatacagtcagagagtctgggggccatggcgacagggatgcctaagagaccaacacagtgtctgtctgcgaactcactcattcccttctcactcactcctccactcattcattccttccttactcattcctccattcactcattgcttccttgctcattcccccacttatgcattcttccactcattccttcctcactcattccttcctcactcattcctccactcagtcattcctccattcactcattccttcactcactcattccttcactcactcattcctccctcactcattcctccactcattcattcctccactcactcattcctccctcattccttcctcacccattccttcttcattcattccttcctcattcattcctccactcactcattcctccactcactcactcctccctcactcattcctccactcattcattccttcctcacccattccttcctcattcattccttcctcactcattcctccactcattcattcactcattcattcctccactcactcattccttcctcattcattcctccattcactcattccttcctcactcattcctccactcactcattcctccactcactcattccttcactcactcattccttcctcactattcttccactcactcattccttcctcactcattcctccactcactctttccttcctcactcattccttccttcctcactcattcctccactcactcattcctcctctcacttattccttcactcactcattcctccactcattcctctgctcactcattcgtccactcactcattccttcactcactcattcctttgtcacttattcctccactcactcattcctccactcactcactcctttctcacgcattcctccactcactcattccttcctcactcattcctccactcactcactcctttctcacgcattcctccactcactcattccttcctcactcattcctccactcactcattccttcctcactcgttcctccactcactcattccttcctcactcattcctccgctcattcattcctccgctcactcagtcctttctaacttattcctccactcactcattcctcggctcactcattcctccactcactcattccttcctcactcattcctccgctcactcattcctttactaactcattccttcctcactcattcctccattctataattccttcactcactcattccttcctcactcattccttcactcactcattccttcctcactcattccttcactcactcattccttcactcactccttcctcactcattcctccactcactcattctttcctcactcattcctccactcactcattccttcactcactcattccttcctcactcattcagtcagcaagagcttattaagcagcagctatgcacgtgtccctgtggcctgtgctggagaaggaacagtaatcagagacaggctctgtctgctcttgcctgccttcctgactgctggactagaatctcgcagggattgagctttattctggcagcaaattcagctcctttggaaattatattaccttttctgaacacctaaataacaccaggaggtcaagtacgtggaagtctgaggggcggaggaatgtgcatttagggtcgtgggaccccttcccatttatttgtggaaacccactgtctcccggacactggcctccagggcacggtctggagggtctgtaagactccccgtgacattcctgttccttgttccactgccagggtcctgtcctccctccgctttcccttcacttcctgagtctctttccattagaagaagaattcatatacacatactgcagcaaagggaatgacagctgcagcaggtcgccagtgcatcaacacagagtaaccgaatacatcagagaggacatagggatctggccagctgggaatggaagccaagtgggcatgctgcagtgagaactgggggagaaggccggaacctggcgggctcatgtgggcacgctggccatggtgggatggcagcgtgggccaggaaagcctgggaactgggggtgttggcatgagatgaagctcacagaggcatgggctgcaccgggtcccagggacacctgagcacgtctcagggcgccttctgttcacagcttcccacaggagtccagctgagaaggaagccacatggccattcctgagaacaaggataatgccacacaaatgagatgttccagctccctagctctgaggaagctcattcaaaaatgcaatttttaattaaaagggaaacttcctgagaggacagggagcatttacagcatgaagtcaggcagggtgagcctcacccagctgctgttcctttctctttcctgccttctgaagaggagactgtggaaagggaagcgaggcagaggtggcagaaagagatgataactccaggaaggaaggggtgcctgagagaagcagccaggcagagcggtgggacgtgaaactcctcgacagcactgtgtcctgggccgaggtggggagggtcagtgagggcagggtactggtgtcattttaattcagacttctctctttctttgctgcaaatggctctctggagcacaaactctcaacaaggtggaaactcgacactatgctctcaatctccatgcacaattttgcagaagaggctctttccagcattttctccccagatgtcagagccgtgcacccttctccggaaggctggagggtgttcagcgttgtttgtcacaggcagcggccagtctctgtgttctcgggcgctctgtgtcaggtcctggtatttattcccagattctgtttagatgcacccgaggccccaggcaaaggtttctgcctgagacagtccttggcctccagccacggcttccgtgccatgtcccaaatgcaaagtgccactctcaaatgttctctgatctcctgttcgaagcaaataacagagtgctaaaatcttatttagaggagtcgtggtagaattatttattcacttctagccttttggctgagactgttttgaaaaatagaaaatggcaggtaattcaggtgtcacccttcaatggcatgtgttcttcttgatgtttcacagctactgcacatctgatgaagaggattttttttaactgagtaaggtcatcttttcctgatgaagccccaaagtgcaaaaggcatgaaaggcacattatgcttctccaccagaggagggtctccgcaggcagggcagccgctgaacagcaccgggagggtctgtagttgccagactctattattgtgggctataaattaagaggcttccgtttcaaatacaaactctctcatcagtcacaggaaattaaatgccttttgaaagggagctaggcataggaggaattcactttcttccacctacacactgttggcagctcctcagagggaaggacggagcctgccattctgcggagcgtcacctggttcttacccacgacttcaccgtgagtgtggagtccacaggactccagagctctgtggcctgactgcagggcagtctgctcccaaagagacttggggagaacatggctaactcaacagaatacagaataacaccggagaggggcaccaagagagtggtgatcacataattgagacctagtcagacccagtaacaacttaccgtgtccgcgaggaaccattcatgcagagaggcctccccattttctgccttaaactcattttatatacgtggggaattgagactccaagattacgaacattttcaagatcctctggctagtaggtgatttagcttagagtcaaatctagatttgaacaactccataatcatcataataaacaataacgacactacctacatgaactgagcaatggctaagtagtaagcatgtgccgaaccctttacgtgagtcaacttagttgatcctcagataatcctgcggcagagtgattgttccagccacagatgaggaaacgcagagccttccaggtgttataactcttttctcacgcctctcttacaatcctcaggaaatgtcgcccccccccccccccgaccccccgccagcccccgaccgcccggaactaagccacagccacctcctgccctggttgctgcaatagtctaatctctcctggagtctgcccggcccctcctgagcttcgtcccagacagcagtcagagcaggacttcagatgttgtcagttctgctctcactccccgccactgcccatttcactgggaatgagagccaggggtcctcaccaggcctccccactgcgtccctctctccccacagtgtctcctggagctgcattgctctctggatgtgccagaacatgccgtgggctttcatcctgcgtcactcgactgggaatgccctgggatcctgcaggtgcccacccagctggctccctccgggtcccgtctttactcaaatcgcaccttctcgatgaagtttactctgaagttcaacctgctcttcccatcctcccaccccaggcgcagcagatccgccttaactggactcccccgctttgcttccacggcgcctatggaaatgctctgacacagaggtcagcgaaccactttacaatcacattttactgggacacagccacaccttttggttcgtgtattgtctgtggccactttcacagaatgaccagtggccctcagagctaacagacgcactgcctggccctttactgaaaagtgcggccacctctgctctaacataactggagagcttgatgacggattgggcttgtttttctcggtctgttttcccccgaggagagcgcacacactggggggcaggaactttgtttcttttgagcactgacgcctcccagtgcctagaacaggacctggctcgtagatgatgccagttcatatttgttgaataaatgtgtgaatgaggcatatatttgctaaacaactcacccaaagtcactccagtgataggcccatcagctctcggcatccaaattcaaacccaggcagaccaacagagagtaatagcaacagagacccgttcttaccagtgacccccgaccagcctcatccgctgctgcctcgcaggagacagtgtcctatatttgctcataaaaaccaggcagggaaaaaggcaagctaccagcttttaatcttattaatatgggccagaaaggatggttcatggttctgaccataagacaaagtgcttcaaggcaaggcttgtatcaaccgtgctacggagttgatacacaccgaactgtcacccgtcctcctgcccaggggccttggcgttttgaagactcccccatctagacgtccagcagatgctgagcacccaggagagaggtcagaatgcaggatttgcattgaaagccacgtctattggggaagcagctaaagctctggaatgaggtaccagaaagaagaaaggaagatggaggaaagaactctggagggagatggggccgaggaaggagtaggaggtgtggctatgctagctcatgctcacccctcattcaagctccagacctgggccaagagcaagaagagagcttgcttgtgggtccagagtttctgatggcagcgggtttttgatggcctgtaaagtcatctaacgggcttggcgcagtggctcacgcctgtaatcccagcactttgggaggccgaggctgccaaatcacgaggtcaagagatcaagaccattctggtcaacatggtgaaaccctgtctctactaaaaatacaaaaattagccgggtgtggtggcgcctgcctgtagtcgcagctactcgggaggctaaggcagcagaatcacttgaacctgggaggcggaggttgcagtgagcagagatggcgtcactgcactccagcctggcaacagagccagacgccgtttcaaaaaaaaaaaaaaaaagtcatctaatgcctccaagaccacacgctattgatttaatctctgaattaaaggtctctgaattaaagtgtataaatgtaccttctcccataactctgagaatggggtttgtgtcttagaaaagaaaaaactcacggggctgggggttacatctattgtttcctgtaattgtcacagcagtactcaatacacacattttcacaggcaaggaaactcaggttaaataactttcacaacacattggaaatttaggctgccaattagtcatccctccggcccccctgggttttaacctctagacctagagaaccaaattagatgaaaataccagcttttgtaaatcaacagtgtctaataatcccccaaggacagggccctaggcaaagctgagctgggggaatgtagacagacctcctactttccactccaaacctagacgcagactcagtggcccacccaggggcatgagtaatgctgggagctgcaggctggcttcccacgctccctcctgggcctggcccccaggcctggctgactccatggggggcctggcagtatcacagcgcagggctctcaggctgccagcagagcagctgttgtgttttcagctgcttattctcactaaaacttctgataaggccatctggaaaagtattactgtatattaataaaaatatttaaataaagttacagaatggagagatttactttggaagtattaatatgtaatgagttagacagataacgtgtttgaagcagcctctgccaatctgtttactccacggagagaagaagaacaggtgtgtcaagccaaacatctttccttggcacttgaactgccttacttggagcagctctgacaagcttatttttgtggtggtggttgggggaacccagcatttttagagaagaaaagagcaatcttcactccagaaagtgaatctgtctatattcatgtatcggccttgacgtggtttgatttttctttttaactccagtgttggttctttgctctttgaaatcaaaacattctgtattatttctgggattatacccagcaaagtgagaacaggagcttcttttagtaaataaacgtgatcatcttccgccagtaggtgtcactgttcatttagcacaaaccatacccgaaaggcaaggcaattacctcggctaaaataacaagcatgttttctggaaataaaataaccagtaagtactgggaaaaagattattttctttcacaggtgtctccaaatcaaagctgaagtgtgaacaacaattcactctttctatggcctcccacatagtatttgcttctagagctttagcaccattgtaagaattccttctaaaccatgtttgtacctcagatctaactgcctgaccctataaacattttgcggttgactttgcttataaaatgcattggcattttcacatacaggcggtggagttttctagcgttccagcctaaatcagaaaacaatgtctggtgttgcctacacagaaacaatcgtatatcatagaaaattagaagtgaggcagtaaagcgagtctctgaaaatacgttggatgtaaacacatcgtttacatgaaggacatggaattataagttcacacagtgacacacaaatatgtaaggtcattagtgttcactaaatgcgtagctatgcaatgaaaatggtgagaatcctttacgagctaacgtgctacacagagtttgatgcttcttgtgcgtgatctcacctgttcccccacttatgtgaccattttacaatgaagaaatggatgtttaaagaggacagtgaggtccctgcgccacagtggtagaaagtgaccaactagcagtcaaccaggagatttttggccctagaacctgaggtcctaaccacaacacagagggcctttccttttttcttttttcttcttctttttttttttaaatggagtctcgctctgttgcccaggctggagtgcagtggtgccatcttggctcactgcaacctccacctcctgggttcaagcaattcccctgcctcagcctcctgagtagctgggattacaggtacacgccactgcgcctggctaatttttgtatttttttaaaaaacggggtttcaccatgttgaccaggctggtctcaaactcctgacctcaagtgatctgcccacctctgcctcccaaagtgctgggattacaggcatgaaccaccacgcccagcctcctctgacttttgtaagggaaataattagattctgcttgtgttgaataattctagccaggccggagttcagttctagtcctcctacttccgactgatagtggctctgagtagttcacttaccatctctgaatttccatttatttcactgtgaaagggggaaattggtacctacttgtgggattgctgtagagattcaaataccgtgtttaagaaagttcctagcactgcgcctggcacgtaaaaggcacttgtttaagaacttgataaggctgggcgtggtggctcacgcctgtaatcccagcactttgggaggctgaggagggcggatcacgaggtcaagagatcaagaccatcctggctaacacggtgaaaccccgtctctactaaaaatacaaaaaattagctgggtgtggtagcacgtgcctgtagtcccagctacttgagaggctgagacaggagaattgcttgaacccaggagacagaggttgcagtgagccgagatcatgcgccgctgcactccagccagagcgacagagcgagactatgtctcaaaaaaaaaaaaaaaaagaacttgataaagtaaaaaaccctgatttttgaaataaattaagagtaatgaatatgcaataaagcattcttttctgaaatgcgttatgagaggtcaggagttagtcttaagcagttttcaaaggtgcaagggctggagtggcctcagtttatctggataaaatgactatatatgaacagagatgccaactgttggtgccaggcatggctcatgggcttttggcatgatgaacagtttcctttattttcttttttttctttctttatttatttttgagacaggattctgctctgtcacccaggcgggagtgcaatggtacaataacatctcactgcagcctccactttctgggctcggtgatcctcccacctcagcgtcctgagctgggaccacaggcacgcgccaccatgcctggctaatttttgtattatttgtagagagagggtctccctatgttgcccagtctggtttcaaacttctgggctccagtgatttcccccccacatcagcctcagttttctttactttttaaaaattaagatcctgattttacaaatgaagaaagctcaaagatgaagttacatgtccaaggtcacatagctgaagagagaatttgccgggctgctggatcttgttttttccatttgccgtactaaatcatgtgctacaatatttgtggttttcctcaactccacagagcttgcttctctgaaattcctattccttgctaacccctaattttgtatgtgaaccattggagacagggagcacaaaaggacagcaagagagaaagcaataaactaagtagagaaaggaaggatcctcctggtccttatgcctttgagtgatgatgtaagaaaatcatgtgaagttcacctgggtgagcctttaccctccaggcactcgagggcccataccccacaccaggagagttgaggcattcctcatcttgattttgaattgatgcttgagtgggggtacttaagtattaattgaaacgtgctgaattcccaacataaatggaaattctcaggtgactttgaatggcaaaaatcagtcctttctagacaattaatgagtagatatagaatttccatccaaaagttgtagaaaagtggttagaagggagttgggtatttggcagttaggcctggagtttactttctgggtcagaaccaatgtcctgagttcatgcagaaatcacatttgatcttcactaaaaattaagcaggaccagcatgagggtggatagagagtatgttgtatcttctgtagttacagcataacttcctttccccatgtagcattaacgggggaatggaggggactccggagatcacaggaagagtttgttcagatagagacgtttaccccttgaactgtttccaaccctggctgttgtatattattctaaagagactacattagatatttagggaaaaattaaggatagtataaagttagcataagaagaacttttgtgcagggtctacacagaagaaatcacatgaagagtttaaaaagtattttttaaaaagttaaaattttgaaatacgttcttgaaattctggattcagtatagtcagagatttactatcagtggtgttgaagaaattcttggtatattcttcagcaacagagtggctatgataatggaaaaaggttagaatttagtgaatttcagaagtaaagaattttgatagaaaagaacaactgaagttctttggatttctatgtagcatttctgtttaacgagttatcattatagaaacataatctagtaaaggaaaatatttttcaagttttactccaagaaatcatttgagataactgtggcaggatccacataaaacttattagccaaggattctacttagttccagttgaaagtaaaacagtaataacccaaaataaccgactaaggaaacacaaataaaatctttttttttttttttttttgagatggagtctcactctgttgcccacgctggagtgcagtggcatgatctcggctcactgcaacctctgccttctgagttcaagtggttctcctgcttcagcctcccaagcagctgggactacaggcacccaccaccacacccagctacttttcgtatttttagcagagatggggtttcaccatgttagtcaggctggtcttgaactcctgacctcaagtgatccacctgcctcggcctcccaaagtgctgggattacaggcatgagccactgtgcctggccagacaacacaaataaaatcttgagaaaattaactttacacctatctcctctctttctttgactaacgcctatattctcatagatgctctgtttatgcttcattttcttgtttcttttttattccccctttctctgctgaaagaattatgaagaaggaagaaaatttgaaaggaatagaggaaaataggaaggaaaaatagaggaaaaaaggaagaaggaaggaagaaaggaaggcaggcaggcagggagcaaggaaggaagagagaaaaaggaaaaaatgccccagaggcaaatgacatattttcaaagctacttcttctaggctggtaatttcccagtgccctgaccttgcattccagacttcaataaataaacggggatgatgccaatgatcgagacgccaacagcagcccttttctagggctgacatcgactgccacatcactcacagcatgtggaccaaaatatgagacaagctgggcatgcattcagacattttatttgtgtcttttagaaagcatttatatttcctataaatccatttacatgtcagtatcgtagtgagaaatgcacgcactatgagaaggccttgaaacatcaggagctgcagcactcttagagcagacttgacagctgcactgggtgtgagatatcagcatctttaatgtatgccagccttgcatgggtttggttgggacgtcctcatctgagaagacgtggcccccaaatgaatagggaggcactcacgttaatttttctcaactagtatctgaagggttgtcatgctctctctgctttctaatgtacatagaggtgtctacatgcaaacggatagcagctgagacacgctgtgtaacttgcagcttacatgtaaataattcggaggtgagtactgcgatgcagttacacgtcgtaaccacctgaattttatgggggaaccttctgcacgtattcatgcatgaagaacacacatttgaacaggggcataggcagtgtttgtcaagctctggaatgtggatgacaaaggacatcttaaaattccttgatttggggccaatgacaagcaagacatttacagatttagatgacttgtcaatcccaagctggaattcataaaattggctggtctgtttaaagctgcctctttctggaagcttcctctgcacactctagctacagcagggccttaccatggctcattgtcccaccagtcccttccactgctcttgttcctggtctcataggctacacacaaccactatcatctttctccaccatttgtctagaagagggaggggactctgcctaggtctcatcattgtgtatgaattgacagaacagtgcccagtttacaggcagtgctgaacacagatcagttaaatgaatgaatatgatctttactattaggtttctggtgattttctaaagtctacagacaagaaaagcactggccaatgaaggtcaatgtcaaagcacaaggctggtattgagactggagtacggcatgtagtgttgaagataaattgaggcatattaatattaaagagttgatttgaggccagccatggtggctcatgtctgtaatcccagcactttcggaggccaaggtgggtggatcatttgagtccaggagttcaaggccagcctggccaacatggcaaaaccgtgtctctactaaaaatacaaaaattagctaggcatgatggtgggtgcctgtaatcccagctacttgggaggccatggcaggagaatcacttgaacccaggagacagtggttgcagtgagccgagatcataccactgcactctggtctgggagacagagggagattctgtctcaaaaaaaaaaaaaaaaaaaagaattgattttgatttgagcaaacagcaatcatgggtgggccagctctggatcacaagtggttcatggctccacagaaggggcaaagaggaaggcttttatggagtgaactcagaagcaaggcaaagaattcatcccagtggaaagtcccaagttagggcttagctggctgtttcagattgtcctagaacatgaccactgagttgggtttcagattgcagacacaggaactcagggcattggggccaccttggtctagcaggcttccatttaattactttaacagcaggaaccacaggacacctctaactgtccttaagagtgtaattatagctctttggccactccctgtactaaaaggaggagtggagaatttggagaggatgtaggcaaaaccactgtgagcaatcaaagtatcaaaggaattaactcatctaggaatgcatgttccttattctgcagtacctggaagggcttttggtgtgtgacagcaatgtgaagcgtctttacatcttaattctaagagacagcagccacgatgtgggaagaacttcctagttaaatgtgctctgaaaagttggactgtactgtcgagggagactatgggagtttctttgttcagaaacacttaagaaagtactcataggcccacattaagtaagtgatgcctacaggtgtcttctgtttctgtgaattggtgtggagaacccaatgtttattgagtgcctatgtgctgagttaggcatgactctctttctctgtctcctctctctcacacacacttactttaacataggaggaaactgcatcctgagaggctcatataactactttgaccccactagtcttggaagagctgaaactccctcctagattgaactgtacagcccaccagctttctactgactcgtgttagagagcagtgggcaaagagtacaaactgcattgaggttctctactcacagcgttgccttacaacacatcaaaaatgcacctcctgaaaggttatcgctgcacccattgcaatcctgatctgaaagttcacagtacttgtttgtcctgtctaccagcaacccttcagaaagagtctccattgacttatttcagaggcaacaaaatgagcttcagggagagatggtgtaggtccgtggtccgattggtgtccaacgctggtctcaaatgtctcagttgtccttgtcttttgagatcagaatccacagattttcatttctgatgcaccagatcaaggactagtcccccttggctactccccagtcagacatgataaaggtgcctcatcacccactggagaggtgtcttcagggggaagtcaagattacaactaagtatcttttgggtcaaaatgtttgtaaagtattatgaggagatgaatttgtccaaatactcaaattttgtgctttgtaaaacacagtaggttgtataatatagacgagacgccttgccacatcagtaattccccccatattcacacggtgcccctgttccttggaagacatggtatttttttaatagctcatgttgggcccacaggattcctgaaaagtgcagtggtctgtcctgtcctccttttagagactaatacccagcctcagttccaacaccgagcaggagtgacagtggagtgttcccacactggatgttcaggggaattaacaaagatgagtgatggcctcccaagtggttaagggggtgcctgtgtacagcgttgtaggagcaaaaaatgtgatggggtgacaaatttaaaggaaaacaaaaagaggaagagagaaaaacggagatttgtaaaaagcaagagagaaaatgagatgtcccactgcccctgaatacccaaaggggcgtgctgaagtacctcagggatatgattctatgctattgtgatggttaatactgagtgtcaacttgattggactgaaggatgcaaagtattgatcatgggtatgtctgtgagggtgttgtcaaaggagattaacatttgagtcagtgggctggggaaggcagacccacccttaatctgagtggacaccatctaatcagctgccagtgtagctaaaatataaagcaggcagaaaaacatgaaaagactagactggcctagcctcccagcctacatctttctcctgtgctggatgcttccggcccttgaacatcgaactccaagttcttcagtcttgggactcagactggctctcctagctcctcagcttgcagatggcctattgtgggaccttgtgatcatgtgagttaatactacttaataaactcccctttacacacacacacacacacacacacacacacacctcctattagttctgtccctctggagaaccctaatatagttatttatttatttatttgttgagacagagtctcgctctgtcacccaggctggagtgcagtggcgcaatctcggctcactgcaagctctgcctcccaggttcatgccattctcctgcctcagccttccgagtagctgggactacaggcacctgccaccacgcctggctaattttttcgtatttttagtagagatggggtttcatcatgttagccaggatggtctcgatctcctgaccttgtgatctgcccacctcagcctcccaaagtgctgggattacaggcgtgagccactactcctggcctacttacttatatttttgagacagggttttactctggtccaccatgtgggagtgcagtggcgtgatcatagctcactgcagcctccacctctccagttcaagcaatcctcccacctcagcctccctggtagctgggactactgatatgcaccacaacactcagctaattgtttgtatttttagacgagacaggattttgccatgttgctcaggctggtcttgaactcttggactcaagccttggcctcccaaaatgctgggatattacatgttactattgggccctaaactagtgctttatgcgaatcatcttttttaattctcacagccaccctaactggtaggtactattatcatccacatttttcagaggaggaaactgaggcacacaaaagttgaataacttactcaagcccaccagctcgtaaaagacacagctgggattagaactcaggtagaactgacccaaggattttctatttccttccagttgctgaaaaatcactaaactcatgaggcaatttcataagtctatatcttgtctgggttgctagtaattagcaatcattacatgaaatctgacatgtgaaagtgaaacacaattggaagacgttttgtgacatggatgtaaagtatatatttcttgagggtagagttgtttcactgccactgtgttctacatttaggcctttgctgaggttggaagtattcaaatagatagataaagtcacatcataatcccatgtatcaagtgtcatggaagagtacgcaatcaggcttttgatgaatcccacgtttcacttgcaatctgcagatttccatatgctgtggctcagcgatttgcactggcttctcaagcaaatcagtcatgactccaggcgtgactccagactgaaatcactcttgtcgatatacctgaaaacagaggtttccagcactggagagaagctttggtgcggggatgggctcagagggtcccgacagagggtgacacttgcatggttgcagaaggaagctcgctgcagtctgagtgtgtctccgtggagctcggcatttggacacagctcacacgcatgagtgatgctcttccacctgcatcttctggcacttgcactgtgggggccttcctcaaagccgtgcgcctccatctcagggcaacatagggcaacttctttcttctactcacattctgaatgaaatacattaataactggcttaaaagaatccaatcctttatcaaaagactccagcatttttccttccattgactgctacctgatattgaggaaggtataaggtgtcagattcctgctgggactggcagagaggggcagagggaggcaggacgggctgctggggtggagagtgcagacagaagcctgccatccgccggagtctgtgagcttcagggtccacacgagcctcatggagagacaggcggctgctccgtccatcttcgaacctggctggcatcgcagatgcccgtgcccagggcagcagccataaaggccgtggcaccttcttgcatctctaagtgtgtggcattgtggctgcctttgattgtttggcggtttgctgtgttctctgagtgtttttccacacatctgaagggcgattctttgtcaactgctactgtcttgctaaagaatcagcaattcacacatataataaagctcacaaccaaaaaaagcacattcacattttttttctttcatttttctgcctgagtacctctaccttggaaaacctccatcttgtcatatatgggcaagcattcatgtatttcaagtcatgtttttgcaggcagatgactgtgtaagtcctacatggccaccctgccagtgtttcaagcaggcctctatcatgtgctgacctatggctaggggtccctggtttctcccaccttcttcctgatggccaggcatacattcctgccctaagactggaaggctggcagaccagctcaggtcagctggttcaagaagggggaaagttttgctcatgtccaagagataacgtaagatgttcctgaagctaaacttctcttagacaggacacctgcagatggcacctttgctaaccttgattgtgccttgagatattcacctttccttcagagtgaatgctcctatcacctatatcacacttcatatgatgtaagatacaatttatatattcttgctcatttactcatttattcatttatagatttacccagcaaatactgatcaagtgctgagacatgctaggtgctgggctaggtgtggaatacaatggtaaacaagattgagaaagttcctgccctcagggagcttatagtcagtcatgggcaagtaaacaggtcattataacacagcagtgccctaagtgctattgctctatgtgtgggaaaacaggcaacctggggagccatggttaagagggacggagaaataacacgaatgtggtgaggcagggtggtatccccagagctgagaccttgcaatggctaggatgttgctagaagaaggaaatggaagcaagttccagagctcagaaaacattctgagatggaactagaagaacctggatgtgaagcgggagggccagggaggccacggagatggctgctggtttcaggtttgggccacaagtagatcaatgaagaaagaggaatccagaagttccagtccgagggtgtgtgggaggagggtgagtttcagagtcattaatgggccttttcttcagtaattcagaatactcctaagtgagtatggccacttggatacctggaaatattcatggctccaggtagctaccaagagaagacttcattttaattcttgtcaggaactgtgaaggatccaagattttgctttctttgcaagctaacaagttagtctgctcagttttacggaggccaggagaagaccagaggttcctgggtcagagacaaaggaccatgcattatttacagcaatatcttttttcctgtgctggtttctcaaatcccagttctcacagggtggtttgaaatggaccagatggcagctgcacatggcatgggttgcattacaggtgtgaggaccctgactttagggaatctgagtcttttataatgggccgtgagcaggactgccattgtcaacagagggagacattgtctttgttataagcaaacttcccctctgctgcggaaagagacagtatctctatcttccaaggctgttcactgtacgattattattgtaactatgttatgaaacacagggcattaatccatccatgagggtagagtccttaggacctaatcactgcctaaaggtcccacctcttaacactattacactgacaattgaagttcaacatgagttttggagagaacagtgaaaccacagcagaatgatagcaattttcaccaacttctgtttaattgcttaacctgttctctcttgggattgtcagtaaatgcactgctcttggggaaaaatgtggtgagagcaaacacagagagaatggataagaaatactgaatgggccgggcgtggtggctcacgcctgtaatccaagcactttggggggccgaggcgggtggatcacgaggtcaggagatcaagaccatcctggctaacacagtgaaaccctgtctctactaaaaatacaaaaaattagcccggcatagtggcgggcgcctgtagtcccagctactcgggaggctgaggcaggagaatggcgtgaacctgggaggcggagcttgcagtgagccaagattgcgccactgcactccagcctgggcaacacagccagactccgtctcaaaaaaaaaaaaaaaaaaaaaaaagaaatactgaatgctggccaggtgcggtggctcatgcctgtaatcccagcactttgggaggtcaaggcaggcggatcacctgaggtcagaagttcgagaccagcctggccaacgtggtgaaaccctgtctctactaaaactacaaaaaaaattagcacggcacagtggtgcatgcctgtaagcccagctactcaggaggttgagacaggagaattgcttgaacctggggggcggaggttgaaacgagtcgagatcactccactgcacttcagcctgggcaacagagcgagactctgtctcaaaaaaaaaaaaaagaaatattgactgctaaaatctacgttttcccatgtatttaatgtgagcaattatgattagctaatctcaatgcttatttgtagagtatatcattaactggaaagaaataaaccttgagccactgaagaaatggctttttctataaattaaatagtctttcaaacataacaaatgtttttaggaactacgaaatttttaaatttaatactagatcaaatcagcagataaacattttatgtggttccttttagatgtggtacacattatttaacaaggtagttaaaacctgttttattaaatcatatcataaaatgtttattcccagtgcaatcaatactcatattttatattataaagtgtttaatattttccacctcttattaacaacaaattaaaattgtttgctagctgctgagtcagaatattttcttttctttctttctttcttttcttttctttttctttttctttttttttgagatggagtcttgctccattgcccaggctggagtgcaatggcgcgatcttggctcactgcaacctccgcctcccgggttcaagagattctcctggctcagcctcccgagtagctgggattacaggcgcctgccaccacaccccgctaatttttgtatttttagtagagacagggtttcaccatattggccaggctggtctcaaactcctgacctcaggcaatccacacccgccttagcctcccaaagtgatgggattacaggcgtgagccactgcatccggcaataatattttctatctatagctatatctacgtttaagcttttcactttcttgacaatgtttgatcatgaataaagttatttctctttattacatgactcttacttaattattcacagatgccaaacactggggtgcattttaatgcatgcacacatgtgtacccaccaaaggactccaggctatccttgcttcataaataactgtaatttcagcaacacataatattcctttattacaaatcaagtacaagaacagatagatttattttagtttgttaaactttgtgaaatggttaaatgaatattctatgtcattctgatcctgactgtttttcataactcatcttgcaagatagatatctactttttagtgacccccaacaatattccttggaacacatgttagcatatttttacattaacaatattcacttcctctgattttttttttttttttttttttttgagacgaagtctcactcttgtcatccaggctggagtttaatggcgccatcttggctcactgcaacctctgcctcccgggttcaagcgattctcctgcctcagcctcccaagtagctgggattacaggcgcccgccatcaccatgcccagctaatttttttttttttttttttttgtatttttagtagagatggggtttcaccatgttggccaggctggtctctaactcctgacctccagcaatctgcccacctcggcctcccaaagtgctgggattacagacatgagccactgcacctagcctctgattttagctattggtgtgaagactgagtttgttaaatattttaccttttctataaattaaatgactcagcaacttccatttgggtaagaatatatttaaagcacatgacaaaaatattttatcaagagatgctttactggcaaaggcgtattgaaaataacaatatttaatattttttcaactctttctgaatgtattaaatgaagggtttctaaatgcacaaaataaaaggtacaattaatagttattcgtaagatcctcataaaacctttatggcatacttctaaaaaactgaaaaggtaaatcagcgtgccaataatttcatggcaaagggcaaaaaatacttttgcttctaattctttgttcctgaagattttgaaaaataaaaatatgttttgatgatagactatcatgtgattttggcatataactgcaaatgacttttaaaaaatagaatgatactgctaaaagacttcttccattgcaatgtacctatttatatgaacaaagttatttagtgcttacattaattaaaatgaaaaatggaagaaattcatattgagggctgtctgattccagctgtaagcagtatgcgtccgcggcatctcagtaagttggatgttcccattaccatttcactttttgtttaacaagtagtcaacaaaacttataatgtatttttgttgtttggattaactgtttactactaataattaattttaataactcaagtaggaaaaaatgttaacctcagaacctcgtttttaattctagaaattaaaaattaaaggctttgtacatattttcattacagaaatatatactggatgaccaataaaatattttcaaatataaacacatgttagagaataagagaagtgaaatggactactaggagtatgaggcccgatataaactccctttgataaagaagagcccattcatgtgtttacaaaatgaatgatgtggaccctctggtgtacagattctatttctgtcatttaaaagattgctgtctctcttcttttataaaatatttgtcagtattaggctgagcactgtggctgtcacctgtaatcccagcactttgggaggccgaggcaagcagatcacctgaggtcaggagttcaagacccgcctggccaacatgatgaaaccccatctctgctaaaaatacaaaaattagccaggcgtggtggcacacgtctgtaatcccagctactcgggaggctgagagaggagaattatctgaacccgggaggcagaggttgcagtgagttgagatcacgccattgcattccagcctgggtgacaagagcgaaactccattaaaaaaaaattgtcagtttttataacactccaggagtttcactttttgctactacttaagcctgggtaaaattttatgatggacttaaacacttgtgaggaggtacattgttttcaaaattttgtatgtggggaatatattattaggaaaacagtttgaagaccaccactccataccattccaatagtaagcattctattcacttgctattttactcaagagattttgccagtatgctcttggaagagttcaacattgccatagatcatagggaaaatgattacttatttctgtgtctgcttaaagttttctgtgtgcttttttcctctgccattatcccaggctaacgtctacggtgcagggtgagggagggtggcatctgcctgccggctgttggggaatttccctaagtttctgctttgcacccagactccgtcttcatgaagccagagccgcccaagcttcaggaactggactccgattcctcagaacaacatcctctccaaggctggggtgtgcgctgacttgtgtagacacaagactataatgcagaccgtttgagaatcaacacacaatggggtctttattttcctacttgtgtaatcgctgagcaagtcatatcatctcctggagccttaattttctcatttgtaaaatgaggatttacaaagcatctttcacctgtctcttcaggattatagctgaagcagggaaagaaagctctttgaaaagtttaacgcaatttgaaacatgaaaatcttcaaggtcctaaaattggggggcatgctgaaggaaattcagtatcatttctttctgtaatatattcatctttaaaaataaaacaaaaaaagaccacaagtttggcgcggaaaaacaccaagggtaacgtagcatgtgtgtttctgggaggaaggagaggggagggttaaagagttcctgggaagaagcccaacttcttggctgaaatttactgaaagcctttgcccggcatgatcttgctctcttgtgctcatgacaaagaaatgtaacctttggccaattgcatttttgttccactggtaactaggttaatgtgaacagacagatctggtgagacagcatgggaagaaataacacatgggcttttgtgcagctggatataatgaaggtaaattgggtggaattcaaagatttgccagaaaaaagagagatgatttcactctaaaatcattttgcaagataatattttacaaggaaccttttggacatgcattataagcggttacattcccattgtcctaaaaaactccctgcatagttgtactctatttttatcaagccatgctctgacgcctcctgcctggttggcgataatccctaatgcaaagggatcgtgtgaaggtaagtgaagtcgttttgttaatgttgtttataaagaagcactgagcttctactttgtgcagagagctttacaaatattcatatgagctttatgaatatttacaaatattggcgcattaaaaaaataaaatgtgttcattttaaatataataatgtaggtgtcattgctatccccgttttaccattgcagaaatggaatttcagaggtgtcaggggccagctcaaggtcactgatgaatcaggacccgcttatccagctctctctgccttcagagctctcttgacttttctgcatcacttcctttaccaggaatgatatttaaattattccaaaatgtaaaatatagttagttttccaggcagttgtatttatttctggatttttttttccctaaataaaacctgtatctacatgaaaactcctccaggatttcctttcctcatgaagtgtgtggtttcctcaaggactgcctgggaggccctgaggccgacccactcctcccagcaatgacttggggaggagggagtgggggaagacagagagcaggggggtgggatgggagggcagagaggagggggagggatgggagggcagagaggagggggagggatgggagggcagagaggagggggagggatgggaggacagagaggagggggtgggatgggagggcagagatgaagaggcagaatgggagagcagagagcaggggaggaggatgggagagacagagagcagaggctgggatgggagggcagagaggagggggcgagatgggagggcagagagcagggggcaggatgggagggcagagagcagagggtgggatgggagggcagagaagagggggcaagatgtgagggcagagagcaggggagtggaatgggagggacagagagcaggggccgggatgggagggcagagaggaggaggcgggatgggagggcctgctgtgtgccctcatcaggtggatttcattcgctgggatggaagaggaggcatggcatagagacatgaagttctagaatgtttttggccactctctgcaaactcaagacttttttgggggggggtgggcggagagtgcaaataatgcctttttggagttgtaattgctccctgggagggttaaatttttaatgatttgtaatgtcctggtaggttcctgcattcatgaactgcttgggtgaatggctgtgatttggaagtgaggatgggagagaaagagagaaaggcatgatgggaacgtgggtcaaattgaaactcctgctctgacctcatcccttccgggggatgactcttattatcctggttggctacttgcaggcatgtctatacacaggccacctggattaagagccattcctcagggtctcctggctattgaaatgtctgtatctgtaagagtagctttcagtgtctgaaattggcctttcctctctctctatgtgttaggttccacctggtattcacttagggagaccggtcaccctctgcagctctgtctcactactgggtacagtgaagaggtttacaagcttggtagcagtgcctatgaaaataacaactaggatgcttctgttaccatcacagtcacccccattatccaagggggatacgttcccagaccctcagtgtatgctgaaatcacgggtagtaccgaccctatatatgctgttttttcctacacatacatgcctattacgaagcttaacttataaattaagcaaagtaagacattcacaacagtgctacagcagagcaggtataatggtgcgaggaccacgacacaagctacgtgaatgtggactcccgctctctctaaatatctcattgtcctgcgctcatccttcttcttgtgatctatagctctgctatcccagatggctactaagtgacttctgggcgcgtggtgtctacagcgtggagatgccagacaaagggaggatccacatccaggtgggagggtgtgagatttcatcgcacaactcagaacagtgagcaatttaaaacttaggaagtgttgagctggtattttccatttaatatcttcgggcctcggttgactgtgagtaccagagactgcaggaatcgaaaccatggataagcggggactcctgtatgcgctttggcagtgactggtggcgtggatgccacaaggcaggggagcctgggctaggctggttgctgtctggaaaaggggccccctttggctttttacacaggtatggccaagggatgtgacctcacctgagctgggacaggctgtgtataaaaaccaagcatcataattctgacatcgtatattaatgtgttcctgaaaggaatattaaataatgcctttctcaaagtagtaacattagtgtatctactaagctcacctaagcagggctagtctgtgacatgcagaaaataagcataacgtagtcaaaggcatattttgaaagtgaccattatgcaactattaaaataaataatacctttccccaaataggaacactagtatatctaccaaaggcaggttgctggtgactacttgattggtaaacatttgtttattcttcccttgtaattgacacagtaattatatgagcccacatctatcctcatccgtttaaatacagagctggtgtgagtcgtactaagtcaggatgatggtatgtgggtccgtgatgctatattccatgggttaatataatctgcacatcatttaactaatccactgagggagctggtctgtcccagaagttttgttattaaatggaatagtcaatgttcttgttttcttacaaattcacttacagggagaattctgttaatttttttttttttttttttttgagacagagtcttgctctgtctccaggctggattgcaatggcgtgatctcgactcactgcaacctccgcctcctgggttcaagtgattctcctgcctcagcctcctgaggagctagaactacaggcacacaccaccacgcccagctattttttgtatttttagtagagatggggtttcaccatgttggccaagatggtctctgtctcttgacctcgtaatccgcccaccttagcctcccaaggtgctgggattacaggcatcagccactgcgcccggctgaattctgttaaattttacatacagcatgtagggcagaagacatactttaaactcataggttttcttactttcactcagaagggaagggaaaacagtacaattcggcgaaataggaaatctaaatctttcaatgcatgggtcatgtggaaaccgagagagagaagaaaatcgaaaaatagatgatggatgttgttaaggaattagtaaaccgttaagtgctctatcattattagatattcgggtgatcatcccgcatgtagctatttgaccaatgctgcttgtaaattggcttaggaaaattaacatacattttattaaactgacgagtatgccttttactgaaagcaaggaatagacatagccattttgtttaagaaatataagcacatgagaggcttaaaaaggtaggggttgtatgttctcagcactgcagctaaattcttaaatggaaactgttcttttagcagtttcagagtaggctatctcaagctgattgctacagactcaaattttaagtcgcatttctttcagaaacagaaggaaagtcaatctcactttcgaaaagagaaagtaaggtgacccttgtcatagtaacataatgcagcaggtcccaggtgtaacccggaggaaaaggcagacaaggtcctgcgatgccgcagctgaaaggaagctgacgccaacgggcttctcagaagaacaatgactcattagtcccgggctcacggcagatgcggtctcccaacaactggcctccctccaaaaacatggaggaaatcaagagggcagagccgggaaggaggctgcatccctcgcctgatggggagcactcctagcaggcacagggtaatcagaaaagtgctttggaatcacaaaatgaaaaaacaagtgtcagctgtgggagatgtagaaatgcaaataagtacgaatgcaaataggccggataaatggcagtgtgcaatcacccaaagctctgtttacaacccgaaggcagctccgtctgtaattatctgggcgccattaactgcgtgggagcagctctcaacgggtacaagagagataccaccagaagtgaaatgtcctctctcccgtgatgaagccagatctccgagcgattccatctacactgaactaaaccggtttgtgccaaagagctagaagtgtacctttggtgaaacaaggaagctagatttttttttattgcttactgcgcatctgaacgtaattcttgccattaattaagaaaacagatgataagagatttggcttcaataaacatgtactgaaagctaccacatcattgagtttaattatgcaagcaatctcgtggggcaggtactatgagctcagatagacttggtcaaggtcgtcccagtagagctgagattcgagcatcagtattttgggcctaggtttttttgttttttgttttgttttgttttttgttttttttttttgacggagtctcactctgccgcccaggctggagtgcagtggcgcgatctcggctcactgcaagctccacctcccgggttcatgctactctcctgcctcagcctcctgagtagctgggactacaggcgcccaccaccacgcccggctaattttttttggtatttttagtagagacggggtttcaccgtgttagccaggatgctctccatctcctgacctcgtgatccgcccgtctcggcctcccaaagtgctgggattacaggtgtgagacactgcgcctggcctggccctaagtttttacccttcccattatgtcagaagttctcagttgacaatgtctggagacatttttcactgtcacactacagagtgccactggtgtctagcagacagaggccagagactctgctaaacatcctacaatgcaaagaacagtccccctgacaaaggattatcccaccccaaatatcaagaatgctgacacggaggttgagaagcctggcatttccccattgctgcctctgggaggctgcctctcgggatagattgaattgttctgcaaagacatggtcggcagacacagagggttccctcaccaggggtctgggagttgctggaaatggataagaaaatcctagttctacctcgcagacagggaggaagtgaagaggtgaggcagtaaaaattcataacatatctatcacaaatgcattctgagattgcttggatctaaattgccctttccaaacccaagagatatttccaatgccacctgaaggtcctgagagctccctgacatcattcaggactgaaggtagaaagtagaatggccctgggttttctgagggttctttatttgtcttcgagaatattaaagaccagcatctctccagaatacaaataagagtctaatgtgataagaggctgaactgaaggtgtccctagaaaatttaagactaaaatgtcagctgaaagacaaagagaaagatgggattgttcttgcaaaatctcattggtaaagagagagaggattttcctaacaaaaatgttctgaactacaagcatctcagagggatttttgaattttggccagctaaacaccatcaggggttctggggggttagtcaaataaagtcagaaagggcctatctgcggcacaaaacacagcacagccaaagctgtggccaccgcaggaggagcaggagagaacctggtgaggagcaagaaagagcagctcagctctgcggagaagcatggtgctcagccatcactgctcgagcgtgaagagaagcgcagtccatggcagtttgggatgtggttggaagctctgcatcacagttcacatacttactaattttgttgatttgtgagctacagaaagagtctggggtcctgtccaggtgcggtggttcatgcctacaatcccagcactttgggaggccaaggcgggcggatcacttgaggtcaggagtttgaaaccagcctggccaacgtggtgaaaccccgtatctactaaaaatacaaaaatttgctgggcgtggtggcacgtgcctgtgatcccagctactcgggaggccaaggcaggagaatcacttgaacctgggaggtggaggttgcagtgagctgagatcatgccactgcactccagcctgggcaacagagcaagactctgtctcttaaaaaaaaaaaaaaaaaaaaaaaaaggatctgaggatctggggtcctgagagctccagttcttccccgcagttcccagagctgctcctgctgatacaggttctgctgccaaggcatcccaggggcctcagggtcccaggaagggccaaggctgcagctgccacctgcctgggggctcctcggccatccggcatcttccctccctccatccctggcctgctgttctgagtctctgagaagagcgtctggcggctggcaaaggggctaccatggaggaatggtcttcaggaagtggataaagctggccctgcctcatgccaatcagcccagcaagcagggaggacatcgccaatgagtttctggttttcacttcagaagttatagagacgatgtaagatgaaatactgttcagtgggctaatgcagccacacgagtgagttttattttcatccctactttaataaacatacatgtgccaagctggctctgaattatttaaaattacagcagtcagaagagagaccttctcaaagtctgtcagaaagatttttaatcatctttaagtaaacttcaatttctctgaaattgaaggagaattatttctccacttcaaaagtcagtacagagccattgaaggggctttccacctcctacgataagtaaaaacataaaatgattagcacaaaaaatacaccatgaaatgagtttaaagtccttaatcttgaaggctagatttaagacactattcttactgtccacaaacaggtttactttagtgatcataacaaatggcttttattcagaaccattactcagtatgattttaaaatctcgggcttcatcttttggataattcacatgaccttctccttagtgggcgagtacaagaaggcactgaatagcgtgccgttccgcaccaccaagcggaagggcagcactgcttgtatctaaggtggcgacctggaccaagggtggccttcgctgtcttggactggacgggctggactcccagctgaaggtggcttggaatttagctgttccttcggggccccgcttacacaccaacacccatgaatgcttttcaacgaagttgctagaatgcagccgtggagacgaacagcttaccgagagcctctgccaggaagcaaaagagaggttctcttccctttcattttggacatcgtaacaactaaacataacatttatatcactatctgtcagcagtttaacataaaccctctcacttactgccaatgtgtccacgctgctcctcaggcaagccattctccccagtgcacagatgaggaaatcggggctctgagaggttaactgacctgctcgaggtgaagaaaatgagtagggattagaatcagggagcgaggccgggcgcggtggctcatgcttgtaataccagcactttgggaggccaaggcgggtggatcacctgaggtcgggagttcgaggccagcctgaccaacatggaaaaaccccatctctactaaaaatacaaaattagctgggtgtggtggtggtgcatgcctgtaatcccagctacttgggaggctgaggcaggagaattgcttgaacctgggaggcagaggttgcagtgagccaagattataccactgcactccagcctgggtgacagagcaagactccgtctcaaaaaaaaaaaaaaaaaatcagggagtgaagttcctccaacacgcgtggtcttatactatgtcactgtgacttaccacatgccctgcatggggcgggggaactggcgtgcattgcctaaatcaagcgcaggagtttgatggtaccacgaagcgccacagggtgtgggagcctgagaggtactcacgcaatgcccgctggaagataagttcattgtcgcacagactttgtaacattgtaaggaaagaagcctgacagtagttttacaaatcacaccatataaattattaatggtaaatagataacccagagtggacagtacatactgcaatttataagaacaatcagtttttttaaatggtcataaccatttaaaaaaaaagaaaaaaagagaaagaaatcctccgcagtcattagttcagtcagttttacctttggtagaaacaagtgtgcttcagctgctaatattactcctgcctaaactgatgccccggtaggcagagccaaggggttaatggaaagagtggagcacgctgagcattttgccatcacagatgcctctctaaacgtctctagctcaagtaataacggagctgcctaattgcagtcattaaggagcctgtgactttaaatgacaaaggtagagatgctggcatcagcagcctgttagcatttaatttacatgaaattcgattcagtgtgcacgaactaactaggaggcgccaggcttaggccttaggcagacaaagagcaaaagtgtgggaggctgggtggggccggtgagctctggagcttctggctcctggactgggggactgggaatcggccaggccaggcccagcgggtgggagctgcagataccacttctccaggacccatcccagggcagcttcatgggatgggcctggctgagtgagcttcctaaggaaatcctcttgcctggaagaggctcccaatcatctgtcaacttgtctttcctatttagcaaacgattgagattctcttccttaaagacacattctctgatgaacagaatgtgctctgtaatgggtttagccaaagcatccccaccaccttcctccaggaatgtgtatgtctgtgtgaagtcctcaaggtcattagatctcatgaatttactccggcatttccatttccatgcatgctttttccatttagactaaactagcgcttggggtgcttgccatgctccaagaagtccctgcagcccctggttagtgggagacgcagagcaggcattcagtcagcaaatattaattgacgtggtgaggttgtgctctgaaaagctgagttcctcctgagaggctaattcactgtgctcagcctgtctgcgggtagcgagggctcctgagtaacagcgagctttgcacgagcgctaccgcgtggcggtggaaacatttgttccccttgatgaatgaaacggcactcttgacatgctgtacggacagaatctttacatgtcgtttattttgcatttcaaatgctttgaaaaaagccttcccgtggttttggccagaggtatttgttatcagtttaatagatttattcctgttttgctaaggtatgtaatagttatttatttttaaaaaaagccagtacctctccagtcttcattttcatttatccttagcatggtcttttctaaaaagggcatttggcacaatatctttttttgtttttttaatctctaggtaaccaacccctgcctacattttactctggattccaagagtagactgggcttcagggaccagatgccagggctggcacatctgcctaaaacccataattcttgaacttgacgtgctcagcctctccaaagccgcggcgctgacacagctccccctgcacgagtgtacagcagtcagacaggaacggggagagggggctcaactttctgacggccacttagaggctgcctgaccacaaagacaggactgtaaaacatagaccgcatgtgacctgctggtgctcggcactgacccaggggaggagggccacttgggctggaatgcagttgctgggggctcatgaggggctcagtggtgcccctggccaccgagtcaagcagcgtagattgatcagaggagctgagagctgaggcccaccctcccctttctcctacacatggacacctctgagtggaataagggaagactgtcctttctccaagcttgaaggaagatgactgtgactcttttcctggacttcaaggcatcgaagtgtcagctggctgccatcccagcgtctgacagggcagcaggagaaagaggccacctgtatcatccacccgtgctgcagctgaatgggatcggtgcagcatgatagaggccagctgccccgcaccaggtctgcgtgtcacagggcagagtgcatggtctcccttcacgtgcggggccaggtgactgcacagagtgatgagctgggcccactttcctgctattggccgccagcaaagaatacaaggggtttcccttcccttcccttcccttcccttcccttcccttccctatcgacagccttgcagggtggtggtttcctttgcccggagagttcagaggccttagttctggaaagcctcctgtggggagatggagtggcggggatagggaccagagcagagagggcagcagcataaacaaagaggagaggcaaactgtttgagcccaggagtttgagaccagcctgggcaacatggtgaaaccctgtctctataaaaaatataaaacttagctgggtgtggtggcacatgcctatggtcccaggtatctggagcatggggtggtggtggggtggtgggaggatcatctgagcctggggaggtcgaggccacagtaagctaggattgtatcactgcactccagccttggcaacagagagagatcttatctcagaacaaaacaaaaaaattggagaagggatttctctgatttctccctttgggaagggaggcttggaggctgcctggggctgagcagggagcaccatgcttgtaggcctttggggaggtttcgaggtccaagtgtgacttagaggaactgggagatgccagcagacactgagacccaaaggggcctggcttgggacctatgcagctgtgggaggggaaaggccctccccgctaccagatgcagactctggtgccctgaagcctggcgtctgagccagatctgactttgtgtagaagcataaaaggagtaggatgtttgtgatggctgagcgtcatggaggaattcatacctgttcctggagcaatctatttttaaccttgttaacctgaactgtactttaagattgaaactaaatgcagcctcttttctacccatgatttattagacctcccctttctatcaaattaaagctctgcacaaacgaaacaattcatcctcatctaatttataaccatcctcccacactaggaatatggagccaggaatgagggaggttcacgtgggaggtggcaactgcagaacagacagctctttggatttctttaaattgccatttaattccatccatcaacccatttttctgctgtatacatagaaaaggacaacagccactccctcaaccaaatatccctacattcagttaaaagctactctgtaccccaggacatgggagcagctcctatccttcccaggtgaaaaagtgggctttttttcccccttaaggctaaataggatttcttttctgttagctatgggtaggtgacttcttaatgatctttaaggaaagaagtcaatacaaggaaaatatccttttttaatcccattttccttctcaccccacactgagcgttactatagcaacatctttcctgctactaggacagttaagtccccctgtgaagttaaccgaaagctgctttttcactcagagaatgggctgctgttcattgaccagcttttcctgcgtgtctaaattcttcggttctctctgacatgctcaatctagggtttcccgcggctaaaccctaaaattcacttcgaaactcctaacagcagaattccccaaaccttttcagaactgaactcattagaaatgaatttacattttgatttagttataaataacttttcttctgtgtattggtttaagtttagaaaaggccccctgtaaagaagacaagttggagaataatctcccatattcctctgccatcctttctttccttcctttccttgagatggagtctctctctgtcgcccaggctggagtgcagtggagtgatctcagctcactgcaacctccgcctcccgggttcaagcgatgctcctgcctcagcctcccgagtagctgggactacaggcatgcaccaccatgcctggctaattttttgtatttttagtagacacagcgtttcaccgtgtaagctaggatggtctcgatctcctgacctcatgatcagcccgcctcggcctcccaatgtgctgggattacaggtatgagccaccgtggctggcctcctttttcttttaaacacatacatacatatatgtaaaaacaaaagaaaatttcaggaccttccaaatttcacaggcctagaggaaagttaagccctggaaatggagttgtgagagcaggctgttttttctctctggtgcgtgaccactgcttcctgatttttgtgttgagatcttagaccttaaccagacttatagccttcattcaaaccagactgaatgatgtgggaggtagggaccttggtcattgttatctctttataataaaatgctaagcaacccccttagagtgaagtcaacagtagccaatcaaatcttacatctgtgtgttagccgttgtatggaaaacaccgtgattctgttcagcgcctcccttttgcctccataaaagatcttcacttttccccacaccgtaatatttcactggattcttggaatatcagaaattcatcattctttggtgtctgcgtatctctgaatggccactcccatgcagcccttgaatgaattacttaactggatcctaagcattttgattattttagatggacatatacacatgcatatacacgtatgtgtacatacacatatgtaatgaaattgttccaaaacacagaaaatacaaagactaatgtaatcaggactcacatatccacatcttagatttaatgctgatttcggggggcatttttgcttcaaatttgtaaaaagcaaaggttacagacataaagatcttgcgattctcttatcccagtttcttccgtctttcttctcttctttctctttctctgtcccccgaggtagcatctatgctgacgttcccgtatatcttttccatccaaatatttgcatttttgctacacattacgtgcaaggcttttatctgcttcctcctaatttgtgggggcaagaggctagacatctctggctggaaaggcactccctgcagatctgggaagccatgagccacaggagcattagctgttcctctaccctttcgtttctttgctggacaatccttataagctggagtccaagttaaccttcccaaatgagtggcactattattttaaaataaaagcgttcaaggtagaggatgactttgggactctggcaacacaggaagcccagtgtgttctccccaaggtcacattaaaaaggtggtgcatctgagatggtgactgctcagaataaagtgataaggggacaaaaggtggatggcttacttacaggtgttatgaatgagaccatcagggctcgggtaagaacattgtctgggataaatggtttgtggttattgatctggaccaacctgatagaaaagaagctgtgtgtattattattacaatttcttggtttatgcttgcaatttataatttgtatgctcagtcaattctgccaatataaaatagtaatgccccggtttcaaaatctgatattggattttgtcccacgatttagcatgtcctctaagcaaaataactgtccaaccagatcacttgccttcaacaacttaaaacacaagtaactagggagaaaaacaaacaaagaaacataaactcaaagaaggtttcaagattgacatagagaaaaatcttttctcatctatccgtatgtactctcccactgctcatcgtgggccccagggaaaggcgattttattcaaagaaggtaactctgaacgtactcagggccgtaatatgtgaaatgtctcccagtgtttgacaaaaagactctcttttcatgttcatattccatggaaatcttaagtcaaagcaacaataaaataagctgacccataagtgcacgtgttgaagaggctcagccaagaaaaactgtttggtagttgctgaaaactggcatctagacctcaaagaggaaatcagaaccaaagtgcagacttgtcccaccagagatggtgggtgttggactgagtcagcgacagtgaggcactgactagacttccgtaaccagccatactttctagtttataatgacattcatggttattgttctacacagacaggtgtagggaagcaatgggaaagtgcaggaaaacagaagcattgggaatggaacatctttggtttctccatttcaatgcactgccatgacccccacacccacccacgagactttagctgttccagagccaacggtgcctgcctctttgctgatccattactcattctccctacagctgcctcatagctttggctcccaagaggtaaggtacaggtagtctggctgcctgcattatcctccagcctcaaaatacatggggaactgaaaataaacaaactgttgattccttgagcttaagaaggcctcttggtgttcctttataccttttcgagtctctcctaagatcagagagaggagtgaagagggggaaggtgtatggccaaaggaggacttgccctgattgccactggcaaagacgctgagccttagggaccatccagaggcatgcaggacccctgctgcagcattcttgaaaaatgatgtcttcctacgcctccctgactcaaccagaagctcacaggtaagaacacatcccatgttgcgaagctccatctattgtgagaacttctgccctgccggctgcctctgacatgccacatgcaagtgataccatttaccctactttgcaatacataacaatctgcactggtgtttccaatgcccaattgttttcttgacttctccataagtttcagcatatctataaaccactcataccatgatttacttaatgttttctttttcttccttttttttttgagacggagtctcgctctgtcacccaggctggagtgcagtggtgtgatctcagctcactgcaacctctgcctcccaggttcaagtgattctcctgcctcagcctcccgagcagctgggactacaggtgcccgccaccacacccagctaatttttgtatttttagtagagacagggtttcactgtgttagccaggatggtctcgacctcctgacctcgtgatctgcccaccctggcctcccaaagtgctgggattacaggcgtgagccaccatgcccggcttgttttcttaatttaattaaaattattccaaaataaatatcataccattaatgtaaatagaaaacactgaattgtgttacttgccacacatagaagacaactgcaaaaaatcaacaatatgaatgatatgaaagtcaaacacttttgcctgtggaagagcccagggcctgcattcttgtttttaaagaggcaggtaagcaggtaatagagaagccttgaggactagaacagaaccgatggaaagagaactggcaaggggctaacttctgcatgacgtgtttccatgttatttctcttaggtcccagcaccgcagaaaatcatcttgaacacctcccaaggccaatctcccattgcaacaaatgaactattaaaaacaggggtctcttttatcctaccgtcatctcatttccagataaaacacctccagtttcttcaatgacttccacgagaagacctctctggagaggtctgaacattgtcttctgtcagctccctcttgattttgggaccaagcattgaatataaagttaggatgtggcctgattagcataggcagagtactgagaagccttccttgtgcctgtcactacacttccatcaacagactccatcaacaggaggcaacgcagcctcaggataccacctgcccacggcccacctgagggaacctgctgcccacagcctctgctcccagagggacctacccagtcccaaagctgaggcaccacccatccttgaatggccagagtaacctgtctcaagaatatgagcaagatgattccaagagaaagtggcagtcaacagtggttttgtacaatgcggataaatattagaaaggccatccaggatgcgtcatttgcaagcttgggtggacaggcagctgccaacagtgacagcaggtggcccatgagtgaaacttagagaattaggggactgctttggtcttggcagatttcctggccagtccatggaaccctcaaaataggtcccttaattttgtagaaaaatggtgtcacctttaaacgttgtaaactacatttataaatttaagacattcttttttttcttttttcttttcttttcttttacttttttcttttcttttcttttctttttttgggatggagtctcactctgttgcccagactggagtgcagtggcatgatcttggctcactgcaccctccccctcccgggttcaagcgattctccttcctcagcctcctgagtagctgggattacaggcgcaccaccacacccagctaatttttgtatttttagtagagatggtctttcaccgtattggctaggctggtgtcgaagtcctgatctcaagtgatcccacctcggcctcccaaaatgctgagattacaggcatgagccactgcgcccggccttaacacactcttaagtacttccaaagtctgatttaaaaaatagttttgtttttcctgaggacttaaataacttataaataaatcaaagcaatagatatagtgcgccttaagttctctgaaaggctttgatactgtttacaaactttgtcagagttcaatttaatatccctagcctcagtcaattactcaattgtgtttcaagctaagtcacaaggctgagctgtttcactaattaaccacattcctttagaagttcaagtatgtataaattccttaatacaaaatattggttctgtgttttttaattctttaaaacatttctctacttaattctaaatcttttagggtgaaagatgattagctactaaggaaactattgcaccatcccacacaactattttaggtgatgttcctgtattatttttgggattgtcctctcaatttgcttgtagttgcgttataatcaaaacgtttagctggggtgctgactagattcttcatggtgaccaagtgggttccatggagccctatttatagttgccatagtgatgattccataacccacaggcgaggggcagggagcccttgactttaaatccaaattctctctctctctctctctaatatcatatatattttatatatatataaaatacctccattcaagtcacttggcagaattttgcactattgtgctcttaagatataaatatatttccatctcaaggtcacgtcaggcttaataaaattctgtattgtcaaagtctatacaggaccacacacattcttcgtgtattcaatcgcatttttgatatctctcatagccatttttgatagttgcaaattctaaggccattcattcccacaatctatttgatgaaagtttttaaaaaatggaatattcaatcctttatagccaatgagggcctgagccttgaaccagtgaacagtactgagtagcagttaggagggcggggagtcagactgcctgggcttaacgtcgtggctctgtcactcatttcgtactcttaatcatcatgctatagaaactcccacaatgtgtgtgtgtgcatgtgttattaaatccttcagatacttctcagactcttgcctgtgtagataaacaacgtgtgttttctatcaccttggcttgtctctagtacctggttttttaaccaaacattactctgggtgttgtggtgaaggtatgttgtagatggggttaaaatctacaatcagtgggattgcccttgataatcttaacgggcctcatccatttagttgaaaggccttaacaggtttctcagaggaagaaattctgtttcaagattacaacatcagctcctgctccgttcccaaccttctggcccgccctgtaggattcagacttgggggcctccatggctatgtaagtcaattctttgaaataaagagaactccaactaatgcacaacggtcggtccatccctccctccctccctccctcccttccttcctcccttccttcctttcctcctcccctcccctcccctccccttcccctctccccaaattcaaaaaaagttaactttatgattaccctttctgggaatactagttgttactatacacattattcacatagaaaaatcagtaatgtaccagttggtagttgaattcttcagagggaaagattagtatcttattttttatttaatgagatgaggaactaaaagagcattactattctttactacaatatataacagaagtgttttcttggtgtctgcaatgcaaattctgatgtcagtaaatacattgagagactaatttgtcaagcaagcacagaccacacatggtttctttttatttctttctttctgagatggaaggaaacctaaaagtaacaatgtacacaactcgctagggttgccagcagcattttggcgatgtccccttgggtcacagaacggcagcatgggttctataggtcggggtggcattagcactgacggcacatagcctgtgtcttttgagctcactttccatgttatcctaggtcctgtgaaagaaagacctcaggctcacgttattagatccttgggtaattctccatactctgaagttcttgaagaaggcactggctggggttagggtggctttgggaaacccttgactgcttgaggaatcctttccaattccttccttaaccaggcaggaggaacagcagttcattcgtggtcttgagtccaggttccaggttctaagcttggtctatgcttttggtgtgctctctaactcaatgataatgatagtcatggaagtttcttaatatctggggttttgaaactgttagttcttggagcaagcccaagtttattttgggggaactttgcgccagcattgtagttatactgaaatttagaatatgtgggttgaaaagcaccaaagccagtgtgagaaatccagcccaccattagggctactgaagtcccattaggttgactactttctggaggccaattgcacttaacttggattcctgagtgactttctctggtccataacttcatctaggtcactgctgagacatcacctctccagtaaaaccatctagcctgtctaaagtcatccttccactcccccagttgtctcagtttctctgtcttttcttccccagctatatttttcttcataacactggtttctctagacattatattacatctagatttgtcatatcctgtctctcctattagaacatagacttcttgagacgatggactgtcagtttggtttaatttgacacgtgttttttttttttttgagatggagtctcactctgtcgcccaggctggagtgcagtggtatgatctcggctcactgcaacctctgccccccgggttcaagcaatgctcctgcctcagcctcctgagtagctggaattacaggcgcctgccaccatgcccgactaatttttgtatttttagtagagacggagtttcacaatcttggccaggctggtcttgaactcctgaccttgtgatccacctgcctcggcctcctaaagtgctgggattacagatgtgagccaccacgcccggcctgacacgctgtgttctaaacacccagcacaatggccagcatgcagaaaacactgcagaaatatttgctgcatgaatgacttgctatttacatcagcctactaaatgctacccagtgagtagaaaaatttcaaatgaaagcatcctaatcattcctttttttatagaggcctatcagtgtaggctattctagtggaggaaatcacatccggtccctggtgccatgaagttacagaaatattaggtgcaggccaggtgcaggggctcacgcctgtaatcccagcactttgggaggctgacgcgggcagatcacaaggtcaggagaccgagaccatcttggccaacatggtgaaaccccatctctactaaatacaaaaaattagccaggtatggtggcacatgtctgtaatcccagctacttgggaggctgaggcaagggaatctctcgaacccgggaggcggaggttgtggtgagctgagatcgcgccactgcactccagcctggcgacacagcaagactccgtctcaaaaaaaaaaaaaaaaaaattaggtgcatacaaataaatacatatacacatactttaactcatatcaacatattatagagaaacaaatattgaaaagaatttcaaggctggccatgtgtgtttatagtttcttccagttcaaaatcactatgaaaaaatgttttcctaaggagaacgttggcctctaggggaagcaaagggctcctgtgttgtgatggttaatattgagtgtcaacttgattggattgaaggacgcaaagtattgttcctgggtgtgtctgtgagggtgttgccaaaggagattaacatttgagtcagtgggactgggagaggcagacccaccctcagtcaggatgggcgaaattgaatcggctgccagtgcagctaagataaaagcaggcagaagggtgtggaaggcctagactggctgagtcttccggctttcaaatttctctcgcattgaaagcttcctgccctggaacatcagactccaagttcttcagcttttggactcttggacctacaccagtggtttgccaggggctctcaggcctttggccacagactgaaggctgcactgtcggcttccctacttttgaggttttgggagtcagaccggcttccttgctcctcagcttgcagacagtctattgtgggacttctccttgtgatcgtgtgagtcaattctccttaataaatgccccttcatatattcatctatccaattagttctgtccctctagagaaccctgactaataatctcccacatcaccagcttgaatcctgcccaagaataaagaggatcaaggacagggcactgaactgtaccaaaagaaagctgctctttgggtttgcgaatgctgacctgggtctgctttgtatgggtggtcagagggtgaaagggtctggggtacatgcacatgacccttcctcttcctcttccacccacatgcccagagagctcagggcttcctcaggagaagagatggtctcattgctcagggaaccttttctcctaggcaaacagaggtagtgtggcagctggaagaggcctggagtggtacttggactttgaagccaaacacttgccctctcagagcctttgcctccactgtggtcctaccagagagctgagttcaggacctgggtttgggcgtggaagggcggtgtgagagcaaggctgaatagtccaacttcctcctttaacaaatatccactgagcgtcttcgctacgcaaggctctcttccagaccgcttggttctttggagtccaggagttctccactcggtacacccagttttaccaaagttaaacccatgagattttgtaataaagccaaggctaataataatgcattccattacttttcctacacatgtgtctctgttaagcactttgcaaggaggatgggcagctgggccaatgcaggatccaactattcaagattcctccacttacacaatatattgacactaactctgaatgcatccctactgaatagagaactctagtaatttctactgaaaacatcaaataaaaaagctactactttaatagaaattacctcttctaattgccctacaatgatacaactgtattctgaaaggatacatggatgtcatataaataactcaaaattcatgtttatatttatgtacagtgcctagaacaatgataagacatgactgctgaatgtgtggatagatggatgggaggatgaatggatgcatgaatgaattaatgaatgctctgtgatctgagggctgaagatacattactgaaaactccaagaaggtcagaaagcaaaatcaaggaatatgaaaatctactgttaggtacaaacgtgtctctagagaagagactggttctgaaaatagggagaatgggaaccaccaacttcctgtgtgtgtgttaccacactcttaatatgaaaacatgtgtgataagaagtccaacattttgtagatgaccgcacatgtaagttaaagaaatagtggccttcttttgtctttcctttgtagttttttgggaaaaggacgccaataatcaaaagacctgcagaaaaggtgatttggtgtttcaagggttgtgggcttttatgggacacaagctgaactgtcatgcagacaatgaccgccttctgatttacttgggctgctcaaaactctggaaagaaaaatagaatatcctagctgttatgggaatacttataagaagaaaaagagaaatacagctctttgtacattcagattcctttagcttgaaagaaaaagggtagcctcctttaagaaaacctttgggtttgacagaacataaataaatcttagtgcagctgcttatcgagctaaagaaggcctggtgtctctgctgccacttacagatttcagaaacgtgttgtcattctttaatcatgatcattattggagaatatgattgaaattttaattattaagtagggggaattgtgaagcactttcatccagcatctcgggtgcctggtgtgatcgaccataagtgcagctgatgcaaacctggaagccgttatcacagctccctggccctcgccgcggtggaggcagccgtctgtctacctcctgccggctgcctgtctcctaaaatgtctgcatgctgtttactgcagagccagtgtttgaaccaaatgctcagtaatgtgaaaacatcaattatttccttcctacatttaaatgaactatgattacccttgatttaatagcaaaggagcatttccaaggtacaaaaacatttcagccattaagctcaaagtttgtgtttaaaatatatgtttgttttcttctacagagcaatgggcactaaatttattagcttcgtgctcaccatgacagtaactccatgtctgtggaattctgtagtctgcatgtgttaggctgtgggtaggcaagcttgtcaatggagaaatactgactttgccagaaattcgtaaatttttaggaaagtgaagagcatatggtcactatgacttgctagtatccttggtctaaaccttataattaccagaagccattttcatgtttttttttttctttttaaagtgcatatctttatttggacagcctcaaatcccttcatcttatctggagggaagacaggaatgaaaaccatgatagtatccaggagggattttaaggcaaggctgagctttctaaagctacaagcacttccttcctcagagagtgtctgctgacagccagggccttgttagtggcccagtagccaaaagaagctactttcagaagtggtacttagcacctgccctcagtgatcaccatttttcaggtaagacttgttctccaggttaattacagtggaaacctgatcgaacttgacagtcagtgtgtttgtgggcttctcttcctgccagtctgcaacctaaaggaaatgctgtggtctctctcttaagaatgagaacattctcagaaatgcccttgaagtgactattaattccagaatatggtgtgaattaagtaattcatttggttttagtttacttttgagaaagtccaagctgtgcacatgttgaaataaatcagaggcctgtttacaaatggagccaccatttcttagtgtggagtgcagggacctggttctgagcaaagtagtgggaaggatggaattccctgaatccctggatctgttcacaggaatgcctagagcttctggcacacagggtagcaggccttcctgatgccccagcttctctgagatccatcctgctgtcagccctagaactccctcacaagcaagctattttcccgtttttctcatcgctgtttagaggtttccacttatatgtagatttgtccagggtcctaggaaactagctaactggtgccaccataacatttgctataattataacagttcagttatttggttttctctttgtctccttcttcataatttagaggctttcaatgacttacccctaatgggagatttctggcccagaaatgggtcagcagaaactattatattgaaagttggtttcttggtgctgcttacattattttatttagataagaaaatggctgttgatattttgtaaaaaaaaaaatctatttatccatcaaatcacatatgcttctttcctttaattcaactatccatccatcagtccatccatccatccattcatccaaccattcaacttttaatgtgtccccacagggtgaagcaggcatggtgcaggaatagtacgaacaaatataaacagcaattgatcctaccctcaataagtcatctgcttagaggacagattttggtggtaatacaaccaaagtttataataggaatataatccgtgttattttaggatgtcacagaggttgcaacaaaagattattttatttaattcttgttgatgggcaccgtgtgtttacagaggagagtgcctttgaccaagatcttgaaaagtgggttagatattgcttgggaataatgggcaaaggaggtgccatactccctctggatagtctcaggcccaaatatccatttaggatctctggaatataatgggctatacttggcattggagtcatttagaaggacacaggacaagaagcagcatatcagcaggaagggccaggggacacttctctgaacccccgtgatcacttgggtttggggaaggagacatgctggtaggtaaggagcaatgctggggtagaagccccaggtgccacatgtgctggcaggagttccgggggcacaaggccaagctgaagaagacacaacttcatcgccgtgagcatgacttccagggatgtccacagctgtggcttctcccaggtatttatagttcatttacagtcctgcctgtcaagatcccacacaccaaccaagagttatcttttttttttttttcttcagatggagtctcgttctgtcgccaggctggagtgcagtgtcacaatctcggcccactgcaatctcagactccctggttcaagcaattctcctgcctcggcctcccaagtagctgggactacaggtacgcaccaccacgcccagctaatttttctttcttttttttttttagcagagacggggtttcaccatgttggccaggatggtcttgatcacctgacctcatgatctgcctgccttggcttcccaaagtactgggactacaggtgtgagccaccatgcccggtccaagagtcatctttatcataagtacttactgtctattaaccccataaacattccacctgcatcagtttttcagaaaacagaactgaacgtcaagtttgtcctcagggacagagaaagagttttgctagccagtggctcagaggaagcagcggcctgtgcaaaggtctggaggtctgaaaagtactcagtgagttccggacccggaaatggttcaacatgagttaagtataaggtgtcgctggagatgagggggatggtggagagggagggtaggtggaagatgaggccagagggtccagaaaacaaagtagatggtcttaaggagctgaggtttttaagctctagggaatcactttatggggggtgttatgagcatattttatggtatggggataaaggatggattactagggggaatacactcaaggcaggaagagtgtaggttgttccagtagttgaggtaaagagtggggaccctgagttaataggaaagaggaggtggatgcaggaatcactggccttctggaatcaatcagttatcagtcagccactggagataaaagggtctggaatacatgcacggaggattctaagtgccactcattgcaaggaccgaggtaagaagagacaggacagggttgcatgtgggtgagggaagaggtggaaaaatgagctcaaatattgacattttacatttgaaatgcttatgaaaattccaaatggaggtatccagtaggcaatgtgaagtataatccaggagctctagagaatggtctagttagagacacagacttggggcctatcaactataggcagtcagaactgcagaaatacacgagaaggtctgagggagggcttggcttgaagagaggaccaaggatggtcaccttgaaaataacagcggttaaagggcaggtggaagactagcttgcaatgtgggctgtgaaggatggcaatggtgggggaagatggctggaaaggtgggtgagaagggcacccacaagctagcaggggagggaacagtcaacagtgccaaatgccgccacctgcaatgagcggggactcactacggtagggacctacacatgctttgtctcatccttttcatctttgcacaatattagcctctactgtcttccaatatgaccaaagtctagtccatctagagagatcagatcaaaagtgagcctgaatcatttacatctaacaatgttatctagacagcatgcttttattctgaatcacctgaacttccagctatctgtggtttataagctggcataagctggcatttttcagtcgaaataccacagggagaggtattttaggagctgatttggtattcagttaatactgtagaacgtgctcttccattaccttgaagctaatgactagctaaattagttatatggcccaaagcaaagataagatggttagtatgtttgaccagtcattaaaatgtgtgtctttctggaaaaatattctctgaagtgaaatgacaccatgatgtctgatcagcaatatagctcacccttattttaaaaggtctactttgaatgtctccccagggtgatcatattaaaaaaatcaaaatttaatatgtcattaacagaggttaacttgctgaaaaataagctgaattcgttgggaattgctgctaaaacattctgtagctggaaaatatcaccctgtttctctggagaacggtagcaataaaaacacacagaatacactttcatcccaaaattggcatactttaaataatccatgatttttttgttctaaactggcttaataggtctgaggccaataatattttctatttcctcaggatttcttcactcagtttttttgtttggtagagcacttagtattaacaaggcactacagtaggctataggggcatgaagatgtcagaagttctatgtatagtagactgcaatgtactggaagcaacaggaaagtcagagagataaatacttacataaatactaaatagagaaaaaactacctaatgagaattatgggtgactgagcaccaaggggttccaaggtcagtgtgagcccttctggctggagtggtcagtgatatattattgaagaaggtggcatggggcaccagtagaattcctgaggcatccagattcagcacggcctctggaaggtgactgccaggtcagcttcactgtcagctggtgcctctcctgacccctcctcccttgttaccaaggatgccaaaactttcccagctttcagaatgacgactgtttggttctacctggcttatccttactgatcctgcctaactggctcttgaatcatgttttccagaggtcaactgagtctaagaagacattaaaaatcctgaaattggccatatcatcctgcccctccttgattttggacaggatgcatttgggatctggcagcacttttctgagggcatcaactaccaaggttggagggatctttacatcaacctacactatacctaccagatgctttctttgaccatcttgatatccagatatggagtattcccatttcttggttcccatggactgaaactttacaggtaaaggccaaagttttgattcagcatgaatgagaaattcaatgtactataagctggaaagacttggctgaaactcagccccagctaaagcaacatcagaactgcatacacagtggtaaagatcaagtgtccactttggaagtataatctttatctagtgatcacttttccaacatttccatccaaattttggaagcacctaaatccaagccctgcaactatcccacaatattatagtattattcacttatatttaagatactgtactccatagagctaggatggtagacatcaacatacagagacctttagggttttttttgtttttgtttttgtttttgtttttttgagaaggagtttcgctcttgttgcccaggctgaagtgcaatggtgtgatcttggctcagagttttgctcttgttgcccaggctggagtgcaatggtgcaatcttggcttaccacaacatccgcctcctgggttcaagagattctcctgtctcagcctccttagtagctgggattacaggcatgtaccaccacgtccagctaattttgtatttttagtagagacagggtttctccatgttggtcaggctggtcttatactcccgacctcaggtaatctgcctacctcagcctcccaaagtgctggaattacaggcgtgggccaccatgcccagctggtactttctcaagccagggattggattgggaaaactgatggagttggccaattcctatggaagtcacatttcattcctggaaactttgaatctcagattttcttttttaaagaaacttcatctatatatcatttatataatatgaaatatgtcagttttaattgtatactttgatgagttttggcaatatatgcaccactacaatcaggatgtattttataacctttccatgttctgaaaaaggttttctcacgcccatctgcagtcaacaccatcctatgcccacctagcctaaggaaatcattgaacttctttgtgtaactacagtcttggtattggtaatttctcagaaagtgtaaactcatgttcattagcagacaaatagaaaaatgaattaccaaataattaaataatgccttgaagggctccaaagtaagtcacacctcaaattctgacatacaggcccctaaggtctcttatgaatccccagtgaaacgaattagtcaaatgtcaggtaaaaccatcaggcaatacacaagttcctccaccttggcttccccacctgttgcttgctgggtcacttgctcccctttgcttagccagttcgacccacaaaatatctccttggaagccttagctcttcaaggaggtgacaactgcttctgcagagctcaggtccttgtggtcaacaaaagcgataggctgcgatcctctccaggtgagctgcagaggttagaaagcccttcaatcactgactcttgcagcttggagtatgcaaaaagtcgcagcgacagagacagcagtctagacggtgagtcttctttcataccgtcgagactggcccatgcaggacctgctttaggcctttctgcctcagtgtttgcttactgctctagttctttttgaaaggcgacatgctttctggcttgcttcttttggtaataatgatgacttcttaacattgggattttaaaaaatcatcttggagctgacctacatttttatacgttctgatgttcctcattccttcgtacagatctgggcttcacttcatatcctttcaacctgcagacgtgattttagtatttcatgcagtacaagtctgatggattctgtcagcttttgtcatctgaaaatgttatttttgggggcctttcttttggggatttttttttttttactagacatggaattttagtatacttttttctttccatatcattccattgttttctggcttccattgtttttgatggagaagtcagccctcactcttatcaccgtgctctccatacaatgaggttccctctggcagctcttaacattatctccttatcttgtgttttcagcattttgactgcaatttgttttaacacattgttttctttgtaccgctactgcttaagattcactgtgctttttgggtatttaatttgatgttttccatcagttttggaaaagttttcaccattatcttttcaaatatttcttctggcccattctctttctttttcttcttggattccaattacacagtgtttgatattcaccagatcttggatactctggtctatgtttattactttttttcactttgtgtttcctttctctccagctttattaggtataattgataaataataatcatatattcaacacatacaaaataatgacttgatatctgtatacactatgtaataattacaatcaaattaatcaacacttctatcaccacacatagttatctttgtgtgtgtgtgtgtgtgtgtctgtgtggggaggacacttaagacctagtcttagcacatttcaagtacacaatacaacattattaactctagtcaccatgctgtacattagatccccctgtgtttctatttgaacagtttatattgaccgctcttcaagatcattgatacttacctcttctgctcagtcttctgttaacctgttgaatgatttagtcaattctgataacattctcttccaggaaagtcttattacttttagtaattttcttcacttaggttttttttgatctcagctctctgatgggttaaaaaatctctgaaactatgtaagctgtttggcttgttctttttgttacggtagaaatctagaaaatagttttatcatttctcctccagtcaactagtttctatttttgcactcatctgctctgatctgtttaggcagaagcttaaacaattctgcttgctcaactaactcagacactgtggatgttaggatgaaggtacagtttgcatattaaaagataagccagtacatctctgagatttgccatcctctctggtaaggactgcactcaaagtaacaggagggcctaaccttaaataaatatgcagccatactgctagggcaaacatccacacacagacacacagacatacaaacaacccaaggacaggctttctgacaagtgattgatagatttatttcaaagctgtcaagtagagcccaaaaagagtggaatctcagggttctcttggcaagactatggttctcagatgggcatacaagctttttcctttctgggacagtcacacgaagttagttaatgagggatttttattcttttgtttctggtggcagaaataaaatattcttttcagggcaaaggaatgaaatctcatcaagaggttcctgtctagattcgcgtccttatatacaagccaacttctctctgcagaatgttctacatcccagaaaccaggattgtttgccactgatttcattttcttctcactgttgcctctggattaaaaagcctctctcattactgctcatcagtgtcctgctgctgggggagccatttgtgctgacgaatagttgtttttttcaatgtactgggaaagtggcattttgagagagacttcttccatctacacccttctgtcttaagtataattcactcattcattcattcattcacccattcatcagtaaatattattgagagtggactgtgtgcctggcactgtgcggtgaatttgatatagacacatataatacgaacacgattctagccctatggagtatatacgttattaactgataagttcagtccagcacacacttaccaagttcttgtatgtgctgggcatttaagagtgtaatgacgagtaagatgggcatttctctgtaagcatatggtccaatggggaagacctagatacaattttaatacaatgctttactgttgtataacagagaaacatgcagattgctatgggaatgcaggttgagaggtgctgagcctaaaaggaggatacagggaaggcttcctggagatgatgacgcttgagaggagtctcaaaggatgtgcaggagcgacagaggctgcaaatgcctgcccaatattcatgttcctcttcttcctcagtaacagaacaccaactatgtgcccagcaaaattctacttttccagccttgcttgcattagggctgatcagtgagctgtgagtagagggtttcctggggattccagggagctacattctcaggaggaatggccatggctcccttgtgaccatggaggtcccacactgtccgtcagttgcatacttccagcttttttttttcatgtgagaaagagtaaaattctattccttctcactcccttagcctacactttatttttatttttagttttattgagacagagtttcactctttcaaccaggctggagtgaagtggtgtgatctcagctcactgcaacctctgccttccgggttcaagcaattttcctgcctcagcctcctgagtagctgggattataggcacgcaccaccacacctagctaatttttgtatttttagtagagacggggtttcgccatgttggccaggctggtcttgaactcctgacctcaggtgatccgcccgcctcaacctcccaacgtgctaggattacaggcatgagccgccatgcccagcctcttaccctatactttaaaacaaaaacaaaaaaaaaacagccaaacctaatcttcaatctgaaatagtgtactacgccaggtgtagacaggaagagagaagaggcagtgggtctgggaaaatactcagccttgaaaagtcaaccataataaatgtcaaatcctacagagtatcctttaaatggcaagggggtacttcagcctgactccatttttgcctcactccccatttattgacatgtgcttattaacatgtttagaaacttaaaaatgcattcatcctttactgaaatctgcccaatgtcgtctgctattatttcaaatactcatatttcaggaaggctcagatttaagtgaaggtgtcaccacagtctaagttaccatctcctgtccttgcatccatggccggggaattactctgctatttaccactaatgcagctgccgggaggatccagcctcagaggacttgggtatgttcttctcaaggacaggaaagtcatgcacagtgtatgttcattcatttgtgaagttgtccttgtggccacagttgaaggccctcatgctcactgtcagcctatacacctgtcagtccttcccataagacatactcaacaccaacctggttaactgataatgctgactacaaccaaggcaacttcctcctactttaaaacccagcagtacacaaatgggcgctccctacaggccaagtaaaattccttcatgcatctcctaatgactccccaccaaaatgctgccaaagagtcaatactgccacctcccccatgtctgtgtactcatccctggaacttatgaatatggtagcattcatggtttggttctgtgtccccatccaaatgtcaccttgaattgtaataatccaccatgtcaaggatgggaccaggtggagataaatgaatcatgggggtggtatcccccaggctgttcttgtgatagtgagtgagttctcagaagatctgactttttttataagaggcttcccccttcactgggcacccattctctctcctgccaccctgtgaagaggtgccttccgccatgatgtaagtttcctgaggcctccctagccatacagaactgtgagtcaattaaacctcttttctttataaattactcagtttcaggtatttcttcatagcagtgtgagaacagactaatacatcgcaacgggagtttgcagaaatgagtaggttaagggtcttgaggtggggagataattctggactatccaggtgggtccagtgaacaagagaaagagagagagagagagagagagagaaagagagagagaaagagaaagagagagagattgaaacctgaaggttactttgctggttttgaagatggaggaagggacctcaagccaaggaatccaggcagcctcaagaagccagaaaagggagaaaagaggattctcccccacagcctccagaaggaatgcagccctgcgacaccttaactttaggacttccgacctacagagctgtaagaaaataaatctgtgttgttttcagccatgacatttgtgataattttttacagcaaccactggaaactaatacacatattactgaactgtgagaggtagaggaccactagcctgcattttctcatagaagctatagcatagcattaataatagtggtaataataattgttccgcttaaaaattagctaatgcttgcaaagtgcttactatgaaccgggcattgctaggctgaacatccaacatacatagtttccttcaattcaccaaggtaggcactcttaaaaaacacccatttaatagaagaggaaagtgagccacagagaagttaatttgctcaaaattgcatagctaggaagtgaactctggctagggtctaaacctagacagtctgagccttgtaacctacactaaaataatggtgtacagtctatgccacataatttttgtgtttgattatatgctttagttatattactacctttgctgtcataggcccattagggtattatttaatgtagtcactcatctaaatcttcattcccctcttcaacggctctacccagtgctcatcactcttctgctggagctgggagtggtggaagacctgaggttttcctctaggtagaaggaactcccattatgaacactcaagagtaattctcaacggatcagaacttcctgagagcaggacactctggattacctgagaagcactcccagtctaaccctttgacccactcaagagatgtcctatgtcttagagggttctgccctggccctcctctggccacacccctcttcctggagcaaagagtctgtggagctaaaaagctgcacccacaacagcacatgcttgcccttcagactatgccccaggcacctgagccccagaattccctgcccaaatggcctgggcttgattcagggcttgtgtaggcagcttcctcccatctgtccttctgagagtggactgttccagtgatgtgcctaccctgagcccgaaggctgcctgaagggctgccacatgtaggggatgtggatgaatctgagatttgtgggctgggtgtctgcctatgtgtgtgcagagaaccttctaggcagggcagagctagacaagagaaggggtctgggctgactctcccagttccactaagttctggtaaagaattctgaggggtcagagaattctaagttagaatctggcctctaaggtccttatgaaggtgtactccttaaggtaagaggatagcatgtattttatttaacagcttgctagtgtgatttagaatttttaaacattgagatgagggccatgtgaacccacacttgtcttcttatcccaggtcctgcaaatgttaggactggactaaccactccctctcaatagagggagagacagagaaaggccaggtaatgaatagagtgaaaaatgtacattagaaaaatgctctttcaaaaagcctagaaagaaatatagccaaacattagcagagtctgcaatgtctgagttttggggttatggggatgttgttttatttcacttacagatatacacctacgtaagcagctttataataagaaaatatttgtttatgaattcaaacttatgaatattcaataagttcccagtataatgtcagcattagactaggatgaaaaaccaaactaaaccaaaccaaatcaaaacaacaaatcttcaagacatgaaaaagaaagaaatggagaaatatggattgggtaatgaagaatgtatcctcttaggcactttcattaacaacttgaaaatagaccttgacagaatgatgacctaatttctatatgctcttgaattggatggtctatcggaaacagaatcaggattcaaaaacatccccccaccgtctgacatcactgggtaatctaacaagattacagaaccgacttttagagaagagtttaaatcccagtactagaatatatgtaacagctatattggctgtgggagttatagcttaacagaacatgtgtcataaagataattaacatacaataaatgcatctatgaaagattaaattaatctaaggtaacactaatagaaaaatacagcataaactgaaggtgtggatagttttcttttgctatgtggtggcaagacctcacctggaatctgtttaatttcaataccaactttgggagacattaaaaaaaaatactgaagcctatgaagaagaagttctctctcatttgaaaaatttttgaaaaacctaatctagtattttgaccatgttaagaaggaaggacacatgcatgtttggaccagggtgttttgtagagttggtaatcttcttcatggcctgctttaatgactgaaggataagcccttcacagaaggactaaggcttccaagtaccccaggacaacagagggaggttgattttagctagatataaagaaaaacgttgtaaaaatcagaactgtttgaaaatagaatggatgcctttagaagagagcaagtcttacttgcagaacgtgttgggagtttaaggaaacccaatccatgacacctactatccctgtctcagcttgaaaagaaaaatgggtcaactaatttttgacaaaggcaccaagaagacacaatggtatctggataggataatatcttcaataaatggtattgggaaaactggatatccacatgtaaaataatgaattgaacccttagcttgtatcatacacaaaaatcaactcaacatagatgaaagaacttaacataggacctgaaatcataacattcctagtagaaaacacagggaaaccccatcgccttggcaataactttttggataccacaccaaagctcaggcaacaaaagtgaaaataaacaactggactacaccaaactaaaaagcttctgcacagcaaaggaagcaacgaacagaatcaaaaggcagcttacagattggaagaaaatatttgaaaaccatgtatttgataagtggttaatatccaaaatgtaaaataaatgcctacaactcaatagcaaaaaaccccaaataacctgattaaaaaacggacaaagagcctgaatagacatttctccaaaaaagatataaaaatggccaacaggcatacgaaaaggtaatcaacatctctgaccatcagggacaggcaaatgaaaaccatgagatagcaacttatacctgttaggatggccattatcaaaaagacataacaagcggtagcacgggttggagaaaagggaaccctgacatgctgttggtgggaatgtaaattgttgcagcctttatggaaaacagtacgaaggttccttaaaaaataaaaaaatagaactatagcaccatatgatccagcaatctctctgctgagtatatactcaaaagaagtaaaattagcacctcacagagctgccttcttatgttcactgtggcattatttacaatagcaagatatgcaaacaacctaagtaagcatcaaaggatgaatggataaagaaattgtggaatatattatatacatatatattagggagaggggagcattatatatatagatacctatatatccataaatttatttatatacatatatatatataaaatggaatattatcaagccttaaaaaggagattctactatttttggcaacatgtattaacctggaggacattatgctaagtgaactgagccagacacaggaaaaagtactgcatgatcttacttacatgtggaatcttaaaaaaaaaatgtcaaatatatagagacagaataaaatggtggttaccggaagtggtggggggaattgtggcagaaaatggggagatatgggtcaaagcatacaaagttacaggtaggacaaatattctagaaatgtactagaggactataattataatattgtataatgaaaatttgcaaaaaagtagattttaggtgctattactgtatacgtatgaaaaaagtaaccatgaagatgataagtatgttaatttgcttgagtatagtaaccacttcactatgtataaatatatcaaaatatgttgtacaccttaactatatataatagaaaaataagtaaataagaaaggagagcaggtggagtggcatttttatatacaagatcgctaggatggagggcatgacttgtgtatgtagactagcgggttttctaatatcaaattttatgcttgtggaaatctatccacccaagcttaggcagagccagacttcctcgaaaaacagagcagaatataagttctctgcagagcatctgctaccaagaaaaaaatgggcgtggagcatgatcagtttactctttccaaacttaccagtaagtcactccacctctcctgtggtggcatggatttgtattatggcgccactgtttactagtaccatgtacaagtaaatggtgcagtcatgtgaggaatgaattggctactccacggaagtgcccagcacagggcctggtgtgtaatggctcttcataactcttaccttgttggctaccccatagttattctccttcatcttgtctttcctgctccaaccatagaccaagcctcttgtttcctataagattgagactggtaacaggagtccgtggagcttgtgaacttggatgggaattaattatatatttaatatcactaatccctacctgaagtttggtgtttccttcagttataaacataggtatgaatatcagtagtgttagtggtatctgtgacttagtcatagatgagaatcacagatatcttcgtatgattttagagcagctgtagacaccttgaaataccaactatgttcaccattactttttttttttttcggcaatggagtctcgctctgttgcccaggctggagtgcagtggtgtgatctcggctcactgcaagctccgcctcgtgggttcacgccattctcctgcctcagcctcccgagtagctgggactacaggcactcgccatcatgcctggctaacttttttttggttttaatttttagtagatactgggtttcaccatgttggccaggatggtctcgatctcctgacctcgtaatccacctgcctcagactcccaaagtgctgagattacaggtgtgagccaccacgcccggcccactattacttatttttattttttgagatgaagtctctctgtcaccagactggagtgcagtggcgcaatctcggctcactgcaacctccgcctcctgggttcaagtgattctcctgcctcagcctcccaagtagctgggactacaggcatgcaccaccatgcccagctaatttttagtagagacagggtttcaccatgttggccaggatggtctcgatctcttgacctcatgatctgcctgcctctcaaagcgctgggattgcaggcataagccaccatgcctgacccactattacctatacttatagtagattgcatgtgatcgctgctgtcctatcaactggtgtgatggagctgccaacttgggggaatgcagtcacctcttcccacactggtgacccagacattcacgttgctttccagtattcccatttgcgatttgtttttggtcatcacgaggaaggagggtactcattctcatgcatggtttattgttcccaggtaaactcagcaaaaatgttctttgcactggtatttctttaaacaataaagttttactttaacttgctatattttaaatgcacggtattgacttgttatttttatttacatatatttttgagacgaggtctcgctctgtggcccaggctggagtgccgcggtgcaatacaacttgccgcagtcttgacctcctgggctcaagtgatcctcccacctcagccttttgggtagctgaggcatttttgtattttttgtagagacagggttttgccatgttgccgaggctggtcttgaactcctgagctcaaggaatctgctcgcctcggtctcccaaagtgctgggattacaggcaagggccactgttcctggcctgacttgttatttaattcattcataaagaaacacatattaaaaaccatgaatttctttttattactctgataactgcattttcctttcaatcttatatattttatatatttaaaaatattattcaagataggctggtcgcggtggctcacgcctgtaatcccagcattttgggaggccaaggtgggcggatcacgaggtcaggagatggagaccatcctggttaacacggtgaaagcctgtctctactaaaaatacaaaaaaattagccgggcgtggtggcgggcgcctgtagtcccagctactcaggaggctgaggccggagaatggtgtggacccgggaggcggagcttgcagtgagccgagatcgcgccactgtactccaacctgggcgacagagtgagactctgtctcaggaaaaaaaaaaaaattattcaagatagtgtccaaactgttcatcaaactgccaaatggatctctagtacaaaatggctaaaactctttcccaggagtgtgagaatgtatatcaggaaaataattacatcctaaaaaaagctgctgcttctgatgtgtggggaaatcaacatttagggaattcaactgtttttagtaacttccccccgaagcttttgtttgtgggattactatttacaactgtaattgggatacattttcaaagaaaacttggctcaaatttagaactcagacacttaagacacttttccttgagaaaatctaaatatttatgcgtctccaactcactttcaaaaacattttaaagcttaagatgttattgagagttccccactgttgatgatggtgattaaaaaggccattaaaaatggctcccaggaaaagaacagttgtcaggaagtcagggcagccgggaggcagaagacccaccgatttgtttctttgacactggcggtttagtcacacagtgatcgatttctgagaacactggagatgtgctggaattagtgtggaatttctacactctttggctctgactgggacattccgtcattacaacgaaatgagactgtgctttgctgtctcgcatcctctgtgaagacgttatccagcatgaaaaggaaggcaatggaaaccgagagccagcatacaggagctgctaacagaaaaactggtgggcgagctgaggtgaaatggcttggacacaaaccagtgcatgcagttctaatgaggcagtaaggcaggcacggaagtgcgcatgatgtcagctaattaacttggatgatgttggagagtgaggtatcctgaggaaaagccaacagcacttaactcaccagtgtggttaattatcagagaatgctgttcctgtgtagtttcctacccagcattttgaaaagatatttggctttaaaagtattaaaaacatgaagtgactcttcttgcaggcgatcagcagcttgtattggtgatggaaaaaaataatgggacttggccaggcgcggtggctcacgcctgtaatcccagcactttgggaggcccaggcgggcggatcacctgaggtcgggagttcgagaccagcctgaccaacacggagaaaccccgtctctactaaaaatacaaaattatccaggcgtggtggcacatgcctataatcccagctactcggaggctgaggcaggagaatcgcttgaactcaggaggcagaggttgtggtgagccgagatcacaccattgcactccagcaacaagaatgaaactccatctcaaaaaaaaaaaaaaaaaatactggtacttttccttaggataaggttaatgaatcaaggtgatgaagatggcctttcttaattcagttgcagcatagaagaaaattaactttgtttggtggataatcattggaagtgtgaaaggataagttgttttcagaatactttttagaaataatttttagttttctgtatcacaaatgggaaattaggaaaattaaatagatacatcatgttattagaatgcataagcattacaaatgtaactatcctgataatggtagcaaatatattgaagacggctcatgcaggccttccttgcttcccagtattatctggaggggaagataatcagcctggcaggatggaatagagagggacaagatggcgaccagtctccgaagcaggaaagagcggcatgaaaagtggctttaaatcaacagatttgtgtaaagtgcaaatgaacggttgtacctgagctgtatcacagtgaactaatttaacaaggagcagttgcaatgtgttccattttagctattctgaggacaataaaatgacaatatacacaggcagattaaggatgtctctttcaagatttggggcctggttgatttactcataaatcaaatgacaatatgatttattgttcatctgaacaaatttgagagtgaaagggaacatagtagcagctactcctgaacaacgggcataaagcagcttgcctcgggcaaactgagtagtgtggctcccaccacttctcatgctatagttccacaattatgtgtctctttttcacatgtattatgcctctctttacagtatgatttccacgggaatgtgagatttacacattgtagatgcagaattatattattgcacttattaataaaataacacaagtagataggacatacagtaaaataattactgtttaccatcagtatagttacacatgtgataattgatctacaaaatactttccaaaggattatttcatttaactctcaaaatagctgttatgtggcttcttcaaaaaattctgaatgatgtggccagccaggtgcagtggctcacacctgtaatcccaccactttgggaggctgaggtgggtggatcatgtgagtccaggggtttgaggccagcctgggcaacatggcaaagccttgtctttagaaaaaaatacaataaattagcctagcctgctggcgggtgctgtagtcccagctactcaggaggctgaggtgggacgatcacgtgagcctcggaggttgaggcttcagtgagctctgattgtgccactgtactcccagcctgagtgacagagtgagactttgtggcaaaaacaaaacaaaaatgatgtatcaaataaacaagtaaataagttttatgtggatatactaatgcaatgatgcagctatagtcatcatataaatatgtaattcattaaacaaataatgatatttcataaaatgaaatactatagaacaatgaaaacaatttatacatagagtgtaacaatttggatgaaagaaaaaagatatatttgcttatagatgtgcagaaaatttctggaataacaacgctaagtggctgcctctagaacctgtaactgaggcctgaggacagggaactaaatcgttctgtatgccgtatgattgttgtgtggtaggtgattacttcgcacaatgatgacatttgaaaaatagcatcattatcactatatttagtacgtacatgcccataatagagcagttcataaaacactatctacgcattcacatgtataataatactaatagtttaaaaagtttcaagtgtgggtatgtatcctaaaatgcctagaaagataagtaataataagtagtgagattcctgatcttactggtttttgctttttatgttaactttctactttttcattttgcttgaatgtgttataataatacatttatattttataatcagaacgcaagcagcaatgccacttccatcttgaggaagtgtaatgagggaaccagcaatgctggtttcagtgtctcagtttggctggaaaggatttaatcctgacgctgcaacattaactttctgagcatatgctctgtccccggggaagacgacagtcaagggaatcttgaacttcttggaaaataagaaaattaagggcttcttttaaaaggtaagtgattttacttttgagcaatttggcttggctttgttttaggagaaaactggaatcttacaatgtagccctctgaagggtggcttgcacaaagccggggtcactggggcaccccctccctgtattgtgacagtgtggggctggtctccaacttccctagcctctgctttccaggtgcaaggtggaaatgcacttcccatctcctttgaagttagaccaggccacacgatttgctctagacaaagagttgtgagcaccagtgacaagtgtcatccaggtgagagctttaagggccagcacacaattccttgctcccttccctctggtgcgggatcatggaagcccaggtgaaggtgagcctctgtcagcctcggccttgatgaggagggcagccttcagccgtgtgcaggccatagcatgagcgagaaatgaacttttgttgggtgaagccactgagattttggagtatttattatcactgcagcgtttcctatctgatcatgactatataatttgtgaagcccagtgcaaaacaaagacacagagccccttcttcaaaaatgatttagcatttcaagatattagcagtagagcctcaaactctggggggccctgtgagtatggggccctgtgagtatggggccctgtgagtatggggccctgtgtgactgtacaggtcgcacactccaagctggccctattttcctattccaccatcacaacaatcctggaaaagaatcttaattctcttatttcacatatgagaaaattgagagcttaaacagcttgcttaaaatagcagactcacaaaatgccagaagcgagagtttgattccattggtattaataacactgcgatgatgggtcttttgtgcattcctggttctgggctttggggcacaaggagccaagtacactattacaggaagcagacaagactcaggaaatatcgtctcctttgtaggaaatcacctaactggaaccttcaatggaaggtaagaaagagttaacgtctaacccattacatgctaagtgaatgttttctcttgccagaaagtataattagtaatttcaggccttatctgaaatacctgcctcagcacatgctgaaagtatcaataaagaaaagcaggcaccgcttttaatttcattgctataactaattagcattagagaaaccattttcataagcagtgtgctaacaacccattggtaactggaaaggaaagctgatggtgcagctttctccatggtaaccgggcaaggagaaaagcgcttcacagccacgaagagggggttcctgagggaagcacgagacgcgggctccaggcagcagcacgtggaagtgggcaggcactgcccctgacttcagatgccacaaagaacattggcatattccagtcaagggcagtgttttgaactgaaaatattacatgccaccatagaactgttttctacatattccttaaaagctattcaaaccgtatcaagatttttttagaaagggctctaccaattaaaatcacattggtttttcctaaagaattcctatcaactctcccacccaacatatcctacctctgtacccagtacagggggcagaaggcatcaggaaaagtaataaaaagaacctttggctgggcgcgttggctcactcctgtaatcccagaactttgggaggcagaggcaggcggatgatgaggtcaagagattgagaccatcctggccaacatggtgaaaccccatctctactaaaaatacaaaaaattagctgggcatggtggcgtgtgcctgtagtcccagctactccggaggctgaggcaggaggattgtttgaacctgggaggtggaggttgcagtgagctgaggtcgcaccactgcactagaacctggcgacagagcaagactccatctcaaaaaacaaaaaaacaaaacaaacaaacaaaaaaacaaaaacaaacaaggaaaaaaagaacctttgccgcacaaagagggtaggtagtgaatctggtaattttaaaaggcagctgtcattaaatcctgagtttcaagatgaaatcctatcactctgtttgagcactttattattgttcttactgattgtgccctagaacacattagtgaattggcacaattcctctgtcattttcttctcttcatataaacttagtttgggcaatttttcaaagaaggaaggaagaaaggaagtaaagaaggaaggaagggagggaggggggaagccaaaagaaacaaggattgagtttgttggagtcactttagaacattagtgccacactggtccataaatatgttcattttgcggggggtgggggagactgcaacaacatcatactgtatcaatgatgaattcagcagtcacttaaaatgaaaaatgtaggtggctttcaaagaaacaatctcaagtaaaattgttaacaaaatttatcaatttttgaaaactgtatattcaaatagataacataaaaacaagaataatttaaagcatgttactcaagtagatttcacaacaaatgatacatttaaagttttatggctccaatattaatgctttaggaactgtgtggcaaacatttactaaccaggttctcatgacctattgactgtgtgaagaatatttgtcagcatgccagcgtgcagtgttaggttctgttaggatcaaaacaatctccctcaggaagcttatataaaaagttgtccttgtccctactcttaggtcaagaaaacattgtcatcaatatgaatatgaagagatgcatgaaataatatgactaagttctttaagggagaaagccgccatagattagctagttagtttgagaactggcttttaaatacatactttctctacataatttggaatgttttagaaaacaaaatgggaacaaagtacaatgcacattagctgggcagggaagcatgaagaatgctttctatgttacggctaattccctgcaagctagcctgactttcagagcattcaactgagtacgtggctgttctccaccatgaggccagcacgtggttaatgaccccaattctggcattgtttctgggtcttgtttttttctgcacaaaggttaattgaatttttacaagggtttcctagaggacttgcacaactttttggtattaaaacaaaaggccatcttataatagacttacaatatgactttcataagcactttaagtattttagcttagactttagtaactgtggcatatttaatgtttcatagctttttgagaatttccacagacattctcagcatcttcactaaatttaatcacgaagtctggcagtacagaattcttccttctccctcggcttctttttaagtttgagagtgaatttggttttgtaaaagtatgctagggagaagatgcaagggacttctcagcaatttctctctatgtgttctgcagataaatgttctttccggctcgtgacaactaacaattgtgtttcaaaaaaaaaaaaaaaaacatgcattgttaatgagacttcgccagagatgcttagagttaggtgaaatagagataactattttcatagctatgcattaattgactgaattggctttgtatttcaggccaactccaaagcactggttaatagttataaaaatgtttcacagtgctccatgtcggcttccccctgaaaatccatgataaagattgagcgtggttgaaaggcttgtcatgcgtaagtgctaattagccccaggatgcttgccttcatgaactttcaggcctcatctataaggtcaggaaaggggtcatagctcatagaatatggacttgcattaattcccagcgtataaactcatggatcctccacagaattcactaaacttcaataagctacaattctatccttacctcacatgtcacatccctaaaggtgacatctacattaatgcccctcatccccaatagagagcacattggtagctcaaataggctattactcactgtgacctcttctacttatttcttaaggcatgggagtggcatagtgagatcctggcaggagcactgttcacaatagcaaagacttggaatcaacccagatgcccatcattgatagactggataaagaaaatgtggtccatatatatcatggaatactatgcaaccataaaaaggaacaagaccatatcctttgcagggacatggatgaagctggaaaccgttatcctcagcaaactaatgcaggaacagaaaaccaaacactgcctgttctcacttataagtgggagctgaatgatgagcacacatggacacatgggggaacaacacacactggggcctgctggggggttgtggggagggagagcatcaggaagaatacctaatggatgctgggcttaatacctaggtgatgggttgatctgtgcagcaaaacaccatggcacacgtttacctatataacaaacctgcacatcctgcacatgtacccctgaacttaaaatgaaaagttgaagaaaattttaaaaaaagaccctgcctggcagggtttcagcttaaagaaaatttctgggttttgcacatggccattttctgaactcctataactggcttttgaaccaaagtcctcttggaatgctgagacgcactggaaacctctagatgggccatccagcctgaagaaagcctttcttgttgctgctatttgtatcattatttcctttactaacaataactaagatgcactgggtacgttacgtgttagggagcgtcccaagtgcttagtaagcatcgattagtttcatttttacaaccatctttgccctgtgaaataggacatgggattcactctttttaaagatgagacagttgacacttgggaagcttaggaaggtttcccaaagcaagctgtgggtacggacggcatcagaactaaacgcagggagtctgactcagggtgttcaatctcagcactactgaagtttgagaccaggccattctcacgggcccgttgtgggcactgcatggtgtttggcaccatccctgcctctacccgctagatgctagaagcatccccctgttgtgatgaccaaaactatctccagacatgaccaaatatcccctggggacaaaatcgctggcaactgagcaccactgctctgactcaaaggtgtctgctcctaaccacctgcctctcaaaggtgtctgctcctaaccacctgcccctcaaaggtgtctgctcctaaccacctgcctttgctgccgccggcttccccctgcttctttgaggcaaaaatcaggtcggactagcatcagtggcaaaggaaccagtcagatcagctcatgtgacagctttgacagaccaagcattttggtcacatattagcttttgagaatcaatatgcataggctggaatgacactttcagtaaatcaacattcaggctataacaaacctattaatattctggggaattcattgtgtaccgagccagtcattcagatgactatatgccttaggtctttttatgaaataaattagatttaatttggtaggctaggcagagtaggcagagagtgccttgcatttcctggttatactagtgtgtggtgtgataaaaaactgaataggcatctccatcaaatgattcctgtaatgtccccattggctcttttgaaataaaacctgtgtcctgtttccctcttcctaattcaccttgctcttgcctgtgttctataatggacaatgtgaacactcagacagggctgattttctaatcaatggtaacaactggagttagaaatgaaaatattatcatagtaaactatatttattttaaagtccataggctagttttcatcccctcccaaaccactctaatttatataggagggggtcaaagtttagaggaatacgaagatgtttctaaaatttagatgcaatatgtataagagagaagcttctacttgtgatgaattagttagaaatcaaaatttttttggacagattcacttgagagaatgaagaaaattcaagtagagagaggtatcctgagaaaaacagaatattttagactgaactgggataatctggagacttagaacaataatatataaggctttatatattatatatatattgctttatattgaaatttcatggaattattttagctcttaaagtataggaaaatcagttaaagatggaaacactgatgaatctaatgagaattttaaacatataagtttatttatcttaaactgtaagattctattaggctttaagactataattttatggactgtgaaagttctaaggtcccttaagattatgtagaagagatgtttactttttagcaaagaaaatattgtccagaaacccattttttagaaacagataaactatttatttttaataaattaagcttatttttggtgaacacaaacttttgaaatttagttttgtgaaagacacatgtaatcatgtattatttcgttctttctatatttcattacgttgcctagatcaagcaaacactgatatacccagataagtgtggcaaacagttatgtgttttttttaaacacctcattttacaattttgtaatgcactttattaaacagaaactttagctcaaggctgcacaaaataatgaattttcagtttctgctaagagtatgtatatgttgtttttgtttctaaatagtctatgatatatttaaaaatgaaatttgaagtcagatttcatgcatagaaccataaggattttaggaacgtgttctgacaagcagtggtgtgaatacagcttctcacataagaggtgagttaacagaggctcggagcagataagtcactggtgctgagtcacaggctggcagagcaaggatcagaatgcaggtcctctgccttttaagcctgcgttctttttggttcacactgcctctattattaaattacttaatttatcagagcaaaaagcaaaaccttagggatgctattagcaatttactatttccagttcttttgggaatctgttaattgccctttcataaatgctgctcattatgattaagactttgattaaatgtgaaagtctaggatttatatgttacagacatatttaatattaatttaaagcaccagagcagaatgaattgtgcattccaattttttagctctatcatacactctttaatcaaggatttttcaagaacttgctttgtgctagcaggacctgatttttcccctcaggaagctcacagtttaattaaggagagctcatattagtaacaatgcacatcagtgtctgagtaagagtttaggggaggtgtagctcgtcttcatggaggttaggggcaagtgagtttagtgaataggtgccacggagtgagacggggaaagatgggtgtcctggttgaggggcgatgaggtaagaatgactaatgcttatgaaccattgcctgataaacactgtgcccaggactgtatatggatcatgtttaatccaaaagcaattctgagtgaagtcctatccctcaaccctttttacaggagaagacattgaggcatagacccatgaagtgggcttgctcagtaacaactgctcagtgaaggggctgggactcccagcacttgcctggttcagatcacactactgtctccttcctatactgccccttcgcccatctgtgtgagccaaggcaaggaagacagtctggggcctgtgggatggcaaaggaattttctagaactaagagtgtgtgttgggaaggtaatgagatgggtttggaaaggttagtttgggtaaagcttgaaaagccagaaaaaggattttagcccatgttctaagccttcaccattttgtagaccatcttattcacattttgatggtcgcttaggtaaactaagatctattttagacttgcaaacaactacaaggagaaattagttgaataatattaaatattgactactgatatgataatatgtgtattcatgtaggaggtaggggttgtgccttcttttccattcattcagaaaaagcgcctatggaggctcgcgaatagagaggcaccatgctcattgctttgggcataccctgcctccagcatgaagtctggcactaggaatttcccattaatgttcagtgaatgaatgaatggaatttcctgccctgctccttgcctccctcccttcccacctccccctaccttccttcctctttttcttccctcccgtcattaaacacatatttactgaatacctacaaaacttctatgactaaaaccaatgagattctcccatgaaatggggtggagagaggggaaaggcagaaaataagcaaggcaattgaataatgtaattccagttagtggtaagtgatgaagaaagcagggctggcttacagggtgagatcgtgcagtggttggggaaggcatggtctaagcaggcctctcctgggaggggacacctgtttagagggctaaatgaatggaggcagccatgcaaaaagctgaaggaaggtcctccaggaagggagagtcatggccctaggaagaggacaagtctgcttcatttagagaacaccatgaagggccagggtactggagcattgtcaacaaggggaaagtgatcgggccgaggacagaaggccaggtcacataggtctttgtagtgtgagaagaactccaaattttattctccggagtggagctgcttaaactgttagtataaattataatggaatttaagtaatgttcacagaggagcagagaagataacagagaccgagaaggacatctgaatttattatattttaattaatttttttagagatagggtcttcctctgccacgtaggctgaagtgtggtggtgccatcatagctcactgcatgaattcctgggctcaagtgatcttcctgcctcagcctcctgagtaggtgggactaaaggcatgcaccaccacacctggctaatttttaaaattttttgtagaggtggggtctcactatgttgcccaggctggtcttgaactcggcctcaagtgatcctcccaccttggcctcctgaagtgttgggattacaggcgtaagccaccacacctggcataacaaggaatttttgacagtgaatcttgactactaagagactaggggaccatgaaagaaaacagtacattaaccaggaaaaggatggctgatacattgaatgatgaagaggaattaaggcaatggaaaatagaacacagacccttggagatgaagaggtcacgatttaccattggctgataacctactgtgatgacatttctcaggaacgaggcgactagaagaaaaacatgaaagaaaagggggctaagagttttcagaattctcacaatactttttaaaaagagtctcaaaaatcaaaaccagttttggcatactgatttctaagacataattcactctccttcttcctatccctcccttccttccttttcttaatagaaattgttttatttatacattttgtattttagttgccttgtcagttaagtgattacattcatactggaaaaaaaaaaacatgggcaatataatcataaaaatacaaatttctggccgggcacagtggctcatgcctgcaaccccagcactttgggaggccgaggtaggtggatcacctgagttcaggagttcaagaccagtctggccaacatggtgaaaccctgtctctactaaaaatacaaaaattagccaggcatggtagcacacacctgcagtcccagctactcaggaggcgaggcaggagaatcacttgaactccggagggcagaggttgcagtgagccaagatggcgccacttcactccagcctgggcgaaagagcaaaactccatctcaaaaacaacaacaacaaacccaaaacaaaaacaaatttctatatttaaaaatgatgtatgtaataatttttttttgctatacttggaacttttttttttaacctactagggatctaatacatgaattatttatgcaggaattcctagattgtcattactacaacacttatggtatatttcttccttgaattgttgagacctgatttattaggtgaaggatgacattgttttcaagggaaaggaatgctgttaaaaaccaagctgttatacaaaggctttcctccaggctctgcaggaactccccagttcttggcttgttgctgattatgctaacaccaacttctggattcatttgagttccgatggctcctgccatactgctcccaattactttaagctgggcatccaatttccacagtaactcctgggttctccttgcccatctgttcctgcagtggcatcaagccccataaagaaggtagctgttaggatattccaacttaatgtcttaccaggaggacctagaccagcaattacaatacaatgacgtaagcattttcctcctctagtcaagttgaagaagaaaagaggagctgacaaacataaggccaaggagtatccctggtcacaaaggctttgaactcttacccaggtgtggagagccatctttggcatgctcgctcccagcacaaaagtgccatggcggtggtctgtccctctaatctacgtaaatctctctacttttctttcttgcttgcttgcttgcttgcttgcttgctttctctctctctctctctctccctctctctctctctttctttctttccttttttttttttttttgagacagagtctcactctgttgcccaggctggagtgcagtggcatgatctcaatctcagctcactgcaacatctgcctcctgggttcaagcgattctcctgtctcagcctcccaagtagctgagcttacaggcaggcaccaccacgctcagctaatttttgtatttttagtagagatggggtttcttcatgttggccaggctggtctcaaactcctgacctcaggtgatcctcccaccttggcatcccaaagtgctgggattacaggtgtgagccactgtgcacggccagatctctctacttttcatagatacagagagggtttggctgtgtgtccccaccaaatctcatgtcaaattgtaatccccagtgttgactggattgtgggggtggggttctcatgcttgtgtgagcaccatcccatcggtgctgttctcgtgatcatgagtgagttatcgtgagatctggttgtttaaaagtgtggtatctctcctccctctctctcttccccctgctcccgccatatgagatgcctgctccccttttgccttctgctgtgattgaaagtttcctgtggcctctccagaagccaagcaggtgccagcatcatgcttcctatccagcctgtgaaaccatgagccaattaaacatcttttctttataaatcacccagtctccggtatttctttatagcagtgcgaggatgaactattacagataccattgcctgtgttcagatttctttagagtcgagcactttcagttatatatcagatgacttcaagatcttttgaaatgatttggttctcttagaaaacttcgtatggacagttgggtaggtggctgggctgatgggcagggtgatgcctgaaggaagaaggatcgtactcattcatttccccaaggctttctcgattgctctgtgaaccacacagggagcgtgagagggcgttgatggggtttgtttcaggatgctctactgcacctggctgaacatcgtttgttgggttgttcttgttagtccaaagggagagggagtctaagagtataatgtgagttggaatcttggagaaacaacttacaaagcttgtgatttgggcaaatccactctctgcacctttcagtgctggcatattaggtaaagacacacatttcagagtggcatgtagagaagttcaaatcccagccatttcatttgctcctggaactttgtacgggaaagtgacttaacttccttttttttttttgagatgaagtctttctctgtcacccgggctggagtgcaatggcgcgatcttggctcactggaacctctgcctcccaggttcaagcaattctcctgcctgagcctcctgagtagctgggattacaggtgcctgccaccatgcccgactaatttttgtattttttagtagagatggggtttcaccatgttggccaggctggtctcgaactcctgacctcaggtgatccacccatctcggcctcccaaaatgctgggattacaggcgtgagccaccgtgcccggcctatgacttaacttctttaaccttgttttttatcctttctaaacaagggtcaaaacattaccttcctcataggattgttgggagaattaagtaaggtaaaactcataagacatataagaactgccatcaagtaaatgctcagtacatgttagctgtcatccatctcgttgttgagaaccaaattaaatatcactctataagtgaaagcactttgttaagacctaaatcaatgttaattattataatgatgaggttgagtattgcttcatccttgatgctactctcctcagtaactttgccaatgatttaaagatgtagaagctattcttgtcagatggatggcacaggcccggggtgggtctcctggtaggacaagaccaagattatggcctatggtcttggacaagaccaagattatggtgacagttgaaattgataaggggtaaaagtaaaagtttcttttatgttcaaaaatgaggtgcattaagaactcctgggaggagacccagcttggaagcagtcaacgtgaaaagttcctgggggttttagttgatggtcagctaatgctgttttgggctgaagaccagaactgctaaattccatctctaatcataagatagttgaaattttgtactttgttctagacaccacatattaggagggccttattatattaggtagaaagaaccttggcaagtcagtgttttgaaaatacggtgggtgaaggacctttaaatgtttgaagttgccatctaaaacaaggattatacatgcttcttgctagcatggaaagtgaaactgtgacagagaagtgggtactggtgagagaaagaatataatttcacaaaagaaaaaactcagtagtaatctctgcagccaaaatggcatgcattgatgaacgtggtgttcccagtggatctgagtagaggctggtgattgtgggaagattctcacactgggtgtcatgttagaccagctgacctctaagggccctatcatgttttatgattttataatatagcaggctgtacagaccatttttaatatagtcttaatttttataaaaatgtattcatgcatatatacatagttataaaacataaccgttaaattctagttaaatgccaccaaagataaaaataataaagtagcttcaaattgtacttattgcaaggtgacctatctgaaatgtcttcttggtcatattataagaggacttaagatgccaaaggggaggatcatagcctattcatatttccatctcccacaaagtgtctggcacacatgtaataattaaagtagacaatctttattgaatgttctcttgtttaaagaagtattttaagcccattatatttaataattcacttaaccatcaaaactgctcaataattttgacactatcattattccatttgacccatgaggacactggcactcactggggtttaaatgacttggccaacatcacacatctaataagtgccagggctgagatttgaactcagaaagtctggttccagagcttgtgttctttaccatcacactctactgcctctgctaatggaaggtactcggtcagtgtttatccagttgatgaactgatggatagatggacgaacggaaggactaacgggggttgcagcacagagtcgcctgaatatgtggcaatgaacaaagaagggcacagattacacgaagagcagatgcagaaagggccgatgagggagggacgctggcaacacctcagtcactgctcttctttgagttgattccgcatagagcatcttagggtgaaacagaacgacgtgcattagcacagagaagcaaaagcttcttctcttgggttcctcctcttcctttgcagaggagatgttttctgtcagaatgattagttagaagtgaacagtgaagtccttcaattagcattccttcaaaatgccatctgtaagtgactaaagaagtgacagccagaaggcagaacacagggctatctccgcacagacaagacaagagccgggaaggcagggacgctcgatcagccgtttccagcaatgttaacgggtccacccactaaactaaacaaatgctttcttcctaccatggagacagaaactgaaaaataatttttgacagcactgtatgatttagtgggtgcttgcagacacagcctatacttagttttataccatatttaatagaacatttcaaactttcataattatttggcagcttttaaaaaataaaaaataaataaataaatagcaaatgcccactgggttactcagtgcaatgaaaataccgtatcatcaggactttgtgatgtcttggcaactcttaccccaactctatccaacacctgctctccaggtaggtcaaggtcaatatacttgactacttcaaagcctcaacaaaaatgttctccatcaccatgttatcaggtgtccacgtcagctgagaagcctgactggtccttttcatgcctgtggaacaagggactgaatcttaaggagagtggagaccttgtgttacttacattctgcattcaagaaactatttctatgaagtttaatgatcaatgatgctttttccttcaaaactatccaaagatttcaaatctgtttgtgcaaggaggcactggattgaactgaatttctagtttcttcatcgactggttccttcattcagtaacaaaactgaacattttaatgtgctgatactgtgtgagagctttacacacattaactgatttaatcagtatgaaaacggtctgcaataagcacatgtattcccatcttacgggcaaagaaatgggctggagaggtttcaggaacatgctccagctggctgaggtgcatctgatgaactctgtgcttccagtgaacttgtaagatccaagtctccaggcgaacatcaagttcttctaggattcatccccagcctttccccagtcttctaggactcctctcccttgctccgccttgaactctgttgttgacatctttcttgccctctacaccgttaaacgattctagagtggtgctatacattggaaataaaatgcgagccacacatataaattgtattttaatatccactttaggaaagcaaaaagaagcaggtgaaagtgattttgataatatattttatttaccacaatatatcaaaaaatttatttcatcctgtaatcagcataaaaattactaataagatatcttatattcttctatggtattaagtctttgaaatctggtttgtattttacatttgcaacacacctcccttcggactacccacattttgagtgctccaaggacgctggctagtggccactgcattgcccggcatatcctaggggagggaaggaatccttagttgttaacgtgtcagacaacatgctatggctcatagttgtcctcctgatgtgtatcttctcctcccgatgtgtatcttctcctcccgtctgcagtataagaagccttcactgggcacgtgtctgccaggtacagactacattccctggcctctcctgcactcagggtcccatgtgactggatctggcacctgagatgtaaacgaaagtgaagcgtgccatttctgggttacgcccttaaagaaggcatgttcccagcccttctccttctctctttgtgcaagctggaaggcaggtatggtgccagtcaccttcaaccacctgagcacgctcaagggacagcagagccacagacgggagcttctgtttccttaccacagagccagccatggggaccatgtcctgagagaaagaggttcctgttttgttcacacaactattgttcatctatgacaagcacggtcatcttcatttactttcatcatttctagaatctaattccgtgctctcttggtggggttagacccaactcttccttcaggtctcagtgaagctttatttcagcagggaggcctttctaatgttctgaagactaggttacagccctcactccatactaccatggcaccctgagcttcccctttctcagcatccgtgcacagggttatttaatgttggtgttcgttctagacctctgtgtcatgggggcatgctgtgaccatcttctgggcacttggcacagtgcttagcacatagaagtgccaaacatttgttcaaagaataaatgtaattaagaggcttaacatgtaagtgatgtgctcttgcccttcccggtttgatgggaatacagaatctctttagattttcctggttcctgttagagagcatcagaatgacagtgcacacaggcaaggctagctgggaggatcgagtggcctgagtgtcatgggttgagttgtatcccttacaaagatatgctgatgtcctaacacccagtaccttggaatgagatcttctttggaaatagtgtcattgtggatgtaattagtcaaggtaaggtgtattagtctggtctcatgctgctaataaagacatactcgacactgggtaatttataaaggaaagagatttaactgactcacagttccacatggctggggaggcctcacaatcatggcggaaggccaatgaggagcaaaggcacgtcttacgtggtggcaggcaagagagcatgtgcaggggacctcccctttataaaaccatcagatcttgtgagacttattcactaccacaaggacagtatggggaaagccacccccatgattcaattatctccacctggcccagcccttgatctgtggggattattacaatttaagggatatttgggtggggacacagccaaaccatatcataaggtcataccaaagtaggttggctctaactgaaacatggctggcatcctcagaagaagaggagggagacacagcaagaaggtggccatgagatgatgggagcagagactggagtgacacagccacaagccaaggattgctggcaaacaccagaagccagaagatgcaaggagggattcttccccatgggtttcagaggaacatgaccttggaggcaccttgatttcagacttctggcctccagaaccgtgagacaacacatttctgctgttctacgccacccggcttgtggcactttataatggcagccctaggagcaaatacatcaaggcagaaaacccgtcacaaacctgctggcatgcccgttcctcctggctacgactccacagcctgttcccaggggtcagcccacaggccagggccaggcggcattgctggctagtggcctgcaggaggggcacttatcagtacttcctcactcccaacatgaaaagtcaggtaaagaagtacaggaagctctgccaaggagtggaagggatttgtacctccttaggacaacttcccaggtaagggcgagtggaggacagggtgtccccactacaggaagaaagagagacatcatcattcagctctcacagacattcctccttcaaaacagaccctctggcaaaggttatcctttaaagaaaaaaaagttcttgctcctctgtcttgaactgggaataaattaggagagataagagacagatattactcctttttaaaactctgtattcccattgaaaagagtcaagggtacaattctcaagtctgtgtgtgtgcacagtgcttacatgtctctctctctctctctctctctcacacacacacacacacacaccatatcccacttacagactgaatactttgcaccacaaagtattttcagctgctcttctcgctcctttccctttcaattcagaaggctaactctagctcaattatctcttccttttgacagaattcacatcaaatgcaaacaagatgagaccaggattctgcctggttctgttgccaaggtgggtgggaagtcggcagcagggatcagtagctgtagctgcttcagcctttgttgaggctaactctcctcccaaggtgtctcaaatagaaaggcttgttcctgatgctttccaattattttcacttcaaagaaatactttaatatatttagttcaaattgcatgatggtaattatgcttctaaatctgatcaaatgacgggagagaggaaacctttgcttccatgaggggatatttgttcttcaatagatgggtctaattttccacagtgggaggactcacaagcactgagactggcttttttcattagttatttataaagctcttattagattggttaaattcacatgtgggaaaaaagacaaattattgttaatcaatttctaacctatactattcataatttagctgatagaaacctctgctcaccaaggggatttttattcaggctgcaaatcagtatcatgttatagagtgtattaattaataaatggaatatttagctttttataattagtgtttgtatttattacatttgttatgttactcctctcctcaacgatcccattataattcctattcctcagtaaataaaagctcactctctggtttggaattcaagcctcctcccaacacaccacatgaccccgccgtgccagccattcacactgctcacagggtcttcagctcccttctccctgagagcttgtgggaagggtgtgctgtcctaacccagttagatgtcgtcaaatgccttgtttggccaatgaaatgtgggtggcaatgacatgtgtaacttgaggccagagcctttaatttctggcactcaactctccatccctcccaccatcctgcttcctgaaggaagggctccacctgccgaccctgatggagaacgaggtcacatcagtctccctgccaaccctattggacaggccttacgcgtgagaaacaaacctttgttgtttcaaaccactgaaatgttgaagttgtttgttactgcaacagactttagtctgtgctgactaatacatccaggatattctttgggaattctagcggctacattctatttttcaagtgaaatatgctttggaacacctatacataataaaagcagagatggtcatgttgaagagtgagatggggtgagtgtgtgtgtatggggatgggggaggattgagattcttctttatcttctactgaagcccccgatgctttgcaacctccgcacatttctcagaactcaggctgaaaccctgtgatctagtccaaaccaaccttcccagctagggtttcgttcaaaggtcacaactggtggcttgtgagcagggtctggacacacacacacacacattttttttttttttttggctcacagagtgcttgaaaagaatctaagacaacatttacagattgggagatcaacgtaaaagatgcatcctaaacttcccttgctaaagtgaagaatgaggacaccctgggcctccactccttcccttcagttgctatttgtcattacacataaatgtctgttgcatatagggaaatatttctgtcccatgtctctatcaaaagtgggaaagggctgtgtttttctaaaagtaagagaaagagtgtatttctttgtggagtgcataattctcctaagtatgaaagtgaaaagctaagatcagtgtttcccacccctcatttctctcgttcatgtcacctgttgcttcttattggctttggaatgtgggacctctcttctagcctcttgcatctacctctatggtttgacttctgaaaatgtggtccctggtccacctggatccaagttagctgagttgctcgtgaaaaatgcagattgcaggtttcatttcagacctactggattcgaggtggtggtggtttctgcattttccataagtaaccctttcccttgacaattcttaggcacaattaatcttgagaattactgctctgtggctgaggtcatcatatattcagaaccaagttctacgaatgggtaaagaatttttattctcttctagctttgaaagacccttcagaaggtagaatttggatgccaaaatgctatgatttctgaaatggtgtccaggaataatacaatgaattatttgaaaccgcagctgttcccaagattacagataaactgaacaccaagttgtcttctgaatgctgccctcactctcctccttccccacttttgttcatgcagtgtctttgccaaaagtccttcggccatgtttccttacaaaatctcacgcatctttaaggtgcagttgaaatgttaatgaaaatcaatgcatccttactattatctaaagtcagttgtgtcaaaacttttagaatttttcatttttcaatagagattatttttaaagacagtttaatttcacggcaaaattgagcagagtacagagagctcccctctcccctctcccctatacatgcacagcctcccccactatcagtgttccccacaagagtggtacatttgttataaatgcaaaatgtacattgacacatcatcacccaaagtcctcagtttacatgaggttcactcctggtgctgtacttcctatgggtttggacaaatgtataacatttatccacctctgcagtattatacaaaagagtttcatggtcctgaaaaccctcagtgctccacatactcatcctttcctccccaaacccctgacaatcatggatctttttactgtgtccagagttttgccttttctagaatatcatatagctgaaaccacacagtatgtagtcttttcagattggcatctttcactggtaatatgcacttaaggttcctctatgtcttcccatggcttgacagtacgtttctttttagcatggaataatatctcactgtctggaagtaccagtttatttatccattcatcgactgaaggacaccttggttgcttcccagatttgtcaattatgaataaatctgctgtcaatatctgtatgaaggtttagttgtatacataagttttcaactaattcaagtaaataccaagaagcatgtttgctagatcatatggtaagcgtatgtttagtttagtttttttttttctttttttttttttttttgagaccaagtctccctctgtcgcccgggctggagtgcaatggcgcaatcttggctcactgcaacctccgcctcctgggttcaagcgattctcctgcctcagactcccaagtagctgggactactggtactcgccaccatgcctggctaatttttgtatttttagtagagacggggtttcaccatattgccaggctagtctcgaactcctgacctcgtgatctgcctgcctcaacctcccaagcgctgggattacaggcaagagccattgtgcccggctgtgtttagttttctaagaaactgccagactgtcttccaaagagactgtaccattttgcattcccaccaacagtgaatgagagttcctggagctccacatcctccccagcatctggtggcatccatgttttgggttttggccattttagtaggtgtgtagaggtatctcattgttttaatttgcaaatgccaaatgacatatgatgttgaacatcttttcatatgcttttttgcatctgtatatcttttttcggtgaggtttctgttcagctcttttgcccatttttaatcttgttgatagttttcttactgtcaattttgaaaagttctttgtatattttggtaatagtccctttatccgataggtcttttgcaatattttctcccagactgttgaatgctttttttttaatggttggtctgtttccaggaatcagaaatcaggcttcacacccagcccagatgttcaagtggttgtttgacttgtctgccatctgcaactgtctctcttctgctttgtactccacgcctctcagatgctggagaaactggtcatttgttctctatagcatctcacattgtgaatttgtacaaggctcagtggcttcttgagccatgggttgtgtgggtctataaaccaaacagacaggccttggacagacaggggtttccttcaggcagcacagcctcagccacagcagcatcctgaggctgaggatgtaacaccaagatatgaagatataaccctacgtttctaagatgcggctgttctgggggaagatataacactacgtttctaagatgcgctgtcagtgagtgacatgagagagaaagtctgcatgtcttagttatcagccatgtgagaaggaatacctggatcactgaatcatctgggcataaaagcttttttatgagttgtgttaaaaactgctttttgtggatcacatgaagcaactctgaaatgcattatcctgatcatcattgttgctaatcatgtccattttgggccatgcactgcacatgcttatcattagtcaattgattaagtttgcactctttgggagaggcactactcctatccctatgttatagctgaggacgctgagacataaagagattaagacgctgtcaaccaagccaataacaatattttctctaagctcatgaacaatgtttggctgtgcagaaaaccaatgacatcaaaaggagagcttctagaagtaaacatgactgatggtaaaggaccccttctaaccaaccctgggaaattagcaaggtttcccagcaccccaagctacttgccttcccaccccttctcttctgaagcaacatcccgactctggaatccattcccacatttaaaaaatgggataatgtgagctgtcatttatgtgcattgactggtagggatgaggatagtaagagtatcctgaaggaggggaccagtaacaagcagggaagagagaaatgggggatttgggagtagcaacctctggagtaccagtgcatttatggaaagataatagttagaacacagtgttatcggctaggactaatgatggtggagcagtgtcggtgagggtatgaggtggctctgatccatgctctacggtgaatgtgtgggaaggacaggtgtggaatggttataagtacatgctctggagtagaaggctctggattaaaaacctgactccacagcttagtaggtgcgtaaccctggggatgtcgcttaattgctttaaccttcactttcttcattttaattgtaggaggagaacagcacttacttcatgcatttgtggcaaggattgagttagatgatacatatccaatgttaagcaccatgtctgatagaaacttcttaatatgttggaaatcttactattttatggttgatgaacgaatggttctagtgactttcagggtatgtcttctggcccaaggctaacagcaggtgtgtattataaaggcaaactgatctcccatgtagagggaggagatgggatctggaaggcctgggtgctacttgtaatactagattgactaaaaggagggtagaacgggagggggctgctgctgtaccgtagagtcttgatgaatttatggctgtcattctgaagattttaatcttgtctgaacaagtcataaaaaagtcttttatacaatagccaagactcatgaacttctgtttgctgcacactgtgctctttctgtgggttattcaggtcattctcaccacaaatatatgggataagtaccattttcatcctaaataacctctgccactaaataacctttgcccccactgcactaagacttttacatgttttaactcacttaatggctgcaacggccccaggaggtagatacttattaattaccctcatttaacagaggtttatggaggtgagggactggactgagggggctatgggggcgacctagtctagctgggttctaaggcagttgctctgcccccagagccctgcttcgagagcctctatgcttctatgaaggtcacaaccagaagcagtccggcctgcagttgctgttttaaaaaagaggttgtaaacatcactcactgcaccacagggtggccgtgacacaaagtcagatgtgagcattcttttagaatccactgtgaggaaaagcctgcttcccccaggaatccacaggcttctattctgataatgatgattatatcaccaccagagtccccttcagccttgatcattgagacaccctagacagggggaaagcattgaagaacctctgtggtcaacctaattctttgctatatccatgatctggattttcagccttgacttctagtttattatgatagtgttaggtctgtccttgttacatgaggaaaggtattaatatatttaaaaagctataccgatgacatgggtatagagacagaagatgtgacttcttatagttagaggtcaaaaagccataagatattcaataacttagaggcttgaagaaagatcccaaagggtctccaaggctggaaggatgggctgaaccgaaccacaagaaatctaatgagggtgacttaaaggcatgaacacagcgttatctgcacctcagagctgggcaaggtctgactccctgaggaagagccggcagggattgccatggggaccactccctgccaggcatagccttttcccaaccctgagcgtccgagcagggtttcaggcagggcgggtcggaaacctcaggtgtgcggggatgggaaaagggggtgaaccctgtgttccccagacctgtactgactgagtcatgttacaagtcaggagttgttgcagggataaatgggaacagaccaaacactgtgaaactttcttttttattattatactttaagttttagggtacatgtgcacaatgtgcaggttagttacatatgtatacatgtgacatgctggtgcgctgcacccaccaacttgtcatctagcattaggtatatctcccaatgctatccctcccccctccccccaccccacaacagtccccagagtgtgatgttccccctcctgtgtccatgtgttcccattgttcaattcccacctatgagtgagaatatgcggtgtttggttttttgttcttgcgatagtttactgagaatgatgatttccaatttcatccatgtccctacaaaggaaatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtgtatatccagtaatgggatggctgggtcaaatggtatttctagttctagatccctgaggaatcgccacactgacttccacaatggtcgaactagtttacagtcccaccaacagtgtaaaagtgttcctatttctccacatcctctcaagcatctgttgtttcctgactttttaatgatcgccattctaactggtgtgagatgatatctcattgtggttttgatttgcatttctctgatggccagtgatggtgagcattttttcatgtgttttttggctgcataaatgtcttcttttgagaagtgtctgttcatgtcctttgcccactctttgatggggttgtttgtttttttcttgtaaatttgtttgagttcattgtagattctggatattagccctttgtcagatgagtaggttgcaaaaatattctcccattttgtgggctgcctgttcactctgatggtagtttcttttgctgtgcagaagctgtttagtttaatgagatcccatttgtcaattttggcttttgttgccattgctattggtgttttagacatgaagtccttgcccgtgcctatgtcctgaatggtaatgcttaggttttcttctagggtttttatggttttaggtctaacgtttaagtctttaatccatcttgaattgatttttgtataaggtgtaaggaagggatccagtttcagctttctacatatggctagactgttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggcagcgtgatgcctccagctttgttcttttggcttaggattgacttggcgatgcgggttcttttttggttccatatgaactttaaagtagttttttccaattctgtgaagaaagtcattggtagcttgatggggatggcattgaatctataaattaccttgggcagtatggccattttcacgatattgattcttcctacccacgagcatggaatgttcttccatttgtttgtatcctctttaatttcattgagcagtggtttgtagttctccttgaagaggtccttcacatcccttgtaaggtggattcctaggtattttattctctttgaagcaattgtgaatgggagttcactcatgatttggctctctgtttgtctgctattggtgtataagaatgcttgtgatttttgtacattgattttgtatcctgagactttgctgaagttgcttatcagcttaaggagattttgggctgagacaatggggttttctagatatacaatcatgtcatctgcaaacagtgacaatttgacttcccaactttcatttacgttacctgcaaactcaatagaggctgaaaaatttgttgcctatttaatgaattcatcaacaaatgctgattgaatgactgctctgggctggtcaaaaagggtcacaggcgagtgagacaagtgcagaaaggaggatgatgcaggtgggtggggcccaggagtggcaggtggctgtggggacctaactgggcttattgagaggcacacagccagtgctcaataatgctaacggtaaaagagtaatattgatttattatacatttaattctttacagataagtgtgatatggctgtcccaaaaagcttgctcagttgtaaactaggccattggtctgcagtaccaaaaagtcaatttggggaaccaccttctgtgagacattaacaaactgtaacccatttgggcaaggctgccacggagccaggagcagcctcacaggaggctgaggaggggcattaagcctccagagaagagacccacaagaggatgtcacaggccgcctgttcagctacactaagcagctcccaggagtgggtctcaagccatgagtgcatgtttcagggaggcagttttaagcctcacgtaaggaagaactttttaaaaattcctctcttcctaaacaaccttcctgaaagatctgaactttttgccacttaagttggacacctgccaaggaaggaaggtgtgcggaacccattccagtagtgggaaagaggtttggtgactaggctttaagttccttttcagcctaagattctgtggggctaagaagacgagtgactttttgtctaagtatcttttcagtgtggcatttgtaacattgctcatctctatgaaatggaatgatccatttcctatcaagtgaatttggggcatcagttctcagttttgacacaatgacttgggcagattattaaatcacattatgtactggtctgcctgtacatggcccaatttaaccctcgaaggtggctatggggtggggaaccgccaattataatctacaatctcttttgctaactagcattccactggtcagggaagttccagacagctgctggggacagccaagctttcctctcggcccagcacgcagctgttcaggaagggatgctctcttcctttgagcccttccccctaccctccattctctgcctcctctatatcttgactcttctctctgctcctgatggtaccatgcacagttgatattttctgtcaatttaatcccattttaggtggtatttcatattttcctaccctcactaaaacctccttaaacattcagtaaactatattttcataacgggttttcacgtccagcctgaatcactccctgaccacccaagtaagctcgttgacttacttttccatctttgtatgctcagtgcaaaacataggtccaggtttataataggtgctcaatacataatagtagatgaaataaatgacctaccttttctgacacatgggaatgcctttctatattcttatttttggtagtgaagtttctgataaaacgtatccagggaaacacgttgctaatagaagtatcgcacacgttaggcataaaagctgtacccttttttaagtgccacagaggactaataactgttagtttgcaatcacagactacaaaagaaatgattgcatgaatagctgagattccaggtgttaattcaatagcaaaaaaatgtgtgtgtccttgtactttagtttctgatggttaggagctgatgtgtacttgcttttgaattcactaaaatcagattcaagaccttctataaatctgtagactcaaaggaatggaaaatgcccccaaaggtcacctggcacaaaccctgcctttaggcagaacaagatataaaactccttgtcgactgtctatcctttaaaaacctgtctcaaggagaatatttttaagtattttctttttctttaacctcggaaacgcttttcctgagggtcagtccttatggctccattacacatgatgaaaaattctcccctgccatattgtaagatcatttccatttgctctgtcctcagcagagcaggaaaacattggtcagcttcctccgtatcatgtcccttaatacacttaataaatccgccctgagctcccttttcctcagacttcataaatccaattcctcaagccgatcctcacagatcagttttgcaaccctttaatcattttaataatttttgtcactctcagttgaatcatttccaatttatctgtagcctactttttttccccctcaattaaacaccatggtaatgcaaaacggaccagagctaagaataggaaagtttcacagttcttgagtgttataattcctttttttttttttggagatggagtttcactcttgttgccgagactggagtgcaatggtgcgctcttggctcaccacaacctctgcctcccaggttcaagtgattctcccgcctcagcctcccaagtagctgggattacaggcatgcgccaccatgcccagctaattttgtatttttagtagagacagggtttctccatgttggtcaggctagtctcgaactcctgacctcaggtgatccgccagtcttggcctcccaaagtgctgggattacaggcgtgagccaccatgtctggccgggtgttatgattctatgacaacatcacagaaacattttggtatctaaagacttttcttttttttttttttaaattagaagagcaccagaaaactttttcacctcctgttcttgggcaacactaccttccagatctttctcagcagtgcttgagaaaaagcacttagtcctagtgttagctgtttattcatcctcgcagagagaaaatgatccattctgagatcaaaaagaatggcaaagcctcgaaaaagagaggtaagaaactcaaggcttttagagccagggaggagcctggagaatagggggcagccaggtgggcatggtggcagattggaagcacctgtgctgtttaaaggaggggatggcctttcatgttaagctgatttttttcttcacatgagaatgcccatctagtgcaccaggagcttcctttggggggaaaaaaagaaaaaaaggctgggcacggtggcttacacctgtaatctcaacacttggtgagaggccgaggagggtggatcacaagtttaggagttcgagaccagcctgaccaacatggtgaaaccccgtctttactaaaaatacaaaaattagctgtgtgtggtggtgcgcgcctgtaatcccagctactcaggaggctgaagcaggagaattgcttgaacccaggaggcagaggttgcagtgagccgagattgtgccactgtactccagcctgggtgacagagtgagactccatctcaaaaaaaaaaaaaaaaaaaaaaaagttaagccacaaatcgatattttaaatttaaatataaaatggcttaattaatccattgtgcagctcaaccctgtgtgggctcaaaaaggtgcaagcaaggttttgcccatgggctcctgcattcatgcccttgccaggaggctaatcctctaccgtccttatgatttctataagaaatttctgaagacatatgcatcgttgagaggcatgttctttacacatgaacacttttataaaattgtgttttaagaggagattttaaagggcaggaacctaggctctttactctctaatgatgaaattccagatgcagtggctactaaaaatgacacaaatttgtggagatgaaccttcttgatgctttgtaataactcaaccatcacaggatgtgcggtatcatgaagcgtgattgtccctgagatcgccagtgaggcatcgtgaagtgtgactgtccctgaggtcgccagtgaggcatcgtgaagtgtgactgtccctgaggtcgccagtgaggcatcgtgaagtgtgactgtccctgagatccccacatcaagttgttgtttccagttaatctgagaccaacgcgaagcccattgaagaaatgcacccacttgtgcttagtattctaattttcaaacccagcaggttcaattcccttacaaaggttggtctaggatagagttctgggtatagaaaggcaatttaaccaaaatgctttaccctaattacacagcaaagctatttgcataagtaaccagtctgggtattaagagacccaagagagtcaatgttactccagcagaagttatgtttttgctaaccttcaagaaaataatagcaagtcaagacttccaatgttctatttgtaaaagcaaatgatagaggatataatcctttatcatttgaatgaaatatgttggaaagagattggtctccattggaagtgggctgaaaatggccctcctttcccctgtggccatttttgcaggagagggtgttgaccgtattgagcgtggataagggaaatagtttttgttatatcaaaagaagccagtccagacatgattttcttcttccaatatggaagatgctatttttaaagaggccactgatcttttgtttgctatagaaaatgaagtaatctcttagggtaatggactcaaactataacaaaggacaggttatcttaaaatttgataagacatttctaacaggtaaacaatgacatcgtttactaggaagaaaaataaatgttctttgtggagatttttaaaaatagacaaaacaatcacctgaagagattggcctatgaggcttaaatcacggcactgcaggagcagttcaatttgtcagattggaaatatgatgtaagtttaaaaaatagaggaaaataaacacaatctagattgctgctacatatatagttcagatgatttaaacttttgcaacaaaatgatgcttggtatttatcagttttcccttccaatagaatataaaccgcacgaggcctaagactgtgatgtcaactggaaacaaatcccttcatttctagactcctggggaattggcaataaggataaagaaaataagtattatgaaggatgagcaaaataataatgcatctttcatggactccacagccatatctgacaccgttatttctgtgaaaggttttagcccatgacaattgactggacacgttaggaattatggtcatactgtcaccatctattcaagaacacccagccctcatgacatgagcaaataacagcactgacctgcctaagtgaccagacaatcctttaaaggagtatcactaaattgcagcattccaaggccaggggtcaagatgaaaaagaacgatccagactgcaagttgccaggttactgcagaatgaaagtggcagatgggttgatcttaggaaaaaaaaaaaaatctgctaactggtgcagaaaacattagtctgggagaagaatatctcactttagcggagacagctcccgcagttccattcattacgatccgcgggaaggctagacttgctgtgagggttcagccaaggctcaggcccacgtttccccctaacacagacacacatgtgcacacacacctacattgttgtcactgtatgcagaatctcctgccaagagccaaagtgacaaaaattatacagtagcttgatgggaataagaacacaagtgtacctaatctattcaatgtaagtctgaaaatggaaagaggtctacaaagaacagtattactaaaacagtaacagaggtggtttcatttttattagtaaaaaatgctctaaagcctctgactgctgcaaatatgataaaacagcacatcccaagctcagaaaaatggtttaaaacaactctaaggaaatgacccccccctgaaaatcaaatggaagtggaaacacacttggccaaaaagggaggctctggtgcataagacaatataataaaattatagggaaacaatatgatagaaatgaatctgatgaagtgtattgctattgtaagtaaattcatgcggagaagtattgaacaaaccacaagaagggacacctcgttggtagggatgacacctttgacgtgctaacaactgctcatttctcacggtcaacagagcgggcttcctttcaggtcaccatattgaacacacctggcttggactgaaattcctggtgaattggtatacaaggtttgtcattaactctgcacccaaaataaccacacaaccaagaggaagctctttctaccttttaatgttgtgagatgattgttctacacgaggagaaaacaatcacgtgtgactatgtagagcaaacgcggagaggcaagtgcccctgactcttacttgccgtcctcctggcctccctggtgcacacagctatgggggctggaagttagcataattacttccaattaaattaaggtggcacagctttttcccctttctctttgaatagctgtaggcttaagaaacaatatccgtgctgatgatattccataacaatatggtttcatcaatactgctaggtgtaagaactttgggagtcatacattaacctgccttcctcttgcctctcagagaaatgcccatctggcctccacagaaccactcttgccacggtttcgatttctcaggtcaggaccaggacaagttccactcacttaggaaagcagatgtttaggagtttcctatttggcgactcatgaaaatgatagactggtttctagaaataaaaatttggctgcctcttaagctattacattctcaaactgtgacgggatattcccatttgagcttaaagatacatgttttgtttgtttgcttgctttgttttttgagatggggtctcgctctgtcacccaggctggagtgcagtggtgcgatctcagcacactgcaacctccgccccccgggttcaagtgattctcctgcctcagcctcccgggtagctgggactacaggtgcatgccaccacgcttggctaattttttttatttttagtagagacgggatttcaccatgttagccaggatggtctcgatctcctgacctcgttcgtgatctgcccgcctcagtctcccagagtgctgggattacagcacatttttttttttttttgaaagagccctttctgctttttttcatttgtttacaagataaatttttgaaggtaaatgtgggcaaggaggtaaacaaactgagccactacatgaaggaacccgaagttggactccttctaggaggtgattttctacctgagcatgctgtacgggccttgctgctgctgttgtttttaacttaagaatgactttcccctgtaagacatctcatgagaaggcggggaaagcactactttacaacgagcatgggaggtgggcttatctcccagatccatcactgaaagctgggctatcttggggaaattatttaactttcctgaccttttgttccctcctctataaaatggtgacaaatagaataccttcctgacagggttgtagagaggactaattgagacaaccaacgtgccagcattttgggaatcattaaggtctatgaaaagttggtggttgtgtaactgtaacagctgtattttaggaccccaggaattacgatcttctcaaagcagaaatgtatttctttgtaaccttattatctagtatatttcctggtgcaactaggatctcaggaactgtaaataaacaatagatttaaagaacaaatgactgaatgaatgagagaaccaaagaaaaaggagtagagagagtggaaaaaaacaaaacaaaaccccagagtccttgctttctcaagatttctgcaaatgaaagatatttatttatccaactgggcaaggactctttaggcaggttgcacagacaggagttggatggtgaatgtggtcatgatcttgagaaacaaaccgggtctgagctgcaggacagggtcagaccatataaggctgggactgggactctgaacagttttttgggggtaaagttttattttgaggagtgataggggttatggggaaaaagggtgaagaaggcaaggttttaaaacagaataaaaccaaggccagctattttgaggatgagcttgaacagatctgaacgcgagggacaaggtgacaaaaagcaagagagggttaaggatctgcgtctgtgactcacgctggcttaggagggaggtgatgggtggggaggaaactggagttgggggatagccgtttgtcctgatgattagaggctggtatctgggacctcattgtaaagagactaggtccagggaaaggggacccagtgactaggggctgaaagaaaactttgttgctgtgggaaccaggagaccagaagggctctggttccaggaggactgcggggaggccaggaacccaccccttgaaaactgcactaggaagtccagagcggcaagctccttagtgctgccgtcatggtgcctactacggagtcctctgggttcctctcccctgaagccaagggtgtcccctggtctcaagcagcactgaactttgaggtggcagttgagaggcccaattgttagttaaagatgggccagggggaatatcttcatcacaagatgcataaaagcgactctatacatgtcttatttcctttaaaaagcatgaggccaacgtgcagtgtcttccaggctgttttctaaattgtgccatgaaagggcacattcacactactgacatgtcctgcttttattgttacaccttcctccaactgcatctactgaacatctattatatgcatagtaccaacgagaaatcagcatccaactgttttcccccttcctgttatctgaaaacacagaacagcgttagataatttaaaatgaaaacagcaaaagtgaccaataataacaccgtattaacctggttaagttttctggattctggatttcttgtgagtttttatccatgtacatatatttttgtaatattgtactcatagtaaatgtaattttgtggagcttattcttatatgactacactgcctttagagatgaatcttaattttcaggcatttggttgtgggatgcttaggctatgagaagctggatctcaacatttaaagcaggatcatttaaaatgaggagtcaattgtgttacttcacatgtgtttcatttgaaacagtatatcgttatgctactatgataactacagcaaatcctccttaggactgatttaagcattgaataaataaagttaaaattgagtacactgccattttcagtgcttcttgacttctacacacttatcaactactacaaatctgatggcatccactttccagtgggttagctttcacctcgacaggtctcaaggttcttcttatgggattttagtccatggcaatcaccaccatttgagcacagtcacctagtatagctggatatttaaagaaaagaaaaaaaagagaagctaatggcttttcacacatgcactgaaaaaaattaataacctgataatttctggcaaaggagaaaattttttttccttataagactgcaaagttcaacattatgtgatttatctcagtgacctgtaagtagtgcctataattattaaaaataaccatcaagctggcttttaagaagcttcattatggtactgctaatacaatgcccaactccattacttttttctatataaccttaaaacagagccagttcattcctagtgtttccaaagtgttactttaagaagaaaagtgggccaggcgcagtggctcacgcctgtaatcccagcactttgggaggctgaggtgggtgggtcacctgaggccaggagtttgagaccagcctgtccgacatggtgaaaccccatctctacttaaaaaacaaaaacaaaaacaatccgcaaaaattagctgggtgtgatggcgggtgcctgtaattccagctactcgggaggctaaggtaggagaattgattgaacccaggagacagaggttgcagtgagccaagattgcaccactgtgcactccagcctgggtggcagagtgaggctccttctaaaaaaaaaaaaaaaaaaaaaaaaaagaagaagaagaaagaagaaagaagaagaagaagaagaaaaagaagaaaagtgggctaggtatggtggctcacgcctgcaatctcaacactttgggaggccgagactggtggatcacctgagattaggagttcgagaccagcctggccaacgtggtaaaactccatctccactaaaaaacaaaaactagccaggcatggtgtcgcatgcttataatcctagctattcaggaggctgaggcaggagaattgctgaaacctgggcagtgcgggttgcagtgagccaagatcgcaccactgcactccagcctgggtgacagagcaagactcaatctcaaaaaaaaaaaaaaaaaaaaagaaagaaaaaagaaaagtacaggaacatgactcttaaataagccaccatttcagtggatgcatttattgaattgatgctttcagtaagttgtttctcattgtatgcatcatgttaaaagttgtatttaatccacaggtttaatgattaatttcttccagttagggtaaaaatatagtattatagagtttatagtaatagtgttgatttcaacttacgatggagtaaacaggttttgtaattgccttgggaaagccagaacagaaaaagtaattctatcagcaacatggaagcaaaatgagtagatgacttcttttatctgggaagcacattttcaatcacgagttcatgattgacaagtgtgagtttgtttggctggggcagggttccgtgtgactgacctatctttttaggttcattcgtgttgaccaatctttatggatctgggagcagtaagtcaacctagaatcaccaaatttggctacttatatggtgacatcacagcgcaccaaaacgtacatcaaaaccactgaatctgttggtttcatggggttctgcttgggtaaggacccagccacacagttataagatgaaatcaagagttgaggtgctaggccgggcgtggtggctcacacctgtaatcccagcactttgggaggccaaagcaggcagatcacaaggtcaggagatcaagaccatcctggctaacacggtgaaaccctgtctctactaaaaatacaaaaaattagccgggcatggtggcggtcgcctgtagtcccagctactcaggaggctgaggcaggagaatggtgtgaacctggaaggcggagcttgcagtgagccgagatcgcgtcactgcactccagcctgggtgacagagtgagactctatctcaaaaaaaaaaaaaaaaaaaaaaaaaagagttgaggtggtagttgcacaaacctacctgtgataagtagagctatacgcatacactgtagcaaagtcaatttcctggttttggtactgtactctagctatgcaagaggtagccatttggaaaaagctggtgaagggtacctgggacctttctgtgctatgtttacaacttcctgtgtatccataactatttcaaaataaaaagtaaagcacacatgaaatcaagaggactattatttcctcggggagactggcagaagttggctgcacagtggcttcaagctggagggagatttggcttctatgagggcatgtgcgagtctagctctccagataccttagatgaaggccactggcctggggatggggccgggggcactcactgcctccctcactggcagctggacagtgactccacaccatggggccggggaggtggcaacataggtgcatgagagggggactgcccccaccctgcatatctgctggcgctgaaattctctcaggacagctcagccctgctttccagaagatgagaggacttcacaaagctgcccactgccactgagcaaacagaatgtcctgtgcagggaaagcagcagaagggcccagaaacagccagtagccaggcgtggtggtgggcgcctgtagtcccagctacttgggaggctgggcagcagcctgggcagcaaggtcaagtgcaggctgctgtggcactgggcgctgcccctggctgtgcaatcccagggctctgggtgagagctgaaccgaggctcacatctgcccttgctgggttccaccaccttctggcaaagagcattattggttcaatgttaatgccacggcctccccctagcagcacaagcccagcctccgctcacccagccccctagtgaggtgaaccacggctcctgtccaggggcccattgcaagtttccacacatcctcctgcctgctgcagagggccggcggtgtgccttgatacttggctatgcatcccatccacctctagcagcccctggcagctgccttgcacagaagagtcacctggtgaacactgactgaattgagtcaaatagaaagcagctctcactcagagagcagccctccacaccaatgtcagggagaggaaggctgagcacaagagaatctccctctgtccacagaaatgcctgagcatggaactctgggaaaactgcactcgtgtccagatgcaagtaaatgataaactcctcgagacttcagacagagagcatagacatttatagcgcaatgtacttgtaacacccagagacaataagccctcttgccaagtctttgctttgggagtataggctaattgagggagattgcactgttagtgaaaaaagtggaatgtttaataccaagtagggagggggtctgcctttccaagctggggaagtagggaggagagaggaggtttgtgtggatggtgctgttcaaggttcccctctgaatcctgctcacctttaaatacctctggcaggcctgcataaagggcccatttcccttcctcatctagtcgaaaataccagcaggattgctctgaatgaggagacaggagcctccattaaaatgcagacgccaattactctgcaggatgggcactaagcttatcctccagacttttactggtctagcaatttgattagtatcagggtagtaacatatctccctccaaagcgtggagagctcagaggggagggatatagtgaaagacaggtggattcagcatgatcagatctggatgggctgagcccaaggagaatgtgggctggagatcaggaataggcaggtgtgatggagaacttacaagggtaccatgaaagggaagagatataaacaagcaaaaagatatgagcttatctgttacgtatttctttacaattttacataaggttagtccttatggtgtactagaataatttccatttatgtgcaaggtaagatcatttttacatttagccatcatcttcattgacgatgcaattcttagagtaccttagagaatctagaggaaatagagtggtggccttcagcgcattcctccatcttattctcctgcccacacccaggaccagaagaagaacacattgtcattcagtctgaaaccacctcaaagaagcagggtttggtaacaattagaaggtgaaagagaaaaatcacctaagctgatctaatttctttctaaagggaggaagtgtattaattgagggtggggaggaggaatagcttgaggaaacttgtgtttccaagaaacagcctcaccagtagagattgtctgtggtttgcctgttcttgctgtaggcaggtgcacagttgatggaaggccatgcttatgagtcttcgatgacaaatgatgggtacatgatgggttgaaactctcctgagctttcttcactttcttggcttctctctatgctcaaatctctctatgcattttttttttttttttgagaaagagtcttgctctgtcgtccaggctggagtacaatggcgtgatctcagctcactgcaacctctgcctcctgagttcaagtaattctcctgcctcagtctcctaagtagctgggattacaggtggccatcaccaggcccggctaattttttttgtatttttagtagagatggggtttcaccatgttggccaggctcatctcaaactcttgacctcaggtgatccacccacctcggcctttcaaagtgctgggattacaggagtgaacccctgtgctcagccaatagttaattctttattttgaaatattctaggaggaggaaaaaaaaatctgaccatatccaaaggttagtagttaatagctaaatatcaacaaagaggatacagctaaagattccctaaagtttgagtcctgggtcttatttaattggtgacttgaataacatatttgaaagtaggctcatgaatctacagatgaatcttcaaaatacctttattatgataaaagagaaatccaatgctgatgagtaggcttgacttatgatgagaaagctgttcttccaaatcaaaatgtagtgaagacattttacataaagacacaagaaactccgcatagtcatctttgtatcacagatgcttacctagtatctgacatagggtcaatacccataaatgcttcttgaaatcagggttcagttagacacaaagctacagagcttaattaaacatataacaagatcattggtcattattacgaataaactcatgtttactggcctcttctcccgtatgtgaagagggatttcttattaatcccgggtcttaaatgagtttgtcctcagcaggatctcaaagtcataagagagctacaaagattgacaattattagacagtgtcagagttggaggtgagtcttaggttgggttgatgaagcaggagacttctagttctcaagaaaatgaagaataagagagtgacaaacagtgaccatatatgagcaacgtattacccatttgcctacatatattcattttgcactatatggaattacatatttttcatttccaagaatttgttgctcatccattgttgcaggtctgacaaattaccgaaagcaaagcataaaattaggatagaaatcccattgtgttaaagttccatggaaattatgcagaaactcaactgcacagaagagtgcattaaagatacagtggttgccctggggaagcttgctttcttcttaagtattaaacatgtcattttcatatttgagcaaaaacctgaataaactctgccctcaaagaaatgaaagataaccactgactgtgcacttcatataagcttcactgctacattttaaagtatcctgaatagtcccatgatgttaagatagcaacactttattatacacattactaacgtggcaagctctgaaggtcagggagtggctggctggtcttcagcttgacccatttgggaggtccattttcatctttggattatctggcctctcagtttgattactggggccataaacagctttcccgtgagagctgaggtgaacatttcttgctcattaggcctcttccagacaagcctcccttgcatgcaatgaatatgcacttgatgcccagtgaacatgcacttgatactcaatcattgttcttgacttgacattctggttgattatcagacatgtaatccatcagaacagagatgcaaactgaggatcttgaattttgttagtttcattccagagaaagctctgttggggctgggaggggtggcagaacggatgtggacggcgaatattgatgcggtgtgtgtgtatataatgttctcctgggagaggtgtttcttaaaaagccgagttggttttcaacgtgatatttaaccgaatgctgccaaattgtgctacctccccagcacgttaaaaaaatccattaataaagtgtttgttgttgtcagaatgcctattccaaagcttgggctgtgtgaagggctgactccccacaagagaccgatgacaggcgagggaggtagaggagagggctgaagatggatatgtgctgccttgctgacaagtggtgaggacaagcgaggcgatggatcagtagaattttccattaaatcaagaaaaacacaacttgccccccaacatcacctctgatggtttcttagaccagctgcttctctgactccctactgaggaacaaattgctttcctggcgggacatttggacactcctgcattaatagatatggatcccagcatgccaagccaagcaagaaggcaatttaatatgagcaacactgtcatctcaatttaggacaacagctagaatgccctacagggcactgcaacagcttcgagaagtacatgacagaagacattctcactgtcttgaggctagagaaagctggtgtttctagtaaacagtcagaccaaggataatagaaaatgtaatgcaaagatgacagcagcattgtcctatctgtgaacatcagtttcaattcatgtgtctttcccttccgtagtgaacggaggtcctgtgtagggtacttcccttctatctcaatcccatcacaaagacacaaacaaaaagcccagtgacatcgtatcaataaagaaataggtaacattagatgacagatgttgtatacctatgtttgaggaaggtcaaagtaagaggtaacttcacgtttgcatgttcaaacttacttatctatctttgatgctatgcaagacaaaataaatggaagccctttaaatttccacctcctaacactagcctgtatgcaagaaaaatatattcttgctttttaaaaaaaaactctaaatgcattatgttttggtacatactttaatattagtttctattttatttttccataataaagacatggttgaatccagtgtatctattatgctaagataatttatgctaggataatatttttgataggaattctcataacaaatcagcttcatgtaccaattacaaaattgggagataactaaatttttataaaacgttttggcaatatctactgatacatcagtttattttaagtcagtgtggtttcttatcaatcatattgccagggattcatacataaattgagaataaaatatgttcacatgtaacaaaaatacaaatgtatctcctgttagagtctctctagatagagacagaaaaagtgacacagtagattcacacttgagtttgctcacagacaatggcgattcatatcaattgcaatgcttttcatggtgtcattttgcattagacacaaaatcgcaaaataactcaattggtcattaccatgaacacttcaccatggaactagctatgtgacagctcataaggctatcattattatgttgtcaaaagtccctattgctaacatttactgtatgatgaaaaaggtctttcccctatctcatgtgtgtttgatgaggtgacattgttttataaatcaatttcatggaaagtaagtatttatcttaaaatggtatccttttatctttctctgttcctcctcttctccctcctgttactgtttttcttcttcttttgcaaaacatttgaacacagaagcaaaccatttttcaaaataccatctgagaaacccatcaagcatggatagcacctgtgaccagaggagagcctctcagcaagagagagactgggaataacatttcccgtatcacttgggaagtaagaggaaaaaaatgaacacaattcaatccatgaattaaaaaaattttttttcctatccagatagttctcattattttttcattaaatattttttaacataaaaatcccttgtttccactattttctatttgtgaaaaggcaagaaaataataccagctttctgtgcatagatctatcacagcacttccaaaaggatgttggaattattttagatcgtggactccctgagcagcaagggtggtccagtcttgtatttccagcacccatgaaaaatgactccatataatattgggcagaagtgctctgaatgaaatgctcccaaatagaaaaaaattgttttgtgtatctataggaagatatttcagaattatattttatttttttatttttccagagacagggtctcactctgttgcccaggctggagtgcaatggcatgaacatagctcactgtagtctcgaactcctgggctcaagtgatcctcttgcctcagtctcccaagtagctagaactacggctgcatgcccctgtgctcagctaattttttttagtatatttggtagaaacggggcctcactatgctgcccaggctcaaaactatctttagactcaacaatagttaaaaccaaaaatagtttaaattgaaggttttgaattccagagggattatgcttttcggagctgaatttcctcaaacaaccgtaacctcatctgcttgcatagcatataatatttatcaaatactaaacaaaaaatggtgaatctggaggtgaagagatatttctgcaaaggagtcttgatgattaaaagttttcaaaattataccttcacctcttatcagtgcacaacatcgtaagagtttggagggagacactcatctgctttccttcccaatgagtaggtgtacgcaggacggagcctgtcagaagagcagggctggctgctgtccttgcatccgtttgatgtaggagatcacaggaaacaatgtgaaattctgcagcctggttttaaaatttcttacatcttttacacatttcaaaacatcaaatatgtttgttgtagcttgttcttacctctattctgcctaagcaaatgatatttcatctcttaatgtgaaaataagatttttgagttgacacattcattcattttctaaaaggtgtgtgtgtgtgtgtgtgtgtatgtgtgtgtgagtagggttctgtgtgagatggacgggtgaagccataaggatatatagtataaagccatcctttataaaacaggacaacaaatcttacactaaaaatttgctctgtagagttgcaagcctcagaaagtttaggagtgtcacctgtcctgttcctgggcctggagatgagggtccacctctcccaggtcctgaggactttcctcctggagcctagcctgccagtgagtaggctgctctgatctcttctccctgcactccaacatcttgctttcagctttgccctctaaatactggaataaaagggccaacaggtcagggatattgggagcaggagaactgtggtgctgcatgaatttaagggatgtttttattataagatcagagaaggaaaaatgatcagaaagcaaagagaggaaaagtttagtttatgagaaggctgtaggaggcagttcccggagcctaagtattaaaatatgaacagagacaagagaacctacctgcacttagtatccctgtacttgggatctttgaaggctatactattttaaaaaattattctattcagcgcattgcatcagaaatgcttctatgttaatctggaaataggtgttctaattatagatgctaaaaatgttctgtatactacttggctatagaatagcctacagatataataaaaaataattatttaaagtaatttttggaaaacaacccaataacttagataatgttattaatatgggtatcaaatattttaaatctaattataccaatgtctcaaatatataacaaatataacagaaaagattaactgaaagataggtttaagttgcctgtaacccaaatctgtgtatataagcaatttagtattgtgtatcttctaaagaccactgcttgaatacaattaaatgatcactcacatataatagtgggctgataaaccagctcttttccaaccttcctaaaaaaaaaggtcagtcccataaatactctcatcacagtcagtttcaagctgccaacatgaagttgctgaacatggagctggaaaaagatgtgcataactggctcctgtgaacctggtacagctggctccagcctccagtagacactcatgtgttcagacacatgcatgtgcgtgcacacaaacacacctgttcaacagattacagttgcttattgtattgtacttgagtattgaataattgcttcttgcttactttgaaaagtacctaagctacaacaatgggcaaaaagtttctcgaatgcacacaaactaaaatattaagtgatattttcctattgtcttcttttttgttgtcctgtcttgctaattctttcttgtttacatgctataaccattagaagctctgctaacatcttaaataaaatagaaatattaaaatatatatataaatataagtaatataaataaatataatgaaataaaatctcaaagcatcagtaattgctacatgaggagcaaaccctctgatataattttacatttactcatccattcatttgcaaatgtttgctaagcactgtaggggacagaaaagactttctttatcctctgaaggttcgataatgtagtctatgaaataaactgacagtagacagatcaacacgataaaatacatacaaatttattacatacatatgcatgagagtccctcaaaatataaggctcaaagaaggggtaggtaattggagtttatatagaatccctgggctacagaaaggaatagaggtttggggtctctggctgggaggtggtgacaggttatggaaaggtgaggggaggaaatgtatgatgaacaaaggctatcttgttataccgatagaaagcctcaggagtagtaaaagttgtttcagtgcatctctcagaagaatctgtgatcacctgtgacagagtctgtctgggtaaggtatcacctccaatcttacctcctgtgataagatcttctctgtttcatgagattcctatgacaattattttcctttatagatatagatttcttttacaaaagaacagctattcagaggcacttctgtgtctgcaacttctcagaataaccagctcaaaatatgccaaagaagtacattctggggtggcatgttctggtctcctaccatcatattttggggtgaagtgtcttgagccccaacggcatcaagtatgaacttggagccagggctttggtgtacatttctgtaatttgtgcttcacacaaacaattccacctataaggccagaagggctgggaaacagggcatttccctccctgaaccttacaacctgctggatgctatgcccacatgagggaggggtgccttctaattcacagcaagatgccttctgctaccaagtgctgtggcctctctctgcctgaggggtggagtgaggaacatctgcccatgggtagtagcaccttgtaaaatctaaaaggtggggaggcaaagaggacacgcactgcatcttcttcccttgcacttccttttactactagaatgagagtttcctctttccgtgatgctctaatattcctagtcaggccaagctattgctaatcagaacattctccggctctccagtcttctttattagactggcctctacagggctggagtctcttttctgacagtgccactgaatcagctgtctgaagaacccttgcgggagactgatggaccttcacagacaccgtttctctaggtcagctcagtttaccccaaggccacaggcattactgcctcctttaacacagcactgcttttaaacatttctttccccccacttagtccccagagacttagagttaacttgaataaattcccctaatctgagattgaaaagacagaaaagatagaaatcttttcttccttcaaaatacttaacatatatttgtgggacagaagaatttccatagatataatatatgcataaaatgtcactgttaaagtaatcctcaggggaaagatttttcatttgtgactttacttagccatgtcatattgagacaggattttattctgattggtagtttttggttttctctttctgtttagtaatgaatactggtaaacctcccagctacaaatatctcctgatatgttaaagaaacagagtcttccatagctgtagtgggtgcacagctgtgggaacgcaatgtggcctctcatacactccaggagctgttcctccaccccttccatgaaggaaaggtgatgccttaacccttttggagaggtgagcagtcttgaagccctcaataatatccaccagcaccccagtgaaaatgggaaataagacaggaacttggagaactcccattgagaaaagatcctagaaatcacagcagagtggcagggtctttctcaactgtgtccaagtggaaatggggttgtgtacaaatagggccccctcatataacacgcaactgactccagggcacacccatacttttaacgtctgattgctttcaagaatgctgtgaaaagttgttgcgagatacatgggattgagacttctgcagtaaagggttgaggttagacactgagtaacttcttgtcagtaaaaggaattaaacactgcctcaggagatggtataattatctcctggggaggtgactttttgtcttgaatgattaggtgaagtccaatgagaatctaagaggctggatgaaaattcttggaaattaagccacaactgaaaaaaggagccaaataaataaggccttctctggggcctcataccgtgtaccaagggtcgaagaagtaaagtttgcctgactcatgattctagcttagaaggcaggaatcctgctttgttttatttgaattattgcattgatattcacaacaacagtcttgtttgaatatcttaatttaggagtctgctacttaaaacagctgtcttatgtctatgagatatacgagccacaaccacagactctacgctgcgttcctctccctagtcaccgcatgccttcctgttccagtgaaatttagggtattgaaaggcaagagtctcatcttcgaatatctgatttgatgagtgattgctggaagtggatgccttagggaaggtgagaagacaatgatggggatgatgttgacacctggttgtggctgacggctgtgtccctccagctgcctcacctggggccgcagtaagcaccaagttcacaggcttagtgaggcgagtcacacattagcccatctgctctggtaatgtcaataccagcatgcaagaaagctccgagtcttagagatggaagaggcctccttttgtagaggaacgggaaacagtggcacaggaaaggtgaaatggcttacttatgatctcacagcaatgggacagagaaatggctggtttctcttcaaactcacacagtttcagttccagtaataaaacatctaaacctccatatttggacgaagtatagtctactcataggattacggcaactcagtttaagtgaggctgttttggaagaagctgtcctacatataagttgtcttctgcaaaataagacacaaaaatagttttgaaatcaaaaaagatttataaacattattggtacaactgatttttgtctctggctggaaaatttttcatgggttacacattctttcatatatttctcacatttgagaagtggagatttaattgcttacattttgatgatgaagaaaaataccacttgacacaaattaatgtcaatccttgagggaccagttccttttccacggcatatataataaaataacacaggaacattaatctactttgtagagtagtgaaacttattgagcatgttataaaaacaacagagcagcaaaagcattttacttaagaagcatttaaaaaaaaaaccctcattcatttcacaccactctgatgttttagccaacagttttttcactgggccgtggctgtgcacacgggcttcttgccatcacttaaatggacacttctcaaactctccctcacaggtgttcctggacagcacaggaaagagaacaaagagaacaaaaactacttggattgtctggaggtcatagtccaaaggaagggttgtaaatttagacattttttgaagattcacgtgtttggttcaatataaaagtatcattccccacccagacctgtcccagtgtctagggaaatgcaccttctcctgtgacattgcatatcatcttccatatcaggtaccctggtttgaaaaatcatacttttagaagaaattgccctttccattttcttaactgctctggagaccagcaggaattggagcagcctcattccgtgtcgaagaagacctatacggcttgcttctttttttctttttttcttttttttttttgagatggagtttcactcttgttgcccaggctggagtgcaatggcatgatctcggctcaccgcaacctccacctcccaggttcaagcgcttctcctgcctagcctcccaagtagctgggattacaggcatttaccaccacgcctggctaatttttttctatttttagtggagacggggtttctctatgttggtcaggccagtctcgaactcctgacctcaggtgatccgcccgtattggcctcccaaagtgctgggattacaggcgtgagccaccacacctggcccaaggcttgcttcttttaagagaaaaaggctgtcatgctgctctacttcagagaacagaccaatttttagagagcttcaacaatttctttctaatgataattcaaatctttaccaaaatcctaacacatcaaatttcagtttcatattttcaactacctacgggatattttattgcttcaaacagaacatagcactccaccatctgataataatgtttattttacctgaatgcaagttccgtaagttccatcatttgcccagccttaataataattgtgcaaggccgggcgcggtggctcacgcctgtaatcccagcattttgggaggctgaggcgggcagatcacgaggtcaggagatcgagaccatcctggctaacatggtgaaaccccgtctctactaaaaatacaaaaaattagccgggtatggtggcgggcgcctgtagtcccagctactcgggaggctgagggaggagaatggcgtgaacccgggaggcagagcttgcagtgagccgagatcatgccactgcactccagcctggatgacagagcgagactccgtctcaaaaaaaaaaaaaaaaattaattgtgcgaacgccaccccctaccctcgcccagcaacacagcaacattgctgaggaaactgatgcactcccacattttaatgacccagtgttggaagaagtcaactaaatgagttaaaagtgtcccaaggtaggtggcccagtaagaccatcccaaagaaaggaacctgggcagaatccaaaataggctcaaaggagaagattttctctttagggggcttgtacgtgtgagtggacatagatatatacgctgcaaacgtgtaggggatatttaggagcactgtccctgctgctctagggcacctattccttggaaagagtcagggtgctctgaaaaaaatcatgtcagtcttaccagcaagggaattgtaaacctgaatatcagacatgcgggtggattacctgcgtctattatccaggcttgggaaatggaggtgctcagggatgagaaggattagattataaaagaacagctttgaggaatgttttggaactgttacaatggatcccacttttagggatacatagaaaaagtctttgcaaataccagagatacaggcactacaaggaaattagatagatgccaaaagcatttaataaagaaggagtttggggtaaaaatttgcaaatcttcaccatcctactcttccctgaaacaaaaaactaatttcaatttaaaattttcactatgattagttctattaaaaatcaatcaatctatccatcctatctctgtcttgcactctctctctctctctctctctctctatatatatatatatatatatatataatctatctatgtgtctataagtacaagatgcttcttgcagaaaaatttgcctagagactgtgatttgtgtaaaactaactggattaaaattaaaattcgcaagttttagggttcacttaagcaaaaaaataactttttcattggtaaaatggtaaatttatttctggatctagtttgtgaagcaggagtgtgtatatggctgtgtgtgtatgagtgtgggtgtatgtatgtagtgtgtgtgtgtgagtgtgtgtgtctgagtctggacccagctccctactcaggagtttactccatactctatctcttccagagtaggctgtgattcccagtgtactaatgttaaatgttccagagacattgaaaatatctagggttgttataaattagctttgtggggtttttttacttgcttttgtttgtatttttgaataaatgagttgaggaaaaaacatccttgctaaatagaaatcatgggttacgagacgggagagacgcccacgtggtaatatggctggaatgtcatggtcagaaggtctttcctgtctttcactttttcatgttcactggtgcatgcacgtggatgctgggatatctgagtcaagaagggtggctgtcactgtccaccctttatacctgccaccacttctcaaatactggtagaaagcctcttataaatctacaaatcttgtcacttgcgggacttttcaatatgaaaccctcttatacaattatatgtatgttggataccatggtggatgctgaggaaacagtaaggaaaatttgctatttcagacttgtaaatattaaactcatatttttagatttaaaaaaggcagcaaattatgcagcataataaagatgggtgagtataaatattctatagtgtaccatattagctattaaacattatacagagagtggttatgaattcaatttctaaataatctctaaaataaaagaatgatctaaatcttccacatccctgaggtattagtcttaaatgcatatgatattacaaaactaaaattcttaaaataatttctgaaaaactagtgatacaggagttgtaaagaaattacttgggcagtgagggtatggaagtcctcagtaaggttttcttcttaatgaaaagcagcccccaaatcattttcttttccaacaaagagcagcctgtaaaatcgacctgcagacacaaacaagcatgctggaagcttgcacaggtacatgctggcagttgtgcccgtaggaatatactacctgggactagccatgttcaaaatggcggctccatcttctctttttgccagccacgtgtccagtaaggagcagacaagatagccccaccaagtggaaagcccatttgcataataagattagggtggggcgaccagccttcttcgcgtgctaagtaaacgtcacacctggtcaaaccaatctgtgagccctacgtaaatcagacactgcctcctcaagcctgcctataaaatctgctgggatctgccaccttaaccctttttttcagacatctctctctcttgcaaggagctgccctcctctctcctttcttccgcctgttaaactttccactccttaacccacccacgtgtctgtgtacttaattttcttggcgtgagataaggaaccctggggatttaccctagactacgatgctgcttcactagtaggaagagaaaagataaacagcgattcctgttttataaggtaggaaggctgtatattcacacgacactcgccgtcacagtggtctctgtgacttcagtgaaccccctttccacctgtcctcctcgccctcacactagattactttttccaaaagatctgatcatgtcacttcccctggaagcccttgcctggcctccattgtctgcaggatgaagtactgaatccttaacccacagggccagactccctttccctgtcctgctcttgatcaggcaccatgagcccacgactcctctccgtcggctaatcattcctccctggccgtgttctctgcagctgcctagctttctgtcccttcactctgttccagaatcttctgcctgaaatatttcagtcaccacttccaggtcaaatttctccatccctcagtgcgcttaatgaagctccccattcttgattccaaaccttttcctttctcactgcatcattcatgattgatacaacgatgagtgtgctgaatgcaggcatcgttgctgaggatacaaaaatgaatagaaggcagctcctgctcaccccaccagcggccccacagcagctccacgtgtgggcaagtggtatgcacacgagcaatgtgatacacgtgactatgagatgtgttcaaggtgatgcggaaactgggtacgaaggcccttaagtatcctggatttctgtgggacattcccctgcacagttacgtgttgccatgcggctatgctgtttcgcatagacatgtcttgtcttcccattagatgacgtgtttcttcagcacagtggctgtgacatcacctctgtgtgcctgtagcatctagcagagagccacatacatgctggataaccaattcatgcatgtagaataaacaattttcccctacaagtattactgatttattttaaatataagaaagaatatactgaattttcccccttggtgcatgtttcttatgagtacagcttagttgctaaaaacagcgtgatttctagtgattgcggtagaagaataaaagctaaaactcctaggacttctgttagaaatgtaaatcagaagctgatattacttcaagtgctacgtgaaataccacattcaatttgtaactccaaaagctttagtctgtggtacatgtggttctacatggtttagtagtgcctttgtatgtgacatgagaacaaaataatcagcaggtgtaaatgtcaatcgaactagagaattttctagaattgtacctctgctttcagtttatggcactactgaatgcaaactctatttatctgcacaacttcagaaggttattgtggcaacaccttttaatagaaggggcgaatacaattttacgggtattattgagagttagaggtctaatttctcatgcctgggaatacggaaagtgaaaaatatatattgttacaaaaaaagataaccaaggaaatactcaattctgttagaaataaaaaagaagtagtttcatgccagaagacttttttcttttcctgcatgaaaatatgaaactctgagactgcacacaagtgaatggtatttgagtaatgataaaaggagacagaaaagacaccagatgaggcagaggctgacatttgtccgctcatcatccatttgcccttttcttcataggaacagtttctagctgggcacatcgcaccccgaatacagatatttcccaactgctttgggggctggccatgtagcctcacaagtaacttttctctgtcggaatacgagtacgatgttgtgtgctacttccagatttgacctttaaagagactgggaatgtcctcttctctttcccctttgtttctggttgaaaagtggacctggggctgagccaccttgcaccatgtagatgagggcaactaaaggcttggtggagtggagcatcccagctccagacattttatgagagagagaaataaactcccatccccttaagccactgcagtcttaggaactggccacacaccacggaactaacgtcagaataatataatggagcctactacaatccatttagccagagaggaacaaaaagattttttttttttattgctgattacagttacagtggacacaaccatattatggaatataataatctggaggtgattttgtttgctactaaaacgctctcatcaaatacttcttttttttccccaatatctgcccaaagtccttagtaaatgaattcctttggtcattattaagagaaataaatgcctgtgtgcccattaagagattttgattggagaaacagaaagccccaatttaactggcttaaatagaaaggaaatgtatcatatcccatgacaggcagtccaaccatggagtggcttcagagctgatgaactcagtagggcaatgaactctagaagggcctggatcttctgaaacctgatcactagtaagggtcaagggattagcaagactggtttagactactcagaactcactactgacccggaaaatgaggtcatttcccaaactggtccacacttgaaaaaaaaaaaaaatctgttctgttagcaagagaaagggggagatggccgtcaggagggaaaccgacattttagtgtacagtctgtctgctgtgcacacagagattctaaccatgacctgatagaaacttacccctgccagctgccagccaggtgctgggggtcatgctctatcagcaagcagttctgtttgtacagggaaggtgcatagcctatagagtcggtttcatgctggctattttattcacattctgaggtagtttgtgtccctgcagatttctgattatacatcagtgacgtttaatgtgatgctcagaatattaaaagcatacccagtaagtgttttatctaaatcatgtttacaagggaagttctgtgcttttctgaggtcttgcaaaaacaatctttggtttctttagaccaagaaactaaaaatagacacagtgacatagcctccaaacagcaattttgagatcgaaaacctctgttacattaacaatgtgaagcagttcccatccatcccattacaggaagttctgggtcaatagatttagtctaacaaagatcttatctctttaatcctatctttctacttcaacttttcttattgattaagcatcttctgaactttacaacaatacaatactgcttatacaaagcccagccatgtcttcacataaaagagtttttgagaagcctactttgatttagatttctttctttccaaatagcagctatcttctgaacacatagcttttctacgtacttcctatttacatgtaaaaccatttaaatgaatggtctaaacaaggttgattaatcactgggaaatttctctttcaggacacatccattccaagctctacattctttaaaaatctagcaaataaaatttcatcttatttctgatgcaaatgactaacataagttgactggactatctcttctatttccttcagataatcagggcaagtcaaaatgcaggcttgtacaaataaagaacaatgcttcaagttcttttttttttcttttcttttttcttttttttttgagatggattcttgctctgtcgcccaggctggagtttagtggcgtgatctcggctcactgcaagctctgcctcccaggttcacaccattctcctgcctcagcctccggagtagctgggactacaggcacccgccaccatgctcggctaattttttgtgtttttagtagagacggggtttcaccatgttagcctggatggtctcgatctcctgacctcgtgatccgcccgccttagcctcccaaagtgctgggattacaggcgtgagccactgcgcccggcctcaaattcttaggacacaatcaaaagcttgcatttgataatgtgtgtaagaattctttaggcatatgtcacattctgcaagtggactgggtttgtctacatggggaggcggccacgggaagagtgaacacagacttcctccaaattacagccctgccagtttagcactaataccttgagaggaattgggaaaaaatcgcttggcatcaaattcccagactgtccctgaactctggtcaataaccaacacggctttgtgaagaaaaatgtgatgtgtgtcaggaacaatattatttctgtctgaaggagagtaacaggcaactttgattggataaagaaacaggcattcttggccttcttctacagaaaggaggaagaaaattgctttttggaagtgcagcaataggcccgcttgacaaattacctcctagagtgcaagagtgaggcttatctgcttctgactgggttccttctcacttgtacacttcttctgatcctggttcaagaatgggcaaacagacaggcaagggttatacatttgacctgggccttacccatggccttgtagttacttgatatttttcttctccttgaaaaaaattcttaaataaattggactttaagaaatctccttcttagtctctatccacaacctcaacttcttaatggacagtggggacaaaggcctgtatggtaggcttggatagctctgccaggtgtacctcctaaggacctccaaatcttaggggaggtgggactaaaggtcaagccaggacagatcagatttgcctaggggacacttcaagtttccacttcttggtgcaaaaagaggccaaagtgagtctttgaggacttcaactggtagaatcctggggcccactgagatgccaagcggagaaggaggaaaaatggctgcatttcttggaatctcaggaaatgtgatttctacatctgttgcagatccttggagaccagtgcccatgggactggctggtctttacccaagaaaagccctattacctcccaggagcttgtagagagatttgattgaataactgatcgacttagcctttcccagtggaatgttggacaagcgagagaaatgcctgtcactctagtcctgagtgctcattctgtgtgggctcccttgaactctgcctaaatgtcatgaacaacaggaataacagcaggtacttagcgctgaccttggtgttcctgtttcgtgtgaagagtgagggcgtgctgcttcttcatcatgccatgaggctaacatgcgatgttcttggcatgtgctagacaatctctgcccttacccccaaggggcactagctgaacaaaaacaacactaaaatcccctgtaggaagttgattgctagaatacagatatgtgcaaagttgcattgggatacgttttcctataacgtaagaactatttaaactatttaaacattttgtgtaatttaattaaaacatcactgatttgcattggctgctcaatacatttggtgacatgtttcagagaccctattttgcgaaggtaaattaaatttcccagtggacttcattctcattaaaaaatgacattcagctacatgggtatgacaggagagttgctcctgacgcattccaggtttaagagtggccagccggaccaccacctgcatgcctggctctttctggaacagcagcgagccttcacggagttggtttctgtgccctcggtctctgccagtgaaaagcatatttccttctccctaagtttaacctcaaagaaacactttgcctaaaaaggtgtaaaattctacctaataataattattggtcacattgcttttatttttaacatgtaacattactaagtttaattaagaaaaaaagtaattcataaactcagtccctaagtaaccatcaactacatgttcagaaacctcaaacattctagaaggttataaactgaaaagtaaaagcttcctccctcacatcatcacttcctctacccaaaggcagccactgttcccggggtgtctttgattctttccagaaaatatcttatatgctcatgtgcatggatccccttttcatgctgtctttacttcattctgtgtattaaaagtgattccgtatcaggacacggattgaccttactcttcataacagagtattgtattccactgtataattatgtcaagaacatacttaactgctataatactatggaaaagtggatcgtttccatatttttatctattacaaaatagtgctggaaaggggaagatcaccattcagaatgctgggggttggggagatgcaagctgcctgtctggtggggggccgccaggtctgccccagctggactggacccaagcactacatccttaggattgttctcactgtttgcagaagcacttcttctgacatggaaaacaaaaacacaatctacatgtcatttttgttgttattatcataatgccccatgcagttaatgtttttgagattgacacatggtgacactcgccctatgaaaatattttatttatcattatataagttattctatgaaattttaaaatctctcatattcatttaattaacccttggaagaagagttactaagcatacacgatcacaaaatttcatcccatcttctctaattgatcttaaacccataaaaatatatatcaatggcagtgttagaaagaaaaagattttactgtaaaaataaattgtagtctcaaaaatacatttgaggcaaataaaccatataatttaaaaagtcatactttcattagttctctacagaaatgaactattgtgggcctaatggctctgatttttgggtatcacttgctcattgtgactagcagtatgcaactcagcactacggattaaaaaaataaagcaagccatctgaatcccaagttgcttcataaaacacctgtcttacaaaatgtaccacacaaaaggtagttcttgctctacagagtttaggaaatgctgagtgtgctgttctgcttgttcaagcaatacatctttgcatagtgaaagttttaagtcctataggaaagaaattggtttaatctggcttacctggtgcctccaactcttggattgcagctctctgctccacctctctgtaccccaactcctgccctgctcctggcagcatctgttggaacctggattgcatgacccgtactctggaaaatgctgctctatatttttgtagtcaagaaattgctttatttctggaaagtttttttctttttttccctcaactacagctgaatagctcaaagtgcttgtgttgaaaacacaggaaacctgagtttgcaaatgttattccttggacagacgtccctgtccttttccagactggaactgtccagtagaactttctgcagtgatgaaaatgggctatatctgcactgttcaatacagtagccacttgccatgtatggccactgagtgcttggaatgtggttactgtgattgaggaactgactttttaattatatttacttttaaatagccatatgtggctaaaggctgccatgtcagacacacagccccagacagaggtcagagcacgaccaaaataaatgcacagaaacaatgctctccacacagaaacaatgcaatcttcacaagaagtctgttttcaggactgttctgagctctctgcagcttataaagctaaagaagtttctccaatcgatttgccataaaactgattttctaacacattattcaaaaagatggatcttacgattttgaaagagtataattattggtcaggtgcggtggctcacgcctataattccagcactttgggaggctgaggagggtggatcgcctgaggtcaggagttcgagaccagcctgaccaacatggtgcaatcccgtctctactaaatttacaaaaattagctgggcgtagtggcacgtgcctgtaatcccagctactcaggaggctgaggcaggagaatcgtttgaaccttgaaggcggaggtgacagtgagccgagatcatgccactgcactccagcctgggtgacagagcgagactccgtctcaaaaagaaaaaaaaaaaacagtataattatttcatatttacctttatttcaacaaaaactggctaaagacaataagaatagctagtggtctgtgttgggttaaaaaatatacttttctatgtgcagctgacccttgaacaacatgtattagaacgtaagtccacttgtatgtagattttcttcctcctctgccacctcggtaacagcaagaccaacccctcctcttcctcctcagcctactcaacatgaagatgatgagggtgaaggcctttatggcgatctacttccatttagtaaacagaaaatacattttctcttccttatgattttcttaataatgttttcttttctctagcttactttatcataagaatatagtatataatacatgtgacatacaaaatacctgctcattagccatttatattattgacaaggcttcccgtcaacagtggatcattgtagttaagtttaagctatctgccgactttcagttgcaggaggggttggcacccctcaactccccgtagctcatcaaagatcagctgtacctcaaaatcacggaacactttctaggaatgtctgccaactgatagatgctttccagatgaatggtatgcagaacttgtttgtacatttgtgaacagtttctttaactaaaataaatactctccaaagctttccatctttgcacttcaagctgtctcacaggcagaaagtctagcgaggcttatttccaatctgcaaatgagctgatcttagagtttaaattagatttttggacacatgtcaaataaacatggactgcatatttttgacatttcataacaccaactttcttttttaaaatgctctttgatgaagaacatcttgtatatcaaagcctaaagtaccaacaagatttgattccagtctctatgtgctggagtgtccaggcggttgaggcaaacttacatggggacagctggagtgaaggctcatgaacccacagttagtcatcctgagaaacacctgttctttctgatgtctccctgaaaacatcatatatttggagactagattttaatctctagtcttaaaaaaactcaatatggtttaaaaaatatctaagcataatttaatgaaattacatatttttacaaaaataaattaaaattggcttgaataagaaaagtaaccattttcttttttccttttattattaaatattgatcatctacatgttttctctttccaaggtccacctattgaaaaaagagcttcacatctatttgttaatttggattttaaactcaataattagttaaatctttgagtaaaagggtaggtatcatcataatttatcttcattgactcctttcctacgttaaaggctgaaaatgaggttcagactctcatttcactaaaacctccaacagtattttaatgctgttgtgataagtcgttcaaaataaccattttcaccaaaaacatatacacgtttctttgcacgaagtaggtcatatcctgtatttgcacaggtctaaaaccacatttgagggaggctttacaacttcatttttataattttcgaaaccctttttaagaaaaccaatgcaagaagatgaacatggttaagaggatttggaaagggtccatgcaagtgaggagcccaaggtgaatgcctcattagttccctgacaaacctgcctccgagcgacacagcatggtgtttgtttaaggacagagtgactgttagatgccttaagaaattctatcgcatttccttaacttatggtcactaatatgatttttgaaattcgattttcatttaaatgtgtatttttctgcagttgccacattttgtttctggatttctaattaaaaacagaaaattccttatccaacttcaaatcattattttaataaattatcacccagacatgtaataccccaagataatatcaaataagataaagatgttttatttatagagaactcagaaggtttgattgccatagctttctgcattcccaggtcagtgagtataatgtattccatattttgttgctgttttccagcactaaacacgtcagcattttgcatcggagtcattaaagtttgtgagatagttctgatgaatagcaataaggccagaaaaaaagaataatgcataacatgaattctttaggaaatcaattaatttttttatgagcagtagtaaaaataggatctagggttagcagagtgaggctagactagtatttggtaccaaaatacattctctgctgcgttctatctatgtaaaaatattctgtgctgagtcaaaactgaaatctcagttctcccaagagtaagacattttacatatcagaatgtactctttacttggccgtgtatgtagcctttgatagagcacaccaattctgtaaattctgcagtactttcaggtttctaatggactttttgtggatccctgaacatagtgttattttggttttctgaattatatactatgtgtgctattaaaacactgtatattgtataagtatataaaggtgcttacgtatttttcaaagagctctttgttggggcaaggtaagcagttctaatactgggataaatgatgattaatattggaaaataaaagtaatagtttgttgatattactcctagattattaagattcactcaaccatttattttattcattcattcattcattcattcattcattcattcatacatttgatgaatgttaaacaccaaatacatgattcaccaagaagaatgaaaaggcttaggacaggaatataaagacaggaaaccactgtaacactgcagcttgaattctgggaggtagtactttcaaataattctttataatggtaataaatttactggatccaccccacatttatcaggcctttcctaggtggactgacatcatcacttaaatggaaatccctgtcttcatttattagttaaggtacattgctcctcggggaacagataagcctgtgacacagtggagcaaagtgtctggaatctgattttccaatggacattcccatatgtttgaacaaaagagtcataaatactaactatagcacctattttacagaagctgaactaaagacacagaagccttcaaatggaaaggatatacaacagaaaccacagctgtgcggaagaccacccaggtacatggtcgtgggtgaaatgactagaagattagaatcctctggagcccagagctcaacacatgggtgtctagctccgaacaattttaaatcccacaaatgacagagaatttggttttcaacttttttatacgcgattttttttgtaacagctaacatttcttgcatacccacatggtaagagttgtactttttctatcttgataattgagggaaaaaaaaattaagcacgggtgaattcacaggcatcttacaataaatctgtgaaccacatcctgataatcactggagttaatgacgtctagggctttttccacatctggaactctgtaattcttctatagctttgctaccaatgacttttccttgaacgatgtattgaatgaggcactcacttctccctgaggcagcttattttgttcttcgttgtccatactgtgagagcaaagagtaaaaagagattcaccttcttctaacttttatgtatttggccatgttctacttctgaaatgacataatctaaccacaatttcttccagacaatggctttccattacactccttaaacccagaaaagatgggcagcttacaaggttatacaaaccacagcaaaacaacatgtatcaggaaaaggggaagagaaagaaggaaacaagtaaagccaggaaaccagtttccaaatccactgtgtttatgacctctatatatgctatagggagcccacagatgtagctttagattttctagcagtcaactgtcagaggaaaaccttatcagctggtttaacatccttaaaggcaactttcctcaggacaagcataaatgtgcctggtactcagatcagacttgaatagtcaccatggttccttgtggaaaagtctgttgggatgtcctgaaccacaggcatcacatttcctgtgtaacgatcacaatataaacaaatggcatggtggcaaagtagtatttaggaaaagcaattatttgaaaggctaaaaatagtaaggtctaggtgcccagtttcctgccgtagatctgactacatcctggattctagactatttggaagagtatatccaatgaatgccatgtaagcaatcttccttgaatgttgggtttttgggtgagctttggataaatattcattaagcttttgattaaatattaaataaatctgcacttaactctgtgccaggaactattctaagtattttacacttattatctcatttagtatgcacaatagttttatacagagttgctcatatataccctattttagagataaggaaaccgagaaagatgaaaaccacaagtagtttgtgaagccagggtttgaacttcacacattcaacgccaccctttttaaatcactgtggaattcctttagcattcaagttaggtgaatatccttctgtgaaagtttgggatttgaagacaaagggcaatgatgaaatcaatttatctctgctgagaagccaaagcaatgggaatggacataagcttgcaaaagtgtatggagactggggcaaaaagacagggagggaaaggaaggcatacagttcagtgcatcctttagaaaatcacttctctgttcttttttcagcttcttcaaattgcaaactgtggtggtttaaaatacgttcataaattctttgacactctttaagatggagcccaactcccttccctttgagagtgagctggatctagtatctcacttctaatgaataaagtgagagtgacaggtgcagctttggggatttggtcctacaaggcactgtagcttctctctgttctctcttttggacaacttgctctggggaaagccagctgccatcatggggacaaacagcctaagacaagggccatgtggtgaggaactgtggccttctgacaacagccagtgaggaactgaggactttttttgccaacagtcatgtgaatgagctaccttggaagtagatcttccagccccagttaagcctccagataactgtgaccctgctaaactgcaaactcaggaggaaccctgagccagaactacccagcaaagccactcacgggtgattcctgactctcagaaactgtgagatgatacatttctatcatgttaaattgttagaatttggagttgctatgcagtcatagataactaatacacaaaccaacaaacacacctccaaaaccaacaaatcgaaacaaattaagataaattaagaatacgctacctacaattgccaaaggacaaagaaaccttgagaacataactatcctcctttaagtaaagttgcctgcagactcttttaatccaaagacattacagcattttgattcacttctaaaataatttgtcatgatttgcagcttaagtatgtatgttatttacttataatttacttgtataaaaaagggaagataaagatattcaagatttcacattacataaacccttcaacattcttaaagcaaggtcaacaaccaaatgcaaaagatgggccagcaaaagtctctacctcctaagaaaagttaaaatcttaaaatccagctttagaggatggaaccacagtaggcaattagcaggcagaagcacataatttagccagtagttaaaaacaattcattaaaagctcattttaaaagacaacatttgctagcattctgatcccagaggttggcaacctgctgaggccacacacaatcattgcagataattcagcacatgataatgactaaggctggagagtgtgtcctgatttccatcgtctccagggagagtaaacacttgagttttcattctaatgcaatcacgattatgaatccagaggtatttctttccacttaggcaccatggtatctcattatttttcaacttccacttcctctactccattgctcaacccaggattttatgagccccactgcatgacatacaggaagctttactaaggggaaccaatgctaatttatttctagatgacttacagtgctcagccccaaatcaagactggctaatacaactctgctatctgtgctccttcttgcacaaaactcctcatgaagttgcaattttaaaagaaatgtttctcatcaaaattcaatagacttttatatgcacatacactttctcacttttccaggctgcatgaaatttaatatcaggattattatccatttgtcattttaacctataatttagtaagcctttttgtgtttgagttatgcttcttccccccttgagccatcagcttgcagccatagattcatttgaaaagccggccaggtcacatggtttgacctcttagaacaaacattttccacatttcttattctgcttccataagagacaccattagttttgttcatctctacttaaaatgatttttatgacataataacatttcaagttttccacattaaccttcattttatttcttgaaatactcaggcaaacaatgtcactaagacgtcactgatggagaattctttctccttcactcctgtctacttaaaggcaactctgaagaaagaataaatttttgctctgcatcagctgagtgctgggagaaaagtttaaaagtctggcctagtggctcacagcatcttaaagtaaatacttccataagcaaccaaagcagaaaatcttcatataactgttttcaccaaaataaatacataaattttcaaatctggagtcctataaaggaatttaaaatctattttcttatatgtaagttcaaagatgtctaagtccaaagggaaaatgaaaataaaataaaaatataatcccagcccatgtgcaaaagcaaacaaggacaggaacacaccgctccaggggtgtgggcagtactcaccccacagcccaggccattgcccccttcgcaggtgactttcctctggtcaggctccggcagcagccccgctccacagccagggcgggggcataacacgccccccatctgcaggacacactcctctgcaccatactgctggtaccggttgtactgcaaaacccaaaaagcagattgagctttcaaactgactgcaaatttcagccaaagggttaggagctacagtgcatgggatttcttgcttaaccagtttcagtaaaataatgcatgtgtgtgtgtgtgtgtgtgtgtagggggagggagagggccacggggttgataggggaggacgaatatggttcaatgcagtaaaagtctaccaaattcaactggcaagacatataagtgtgtttactttttgcttttttgtcttcagaaaatagattttccaaagttttgtattttataagatcgcttctaccaactgtattttaacaatcttatttcatatacattttgaggaacatatttatgtattaaatgatgaacacttttaatacatcgctatcaatcttataaagcaatatattgtcatgcctctatttaaaattcaacaaggttttatatttattttgaaaatcggcccagcattccacctcataatattggcagcccacacaatatcaatgagctagaagaagactaatgttaaacaatcacattttccctttatcattattcttattcttaaagcatgatttcttgtgtccctgatgtcatttcttcctggtaccgttttgctcaatttcctttaatggtttccccagcctgcaaataaattccaaactccatcagaccattttcaaggtcttctttgtggcagccctacacttttgatcttacattatttgtaatataaactcagatcaagtcaaataggtttgctcaattattaattaaataatgcaacatttattgagagcctactacattccagactctatcgaggcgctggggatacagcagtgaatgaacaaacttctccgccttcatccacagcactgtaacagtcaataccgagaggttagaatgtctaggatttccaatggtgctaagtgaggaagaaaataatcaacagggaagagggagagtccaaagaaggtggagatttcaattttaaagaggtgattacagaatgccttacaaagcaggtgtctttaagcaaatgtctgaaggagattagaaatgcaagtcacatggatccctgggggaataagcattccagacaagcagagaatactataaggggccagagccccagtgtgctgatgtggttggctgttcagggtacaacaaggggggcagtggggcggaggcagagagaacaaggagggaaaaaaacagaaggtgaagttggagagtttgtgaggatctagaatatgtagttccctgacagctgctttcagaaccctgggtgttattctggaagataccagaaccactgcagaactctgaggctgaggcatgacataatttgactaatattttaaagacatccacctggctgctatgttcggaataccctctggagggccagggtgtaggcaggaagcagagaagcttatgtcaacatctatgacgtaagctaggagcttatgtcaacatctatgcaaaagatggcactggcttgaaccgggaaggtagtgctggaggtaggatgagtgtttgaattctgggtataaattaaagggagaagttgcagaattttcagtcaggttggatgcctggtgtgagaggaaaagaggagtcaactgtgagtggagtgtagttccccgtttcctgagaagacaggaggcgggtaggggtggggacaactgtggtagaagaaagggtatgtgtgtgtgtgcacgtgtgtgtgtgtgtgtgtgtgtgtagggagttgaggcatgaaataattatttctattgtgctcgtgttcagtttgataagctattacacagcgatgtcaaaatgtccagtatctaattgaataaataagtgtagtttaggagaaaggcatgggtcctgggtacaaattttgaagtcattagcctgagcctctaatccattttctcattcttctgtccccaggaaagaaagaaaaagatgacctggcctccttgtaaacgtgtgaatggcatacacatacagcacctttaccagaaaagaggtctaagagttcggatggcaaacaaactagaatctctgaatttatggggtaaggttctctggacagtgtcataagctgtgcaattaccagaggatacaatgaagatatttcatcaggtaatgaatgatgagacagtttatgtaactgagagattgcctgtgagtgattactgcatagatttcttagaggcttcatacataacccttgcccacagcacagccccaaatgccaaggaaggacctggggaggcgcgctggcgacctgaacgtctccaggtcctgcctgagtctcaggattacctgcatccttgaaattattcgtaaagctcgacactaggttagatctatgacactctgaccatgttatgaggtcagatgtgattatccaacctctgcagggaaggtgagaaaacaccagcaaaggagactaaggagcagcagcctatgaggcaggtgaaaactgaggaggactcaggtgtcccgaaagccaagggaacacatctcaaggaggctgccatgatgagctgtggttggagctgggtgtgtggctgccattgcggtcttgaaaagtcatttcagtggagtcatggagccaaaagcctttggagtggagtccagaaagactcggaggagagaaattcaaagaagtgagaatagacacttttttaaaggagtttgccagtaaaagggagcagagatcggggaggccattggataggactctggggttgtaaaggattttcgaaaatggagaaataacgatatgatactatgctgaaggcaggactgagacgagaagcgcagatggacagtttaagccagagaaagagctctgtccttgagtaggttggaggggaggatctaaaggatgtgtggagggttggccttcagagagcaggcagccatccttaggaagaggaggcccggctgagtgcttaggcccaggtgcagacaggcagaggggtactgggatttgaggaagaagaaacgtatgagtgatgaaggaaggggagggcggaggaagtcggtatcactgctgggcggcacccaggccctcctgaggtcagagatgatgaatttaaaggaaaactcgtgagcagagtcttctgtttctctgcaccaacactgagctgcaaaggcaaagtagaaagaatggtggatttaagtttggttgcagttttgccggaattgtaaaaggaagcgggacatctctcgatcacctctgcctatgactgtgaatgatctcacggtgatcctccaagcccctctccctcagctctgttcacctccgcctatgactgtgaatgatctcacggtgatcctccaagcccctctccctcagctctgttcacctccacctatgactgtgaatgatctcacggtgatcctccaagcctctctccctcagctctgttcacctccgcctatgactgtgaatgatctcacggtgatcctccaagcccctctccctcagctctgcatcaccgaactgctcaacctacttttttgtcttgacctgtccaaatccttccacattgaaaaaaaacaaaaacaaaaaacaaaaaacaaaaaactttttattgtaaatatcacatagaataagcttaatacattataaagtgaccaactttttaaacactacccaggccaagacacagaactttaccaggtccgcctgaagccctccatgtatctattctcatcacaacaccttcaccccttcctaaaagacaccatggttttgttgttgtttttgttttttgttttttttttttagacggagtctcgttgttacgcggctggagtacagtggcgcaatctcggctcactgcaaccttcatctcttgggttcaagcgattctcctgcctcagcctcccgagtagctgggactacaggtgtgtaccaccacacccagctagcttttgtatttttagtagagacggggtttcaccatgttggccaggatgatctcgatctcctgacctcgtgatctgcctgcctcagcctcccaaagttgtaatcactctcttgtttttctttatcactcaaggttcatttctaaacactacagttcattttgtctgttttgaagatgtgttgtttagtccatcaccctccattgtctttttttccttgcaatttatctgttgaagaaagcaggacatgtgacctacagagtttcccagtcttcattttgctgattgtatccaatgttgcagtttataatgcacctggataatttttttcctataaattgataattggtctataggcttcatttaattcagcttctttccttccttctttcctctctccctaccccctctcttttcctccttttttccttcctccttcattctcatcccttcctccttttttggtccctccctctatctctctgtcctcctttctcctcttccttctttctgtctctctgtaatactacttcatagatggtgttttgtacttctatcaggaagatcataatgtctttctctcttcttgaaagcttagcagtcattaatattcagtaactagattaatttattgggattgaaaaatgatattttaattcaaacattccttcatttattagttagaatacttctattttttggttatccagtggtattgtatgaataggaaaggcaggataaaatatttgaatcttttttttcaatgaacatttataaactcataaacttaaacatattatgtgttaagtgtgttttaactcaatgcagtgatttccttcttgatgcacaactatctcatctctggccaatggcaatcctatcaagatgagtttccataacatgatcctgacaccattcaatagcttcctcgctatctgctatggaaaattactcaggttcatcttacacgtttcctgctccaggccaggaattgcctacttttaaaagaagcactgcttcttaaaaatttcaagaccataaattgggtgctaggcatgttcagtgctcctaagttagtcattgtttctaagtcctctcagttctcactttgaaggacaggtatctcagaactacaaggtttttacttaacattttctgttttacctctgttgctcctttcttccacactggttctcaagaacacagaagatgacataattacaatattccataattgctcatttgctttttctcacattacacaatttcagaataacaataccatcactgtgcctatgatttctgaaaacttcaaatatgttttcatatgctctactcattctcccacaaaatttttaaaataattatactgtatccacactgttaacacatgcggccatttcgaactatgctgtctttctcttaaccttcatgttatcttacttctatacacacacacacacacacacacacacacgcatgcaggcacaaccatcagtacttatgttgatggttgatgttttcccagtaattttgattgcttgaatcttgttctctagtaaattcctcaggaagagttcctgggaaatacagtcactgagttcttccatagtaacagtttatttagggcttttattcttgataatgagtttggctgcataaaaaatctttatattatacataaaaagaatatatggaattatagtttcttacagtatacatataaggaatatacaatcctgatatacatacagggattgtgtgtgtgtgtgtgtgtgtgtatatatatatatatatatacatacacacttatatttatacatacttcccccttgagtatctgaaatctcttacttcatgttcttctggtataaaatattatggataagcctgaaaataatgtttttttcctttgtaaattaattgccctcttttgcctagatgcccaaggaattttttccatttctttagaatccaggaattttgttagagtatatcttggtgctggtcatttctggatcaattttcacaagcatactgtgtcaggaaagttgtactgaatttagtttttagggttcactttgttcagttgctttgatgtttttcttatgtcatttctagtatacatatattggatcttctttacctcacttctaattccaacagcttatctcaaatccctttttaattttcttatttgtgttttttagaatttccttcacttttcattttctatttcttttaagacaatatctattatatgtatttgtgtaatttcctaataatttcctaataacttggttcaccttgaaaaggttattttggctttcctttgatttgaggcattcttccattgtccataaggatgctattttgttctacattcgctgcatcattttaatagccctgtacgggactgaaccttgcttcttttctgttagagttttaccttgttcctttgctgttgctcagttttacatgaaattagttctcctgaaattttacaaagaggtaggattcagaaaaactgtagacttttctgttctggtgttttaggcagtgttcaaaaatatgggggcttcctttctgcaatctcacaactctgttaccccatttttaaccggactatctccttcctttttttctcttctattttgagcaaatttctgctcagtgtggggctttgtcctgaggagggcctttgcctgggtaaatctggtgagtgcatgagacctaaagtgctccaagccctttaaaccttattacagacttttgcactcattcctctatccttttgtgcatccacatggcctgagtttggcatagtatcttgtcaatagtttgtggacagtaaataattataaattaataaaatctaactccattaagtgacaattaattaaataattctaataagataatcaatagcaatggaaattaataacagtaactcaggattattttacctacaaaaataattttttaaaataagttgctcttaagtaattgactattttctcatttgacaacacatcacctagtctatttaatttagttaggtaattttattactatgacaatagcttttatctcggaagaagttaatgtatggacaacgtccaataacaatttagaaattcttgttgactgcattcatagtggtctcaaatattgatggaattttaaaaattatgtccccctttccattcattagctagggaatttattaaaaattattgttatttattttgtttatgataaactcaagagcatttgagcatacaattcctttttcaaaggaagacaaatattttaacatatgcgcctgggaatttctgatgattaaaaagtacacacaatacctgaaatatgcctattgaaagtattacttttcaaaattaacattgtgatatttataagaaaaacactgacctggaacaaagaatgtgctagtatttgtagaaagcttaatatactaaggaaataatttagtcatgtaattacatatcattagcaaagatccttactaagttaccttcgagatataatccacagttttcatagatccttttaaccatttactggcacgaagttgaaagcgcattaatggagatttgtgacaaactagcactaatacagaatactgtatttatctcagtataaaatatgtgtgataatggtaaagtaactaataaatctaccccagttggtggaagggaacaaacacttcccttgatattcttgtattggttccaagggcttttttacttatcaatattgaatagcattttataaacagactaacttggaggaatgtgattaatttataatgtgaactgggtttatatagagtccaccctcaactgagctcaaaagtggaaaaatcactcatgcatgttttgtctatggaatgcacagtgagcatctgtgtgtgtgtagatatgctaatatttacatgtcaaactatactgacagttttaagctattaaaaatagtttgcaaatttctagatatgctttcataaagtgaataatccacagacaactaaaataattttgaatttattgtacaatatttgcaaaaatatttgaaaataaatgtaaatattcacaaagaatactactctgaacctaaggaaaacaataactgtttttctcctgtattttatcagattatagcaaaaaatacatttcattagtatgcgttatgcaggtagaatcctgactcactgctatactttctattttatttctttggggagtaaattattcagtctttatgtgaatgctcatggattctcttaagaacaaaaagtattcattttaaagcataaaattcatagaagtttcaataaactcgtattttaagaatttaaataatgggtcatgggagagtataatgaaatagatattgtattctgttagtctgcaggttaggagacctgtatttgggtagaaaagtgttctataatgaaggaacggttgcacgttcaagccccagaagggccagtgaacttcccctttcttgctggctgttgactgcatgttaagtacattaaaggaacatgggtagtcacctgagaagtgtggctatggggaaaccaagcgtaaacatcccccaccactgaaacaccatccaaaaggcctctcctctgtaggagagaacaggctgcttcactctgatgcttaatttgcatgctttcatagaaaaagaagaaaagaatctaattttaaaaactacaagaaatgtgaagtacagggatccgaggtaaaactcaagtctgagaaaaatggcacatgttctgtcaaaatgagtcaatgcttgccagccatccaggagctatgtggccccctttcaggtcctccaagctaaggaggttgattttgtgctgtcatagtgtttcccagagtatccttttgggggcactcaggtacagctcttgggtctcctttgcttccccacaccactccataaattatagcttttgttacatctcagccaaaagcacttcggggactccctccctgggcttctccctcaatccctcctagagcagaggggtcgtgatcaggcttctgttcactgagctactgcagtgaaccaaaccacggcaccgacactttgctgctcggttaattctctgtccactctgtgaagtgatggatgtggcctcggagccacaaagaagtgccatcttttgctgacatccacacaggcagagaacccacagtgctgcattagaactaaggctgaaactttcaagaccacgctttccacaatacccagctgcctctttctcttattcccttctattaaaaaaaattcagtcaggtatagtgactcatgtctgtaatccaagcactttgggaggctgacgtgggaggatcgtttgagaccaggagtttgaggccagcctaggcaacacagcaagaccccatttcgacaaaaaattaaaaaaaaattacctgggcatggtggcatgtacctgtagtcccagctactcaggaggctgaggtgagaggatcatttgagcctagaagttcaaggcttcagtgagctgtgatcacaccactgcactctagcttgggcaacagaatgagactttctcaaaaaaaaaaaaaagaaaattcagctcactattcctctgccatcttttagaaactaatgaaaaatagtttattatagaacttcctctttggattaaaaaaactataataacgtcagagaggaacatcagcttatgatttagccatttctccttgctatgcagataatgtcccattttctatacgcattagaaatttttttcaaaaaagaagcactccttagattgtcagtaatcttcatcttcctttttttttcatttgcaggtagttagcctgagagcatctgtgacagcctaagtggtggcccccatgaccctgctgtttttcttctctattctgttgctaataatgttttcttcatccctgaacatctgtcagctactgatgaagtgaattggctagagaaagggctggaccttgttaattgcatagaaaaaactatcaagatggctgaaatcaaatgcaaagaggcaacatcaaacaagacctaaaaaaaaaaaaaaaaaccagtaaacaaaaaaaacaagcaacagatcatatccggaagcacagtttaagaagtttttggtttttttttttccagatatttcaggtgacccaatgccaaaaagcatctcatcttctagtagttgtggaatcttctggaaaagagatccaaatcaactggcttccttgtcccctctccatgtgtgacacggagcagcacccacttccagtgtagctcccctttcaggggagggctacaaaggctgttttcctcacaagagttcctacagctgatgtgacttcagagactcctgtagactatggaaacagggtggtgaagcgtctcctgatggagcgcactgcagaaagcagggttgtctgtggctgtaaattatttcactctttgctctcatcccagagaaacagtgttagggtagcacctaaatctgcaaatccaagagccttgcccctcagataaatgagcgttgcctctgccttccttgaaaggagctggggcacaggtcactgccaccatcctccttcctggctccctagtctttttctttccctgaattcagtattttcacctctcttctttctgcttattctctagaagctctttgtccagtcctgaagcaactgcgatggtttctaggtgattctgagggaagggtgacatgtcattgtctggaagttttgtgtaaggctacgggtggggcagtgaaatgggttagctccactgagcatttaatgatctaattagaacttggatgaaccaaaatattttttaaaatcatgtggattgtattagatggcttcatatttataactatctgaaatggacaagcctctaacactgaggaagccttttggggtgaaagccgagaagctgccttaatgccaaggcacacctgagcacaggtaacaacagccaggtgctctggatgtccacctacgtccctccaaagatcatcacaatgcatccctcatgccccacatcattgcttcagaggctcaagctgcctgtcattcttatcacccaaactgtcagtcccatatgggtccatacgtttcctaatatcagccaatttccatgcttccctctctcctaagccttttttctgtgtcccctgaaattcctgttcatgataaactaactgccctgtataatcagccttttgaaaggtttccctgtccacactgacttaactgaaactgatccatctcccttgcaaccttttcaagtgaaggctgcttttcatttcatattcacatctttcaaggccagaggtgaagatggttgtcccttggctccttaacgacgcccccaaatgcttgggttcctctcccttgcaaaacccaccactcctttgagacccatgcttcaccctcacctcctcactgctgccccctgatctcctggatgcagcccctcattcttgaagactgtagcttcaggctgttctcaccttttctccgattcttgtcatcattctggggacttgaactcctgtatgaataagccaccatcaatctattctttctgttttaccttctcatcctgctgacctttttctcatccttctattcgcacggtccatccccaggctctgtcatcctgagaaactgtaccacctctgaaatcccaattccaaatatgtctctttctgatgatcacctcttatctttccaaatctcttgctaaagtatgaacattgcttaaattcttcaacttcatcaagacgtctaattaattggccccatatttcctctccagccatgggcctctccaggcccaccttccttcctggtctgacagcttctgtcatctaccaccagaagcattgcctggaaaacacagatttccgtggtcttctttatctgatggcaaaattccacgcctggaaaacatcacctccaccttccctgggcgtgtagccctgcagctggacacaatggcacgatgactttctcttaaataatggaccacaaacttcaaatgggcatttacaacttcctcaagattgtattgtgtttctccagtgacatgttctctcttctttcttcccctcaacccgccgaaaaaaggggtgaaataaaaaagatgaaatgaggatagttacaaaagcataggagatagaagttttcacatagcaagggtaagaaatatttttataaatgttggtaatagttatgataattagtagaattaggataacagtgaagtagttatagaagaaaatgaatttattacttttatctggagttgcaccaattttttggttcctaagaccaatgtaggtaggacctgcctctctccagccatccatactttatatttcactgaggagagaggaatcatggctgatgtcctgatgtgctcaacagatgtttcctaagcacactctaagtgtcaagtactcttctatgtggaagacgcagcagtgaaaaatgacatcttccttcgtggagccatcatactgcatctctcctcttcacatccctgcaactatgaacacacctgcacctgcactcaccctctccagcccctctcacaacacaaaaagtggccttcctcctgttaggggccgattcctccctctctgctggatctgagcccttcttgccttccaaagtacttcccttcttcagttcttggatctctctctcaaattaccggtaattcatctctgtggaatccttcctgtgagtgtaaaacaagttctggcccttcgatctttaaagaactgtcttgtggttgctgcatttctctttctcttcatagcaaaccctctagaaggaattatcctccccttctgttcactcttcatcccataaaactctggctcctgtctttacgcatcccccaaaactgctcattatggtcattcgtgacttttgccacagtgtcacaggcgaaggacgctccctgacctcatcttctgcaaactctcagtagcattcaacacaaatcaccattcctcctctggaaggcccgccttctcagcttccccaacaccataaatcagcattcctcctctggaagccccaccttctcagcttcccaaacaccataaatcagcattcctcctctggaagccccgccttcttggcttccccaacaccataaatcagcatttctcctctggaaggcctgccttctcggcttcctcaacaccataaatcgccattctcctctggaggacccgccttcttggcttcctcaacaccacaaattgccattcctcctccggaaggcccgcctacttgccttctcagcttcctcaacaccatatggccctggattgtcttctactttccttgaggttccttcttggtctcctttgttggttgctgctctttacccaatttccaaacactggtgttccttacggttcatccaatcacggtctctcctttcttggcttcttctgagaatccccatgggtttaaaatttcctctacatgctggtaattccaaagttatctctccatctcggacctcaggtctcactgtcctccaagctctcactcacacatccaagtcccgacttatctccttctccatgcttcaggcatagcaaatgtgttcagaattgaagctcagatcccatgcctctgatctcacctgccccattttgctcatctcagtcaaatagaactttcaaactccttcctttccctgacccacagccagtcagtcaccaagtccttgaattctgcctctcaagattcacttctttttgtctccgctgccaactgtcttaatccagagcctctccatattgcaacaagattgacatactcaaaatgtaatttggataatgctaaccccttgcttaaaccttcaaggatttcccactaaactcagaacaaaacccatatgcttaaccctggtgtccttggtccaggtggccttcatcttttggcactgtccttcctgctcagtattttccagccaccttggtttaatttagtgtcttgaataaagcaagctcttcacctccttgggggcactggatgtgtgctttcctctgcttgggatgctcttctgcccactcccataatgctagctccttcaatagctggtgtcccctcaacgcttagtctcagggctcctcaactacccctcatctaaagtaggtgacatccctatttgttttcatcctagcatcaattatgatcagtaactgtgacttcctcatttactattttatccaacactagcacaataatagtacaagaaagtattcaatacatttttgttgaatggataaaggttatttccataaaatttcagtgattaaacctaaggtggaggaagctggtataaatggaggtacttctgaaatgcaattggttcaaaggccctacaaacctattgactccagacatcatacctgatttctgaagggctcacctggaactgcagagtgactttagtttcctacaatgtgataatgtctttgccaaagaatttggactagggggaaggagtgttgaaaggtgctatatgaatatgaattgtgaacacaaatcagagaaggggctaagaagctaatataaatgtattattttaaggagtttatttttattttgggaaggcagtgatacatagtgtttaatttttaatccaaatctaaaaaatcaagatacctactaaagatcaacgaaaacagaaaggaaccacatacaaagaaattagaggtctgctgtgggtctctgccatacagtaatgaattagtaattaaccagcatttttgtaggttttatcaactcactttctaagtgagtattacgcttactttactgtctattttgttgccactatgtaaagctggaatataaacagcatttaaaatcagaggaattttagtatagcacaatatttgcaacttacttggcaacctatttatttacaaatattctaagagatgattgagcttcactctcccttgtctacaaaaagctaagttagagaaacaaaaatgatttgtccaaggatgcttgtaacagacattaatataaacattttattttatcaagtgataacagttgcctcaagcatccagtgagatcccaagagtttcaccagctcctggagcagttgcccccaccgctggcaggaatgctgggacaagagctctctgcttcctctcgggagcctcattgccaccatctgcctagaggccagtaggtcttgtcatgaataatcaggatataaacgtccctgactgatatgccctgttcacgacagtcaccaaagaatgcctgactcctgttccatctctccaggctgagccccaagctccacatccactctgtgtatcctttttcctaccacatattccagctgccccaaaccctgagacccttcccccatgcttggggaactcatgggcaatcagcagtaactgccctatgactgcaatctgctttctcaatgtttttcttacattcttccctaactgaaacaggcgtgtccctgaggacactacttcgcctgcagcaccctcaaatgtttttgtgtctgcaatcccagtaccacaaagcattgctctacagtgttgtaagtaaaacattttccctttctccttctaaagccctccaactttccatttcaacccatcagcctacaccatgcactatttccccttctgctgtcagctactgacatccatttctctctctctctctcatttctcaaatcttcagtttgcaattctggaagatctcagcgtgcacaggggtggtactcccaactctccgacttcccaattccatgacctcaacttctctcgtcaccttgtcctccatctgaaatcagacacacagcctccctaggcctcctctgacctcgtcggtgctgaccatgcagctcctccacaagctcgatgtgaagtctttcattctttggccaatgcctgtttgtccagttcaacccttctagtactcaaatcccgaaaattctttgagccactggcatctgtaaccaactttccctgtcctctctctcatctgggttctctgcttgcccagctgaaatttcatggtcggtcataatcactcccttagattcaccctcagcttacactgttgttgtaacactgtaagatgagatccaccctcagcttcttagcctccctcttgtttttgttacattttgaccgcaaaacttcaatgccagtgccttttctgcatctgtgcctacacagatgagtgtgtcagaaaaacacccagtggattgacctcactccaaattcaaccatttcccaagtttattccctcctcaccctcctaaatgacaatttcattatcctctcctgacatggtttggctgtgtccccacccaaattctcatcttgaattgtaatccccataatgcccacacgtcaagggcgggaccaagggtggaagtgattggatcatggggatgattccccccatggtgttctcgtgatggtgaatgagtcctcacgagatctgatggttgtataattggctggcatttcccctgcttgcacttttctctcctgctgccttttgaagaaggtaccttgcttccccttcgccttccgtcatgattgtaagtttcctgaggcctccccagtcatgtggaactgtgagtcaattaaacctctttcctttataagttacccagtctcaggcatttacttatagcaatgtgagaccagactaatacatctcctttccctctaaaactcttccccgatctgtactctcagctgatgacctagcttcctgttacaccaagaaaagagaaacaaccagcagagaccctacgcaaggtttaccatcaaatccaatgctcatacgtctgtgcctgcatattctgtctcccccactgttaccaggcggaactggccactctcttgtccaagcccatgcctacatccaaggacactgctcctgaattctcccttcccccttctgcatcatcagtctcccaactcctctactgaatcattaccatcagtacatagacatgctgcaatttttcccattaagaaggtcattttcttatctccatccctcagctacctcatttctttgctttcctcttcagctaagttcccagttgccaaaattaaaatgtatgtatttgcagtctcccactctttggttcacctctcacatgaatccattcgaggcaggctttcccctcactgcccatggtcaaggttaccaaggacctccacattgtggagtccagtgctcatttctcatccttgtccttcttgctgagcataggacacagatcatgattcctcctcctaaagatgccttcttcctttggctcccaggtcatgatacctgcctggattttttcccaccttattatcattattatttttctgagacagagtctcactctgtcacccaggctggagtgcattggcacgatattggctcactgcaacctccgcctcccaggctcaagcaattctcctgcctcagcctcctgagtagctgagattacaggcgcccgccaccacacccagctaacttctgtatttttagtagagacagggtttcgccatgttggtcaggctggtctcagactcctgacctcaggtgatccattcgccttagcctcccaaagatgtgggattacaggtgtgagctgccacgcctggcctcctcccactttattattgcaaccctatctcatgcaatgtggctccttcctctttgttttgctctgtcctcctcccctcccctccaccagtcacacttgtttctggactattatgaatgttaaagccaggcacatgatcacattggagcctctgttgttgcttcatccactctgtggaaatctcctttcccagatgtcaccatgaggcttctctggatacctttcagtctttattcacctgtcacctgctcagtgaaactttccctgaccaccttatataaaatttcacctcttcctccagtattcactgtccttgttttttttttttttttgtgtgtgtgtgtgtgtgtgtgagagagggtcactctgtaacaaagactagactgcagtggcacaatcttggctcactgcaacctccacctcctgggttcaaatgcttcccatgcctcagcctccagagcagctgggattacaggcgtgcaccaccatgcctggctaatattttgtatttttagtagagatgtggtttcactatttcactatgttggccaggctggtctcgaacttctggcctcaaatgatctgcctgccttggcctcccaaagtgttatcattacaggtgtgagccaccacacctgagtgctgtcctttttcatttcctttttctccatagcaatgatagccatctaacataatatacactaaatgtgtttatgtgtatataatatggttttctctaagtagaatatggagatttttcactcctctatccctgtaacctaggatggtatatagcacatagtaggtactcagtaagtatcagctgaaagaaagaaggaagtgtgtgtatgtctgcatgtgtgtgtgtgtgtttgcgcgtgtgtttgcgttttaggaaatagagatcaatattgctctgatgcactatattaccaaaactaatcgtagtgatattaattttgattatggctcaattaaatttctaggagaatgcaaagtgacctgacctttacaaagcagatctgaggagatgattactgttggcttctttccttactaattacccatggactctaaaacaaaaatggaaacactgcaaatattggtacaagtttgaagagaagactccattatctgagcagaattgtcagggtaacaaccagtgattcttgctttaagaagtctttaggctttcactgggaaatggctgtgagatccaggtgtcttcacaaggagttatgtttgggagagtcagttgtcaacttttacctgcaatacgggataactgatttcacttgtatttgaatatacatttatgcctgctattctggaaactcacaatatagaaaaatgaaggggatgtactgtaattctctaactccaggatgtggcagtgattccagtttcttatcctctccttactaatccttttgtttttattctcatattggaaatgggcagttttactttgccacatacatacaccaaacaaaaacacacaaaccaaaaactcattgatgaaagtgagctgccacatctccatttgcatatttcctggtcaaagttggcagagacaatctttaggagtaaaaataaataacactgggctgggcgtgatggctcacgcctgtaatcccagcactttgggaggcagaggcaggcggatcatgacgtcaggaaatcgaaaccatcctggctaacacggtgaaactccgtctctaccaaaaatataaaaaattagctgggtgtggtggcgggcgcctgtagtcccagctgctcaggaggctgagacaggagaatggcgtgaacctgggaggcggagcttgcagtgagctgagatcatgccactgcactccagcctgggcgacagagcaagactccttctcaaaaaataaataaaataaaataaataacactggaagttaggtcaatcagccttttgccaactctttagtgtattttaaggataacttgacacctagatttaacatactaatacagagtttgtagttccatatagggatcaagaaacgtatttttaagcattccatactatatatgtgtgtacatatatataatatttagcaccctgaattatttacttagcatatctatttaaattatgacacgcctcactgagcacaacacagcatttaaataatccacttcaaatggtcaccctttgtatagacgtcacatgttcatacccgtgtacaaaaggctgccatgaaatacagataacaaacacccaatacaaaaacctggtaaaaaaaaaaaaaaaatgctcacacattcacccacagacagcaacttaggaatgtctatgaccatcgatccctcaggcataattcatctctgcatttatttgtttgctcatctgccactatgcagtgcttgcttcctgcttgagtcttgagatgaaatgcactgcactggcagatagcagatgtagcaattaataacctgtcaggtctgatggatagaagaggaaaaaagtgtcctcacacatatctccagcatggttttcttccccatttcagggcacccagggtcaggagacatactcggcctccctggggagcccaaactgtctcattagcgtctatctttcatgacagtctgatgcagcctttgagatgctcactcacctgctcttctcccagaatcctgaagtgatggagctctttaatcaaggagttgggacagccagctgttggaaagaagaattaatcacaaaaacgtcactttcactctgtgtggttatatgttcttacacagagttatgactatcaactgccagtgttgccttttgggaggacacagacgtgtacctgaaaaacacacatctaaccaaccacaaaaaaagccaaaccctcaaaagagctatggccgctgcctggcctccaaccgcacctctttagaaaacagttgcatgtgaccctggccaggctttctctcccctctgattatgatctggccttaggatgtcatgccactctggttcttagaaacatgttcagcatgtcactggttcctcatatatagccaggattccgcagggccagagtaggggagttggtgaccacaggctctgacttattcatcatgtcctgtttgctcaccatcaaggccaggggcctgctcattgagaggtaagagcaaaggtcgggtagctacacatccattctttggggggctcagctggcggttagtaccttgcctggttttgtcaagaggctttgtgaagacctattagatcttgcgtttgagtttggaaagggcatcttacggaaggaccaagagagaaggcccagcagttctggtgcctatcactttctcgttccacccaatcaatccaagctccttcagactttcaccttttccttcttcagttgtaaaacaaagtaagtaaataggtaaaaaaaaaaaaaaaaaaaaaaatatatatatatatatatatatgcacacatacacacacaattaaaatacgtatgtataaaatattatataattatatttaatgtatagatatgagttatatatatttttatataactcacatatataaattatatatgtaaatatataattttatagaattatataattaatataaatattggcctaaatatatatatttatatataataatataacatatataataaatattctatgtaaaataaaatacagttgaccctggaacaacatgggcttgaactttgtgggtccacttatacacagattttttcttctgcctctgctacccctgagacagcaggaccaacccttccccctcctcctcctcctcagccactagctgtgaagagaatgaagatgaaaacctttatgatgatctgctttcacttaatggatagttaatacattttctcttcctgatgattttcttaataacattttcctttctctatcttactttaagaatatagtatataatacatatgacctataaaatatgtgttcatagactattgatgttataggaagggcctctagtcaacagtaggttattagtagttaagttttgggtgagtcaaaagttccacatagttttttgacttcagggatgttggtgttcctaagcctcacattgttcgaggcccaaatgtatagatatgtaaaatttaggccagtatatgcttaatatcatttaaaatgtgttgcatccctgtcttttcaatagaactattcctcgatattaggttgtagtcatttatactattatttttttgagtcagggtctaactccaggctggggtgcagtgtgtaatcatggctcattgcagccttgacctcctggctgaaggtaccctcttgcttcagcttcctgagtagctgggactacaggtgtgtgcaccaccaagcctggctaagttttttattttttcctaattttttgtagagatggggtctcactatgctgtccaggctggtctcaagctcctgggctcaagtgacgctcccgcttcagcctcacaaagtgctgggattataggcgtgagccactgtaactggcttatttatattattctctctggaaacaaaattgatataaaaacctgtttctttgagataagacctatggattatataatctgttgaacttcctagtaaggaaactggattgtatgcaggacatatcaactaaattatggagccatttctcatattcctcagcattgtgatgtgagagtggtcagaagccctgagagtgtttgtctgggggagggcaggctgaggaatgagaaaacctgtattcacacaggtgaaggtgctcattgcgatacagattagatctgtgcattgtttcagagagtaggatttaaaccaacagaagaaaatggaataaactgccttataagacagtaactgcaggtttttcaacacatgctaaatgaatacttatgtaggatattttagagaggaattttactgggtatgatgatgaatttatgtgtctacttgattgggctaaggggtgcccagatagctgataacatgttatttctgggtgggtgtgtgagagtgtttctgggagagactggcatctgagtctgtggaccaagaagatccactctcagcaatgtgggcaggcatcgtcccatccactgagggcactgagggcctgcacagaacaagaaggcagagaacggtgaatgctctttctcttctagagccttaaagatcagatttcctggttctcaggccttctgactgcaagacatacacgactcccaaacctgctgcccctagttgtcaggccttcagacacagactgaattagaccaaaggctttcctggttttccagcttgcagatggcagattgcaggactgcttggccgccataattgtgtgagcccttcccccagtaaacgtcctcttgtctctttctctttatagatcctatagacagaaaggtcctgtttcttgggagaagcctgactaatacactgagttatttccaattccaaaattctatggtcatgtaaaatgctggaacatagctttagcctatattatataacatttcatatgttgagaaagtgcttcacaaatgtttactgagtagtacaaaagattacaaaaatgtgaacaaaatttaaacacacgtgtaaacaggtgatgccaccaagaaaataaataaaaatcctggccgggcatggtggctcacacctgtaatcccaggactttgggaggctgaggcaggaggatcacaaggtcaggagtttgagaccagcctggccaacatgatgaaacgctgtttctactaaaaatacaaaaattagtcagacatggtggcgggcatctgtaatcccagctacttgtgaggctgaggcaggagaatcgcttgaacctgggaggcagaggttgtggtgggctgaaattgtgccaatgcactccagcctgggcaacaacagcaagactctgtctcaataaataaataaataaataaataaataacccaagtgaatattttactggaaaacataatacattagctttcacaggcatgtctggtactgtagagaaggaaaaccagatccttcaagtgagaaacagatgcttgagctgagtgcttctccaactagagaccacggagacttgcaggctgaagattctttttgagaagttgttgattttggggttgctattctgatgattacctaaacaatagtaaaaatatattctggatcatttgactggcttcagttcaaacaaaaactgctgtgaaattcagcctcaagtcagttcctgtgctttggatctctttgggagcaagtcatcatagtttagtttcctgaaatgagtgagaaaagagtggatagaaggcaagggaggcttcccctgccagtgacgtcccatggtctggggccgagtgtccgaagggtagagtcacaggagaagttgtgggggaagggaggcagcctacagctcagggtcccaggcctgctgagatggaacatttgaatctgggccaactcatcagggccctgttcggatcccaagcactgctttagtgtcagtaaaatgacagcctctggcgtattaaattgatagagtccatcagaatattttggtcttgtactttcagttatatttaattgatatgtttttatttgggccttctagttgtataagcataaagtatttatagctcagtttatatctagacacattgaagacatattgtcttaaaaataatttcattcggccaggtgcggtggttcacgcctgtaatcccagcactttgggaggcagaggcaggcagatcacgaggtcaggagattgagaccatcgtggctaatacagtgaaaccccgtctctactaaaaatacaaaaaattagcctggcgtggtggcgggcgcctgtagtcccagctactcgggaggctgaggcaggagaatggtgtgaacccggcaggcggagcttgcagtgagccgagatggcgccactgcgttccagcctgggcgacagagcgagactccgtctcaaaaaaaaaaaaaaaaaaaaaaaaaaaaaaaaaaaaatatatatatatatatatatatatatatatatatatatataaaacttcattcaaccttgggtgttttggagaattttttgtttctttacaagcggtcttttatgtcactcaaacttgagaaaaatggctttattttaatcctgcataaaataagaaacacaattttaaattagcttatcttcagaatgtgtattctggctgtctcctaagatacaagtgaaaggactgatgttgatgatagctcgtatataaacatctttaacagaagactagataattacttgaaacacctggtaggttcaaaaaaacaacaaacaagactagacacagcatagacttagatgagaagagctggaaggcggcaagatatttaagaagaccgtggacggctatctgcaaactgtgctcatcacagggacactagtgtgggaaatggccagatataaactcagtgtgaagatggggcttaaaaataacaaaactggaactgcaagacgggcccacagaatgcattcgcgtagggagacaggaaaacgttagcggagggggcggaggtggcagagaggaaaacatgggcctggcgaataaaaaccacagtactacttctggatttggagcaatagagaccatgtccgatccttccatgccctttaagcatcacctccctcacatatgggttcttctgcattgatttttggtaaatctgcgttgactcttaatgactgcatattactttacgtaatgagtattcctgatgaaattcgtgagtaagcgctcacatgatttttttctttgggtgtttgatgggtgaaactggtatcaaactcactgcttttcaacttttgagattcaacttttcctcattctgaaaagttaaaaaatcatctccggaactctgaactctttattgtatctcaaagattcccggcagcatctctgagactataatagaagtgtttggacatctattggcatttaaaatatttgtatatgccatattatgtcatcatttttcttaagcacaaggttctccttaaattgttattctgtcctttctaacatgggacatattctctttgctcaagaaaacagaacacacaggaatcgagtagtgtttttacctactgacactgtgttagctttcttgacaagagcctattcttctctatcttttccctcttttcttgtcctggactccacttttaaagcccgtcctgctgtccttggaaatttaaaagagaatgtcacctctttccgtgccatcctcatgccgtgctcacaagtttgtgctcttctgtcgtgtttttcctctagttattaaacccatcactcaactgttgcctgtgttttctaaaaatctgagctcattggtgttcaatgaataccagctttttggtgttaaaaatgaataagacaatttgttaaaaagcatataaacacaggattgaatcttattttaaaggacaactgcgaaactgggctctatatttcaattagtatctgtaatcaacatttacttttattctgttgctataccataaaggtcattttatcatctaacggggaagctcctcaatgaaaacgcgtcacaaagttgtgtagcatttccacaaagtcactgacagctactgagaaaaagcaaccccaaacaaaacaaaacaaaacaaatacctttgagagattaactgagccataatgttttcagaaagctttcggtgaatttcctcaacaatcatgctgtaaagtagggaaaactcatttggaaaatatattccattgagaagcattaaaaaccacatgagtcttcgatcactatttttccttttaatttctttgcaagtcatcacaggagcaattgtgatatcctttgggttcaatggaaaatcgtgagcacccaggcttgggatagaaatggaaatggatttcagctctctgatgtgctcctggcactggtcacatgacacaaataatctgcaatttgcagattgctgctgtttggtgcgaaacgctttgaggattaatttctctctcggctatagcttagaatccctaatgtgggcttgacaattacagtgaccttctatttcccccctaagtacaacttagaaaaggaaaccgactaacgacaaaatggcatcaaaaataaatgaagattcaatgtgatcgaagacaatgcagcgagactgaacactgacctctgagcacaagccagagagcatgggccacatgtgcaggctgggctgcagcagtgaaggaatccagtgggcggcttgctactccagctaagccaggttgattagggttgccatacactgtgctgaagtagccatttctgaattagtctgagagccaggcgttaataggatccctggaaaactcactaagctgtctcgacagagtaattgcattcagtcagcagcaggactttacagaatcaagtttaaagcattatcgttttcataaataaagccaagcttattttaatcctttctctctgctgatgggtttttatttataaaggattattcatgcattctttctccgtagccaatacttgctgtctcaagatatcctaagccagttaaggagaatcttgaagatactcaccttccacctaataatgtacttacaggtatacacacgggagagtaacttacatggttacacaaggagatatggaatagaatatttactgcgacatttttgtaataacagcaacaacaaaacgacacatctaaaatgaccatcaacagaagaagagataaaatcattcaacaaatagccattgtgcacccactttgtgccaggcactattacgacacttgggtcgcagccgtgaaaaattaaaacagacaaaaatccctcattggagcttgcattctaaaggggcgagagacaataaaaataaactaataagtaggtaaatgaagtaacattttggatggtcattagcactgtgtggaaaagagaaaatacaacagtataaagggcagggttggctaacgtaaaagtaagtgttcatttcttattgagaccatgacactgaagcacagatttttaggaattgagttaatatgagttagctagagtgaaatgtatcaaaacaggtaaatctcaaaatcataaagttgagaaaaaagttgcaatcgtttatgcacaatgcaatgtcatttacagaaagtttagagaatctattaaacaatgtcgatgcacgcaaatatactaagaatataaaataatgcctgcaaatgataaacgcccctgaagtatgtatcaaattgaagggaagaggaaagaggaacaggaccatagaagggcactgctattcaaatctgtcttaaagtgtattacaataattgttaaaaagaaaagctaatacttctatgatgcttagtaggaacaaaacactcttcacagtgttatgcatgtaattcatttactactcatgacaaccctataaggcaggtactatttttatccccattttaaagatggcgaaatcgaggcagaaaaagaactaaactaatgaagtcatcaaagccgggtagtgtgtacatggacattgattatgctactttaaatatctaactggatgtctggaacttttcataataaaaatctctagatgaaacctttaaagtacatctaaaaataaccttggaaaaggctgaataaaaattcaataacgtatagacctgagtttgtgaacatatatgagcatgaatgtagtctggagaaggaaaaccttccaatacaaccactaattagtagacataacttatctgagtagtatagcatgaaactttgtaaattttgatgctttcagaataagctgaaagaagccatgaaatattatctattcaatttcttacttgtagatgaggcagttaccagtccagaagatgcgaagtatcttttaggagctcagcatagtgtgtatgaagctcagatagctgtgatttcataatttatattaaaattgatgcagattggtattttctggttttttgcagctgctgtattaatccaaacatccttgctgggtcagcttctagtggctatgagactatccatcttccaatgaggtgccagggaagaatcagtctcattgataatgagacacgatcagaaattttcatttcacaaataatattatccttattggccggaggtgaattccaagtaaatattcattgattcttcatcgaacaactcttgagtgtacacttactatgcgtaacgccaggggccatagagaaatcataaatgaatcagacagggattctgccttcctggagcttgcagaagaaataagacgcacaccaacaaaccaagtagatgtagaaagagccaagtgagcagagagcaaccaaagaggtataaaaaaagaaaaagaggaggtggcttggaatcaaagaggccaaagcctggagtgtttgaggaatccaagcagctgcttggctgcagatgagaattgaaagcacctgcatacacacagcctacctactggggctgagaactgagaccactgagacctaattatttgttccagaagaattctgccctggaagataagcttgtaaagcaataaataacttcactgtttgcttcaagaaactcctgcaaataatttaaccagacagtttgctcatctgagtagccatctctcttaacaggaaatcagacggttcacctgggcaataatagctcttgtataagacaacagtttccttatgaaggcttccttaggactttgtctcactgtgtccactgaccccaaactactatgtcattgatctgctcaactccaatcagtttcccacttgaaagatctgcaataagcgcttaagcccagatccccaggctctatgaacaccctcccctgacctctctttcctgtgacacctccatgactgtccacacgatggtgtcacttcctgcactagatctaatcagcgctgctctgcaatagattttctgtggtcatttgggaggtttgagacagaggacaaggtagaacatgcagtaacaaaagatgaaaaacacttctcatttttcttatttgtatgtcattacaatgtcaaaacaacttaaatattttgaattgtgtgtatattcttggcgctttgccttcacctttgaatttcataaagttcttcctttgttattgacctatattttgagtgattgtgatgatacattttacagggcaagtgttttcaacatccagcatccctcagatcacaaatttaatttggctggtcaacacatgagtggccactgggaatgggaggctctcagagtgaaaagggatccttatccattattttctttctcctgctgctctcaaaagtttgtccttggttgacatcagagaaaggaaagggaggaagtgaaggagatggaattttgtgctctctttaatatgtttttccacagattatggtggttggttggttacctgagtgaaaatgtcaatgtctagttaacgttgggggaaagagaatctgtgggactgtcatcccccaagtgggtgtaaccaaaaagggcacttaggttaggcacatccctgtcagataaggcctagttaaatagggtctagagggtcagcggggcacctaattatcatggttaatgaggtttctttaggagaaaagaattctgagttccaaacaatgtatagacatgaacatttatggaacactcccctgtttataaactggaaacttgtgtaatttatatttgtaccctatacttcgccatagagtgtgctctgtaaactggccttccttgtagggcatgttcctgaatagggcatattcaggcactattaagtttgggaaaataaatcatatccaaaaccagtattaaataaatataagtcatcggactttaggaattgatgcaattccttaaatggaggaatttcttaaatggacacaattccttaaaaatgaggtaaagagaggggctgggggtaaagtggaatggggcaggggaacagaaaagagtttatagttttacaagtacttaatggtattttttgtttttgaattttgtattttaaattcatttcagtactttcccttgtcactttagttctgtgcatttggtttcttttattcatcttagcgtaggcataactgcattcattactgaaaggcatctttcaaattcttataaaaaacaaaacccatgtaagcactctaaatattgccacttaaattcatcactgcttttatatagcatccctgcttttatatatttagagtgtatatgctggggtgagatacatttgaaagagattatgaaaataaaacaaaaatccaatttaaaagacaactaatagcttctatgatgcgggaaaacccacacagctttgagtatattgttaattacactatggtttgattgcccagatctttgcattttatcacgagaattagtaattattctttattttaattagccaaaatgatgaatctgagcacgtctcatctgtcagagagttttaccaatgagctcaaatttgctatccatgttttgcagtgcagcatcacaagtgttcaaccaggtgcctctaaaacacgagaccttgagccttggtatgcggctcaggtgactgcaccatggccctggtataagcaattccagacagttaaatccagcccttcatcctgcacacttacataagaaattcatttatagacaatttttttgttgttgtttgtttgttttttgacacggagtctcgctctgtcaccaggctggagtgcagtggtgcaatctcggctcactgcaacctctgcctcccaggttcaagcgattctcctgtctcagcctccccagtagctaggactacaggcgccctccaccatgccaggctaatttttttgtatttttagtaaagatgggatttcaccgtgttaggacaggatggtctaaatttcttgatctcatgatccacccgcctcggccccccaaagtgctgcgattacaggtgtgagccaccgcacccagcccaaaaatttgttttaagcaagcacttatcaactagaaaatgaagctcaatagacacggatatcgttggtgtgtcaaagctgaagattatcctaggaaaaactttcatctatctgtgtttgtgtatttacaacttcctctatcatccagacatggtggctcacacctgtaatcccagcactttgggaggccaaggcagatggatcaccttaggtcaggagtttgagaccagcctggccaacacagtgaaatcctgtctctactaaacacacacacacacacacacacacacacacacacaaaatagccaggcgtggtggcatgcccttgtaatcccagctactggggaggtttgaacctgggaggcagaggttgcagtgagccgagattgtgccactgcaccagcctgggcaacagagtgagactctgtctcaaaaaaaaaaaaaaagtttctctatgtatcaatttttattttaagaactttcataggcatgagtaaagctactgcagtgaaagaacctgtcaaaggtcatttcactacttctgtgctgtccttttggtctaagttcacaaagtgtttgtctccattgtatttgctgtttttgtgtttggttatttagtgactttaaaaatgtcaattaactaccatgcccaataagtacataagcaaaaggagtttttttgagaagtgttgagagagaagaggcctggaatctaaaaacacagataatgtgctgaacggaagaaggtcacggaagaggatatgctgaagtctgaggtttgagtcactggacaatcagaagcaaagacttacttatggacaaggtgaagggcgttgggcctatgtcatcaacagtgagcaagagacaggaaatagaatggaagaaatgaaggaaaaatggaatcgctggcctgagaatgaacatcagcaattggtgttgactcagaaggctgagattctgtttgaggacttaaaggtgagggatgggaaagtggtcctgccgagctgctagtgcagagggtgtggaagccatgctaagctagtgagttctgacaagggctcctttcctgcttcaggttttatcacccactcaatatttactgcgcagagagctgaggacacacattaatgaaacagtccactcttcacagtgcttagggcgtccttcgctcatacttctttgaacatatccactctcttgtctattttacattataacacctccagatcagagaaggagtttttgacttaacttgttactccccagctcaccgtgcccagagctccacgcatgactgaatggtgaatttggaatcattgctttcatctactggtttttaccaaagtgtaaagtgcattttctaaatggctctctggctcacagaaagtaacagttttaaaggagatattttaaaaggtagaatttccaatgacaacccaattctttggataattcgtcttattttataatagcagaaacattcctatatgagaacaccaactcttgttaaaacattgagattaccttgaaacaatttagagtctctaaagttgaaagttcttctttgaagatctatacattacaatgttgggcgcagcagatataatctgaactaggaaagactgcatctgcagactattattattattattattattattatttttgagacagagtctcgctctgtcgcctaggctggagtgcagtggcgcgatctaggctcactgcaagctccgcctcccaggttcacgccattctcctgcctcagcctcccaagcagctgggactacaggcgcctgccacctcgcctggctaattgttttgtagttttagtagagatggggtttcaccatgttagccaggatggtctcgatctgctgacctcgtgatctgcccgcctcggcctcccaaagttctgggattacaggtgtgagacactgcgcctggcctgcagactattattaattttataataaggataaatgaaaccagacgtaagtgtcatacatgcatgaattgagttcagagctgtcgtcttatgactcagatccatgttcacccaggttgggaagctcaatgctgcatccatgtagctgatcccagcataggcctgacataggaaaaagactatgggagcccttgtgccagtgactaaattccaaccagcatctttccagtgagatggcctattccaacacacacacacacacacacacacacacacacacacacacacacacacacatacacattttgtaagatcttgaaaaccataaaccaaaatagatccatgatttactggttaattttttgatgatgaactatagagcattaccaaaaagcctaaaatgtttttctgtttgactttcatgccttactttttttctttctggtgatatgatgtcactctgagcacacagggcataggttatatatagttcctttagattctctttaaaactttcaggaacaatgaaaaataatatatcgactaggtagcagttaggacaaatggtgttaagctgttctaaaaagacaatgtttaagctaaaaaacacatcttgggataagaaataaagaaaattcagttacataatggcactatcagggtatagcatcaaggcatatgtatttttctcttctcttcttagaagcgttggtgtcagattatcatttccaggttttttttttcctatttaggagaagttcaggaaatgcttaatatttacaattccctttttaaaggtgtttttcaaaattaaaatagctttgttttcattgccattataaaatattaaaatagttgagaaaggtagaaattagcaattttaccacccagagacagtcaccagtatttttttatgaatcatctcctagataactcattgcatgcccttacatcaatacacataggatattaaggatgttgcatcatactatgcatgacattctgtaacttgttttttccacctaataataggaatgggcatcatttcatgtcaaatgatacagacatacatcatcgtttttaatggctacgcacctttgcaatatccttgaggcaaaccctaatgatcatattggtgtcagtgagtcacctagacatgcatatttgcaaaccattcagaggcattaaattggacacactccccaaagtgcgactaccaccgggttaaagtatcgttccatttaacatttccatcattcctgccaaaacactcttcagaatttgtctacaaacttaacaccaccaatcacagtgaggccaatgtcccccagtttcccagagtattagagacacaaccctcccctccttggttgtatgtgtattcatctcttcttccttcctgagatgaagcttggcatcactccactctgaaagaaatgagaaccgtttttgcatttcaccttaatcagatcaaattaggacaggtggcaaccctgcaggcaacataattatgaaaaatgtctgtgctcaatacagcctgtccttccagcttcccaatcaaataggacaccagagcccaacctttctatttcagctggtgactcatagagcagtcacccacataattgctctgaatataatggtgctgcaaaatctgaaattaaacataatataaaaagcacaaaaatctattttgtaagattagttaatttaatataataatagttcttctattataatcttcatgtgccaaattgggggaaaaaaccttatggctggcctgttattagaagaaaatcttttaacatatcccccttacacttgccatccaaaggtaaaaagaaatgatgttgaggatttcctggttttattgtaagagagtagctgttgtccctccaataaaaagtgtgcaatgaatatctgtttaaatagatttgagataagctgaagctggatacaaaactccattatacaacagggggatcctacatccagcttcatttaggatattgcttctcagaagacatcccgaacacctcaataacaaatgttatattgaaaatgtgctcagtaacaattgcgggatgagtctctgtgcagcgatttttcagcatgtcaaaattatactatcacaccatggaaacaaattaaacagcacaagcctggctgccgggatggctgtattagcaatgcagtgctatttcataaagaatgcattgcttcagatctgtcaatgaatgtcaacaatggcttctccatttgtatgaagcccaatttgtatttggagaaaaaccaaacagaacacttcagaatctggttccatttcttcccaacatttagattaaaagaaaaaagcccggttatctaatttatctgtagtcagcgttccttttctagggaggcacttgggaggaagcctcagagtgtgagttaagcactaacattctctttctgaagcacacgggcaccattaaatgcttactgacagctcagagaaaacacaatctatgtgctacacattgtacaagaaggttttgttgatatattagattcatatatgtgagctttggttttcttgtatttgtgaaacgtggcttagctgtgtattatggctttttgtgactaatgagtgggtcttgcttcagaaatgattacagttatgtcagaataatgtcaaataatcagtattagtagatgagctcttagaaaacagaagccctcttttgcagatagatatgtcataccaaagagaaattaaaacccaagactattctaaacgccaaatagagtctgctatattcacatctcaaattttgtgtatctaacaattaagttaaatagtgattgtcaattaaatagcgttcaaattgtagctcaaaccgaataagaatttcttgtccctggagtggatgtatgtagacatcaacattttaagacacaaagggatgatgagtttcaggctttgttgcagaagtttggacagccgtttggctcttccctagcagtcctgaaacacatgaagtaggtggtcctcctgcctcttgcctttttattttctacagctggctcgattacagccctgaggacttgacacagcagaagacaacccagccaggcagcaggttcaatacacagctgaaatctcactgacctctacatatttggctccagtaacctcttatgtatgtatttattttttaagatcatgttctcagtctccataagggtaaatttgtaaggaagaatttctttaattgtttttccaaacatgcaattctgtgcctcaatcgcttctttttttaaaaaaaagaacagttagggtgtcactctgtcacccactgttgagatcatagctcactgcagcctcaaactcctcagctcctgggagcaatcctccctccagcttcagcctccagagtagctaggactgcaggtatctgccaccatgcctagctaagttttaaattttttatatagagacaggattttgctacgttgcctaagctgatctagaactcctggcttcaagtgatcctcccacctcagcctcccacagcactgggattacaggtgtgagctactgtgctcaacctgcacctttggttttgtcactatattgccatagcaaaattcaggtcagtgggacttgagttttggttttctccactgagttccacgttcttgctcacgtttactccagctaccctggtgtagaaatgaaattaccccagtcctcatgatgcaagcgcttattctgtgccaacaccttaagctccgtttctaaatgagattttgtgaaacgaatcaatcaatcaatattaaaactcaagactaaaatctgtctttgatttttgttcttcctactgctatttccactgaaaaaaaaattctctttcatgtgtccatgggtagaatatccttgcattctttctgttgaaatagtatggttctagtattcactagctatgagatattaaagaacggaagccatcttcctcattatgttttataacagagaaatataactccccaatttacatctaagttcatcttaatagtgctttatacaaaaagttcctgaagaattacaacagttggccattctgcaaagtgccaagggactgattctgaatccagagcaacaacaaccaattatgaagaaatggtctctgtggctagtatggtctagacactagcaagctacatataatgagactgctctctcctttcaaaggctgtgatttaaatttataggtggggtcaatgggttaattttcactgccttgttttcactacacttaccgctattgaggggccttaaaatagctctgctatcagaactcactaatccaaatcagtttataaaaacactctcagattaacaaatcaatgatacttacacaccacaaaattggttaccacttaaaggctttattctgactagatttatagcctgcataaatcccattctcatgtaatttagatggaagacaagcaagaggtatctctgctgtctactcacagcagtgtaggccaaaaaggagagcgattctttattattgatgtttagcagcttgtgtttaaaagctataaagaagacgcaatgaaaatacaatagatcaattcctaaatttccagtatagtttacaaaattttaagagggattaaggatgctagtaattaacttaaaaataagggcatcattatatgtctgtgtaacagagatcttttcagaaacaaaaaatcaagatttttttcttttccaactataaataaagcaaagcctgtttcagataaaattcatctgccaaatactttaatgctatcctgaggttaagaatgatgaaataagtttgatcattcttatggtaaaatgaaggctatttaaagatgagtttcattcctgctttttttttaaaaaaaaacttttatttctataagtttttgggaaacaggtagtatctggttacacgagtaagttctttagtggtgatatgtgggattttggtgcacccatcacccaagcaatatacaccgaacccaatgtgtaggcttttattcctctcattcttgtttttttaaaggtgttttgaacacataaaactcactgtatctaatatattctgagcattggattctagtaacatcacctcttaagatgtaaaatctcttcattttagtctctgttgagaattaaagactggtaaaaccagtaatgtttttagaagcatatattgctgtctgaacttgggatttctgattcaaaattcagagtaaaattttagctcttgggactgctacagaaatattctataagcattaataagaccatgtcaatagagcgttaattattaggattaaaaatttactctatggggggctgggcgcggtggctcatgcctgtaatcccagcactttgggaggccgagtcgggtggatcacaaggtcaggagttcgagaccagcctggctaacatggcaaaaccccgtctctactaaaaatgcaaaaatcagccaggcgtggtggctcatgcctataatcccagctacctgggaggctgaggcaggagaattgcctcaggaggaggcaggttgtggtgagccgaagaggcgccactgcattccagcctgggcaacaagagcgaaactctgtcccctcgccaaaaaaaaaaaatttactctatgggtatcaataatcaatgtgttattctaactcattctgtgcctcattcagtaaaaggctatgaagcaatttaaggatatttgcaacaaacaagttggtttgctggtgttgctcttgctttttttaatgaagggaagactggaaaagggaaagtgatggcaataaaagtaagggcaaactgggaggtggggctggacctctcggtgcataccgtaaagccccatgatactgatccatgtgagccaccaacttggttctgagtttcccagcaatcagaacaaagagggcaccacaatccctagaaaatacacccaaagtggtttttgagaggacaccatcatctctagaaaataaacccaaagtggctcttgagagaaggacagaacttaattttggcacaagcctaggactgccagatttagcaaataaaaatacaggacacccagttaaatttgagtttcagtaaagtaccaagtcctttttttttagcctaagcctgacccagatatttttgttaacctgaaatgcaaatgtaaccggtatcctctagtttatctggcagccttaccaagccataattcagagagaatatttgtaacagaaggccatttgtagcatgtagttttagttcttggtttcttaaggaatgactagaatgagaaatagtatatttcctagaaacaaaagcttctaatttcaacaacatcaggacatagtatacggcatgccgtcaagaaacctgctgaaatacaccagcagatctgagcaggagcaagtgctgcagaagccagggtaaggaggacgcgcagagacgccccgctgctgagagcgcctgtgcttcagggtccactgcaggtctgcacaccacagggtgggtcacacctgagacgcccgtattttaattcctttctcccgtaaagccctcacctcactccactctaaggatttagtcggtgaaaaataagattatacttcagacaaggttcaaccaaacatcatcaaataaacctattctaagaaatgaggagtatctgtattcgatggtagaagtttgaaaggaaatacagatttttttttttttcctttcaaagagcttgttaaatttgatctccctcttcaggtagataactcgtggtcaaagttttcaaaagtttcgacatgtaagaaagaggaaaatacatgtaaggcacacaaaaaccatctattttgtgtatgtaattccaaaggattttgcttctttcatggaattgcatagagatgtttgtcttattttcagacactgataagccattatcagtatcatctttacctgtgcacatgttttttgttgaatttcctttaaaatacaatgaattgaaaaggattaaattcttttttttttttttttttggagacagggtcttgctctgtcacccaggctggtgtgtagtggtgcaatctcagctcactgcaacctccacctccttggttcaaatgattttcctgcagcagcctcacaagtagctgggactacaggtgcccgacatcatgcgcagctaattttttttttttttgtatttttactagagacagggtttcaccatgttggccaggctcgttttgaactcctgacctcagatgatccacgcaccttggcttcctgaagtgctgagattacaggcgtgagccactgtgcctgggctagagtattaaattctgaaatgcaattataattttatttaggatatattttacatctaattaaataaatatcctaaaattagcttcacagtggagaaacctgacggccaccactttgaccaagtaatccaagttcatcccaccagtaatgggacaagctgacactgtgtgcctactgagaagggtacaacatcctcctccaacactcttgccaaaaatgcataacttggttgggtacggtggatcacgcctgtaatcccagcactttgggaggccgaggtgggtggatcagttgaggtcgggagttcgtgaccagcctagccaacatggtgaaaccccatctctactaaaaatacaaaaattagctgggcgtggtggcgcacgcctgtaatcccagaactttgggaggctgaggcgggccgatcagttgaggtcaggagttcatgaccagtctggccaacatagtgaaaccccatctttactaaaaatacaaaaattagccagatgtggtggcacacgcctgtaatcccagctactcgggaggctgatacaggagaattgcttgaacccaggaggtggaggttgtggtgggccaagatcatgccactgcactccagcctgggtgacgacagagtgagactctgtctcaaaaaaaaaaaaaaaattgcataacttgagtctaaacaggaggaaacattagacaaacacaaattgaaggatagtctacaaaataactgtcctgcgctcataaaaaattccacagtcataatagactagacataatagtctagataagaggggtctaaagagatgtggcaactggatgcaacatgtgagctgggattttcttcttactattaggtatgtactgaggataaattttgaaatttaaataaggtttgtgtaaagtatggcatcaatgctaatttcctgacttcgatcattatactgtggttacataacagattactccggtattgagaaaacatattctgcaatcttcagaagtaaaggaccatcatgttggcaacttactctcaaaggattcagaaaaaaaatatatgcacatatgtacacagatggagacaggaagaaacaaatgtggtcagtgtcagcatgtgggtatctagttgaagaatgtatgaaaaattctttctcttgcaccttttctcatgagtctaaaattacgtcaaaattagaaagttcaaagaaaaagacatttcctttggtaaaaaaaagtcactcagtatcactaggggaggcatccactttgttttaaagcttactgggcctgaaggaaatgacactcgaacagcacagccagctatagctacagcacagaaaaccacctccaccctctcccacaggagggctccccggctagagttttctgaatacttactggatagttcaatgttgtttttttgtttgttttgtttagctttgccttgttttttgttttttacagctgagaaaatttgagtttccacaacatccacagacaatctggaccataatcaagtcagtgcagtctaaagcaatgtttcaaatatccgaaggtaaggccagttctttattttttgattgctactgaaactaattgaatagtgttatgaatggagtcaaatgatgtgcttaatcaactgaatatccaataattctgtacagcctattctatgttagttttctctaactataagatattctaatggagaacaaggaaaggaataatgccatttttacccggccctttagaagacaaggtaaactcatcttttctaacaggatattgaatatgcattttttttttaagaatccaagccttacctgtacggttgtcccttggcgtccaaggagtattgattccactactcctttgggatgccaaagtgacaattgctcaagtctctgatatacaatgatgtagtatttctatataacctatgcacatcctcccatatacttaaaatcatccctagattatgtatatctaatacaaagtcaatgctatgtaaatagttgttatattgcaattttatttgtattatttttatcgttgtgtcattttttatgttcattttttccaaatattttctatctgcagttgggtgactcctcagttgtggaacccatagatacagggggttgacagacactaggttgaggtaatgcttcatgattgttgaatgtaggattttggatatgcagaaacgaatttctaccttaaagactgaggagcaaaatataaggagacaatgcattaagcccatctgttaattttgattagttttaatattctctttaatatactcttctgtttatataatgtggggctagtagacgaaagaatatcaatatcatttgatgatattaatgttctgattatgcctatattccttctacaaatatatatggcacaaaatccaaatgccaggaactggtctagataagaggaatacagacgattagacacagttcctatgctcaggggatttacactccactagatgatacttaagtacacaaactaaagagagaaaaccctaagggctatggagaaagatgaagcagggaaactgttggagggagagggaggatctggaacatcagcaaagtcttcactagggaggtcccttgtgcagaccaagggacagccaggaccagcactaggaggacgagggaacacaagcagagcagacaggtctgcgggccagggtgccgccaggataggagggctggcgggagaggcaggaggtcaccgcaggacctgaaggaaatgactcctggccaggggccagatcgtgatggtctcaagggttgaagtttaattccgagagtagggagaaggcactggaggacttgcacatggtagtgatgtcatagccttcatattttagaaggcattctacattataataatgtgagatttacagaagagttgtaacgactgcacagagcgtcctcagatgcgctgcaccccacgtccgctgctgttaacatcctacataaccaggccatcttcccataatcctctatatttaaaaggtgatctgtccccttactgtatagaaaataattacgaactaataataacgacaatcattatgaactaataacatcgcatgtcaactgcatcccaggagctgttccgagtgcttcgcatggatcacctccttagtccttacgggctgctttgagtgtgagggcagggctattgatattttcattatccccatttaatggatgaggacagtgaggcagggaaaggtgcataaacctgcccagtgtcacaaaactaatatatggtgaggctggtttcaagctaatattggccaatccccaaccctgaactctggaatagtctgggggagcaaaacaagatccagggagcccagttaggaggctctggctgtggcctgtggtcagcagtgcagcggtcaggtgggaggtgatggcacctgggggctggaaggtgaggccagcaggtcttgctggtgggctgccctgtggagcagacaaaggaaaaggaggcaggggttgcgctgccacttttatcctgaggaaccggctggacagtggtgccttctactgagagtaggaagactggggaagagcgagagagggctcgaggagttctgcttcggatgccacattggcaaagcttataaattatccagttgtagccaagagaagaaggtgagtgtttggagagtagagagtgacacaccaagtcatgatgctcaggggtcaaataggtggaggtgatagaattgactgctggaggccgggcgcagtggctcatgcctgtaatcccagcactttgggaggctgaggtgggcagatcacgaggtcaggagtttgagaccagcctggccaacatagtgaaaccccatctctactaaaaaaaaaaaacaaaaaacaaaaacccagcagggtatggtggcgcatgcctgtaatcccagctacttgaggggctgaggcaggagaatcacttgaaccctggaggcagaggttgcagtgagccaagaccattctactgcactccagcctgggtgacagagcaagactccgtctcaaaaaaacaaacaaaaaaagaactgactgctggacttcatgccaaatctatttacaaatcaatttaacactcttcaagatgtagaaatcaacaaaaattggttcatcaattttctgtcctcagcctgtctcctcttcctcccagatccccatcccagctctgtcttatgagagaaacaaggaaagagagaaggaaggaaagaaagaggggaagaggctgtgggcaagatgggagaagacatcaagaaacccaaaggcaaagaaaatgatggctttcaagaagagtggcaggccacacctcttccctttgaacaacaaattcatgtcacttctttccaatatcaagacacccgtaggacacaataatatattttctctcagatttttgttagaattcagtcaaactgtctgctttagaatttattatctcatgacatgagcctctcattacagggtcacatatttgatttatgacatcaccagttaagttgtttctagtataacacttacacagttaaaatatataaatatttttacatagaagttatgaaatttcaagttgactgaataactgaacaactaaaaacactggtttttttatatttgaaaatgtaactacatgtgcaagaaaattataggtaataaaataatagtgaagaaaagaaaaaaataagtgaaacaagaaaataaggaaacaagtggattacaaaattatacattctagagaggaaaaacagtcaaatcagataggcagaagcagggatacctaaacgaacatggatcaatacaagttcttcaactacatgaacactggttgggggggtccccaagaaagcaaaatccaatggaaaatgtgactgtattgggtgggtaccctttgtgctattcaaaaggacaaacaatgccgtgagaaatctaaacctacaatgtaattgttgactccatagtgtgactataaagtagtgacaaaataattatatacttgtttctattgtgtgtcagataaaacagcacaaattcttgcacccatgtattacaagaacatcaaagaacacgttgtcagtgttcaaatacggcaaaaagttgagagggaagtttttctggtaatctctcacattcaacaaaccaccgacaacaagatactccaaaggaacccacagtgtggggcgagatgtaggaatttcatacacacagacaagaggcaggggagctatgttattcaagctcaagaaaagtatgaaagtaaaggcttctgttatgacactgggttttacctgctttcccattgttgtgttacaaaccaccccttactttttattcttttcacaatctctttccacgcagacactccatgtggttagcttggacttcctgacaacatggtggcctcaatgtatctggatttctcatatgaaagcccaggactcttcacgaaggccaagacggaagctgacagtcatgtcaagagctaggcctggcagagtgtctttttccactgaactcagtgcaagcagggtgaggtcagcccaaattcacagggcagggaagtagaacctacctctcattgggagggggatcacattatttgcagtgatctttactatgccacagggttgatcacctttatggcaatttgattgcttatcagccaaaaggaaggaggtggtgctataatttacggcgggaaagtgaaaaaagaaagaacattcctgggtcacttctctaggctgcctctgactaactccactgacaactttaaatccacatcagaggttgcatttgaaacagaaagacaagaaatacctgcaactaatgttgtcctgtggagtggccggtggcaggggacagctgaaagatccacacagaaggacaggggacttgcagacatggggtcggggtgaggagtggggactgcaaggagactgacagcgtggagctgccagctgtacaaagcttgctatacctatcagggttgaggactcatttttgtgtttcgacacattcttggcacgttccccttgagcatgaggcagaacgcaactgcctttgcttattttatctagagaatgatgaccaaggtgctctttccctaaagagaaggcagaacaagaggagagaaacacattactatggttggaggttaaaaaaaaacacttttctggaaataaaagttattcaccactaaaacagtttacacctaaaagtcagagaatcacttatttggaagatttctatctttactagtgcttattgtataggaaaacaactatttaaacaatactcttcacaatatgtatgtttttctttttctgacattgttttccaactttggtttgctattttttccctttattcctcaacttgtctcccacttctcagcctccattcatgtctgccttgcctttcacccaccagtggtcccagcgatatcgacaagaaacccctaggaacatttagcacacacaaaaaaagcctactaaatcccttcctggtggtccctatgctcataattaagtcggtgcatttctgtctggaaggagagttacactagattatttttctgatcatttaagagctagtgcccattagttataacaatggttgtaggagaatgaaagtgctgaccaactcctatctttgcctacacaatagttctctacctctttcttccctgaagatgatttgatgcaagacctggcctgagagccttccatgtctcggcagcagggactctctgactcagagaattgatggctaatctcagtttgcctcaagaatcctattctccgtgtacagtgactgtattaggagtgttcataggacctagtcttggccaatgaaaagtaccgggaagactgctgggggcttctggggagtctatcacttcctgatacctagagagaaattcaaaagaacaagaggctttgggcctcacgcttttcttcctgtttggattccagggtgatgagatgttatcttgagctgcagcacctgtgggcatggggtgatgaacacatgccgaaaggaggagcccagggcttcacagaagtgttagctcctaaacagagccctcacctgccaacctctggacttctcataactaaacagcaaatgttctcaggtttcagacctcagctggtcaggttttctgttattgtagctaaaggaagctgtgctccatgaatattttcatatttcacatttctgcatagctagggcttattgagtaaggattactggcaacccaagttaaagaatgaccgaatggtgaacatgccttggaattcgagatagtgacttgttcctgtgacatgtaaaggctcatctcctctgcagccattcacttacccaggggtgacaaaactggggacctttctctcctttcttcagagaagattcttccacattcccggacaaaacttcctgccttgctgccctccacccccgactctctctctctctctctggagtggagaagggacaagtgtgacagttactctatgtaagctccaagtttcataattccagaggtcctctcctggggagaaagccctgcccatgcaggcacatgtggccctcactgtaccataccatgggagattagtgcatgaggtactggtgctgctatgatgttctgtgagtaaataaaaggtctgtcctctgatccagcgtgcgcacacacacacacacacacacatattctaaacccacatacacacatgtgtgcgtacacacagttagggtagttcatgtacctacttaaatgcatgcacaattctgtgtgtgcatttttcttagtgcagaaggggagaaggtcctatggttttaatcagattctcaaaggtgtcagtaatcaaaacaaaacataacaaaattaagaactagttactagagtataaatctcttgaggaaaataacattgtcttaatatctgtagggcctagcacagtgtttgacatgcagcagatgctcaataaaagcttcctaattgaatgaatagataaattagttgtgtggtcctccaactatgctcgatgcctagtgctctgggtgaaagaaacaagtatgtgacatttaaatacaaactcataagccataaactcatagaaacagatgtatacacgacaaacttgcatttatcagcatgaaagtctgataaagctctatattgagaaacattcaattgtatgatagcatggaacataattttgtacatccaaatgttaattataagagagagaaaagacctgtaaatgaaagagagagatcaccgtgagttatctacttaacatacgggcttggtcacattaagcattcattctgcatttaagcattctgaatcttaagaattttaatttgccttcttagcaatgagaggctggagtaaaaacccaaaacatatacacgcatatgatttctatattatatgaattttgtataaaacatgattatctttctctaattcattagctagtttatcataagcatccactcgatggaatgtgtttttcttccttcaaagcataagatacaggatatttaacaatatatgttacgaaagtatgtacagcagatagattagtaaactcttcttgtaacatacttcttccaactatcctttttctttggatgttgggtggccatggatgttatgggttgaatttactccccaaagagatatgttcaagtcttaaccctaagtaccaatgaatataacctcatttgggaataaaatctttgtagaagtaatcaaattaagataaggtcatgagggtgggccctaatacaatataactcttgtccttgtaagaagaaaagagacacaaagacacacagagacaaagccatgtgataacagatcagctgtctgagtgatgcagccacaagccgaggaatgccgactcctggcaacaccaaagctcagacaaggggtgggagcagatccttcccagagccttcagagggagctcagtcctgccaacaacttgattgcagacttcaggctcccaggacaatgagacagtaagttcctgttgttttaagccatccaagcttgtggcagattgttttttggcagccctaggaaactaatacaatgggtgacaatggatatattcttgtgactcagatcctgctagtgcaatgttgatttccatctgtcactatataaaatcattgacactcagatgggaggagacagatcaaaggagatcaaatcatagaaaatagaaggatctgagaagaccattcttttaacatgcaattgccacttaacctaaccaaaagatgtattttgtaacttatccttaagactattgttctgataaaaataacgtttctttagagttctgaaattcaagagcaaaatgattgcctcattggaattacagttgacttacatttgagacagggcatcttggacatgtcatttgaaaataaggaaggcattggacttccctttataccaggtaaactttcattaaattcaaccaaagcctggcttacagcaatttctgtgctcccatcagcttgaattgttctagctgtgtttggcagtgctgggatagggatggggtaacataatgatctctcgctagctacccagttttctatttctcatttgttcttaaaagcctcaaacactcccaaagtattttcttaaaaattgggctttcgtttatttttggaaagaaaacaatcaaatgttgatgggtgaggaatgtacagagacagcaacacagggattctcaaatgtttctgctactgggtgtctatgatgacaaaggcgagacccaatggtgcaattttcccaaacatcccgcacacgtgaaaacaccatgtttgtttcttcaaccacttctttaaaatctgttatattaacattcaattaatgatataatttctttttattgtacagttcattttcttagaaaagctctgggtattgaatccttagaagttccccaaattgctattttgaatagcctaatttttattccttacttggtattattatttcttctttctctcatccttttctgttatttctctaccccttttctttgtgcattttgatcagctagagttatattcttttccactcccagaggatacttcaaatcccatcaccctctctgaacggtcttccttttctatcctcattcatctgggtggacttcttccaactgcatcctcctgttcaaatccatgcttgcctgggatcacactgagtcagtgattctgatggtaattttttcaacaagcatttgttaatcattctctgtccaagtagtaggtcataataattagatactttaggtaagagataatttgggcccagtttctaccctctaggtatgtctttattgatatacccagacagtactagttagttagttaatatactccgtatacaatatactctagaaaattacggttctgttgaattggcatgcttttgttaatgcagattgatgctacatctccaacactaacctcagttaaactttttacctaagacaaggcatattatggggatatatgtgtgggaaagaagaaaatgttctcacctactagatgggtctttctttcctttcttatttcattctttctttcccttttcccttcctccctgattccccttttctctctttcttctcagaagacactattaaagcagctaagtcataatcttacaggtcagggcaaaaattagaaaactattcaaaaccactattacccaactcctagggaaaaaaataaaccaaactcctattaaaaaattcattacagttacccttgggaatcattctttcatccattcactcataattcatcagtgtatttattattgaaaattcctaagtgtcagcttacaacaaagtcatcctaaactatatgaatcttttctaaataatcaagactgtatctcaaattactcaacattacatttctaagaatttaccatttgacttcatattgaatatatttgtttttctatttatgtcttagtctgttcaggctattacgacaaaataccataaactgggtagcttagacaaaaaaaatttatttctcacagttctggaggctgggaagtccaagatcaaggtgctggcagatttggtgtctgctgaaggcttcttccccattggtagtgctcctagttgtgtcctcacttggtgaaaggggcaaacaagctcctttgggtctattagataagggtactaatccagtcatgtggactctgccctcatgatcttgtaactccccaaaggccctacctcttcatactatatcttggaatactttgaggagaattaacattaattcttctttaagtatttggtagaattcagcaataaggccatcagatcctgggcttttctttgatggaaatgtatagaaatgtctaatatagtggattttttttttttttttggacggagtttcgctctgtagcccaggctggagtgcagtggcgcgatctcggctcactgcaagctccgcctcccaggttcacgccattctcctgcctcagcctcccgagtagctgggattacaggcgcccgccaccacgcctggctaattttttgtatttttagtagagacggggtttcaccgtgttagccaggatggtctggatctcctgacctcgtgatccgcccacctcggcctcccaaagtgctgggattacaggcatgagccaccgcgcccggcatatagtggattttaagtcatcattatttaagacacaatgtatttagcaaaactaaaaactgttatttttttaacagggtgcatgtaatgctgtatttaaatatcaaaagaagctaattcaatgtgatgaagtaaaataattcgtatcacttgccatctttcagtggttgactaaagctgttatctaataaccatatttttatctaagtatatttaggggagattatctatctatctatctatctatctatctaatttgcctatcgatttacctacctatcttatctatgtaatctattttatccaatcaatcaatctaatcaaccaaccattcaatgtatctctctatttatctatcatctgtcttccaaagtaactttccaaacacaattagaatttgtgctatttctacgtatgacactgaatttttacatcaattacttaagctataaaaaaaaccttccacagaaataatcttactaaaacaaaactgggtgcaagtgaaattcaacaccggcttgtctcccagtagccttagcatctctgctataatttactgagagtataaaagtgctcattcatttggacttacttctgtttgttgcatagggcctgttagtcatgctatatttccttacaaaatgttaacattgagttgtccctcaaggaatattttaatgtgagagagaagtgtcaaggttagaactgctgagagatttgctctctgtagactgctggactgtaaataatcagccatctccagcatcaagtgattgctcaaaagataggatttctttctctgaacttaaaaatttagcataacttgtatttacttcatttcaacatttagatctgcatttcagagcactttaagaatgtgttggtaacttattaggccaatactaatgcagctcagcaaatgaatgcttattatgagtaaactaagaactctagggaatataaacaagatctaatccttgccctcaaagagcccacagcttagttgaggggatacataaacaaatatttaagtacagtaagaggcagactgataatggtactaataaagacttctgtttttataaaggtctacacagttttcaaagcccttcacccacattacttcccttgacctgaacaagaaatatttccagtagaccagaaagactgaatcatccttagtttagaaacaaggaaaatgagaatcacaacattaagggttggatccacattcataagcgtagcagcaacagtgctaaattgccgatttttttttggcaccatattgactatcttctgtgaaaataattaaatgggaggccatcagacagaggtggctctaaaaccccgggttcctaaatcagcaaactgaaatataactcagactcatttcctatgatcggctaatttaaaagatgaaacttgaactcagctgatcacaggcagtcaacttggaattagttatattgttctgaacttcccatgggaatcgtccaaataaggtaattgttcaaactttagccaattacataatttatttgcttccaaatttatcctataaaagctttcccttcaatgacctgtggtggagctctgaccacttgtggctagattcataaatcactgtttgcgcacataagctgtttaaaattttaatacgccttagtttatcttttaacacttctattttattcactcttccctctgtgttctgaaattttgttgacctctcttacctgacttttatcttctctctaactctttgtgttcttgtggacttacactattttaactccttccgtatcattttgatggggtttggggaagtagcagatatatggaacttcttcaggaacccatgtgggacaaaattatttccataagctctgggaatgcctcacagaggacagcaaatttgacctgggtctttagaaatgagtaagattagagtgagctgctgagctgaaagggaaatccaagagaaggaggaaaatgggagaagctatggtctgaatgtttatgtctctcatgagtgtccatgcatctcaattagtacccgtataaaacagccccttctactatgtgaggatgcataagagggcaccatctatgaggaagtgggccctcgccagacaccaaatctgccagagactttgtcttggactgccaagcctccagaactgtgagcaataaaattctgttgtttataagccacctggtctatgggatctcattatagcagcccagatggactaagacaggagacttttaagcccacatgataagctacgttaatatagagatcaatgcttttcttttttttccagggttgaaccttaaaaagaggtcaactatttgaaactaaacaagttcttgtaaattaaaaaaagcaccttcaaaacacagagacaatccagaccatttagtttaagacataactttgagcctttcagctagagcgggttttcaaagtaggagtcatgaagctgcctccaggaggatggcattctttacacaacagaaagcctccaccatggtgatatggatgggggtgcagaagacaaacttagcctccaatctactcggctaacaactccctaggcctttagggcagaacgggtggccagaatcgaagtcaaatggagtttattcagctggaggaagaacttgcagcatggttgctcaacttcaggccacggatttgatcctactttatagagatgagaatgagtctctgaatgcacagtgtttaggttagaaatctgacacattggcaagcatgaacggttcatgcctgtaatcccaacactttgggaggccaaggtgggcggatcacttgagaacaggagttcgagaccagccttgctaacatggcgaaaccctgtctctaccaaaaatacaaaaaagagccgggtgagctggcacatacctgtaattccagctacgcaggaggctgaggcaagagaatcacttgagcctgggaggtggaggttgcagcgagctgaaatgataccactgcattccagcctgggcgacaagtgagattctgtccccaaaaaagagagaaatctgacacattcttaagagacaccataaagggatttacttgttactgaaaatcttagattagcttttttctctttgattaaaaaataacataaattagaataaaatacagatttaaatttatattctattttattctatattttagagaaacatatttgagttcctcaacatctaatatttctgcattctcacagtatttctgtgatgtaatttttcaaaggatctgtgtaccatccacccctttcaaagctgagaatttcatattagatcattgcagctttggagaaaaatgcattaaaatataacagttcacattcttttgtgagaaaacatatatacagctatgtacccgtatgtgtatatgtgcatatatattacatgtacatatagaatgtacatgtgcacacagacacatatacatttacacacatatgtattttgatatttcaaatgctcaatgcagcatggccataggtaatagcaatctattctatttttagtggtagccatgtcatacagatgttttgacaccattgtaaatagcagaaaggggctgccctctctctttttttttttttttgagatggagtcttgctctgtcacccaggatggagtgcagtggcgcgatcttggctcactacaagctctgcctcccaggttcaagcgattctcctgcctcagcctcccaagtagctgggattacagacacgtgccaccacgcccaggtaatttttgtacttagtagagatggggtttccccacgttggccaggctggtctcgaacccctggcctcaagtagtctgcctgcctcggcctcccgaagtgctgggattacaggtatgagccactgcacccgtctggactaccctctctaaagaacaatgccaagcagaaattacaaccctctgatgagtggcatatagagaaaagcatcctatggtatcagccagaggagaaaataggggctctacagcaagatgcggacatgtgtgcaaacaccctgagccaagagtttcctcaggaaccaaccataagctctttgggggcctgtggtggtggtagtcctaggaggtggagatgggggttcgaggaaatgcagaaggttttgtatgtaatgaagtgttttcttttcatggacagagactgtttttctatcccaaaggtctgggggagccataaaaacattttagggaaaatgtcatcaattcctgttttagagtcacaatggcagggttggtgtgaagaacaggctgatattggaaggccaatgtggaagctgctcaactctccagttaagtgtgatgtgagcgtacactaaacacacagcaggaggaagggaggctgggagacacatttaagagctaactagtaggtagcattgagaggagttggtgactacctagatgtggtaaaagaaggagtctgggatgacttcagggtttccaattttgaccagtagggatggtggtgacagtaactgaaaaaagaaaaacaagtgttccagttccatgtggcagactgaacaaatgtgtttaaatctcctacttcctaaagcctgactaaaatgatattggtgcagaagggaaataaatctataaggacaaagagtttgagagagaagaaaaaatcagaagagagatgttaatcaaatcatagaacacagatggaatggtagaacctactgtatttagcagagcagagaaagctaaagcctcactgtctgcagaagggaaattcagtcataatcaaggccatttaggtgcagcaccaccggaaggcccaggactggaggatccaggtccctggcaaattcagagaaaagaaagggcccaaatgagaataagtacttgaaaatctcatacagtgagcagtaagatgacagcatcccaccccccagcctatgaagctggcaactttccctgcttccccaggctgaagacaaaatgttcttttcccagagtagccctacagagtggatctgggctcaggccacctggcacagcatgggggggagatgaggggctttattgaaatcagggaattacatggatgactgcatgttgattggtgatagctcaacccctttgttctgcctcccttccagactgacggcatccagatttaataaaaccctacacctccccaccactgggcaggacattattgtagactttctatctgcagttgtggagtcctaccaccctagaaatagtccagtgtttgggtgcaggtgtgccccttcctcacatcctgttcactgctctactacaggtactcaggtgaaatgcagaatttaacaagcctgaccttgcacacggtttccaatcagtttttttaaaatgcttttaaaaaaagtatgaatgaaaagcaaatgaagacaagacatctggagaaagtcttcagtaccaaaggtaagagactccaagaaactgaaaaggaaacagaaaacaatttagggaagagtagaagacttaaaaaaatcaaacacaacaaacactcaactacaatcaatttctttgaatagataagataatggtataaagaaaaaatatttggagaaaaagaagcggtcttaaatattaaaatgatgacggcagaaaattttaaaaatttagtcagtttggaaaacaagtttggagaaatctctttgaaagaagagcaaagaggtagaggaatgggaaacaggagatgggagatttaaagaaagaaaaacaaagaattgacctaacacgtttcatatccaagatgtaggaatcccagaaagagaaaataaagtggagaaaaatatcaaataattaaatacaaagatgtttcccagtatagaaggtcataggtttctggcttcaaggagccactgtataagtaggcccagaacaatgaatgaggaaggcctgagccaaggacagccgtcacagtgagcaaatggatgatgggctgggggagaacaggaacaagaatcagaatggccttggacttcagccaccagccctgaaagcttgaacagaatgccttcaacattctgaaagaaaatagtgccttacctaggtttccctattcccagacaaaccattgatctagtgttggggggacaatagagagaaaaatcagtgcagaataaacctggcattcgggacaatgtggacgacagtgccctccgctgtgctggagggtcctgacagcctcaggaggagtgggacctcagaatgcatgtctccaattggaaaaattggggagaaaatgatatgtgatttttcgtgattatactaagagatttataattctattagaaagtttggggctgaattaatgacgactttacccaaacccaagtgaacaagcaaatgaaaaaaccaagtcaatcactaaatccaagaaaaataaaatagttgtataagaaagggaattataatacctagtctgaacaatgcttttaatagaggaggtgtgtgtgtggatgtgtgtgtgtgtttgcaggcacatgttgtgtacagcattaaaccttcattgatctttcatagctagaatttagcagatagtagttaaaattaaagtaagaaaaaaatagctggatagtcatactatatttaatttttttttttttagacagagtctctctctgtcacccaggctggagtgcagtggcgtgatcttggctcactgcaatctctgcctcccaggttcaagtgattctcctgcctcagcctccagcgtagctgggattacaggtgtgtgccaccacgcccggctaatttttttttttttaatttttagtagagatggggtttcaccatgtgggccaggctggtttcgaattcctgacctcaagtgatccacccgcctcggcctcccaaagtgctaggattacaggcatgagccaccatacccagcctagaattttttatcctaagattcatcttgggctctttcactgatttattttattattattactataattaggctgcagcttaggttgtcatccaggtggcaatgttgtcacagttgtcattgcctgcacatgcccgtcaaacatacagaatagctgtcaggagcttagaagaaaattccaaagacagtagctgctcactccttaactaagggcagcatcttcagcactcttgcttgttgagagcatggtatttggaaaccatagtttctgaattatgggacataggtcccatatgtccaattatgggacaaccataattctgacactgcaagtgagctagctaggagattgcattttgaatgtgttaaaaatatcttaatctattttacttttaattttttatacatgtacaagggggataaataatgaaaaagtgtctcatatatttctactctaagagcacttttgataagtattaaatataagtctgagaaatttgaagtgatacaaagtctttcagagttcattaacagtgtttttttattttttcttgatgatgaagaaaatgatactgttttttagttcaatggcatcttaataactatttggtgaaactacaaaagaatgaaaagtgattctataggaataaggaaagtgagtagtttacagatatttaacactaaatgacaaatgtgaggtttctttgatgaaatattgaaattaaataacagaaaagcttctaggagatggggcttcgggcagatggttggcaaagttgagctgggcctgagatgataatacatgaactttcctttaagaacctgtttttccctattccaccaaaaccaaaacaaaaaaccctaagaaaacactgcaagtgaagatctactaacaggcaggttttgggcatggagattcagggcgaggtctgtgctggactcagcttggggagtcgcagtgcctgggggctggactacggttagagttctccagtcaccaagaacctgctgtttcactgaggaccagaagcacatgaaaggagaatgcttttccaatagcttcaaaggagtcgaattgttttgaataattagctatgagactgttccccatagtttacaaagaaaagtcattgatatatttttaaggtcatcatttgattcacaaaataagcaaaaaaaattttttgaatgaggcaatgactcagagtgcagaattattttatcattattcatgtaaaaagatattaataaattgtattatgtgccaagcactatgctaggaactcaaactgaattatttcatcaactcatcccaaaagcactaaggaatcattactaacactgtccctgtgtcacaaagagggcaacttgcccagcgttgcatgggagctggcctgtggtgggaaagtgggttctgactctgggggcaaagccgggagctgggatgtccgcgagctgcttctgaacgctgcccatagggagttatcttttgtaaggtccttcagcaccaccaaaatacgtacctctaaaaattacgggcaaaacagaaacagggcaggtatttcgttggttgattgacccacttatttattaatttattcaataaatatatattaatatataactaagaaaaatgtatatgtatattaataatacacacacacacacacacacacacacacacacacacaaatttaagaacctctatggaccaggcactgtgaggagtaccagggatatgacagtgaagaagagaaaataaacacctcaaacaacccaggatgttgtgttgcttgatattgggtgccgtaacaagtagaacaggaggagcaaataaaccagggaggcaatggggccagggtggtccagggaggatgtggaggaaggtctgggggaggctatcagctgtgcacagtgcccaggaaagaggatgccaggaggggcctgggcttggccggggtgtccatagcagagccaaggtgcttgtgttggaaagaagggtcgtccacgtggccagaggttgtgataggagaggggtggtcacaaggtgtcaccgaagaggtagagaggaatctggcactcacagatagagttgtttgaattttattctaattataaagggcagttactggagcattttgagggcggggataggatctgatttgcagctgaaaactatcgatgccctgaaacaggagcttgaagccttgttctcacgtctaaagccatccaaatataggggccactgtggtttttgtctggttttacaactcagttaatcccaatgaataattgagtacataaaatctattaattagggctgttaaaaaagatgtgatggaaagatgatcaatggaaccaccaggcgtggaaataatgtgagtctatgtgcgtatatgcagggcgagcttgagcttcacccaaaatctgtgggtctagaacttacttctctcttacagcacaggcacacctcttcttcttgtgtgtcacttcactgcattttacagatgctgcagtttttacgcattgaaggtttatggcaaccctgcatcgagcaagtctgttgatgccattttcccaacagtgtgtgctcactttcagtctctgtccatttttggtaattctcacactatttcaaacttttttgtcatcatcatatttgttatggtgacctgtgatcagtgatcttggatgttaccattgtgattgtttgggagcaccatgaaatgtgcccacataagagggtggactgaactggtaaagtgttgtgtgtgttctgactgctccactaaccagaccttcccctgtcttgccccttctcctcaggcctccttattccctgagtcataacaatttaagttaggccaattaataaacctacaatggcctccaagtgttcaagtgaaaggaagagtcacacaacttctactttaaatcaaaaactagaaatgattaagcttggtgaggaaggcatgtcaagttctagatctcttgcaccaaacagctagccaagctgtgaactgggaatgcaaaccaggagctattgaaggacatttaaaatgctactcctgtgaacacacaaatgataagaaagcaaacagccttattgctgatatggagaaagtttgagtgttctggataggagattaaaccaatcacaatactccattaagccaaagcataatccagagcaaggccctctcttcaattctatgaaggctgagagaggtgaggaagctgcataacaaaagtttgaaactatgagaggttggctcatgaagcttaaggaaagaagccacctccatcacataaagtgcaaggtgaagcagcaagtgctgatatagaaaccgcagcaagtcatccagaagatctagctaagatcattgatgaaggtggctacactaaaccacaggttttcaatgtagatgaaagagccttctattggaagaagatgtcatggagaagtcaatgactggcttcaaagcttcaaatgacaggctgattctccttaggagctaatatagctggtgactttaagtagaaaccaatgctcatttaccattccaaaaatgctagggcccttaagaattatgtgatatcagccaggcgcggtggctcacacccataattccagcactttgggaggccgaagcaggtggatcatttgaagtcaggagttcacgaccagcctggccaacatggtgaaaccccctctctactaaaaatacaaaaattagccaggcgtggtggcgtgagcctgtagtcccagctactcaggaggccgaggcaggagaattgcttgaacctgggaggcagaggttgcagtgagctgagatcatgccgctgcactccagcctgggtgacagtcagactccatctcaaaaaaaaaaaaaaaaaaaaaaagaattatgtgaaatctctgactgtgctctataaatggaatggcaaagacaggatgagagcacatttgtttacagatgcacatggtttaatgaatattttaagcccactgttgagacctactgctcagaaagaaatattcctttcaaaatattactgctcaatgacaatggacctggttacccaagagctctgatggagatgtccaaggaggtgaatgttttcatgcctgctaacacaacagatgaagggataatttcaacttttgagtcttattaagaaatatatttcataaggaaatagctgccataaaaagtcctctgatggatctgggcaaagtacactgaaaaccttctggaaaggattcaccattctagatgccattaagaacattcatgatttgtagaaggtcaaaatatcaacataacaggagtttggaggaagtcaatttcatccctcctggatgactctgagggcttcaagacttcaatgtaggaaataactcagatgtattggaaaccacagaagaactggaaatacaagtggagcctgaagatgtgactcaattgcagcaatctcatgataaaacatgaactgatcaggagttgcttcttatggatgcgcaaagattttttttttttaagttggaatctacttctggtgaagacactgggaacattgttgaaatgacaataaaggattttgaaaattacataaacttagttgatcaagcagtagctttgagaaagtttgagaggatcgactccaattttgaaagttgttctactgtgggtaaaatgctatcaaacagcatcacatgctacagagacatctttcatgaaaaaagagtccagtgatgtggcaaacatcaccgttgtcttagaaattgccacagccacgtcaagcttcagcagccgcaaccctgatcagtcagcagccatcaacatgaaggtaagaccctctcccagcaaaaagataaggatttgctttattgcagtgggctggaactgaatctgcaatatctctgaggtatgtcagtattcattttctactgccattataataaatcaccataaaaccagcttaaaacaatatccatttatctcatagtttctgtggttcagaagtccgggcacagcgtagctcagcttctcctctgcccagaatcccaaaggccaagatcaaagtccagcactgctctgtggggctctggagaagaacctgctttcaagctcattcaagttgtagcaaatttcagttttgtagggatgtaggattgaggtcccttttccttgctgtctacctggaggcacctgtactccctgcctgcttcacagccagcaggggtgtctcaaaagcttctcctgcttcccctccatctctatgcatgcctccacctttctcttcagccacatctctctggttgcttttaaggtctccaggggtgagtttggagagcctccctatttgaggtctgtgacctttatagctgtagctgcattcgtgtttaatggcataactagaggacagaatcttggaggaccctctttacaattctgcctaccacaataaatatttttagtgatggagacattattttaaaccaattcactgaggaccaaagagggctctattaagcaactcaacaacaacaaagagaaacagatttgagacaaacataatttaaacaaagctagaaaaggctttaaaacatcttttagcatgccttgcattagtaagcacatgtgcaaatgtatgccatcagaaggctatggtaatatctatttagaagtgcaccaccggactgaaatctagactatgttgagattgtatttctcaatatttctggtatagtaggtgtctaagacttcttatcagttatttaatacagacatttaaatagttgatattgtttcacatatatgtatagacactacagtgggaatgtctagttttataaaaacaaatctatttggtgccactaatacatgaaattttgacaggtggcagaaatcaaatgacatttacagaaattcaaacaaaatcttcgcttaatattactctcctttcccccacccttaatcaatcttgaaatgtcaggctgcaggcagccactgtgtctatttggaggtggatactgaagctgacctcccagaatttcctccttccatcccccttggcaacaacagcagtttcttatttttagttttctgggagaggaagacagagagagagagagagagagagagagagagagagagaacactgaaactgtatatttctatgagatgctggagtctgataggtcctttgaagaatgaagatgcaaaaatattaggttgatgcaaaagttattgcaattttttccattacttttaatagcaaaaactgtaatttcttttgcaccaacctacacatttttcttttaatgagatgataagcatatagagaggggtcttgaaacagctagatgccttttgtgttattttggggcttctaggctgcctttctgctgccccctaaccctcccttcatctcctcatccacacttttacaataaccccaaagctattattaatattaaggaccaataaaaagttggtagaatttagagagattgaaaatattttttatttcagtgaaagttaaatatctggtctagagaaatactcagggtataaatatgtcaatactttcatggctgttctcataaaactcagctccaaattttagctaggaaaaaacagcagagtgtcgatgaagagaagaatgaaatttcaggattcctgaatgaccactaaactaccaatgcatccaactatgttacaatagccacaagcaccggcaaacagccagccagccaaaggctgtggcagcaacgtgggctgccaggacccttgctccggccccatgccttgctctctttccataaagggggtcatgtgatacaaccgtggcaatgccacagggcagaatctgcagtgagttcctaaggaagcttttgcctccctctcctcctgcatgcaatggggagctgatggctgcagtggctgcaacgtggacctgactatgaagcaaagggggagagaactgcagacgagctgccttcacacaacatcatgaatccatgccaggaccacgtaccccgacctttttgttatgtgaggaaaatcaccctctctcgggtaagcatctgtagttgggttcgtgctgcttatggcctccaatagcctgaatggtaacacacacttctcaccaggactccctcagggtctcccgtctctcttctggccgctctctctccccagccctcctcctagctaccaccccttgctgctgatgcactgactttgatgctctgctgaactctcgtgtggcctgtcaacttgcctgaactccctgtcctgctctgttcatttttactccctcctgacacatagctctgtgtgcttctttatttggtagcctttgcagctcagagtaaaaggtatttcatttgcgaaagcaacacaacacaacaggtttgcctcctgctctccctgcaaggggaggggccggactcatcccatcccttttaaactttaaaccactattaggactgctgaagggaaaattagtgtgtaaaaataaaatgtccccagtgatgtgcacacccatttttccatgtgttcttttttttttttttaattatactttaagtgctgggatacatgtgcagaacatgcaggttcgttacatagatatacacatgccatagtggtttgctgcacccatcaacccgtcacctacattaggtatttctcctaatgctatccctcccctagccccccaccacccaacgggccccagtgtgtgatgttcccctccctgtatccatatgttctcactgttcaactcccacttacgagtgagaacatgtggtgtttggttttctgttcctgtgtcagtttgctgagagtgatggtttccagcttcatccatgtccctgcaaaggacatgaactcacccccttaaggctgcaaagtattccatggtgtatatgtgtcacatttgctttatccagtctatcattgatgggcatttgggttggttccaagtctttgctattgtgaacagtgctgtagtaaacatatgtgtgcatgtgtctttacagtaaaatgatttataatcatttgggtatatacccagtaatgagattgctgggtcaaatggtatttctggttctagatccttgaggaattgccacactgtgttccacaatggttgaactaatttacacttccactatcagtgtaaaagcattcctatttctccacatcctctccagcatctgttgtttcctgactttttaatgatcaccattctaattggtgtgagatggtatctcattgtggttttgatttcatttctccaatgaccagtgatgatgagctttttttcatatgcttgttggccgcgtaaatgtcttcttttgagaagtgtctgttcatatccttcacccactttttgatggggttgattttttcttgtaaatttgtttaagttctttgtagattcttgatagtagccctttgtcagatggatagagtgcaaaaattttctcccattgtgtaggctgcctgttcactctgacgataaatttctttaggtgtgcagaagcttcttttggtacttaaaatatttttagtactgcattggcaaatcaggaaaatgctgatgagaagaaaatgtacttgctccgttattaacaatctacatttcgctatacctttaaaacagactcattgaggttttagactcaattactgtaaagccagcatacagtgtatgggaccaggaacttgcacactgtgtgattaccacagagttttcagggaggaatataatgacaaactttagtgagatgggtttgtggtatttatattttttcttatttctttttagctaggtgtttctcatatccaacataagtggaggtttgaataagctaatagattatacaatagatttgaaggtacaaacatgttttacatatgaaatggcatgggatggggggcaacctattacaatcccaggaagccagtgccagaactgccaatcggaagatatggcctgggccttcctgttaaatcggtagattccttgtctattagaaaatgctttaatgtactcatcaatgaattacaacaaaggaaaaagactgtgagaaagtaaaatccttaaggctcacctaaatctgaccaaaatgtgcaggtagaaccagtgtatgggacaccaaacgggtgctgtacctctccacttccacactgaagcttggaattatgtatgatcataagaactactctgtgttcatgacaatttgcttaatcaatgttactttggatttactacacatgttctagcaaactgcaacatatatttttttcctatcgtacatgaagtgtttggtgtggaactttattttatatcccatgctcgttaattccctaagcacagctcccatttttcaactgctgctttgagaaaaggagttatttggtttgataatcctttccctctcctgaccttgttgccccaggatatgaacaacttcaataagcaatgcacaagggaagtactttgtgttttgcccggaaagccacagaatctttgaatgcaacagacactctctcaaggtaaaagactatgtccaaatttttttttgcttgcccaaatttttccccagcttttccttttctctctcacttttctttttccagaaaaataccaaaaaattaaactaaaggtttattctcagtattatgcccaaacctacctacaaacaatacatcaatataagactaattgtgcataaaattcaaattctattgcactgccgcataaaaatgcaaaatgctacagtggtataatgtctaatgctgagcccagttccataagagctgccccaagacagcttgtacagatgcaattatctctcacacactcaaactgctttctttcacaacattacttttattatgcaaatgtataaatctaattttaatccaaaagaccatctagaagattaaaaccgcactcgtgtcttactttcactaagtgtaattaaagatactaaaaatgtttttcactggaggaaggattttagccaccaggtcaagaaaccacaaagggcgccatggagctgccaagctgacttcgcattcatcttcattcttgagtggttctggtgaagcagaagtgatagaaaaatgagccacagtagcagcagttttcggcagagggcagcagatgctcttcacttggaagagacagaaagtcctggcagagcctgaagtggttctgaatccgccgggtctgaaaggtcattttgttaatcacaaaaaggctgaagatctacaaggtagcaaggacacagattgcctggtttcacagacatatggtcaccggcacaagaatttttggcaagcctgtaaagcaagcctttacaaaaactgtcttcattaaaaaaaaaaaaaaaaaaagagtgacgcaatctcgatgcccagagtagctaaggccaccatagggaaagtcatttgctaagctgctttttttttttttttcttctccttactttcctgttttactgttctatatccaggtaatggtagttacagcagaagttttttatttttttcaataggtctatcaataattgttacactataaacttttcatatgataaaattggtaataatgatatctatataacaataactaacatttacagggttcttacttggtatcagtttaagctctttgtatagatagttttattttaaatctcacagtgaccctgaaatattactattaccatttcctaaatgagagaactgaggctgagagagcaatttatccagtcacacttggtatgaagcagcagtagcccttgacttgaattggggtctctgagacagcagagtctagaactgtaccctccaatatggtagctgcaagccacaagtggttatttcagtgcgtctatgctgaatggagagaggactgtgaaatacatgctggattttgaagactctgtgtgaaatcagaaagtatctcaataatttttacatcgattacatgttaaaattataatattttggatgtattaggttatataaaatatattattaaaattaacttcacctttaatgtggctattagaaagcttacaattctataattgtataattggtacacattattctttttttttttttttttttttttttggagatggagtcttgctctgtctcccaggctggagtgcaatggtgtgatctcagctcactgcaacctccacctcctgaatttgaacgattctcctgcctcagcctcctgaagtacctgggactacaggcatatgccaccatgcccagctaattttttttttttttttgtatttttagtagagatggggtttcaccatgttggccaggctggtcttgaactcctgacctcaggtgatccgcccgcctcggcctcccaaagtgctgggattacaggtgtgagccactgtgcccagctggtacacattatatttccattggtcctgttggctttagatccttgactcccacgctgtacagcccattgtcccaagacaccttcttcctcgccattctcaggaaaatgaatgacgttaaggaattctgtaaaatttctcgacctgaaccttggtagttcctctcactgaattgatttgtttgataggaattatgtcggatgtaggtatcacatggaatggaaggaggacagaattcagggataagagggaagaaaccactactagcatcacctctcactgtgtagacaggaacatcagaggaatccgaatctccactttgcatcgacatttcctggacaggattacctctcaactttaagactccaacttctagagtttacatagattattggtcaggatagtaactaagggatccaatgcgtgaatatttgaacaacctacagtcatggaaggaaaatttttgttttgattcatctatgttaaaaaaccttcaagctcttcttggcaagcactgggccagagacaacgtgtctttggtttacagagaagtttccccatctttttcttttatcagcacatctctttcatttcaacaaagattctcaaccaggaaatggtcaccatggaaggcagtgagatggaggataggctgtataattccgatgactatccagggggattctggcaaggtgcctcctgtccacctttatgttcggtgcttcaagggctcacttgagtttctgcattcttctgttgatgcttaccatcaatgcccctgacagcctgggtgagggtgcaggggagaggctcaaaggggccagggttttgctgtctgtcatgtgccactctattagtcaggcttctccagagagacagaagcaataggatagatctttaggtagataaagatacatatatgaggggagatttcttagaggaattggctcatgtgatgatggaggttgacaagttctaggacaggccatctacaagctgaagaccctgggatgctggtcgtgtggctcagtccaaatcccaaaaccttggaaccagagaagctgatagtgtaattctcagtctgaggctggtgggggttgggtgctgatgaaagtccttgagtcccaaggctgggggtcctggggtcctgatgtccaagggcaggaggaggagagtgtatcccagctccagtaaagagaaactaatttgttttcctttgtttttcctctatataggcccccaggagcctgaatggggcccgtccacattaagggctgatcttccccttccccaatcaatccacttggactcacatcccaacctcctctggaaacaccctcacaaacacaccccaaaataacactataccagctctctagctattccttaatccagtcaagtcgacacctaaaattaaccattacagccgcacattttggttcataggaaagaactttaaagctactgatctagttaaccttgctggtcacccataaatgagaaaggatgtgaatcaaggaggaaggagacgtgctctacaacataggccacccacactcactcctagtatgttaccaagtgacaaattcacacatcacattccattgtagaaaaaaaagtcacttcttaatttcctcaatatctgatctcaccttccgcttaagccaccctctgtttttctccccagagaggatgccttaccacgtgtatgccgcctatctcagtatctgctggtgtaacgagcgcttttggtacctgttaggccccccgtctccaactcctcgcacctcctttccaaggtggtgactgggtcctcatggtgagtgagaggaggggtccccaggctgtttgcagatggggggctgccctctattcctcaccagctgctgcagtagtggtctccctgtcaccacctgctctggctgctaacttctttgaaaagggaaagttctctctttgcttagggctgtgtagcctctgaagatctggccgccattcccattcaattcctgggcacgcaggtctgccccgtaggctctgatggtaggctccgtttgctcagtagccagcaccaggcctgcccctttccagcgacctccctgcccctccccaggcccctaaaggaggttctgggagctgtgcccaggcattctctacctgaagccactgtgctcctgcctggccactgctgcagcccccagcaggaagcagagccacaagccctcacctctcatcctcccccacactctatgcagccttcttgtcatggacacaggtcttccctccaccccacagtccatgtgagcctgaaagagaggttctgttcctcttctgtctcttatctgaccagagctgccactacctcatgccctctcctgggattgtattaactttaggcttctgggaaagttgatttatgaggaagaggaagagtgagaaagaattggagaaacaaaagaaatcagagaacttgacaattttcttgttccttctgaaatgaattttcaaggtgacttattattctgtttaaaacactaaattctcagaatgctatgtacttcttggtgctaacaaactgaaaaagaatcacacctacatcaaacctatgcagtttggaaatcatctgctcttgtggctcatctgcgttgctcacttgtcttggcaaaagcatatctgagttggcaatgtctcttttcttttccgctttttcttaggctgtctatttcatgtgctatagctatttacaatagattgcatgagccccagcctgtttctaagaaaaagataatagaaaaatgtgtataaaattgtaaaaatacaatcatgtacaaagccatagttaacactcgagagcctatgggtgagtccactgagggcacctgccaagacccttaaccacagaagtctgagatatccccaagctgggactcccattactttccctattctggctctctggtgtgcttcctactatgatatcctagtttttctgcctctcttcaaccatgttttcccttaaaaaagatgtatatacagacataagtcttgtaagtgaatgcataaataatagatacaaaaaggattttattgtagtattccctagcaacacaaaaatatgggtatatacacttccagtgtcacattattcaggatgtctttttaaacagtataaatattatcctcaactgtaagcaaatatagaccagtaagggagcgacagacagctttttaaaaactgcttttttgaaaagcttatccaaatcaagcatttgttatctttttgcaatgtcaacagagctcttgaataaaatattagattatgcccctgctttttaatctgaaagtcatgtgggttttggttttgtcataactaccttagtgcctgtgtatactctctaacacccattattttcctaatgattttatgaaactacattggttttgcagatgagccaaaaatgggtaaaaaggaaagaatgaagacataagtaaaacagaaaacatggctttggctaagaaagcaccttttcttgcactgtgctttaatattcagtaaacatttggttacggttaaaagaaataagaaatatgtatgtttatattgaactggctaatttaatggctgctttgacttctactaaagggtcatctaatatttgataataaacacaacacattaatttttcacttttctttgaattacgggaaggaagtcttactatgaaaagcctcattatgaaaggcctcagtctggtctcaaatccgcagaaattatactctttcctcttgacatcttgtaataaataaaactgttaatattttgactttagacaaatttctcttttgctttcagcagctaacagttacaaaaagagacagtgccacattagttacagtaatttactttggggacaccagcagaaacacataaaattcattagtggcgccaaaagctatttccagttctaataaaaaggctaaactacaatttatgaaacgagtcttaaaactttcctgaagacagaagagttgagatgatctttggaataaccaaagcaagaatccctactgtacttaagccaaaatgtttgttttcacaataccgtaacataatgtgttaacattaaaatactttctcattgccaaatgaatataaactggggagatgctctctcagctcatgctcttggtccattaagcccgggttcctgcctctggcagtgtttcatgcttcaaagaaaggcaacaacaacaaaaaaaccttataagcaaaattagaataaatctacagctcttatgatcaatcatgcaaggttagcactgggagaaaaacacattcgcttctgtttcccataggaatcgcatgcctctgactttgagaccttgggaaatacattttcatcccacaggaaactcaaggttgcagatggacacacacattctactaatatcatttttatttaaacagtttggtctgataatttattaaaaagtgttccctaaaggaatgatgctgctactaaaaacattttcctgaattacttttaatctaaaaagtgcttgagaagaaagctggaagatacgatagttgaattcctacagaagccttgccttctattaataatgaacacaaaatatttggaaaataagacaatggaaataaattgaaataaacaagttggtctgcactggtctttcttagaatacattatgccattcaacacttcttatttagaaatgtctttttccaggaaaagtcctatgccctttttaaagtagatgactttcaagctactataaagacacatgcacatgtatgtttattgcagcactattcacaatagcgaagacttggagacaacccaaatgtccatcaatgatagactggattaagaaaatatggcacatatataccatgcaatactatgcagccataaaaaaggatgagttcatgtcctttgctgggacatggatgaagctggaaaccatcattctcagcaaactatcacaaggacagaaaaccaaacaccatgtgttctcactcataggtgggagttgaacaatgagaacatatggacagaggaaggggaacatcacacatcggggctggttgggggatgggggcctgggggagggatggcattaggagaaatacctaacgtaaacgacgagttgatgggggcagcaaaccaacatggcacatgtacacctatgtaacgaacctgcatgttgtgcacatgtaccctagaacttaaagtataattttaaaaaatcaataaaaaataaagtagatgatttctcaattatttcttctgcatataacccatcgttgaggggtaagcgcagaggagcaatgtggcggctacgtagaaccacttcttaaaggggagagtaacatctaacactcgtgctaagatttccatgcaatcatgtgcacaaattgccagctcagggctcagcacacaagtgtaaaatttaaaaatgccagaacatttctgctcaggcctattcataggccaggcctccttaggtttattgatacccttcccttagtcacaaaatttccttacaaagggcctgtggaatagcagttggaggccaaaggtctggccaccacctaataagaccccacccaaagtcatccagtataagaagttggtttcattacagtataaagtaaaattaaaggctgattaaaagcagcagtttacatctgtacatcatctgatctaatttcctcattcctgatgaggaaactgggccgtagacaggctaaacaaattcctcagaagttaagatcctatatgttcctggtgcggttcactgtgtattcctcgccgtgcacacagtgtcaggacagggcaggctccaactccttactgtttggtgaacgaataaggagggaaccagcctgttttggcgtaaccagcttactggctgtgcggctgttaggattcagatttcctgtggctttttactctctactacacttaccaaagaaaggatggttctggaaagcatcacagtgtgacacagatcaagtgcagaccgaactaccacccatgtgtacacgaacaggggccagtgactgatgatgcttcaggtcccgttagtgggcgccagtccttccttcaaccattaaagaaaaataaagggaacacactgatattttttcctttcaactgggtgcttgctgacctcagagtcctagggcacatgtggttgccagactgaaagaacacggagcgtgtctggaggatgccggcaaagctgagaagccaaactctggctgcatccactgatatttacagctttgccagcctaggctctgctcccaccactcttgggtcagacccgcagaccctggccaaatgatggatgaacaaatgcactcagacacagatatctagtgaaagagtgggttagggaaccgggccgcttacagaccccaaggagggtactgtaaagagtcagcagccacggctggctggtgccgcaggcatttattcagcacaaatttaatgacaaaggctttgagtcaacacacttgtggataattaacatggtcaccctccccccaccacccagagcagtcctgctcgcagacgattaaaggccaggttctggggcctaagtaaactcacttatctagatcagtttctttacatccccttgttacctaacctaagctcttaagagaattcagctgccttcagccaaattttctttagaagctttgcaaacccctggccttccaaggtttgcatctttctacaattgttcccaccaccctgaccaatctcctacacaccacaatatgcattttctcaaggcattctgctgaaggaggtacagcatcggagaaaagcctaggaaacagagggccccgactgccttatcagtcatgctaagatgatcttaccaataatgaaataggatctactattatgtgatctaataaagttatacttttttgataaataattcagcaaagtttcagttttctgaatcaaagggcaactaaagtacgtattattttctgaaagaactctacctactttaccagaaagagaacaccatggaatatggtacacacatcactgtgtcatgtgatgtacagccttggactttacatgctacttaaaatggattaaaaacagtgtttactataaagaacaagaggagtgtagcaagtgtcatcaaatgctttcataaagcccatcgccagacagtcagttacaaacactgagaagacctccaaaggtctttatttgtggcggagagttctaggaaagatgggtggaacccacaccaaaagacgtgctgctctttggggagaatgagtggtgtttcatgtctttagctgttgatatgtttgatccccaattcagggagcaaatggccacatcttttgtgtggaccccattggtgcagagatgagcctgttctatgactgcttccaatgcaccagggtgactaggataactctcagtgtatttctgctacatcaccttgcccttcattcagtaatgatacaaagatggaggttttcaattaaaaacttcacttaggaataaattgtgtttcatgggtttatgatgccctaaaatgtctctgagaatttacacttccttttttattttttattttttggcttgtgggtatttgctttgtgggcagctgcaaaatcggtattagccaaaacaaactgataattaaacaaacaaacatgatggtgtcatgtatcatgtcaattagagtaatgttggaaaatggaagtatacaatacttctaaatattgatttattgctctcctttttcttattctatagaaaaactagattaaaaaatcaatgtcatttacatgattttagtccaataaagagtgtaataatttggctgttcaattaatttggtttgaagaaatgagtgtcttagtctgctcatcctgctgtaacaagatactatagactggatggcttataagccacggaaatttatttctccaagtctggaggttgcaaggccaagatcaaggtgatggtggagtctgtgtctgatgagtgctgtcttcttgctgtgtcttcacacggcagaagggatgagagggctctctgagttcccttttataagaacactaatcccattcctgagatctctaccctcatgacctaatcacttcccaaaagtcccatctcctaataccatcaccttgagggttaggagttcaccatatacattttggagggacacaaaccttcagttcatagcagtgggtaaacatttagtgcttgaatatttgctagtgaaaggattaaattccaactagccaagaaggccacaagccagcctttgtagagaagtagagacatagcacttagaagagggggtctgacatctccagagctgcgccagctcttactgcagtaccgttcattgttaattaatgcattcactcattcattcaacagacagaatcgcgcagggctacatttggccctgtggggatgtagaggcgcgtaataggcaggcccttgaggcaggaagccaatgagagtgtaccatgcatgcagataaccagagtgctgagcaggcaatgaagagaaccattcgcaggacacacagctttaattaagtaatttatagttacgggaaatcttcaataattgatatcttgtaagtgggagctgaaacataatgggcaggcaaaggagtgcagaaggcagacacagagctggaagacactaggcactgaggaaaaccagcaccgaggaatggcgtcttcgtggagcatggactggatcaagggatgatggaagaggtggggaaggcaggctagggatgctcatgcatctgggctttgttcaggaagcaggacagactccttgaaggcgtttgctcaaaaatgggacctgatcagactggtgtttcagaaaaatgactcctgtagacatgaacagggtgatgtggatccaggagaagtttagggcaacgctctcagccagcagaatctaactgagaagcaagggaggaggtactgacatcggttagggtgcagtcaggagcgatttcagaagccgcactacaagcctctcccctgcaccccggcagttgctgcccaatcacccctccctttcacctcacctctcccaacccaggctccacattccatcagtcaccgtttaacaggcatccacatttagcccttctgcttaaaacctccactacttgacccgtgaagtcagattatccagtggtcacaaaaggcaccctatacatgactctgccaacctcccacctcctgtcttgcccttcccaggctggccctgaaccacggacgcttttttaatgttttccatcctggtattctcacccaaccatcctccgcactctcgctctgcctgcctccttccccacccacctagcaaatgccaatttgatcttcaggaagatgctgcacataagctcgtgctgaagaatccagttaatgtgagtggagcagacctaaaatcttggggcgatagtggttacctagtgacccacatctttgtgatttgctaatgctgataaaagctttgttgacaagccctttcaaaggcactctgcttccactctgtgacaatagcgccaggtctgagtctctagcttaagggtttgtgaaatgctttcaggtttttcactgaaggagttcacaagctttggtgcaccctgagttgagctgtgtcaatgagctcacatagcgttcattgtgcttacacacccacggtatcataataacagaagccttttcaattttcaatttgattgaatttcaccctgaaaaggcataggtttttactgtgtactagagtaagtcccactcttccttgggaaactcataatataatatgaaagcagagcctttagggtctgaaaaattgagctttgaaggtctgacaacacctaccatctacccaaggaactgccgagcacccaccaataactccctagtttgaaaacgtggccaatcagcgcaactctctgaggctcagcttccctgtagagccgtagatgagatgctttgaagtaactggcacttgggtgacacacacggtatgtccccaataaatggaagttaccattgacatagtttatactgtcatcataatagaatttcagaactgaaattaaataaaccaaatttatttaatttaatgagtttccaaaagcagagagtatcttaaatcttcctgtacttccaagaattacattgttttaagatgtcttttaaagcagtttcagaagtaccagtgtgttgccatttaccagagtcaaattcaaactttcacaaattcatcatctttaagttatggcgctctctggataccctctccgcaggcatccacggttttctcttgtcatcatcatcatcagtgaagatgtttgtcccccaccatgtctagggccctagactaggcactcaggaagagaagcagtgatgaatcaaaaaagacacgtggttctctgccagcaaagggcttgtaaaagaccacacagtgacagtcaaccacttgggaaagaaccacatgacacaggaagttcgagtgtctaaatacaaaaacggttttcttccaaaatgttagtcacagataaaataggatacagacaaaaacaatcctttaagggctgtttgcatccccaggggtgtttgcgggcagcactaccccagaagggtggggccacgctttctaggcaggctgctcctgctaccctcttggaactttgtgctcccagccacagccatggaagaggaagagagggtgggagcccagcaatggttgattgggggtgagtacatcagaataactctgccgtagcagacaggagtgcccaccatgtgccatgcatgagctagtgcttactgaaagccttcaacattgtgggattccatagatagaattttttctgagaaacagttttctgatggttgtaaaggaaacaaattctttaccaagcatttaacatctgcaaagcactagagtaccaataagctctacaagacccgaaatacactagagtaccagtaaatcatgcaagactcacaagtagctcagtcagactggtaagagacaagacaggagaagagtagctttgccacgtgttttatgcaaagtgtcaagtgacaggtgcaacaaatccatggcacaaatatcacaggccctcaaaagcaatgagtgtaaatagaaaataaaataatctggaaaaataattgcctatggcataaggcatcttatttatttaaaaatgtatccatcataatatgaggatgacttcaggctatgaggaatttattggacagttttcattcaatggggagataaaaacgctttttgaaatgtcttgctatctgtagttagaggaatatcctcctcttcttacatttctatttcattttctatatgcagttgctaggggtacgcacacacccagacaaacacacacacacacacacacaccccacacacacacattcctcagggctttttattcattggaaatttgccatagctaaacacagccactgaaataaaaacatatcctgacatgcattcttacccaatttatcccatttaggactgtagaaagtatctgggaagaaaaactaataaaaaaatgtgtaagtcgttaactatttcttgttgagttcttttccccccagcagtacattaaaatggtctgtacaaattgatagcttcagcattcaaagtgcattaaaataagccaaaccaagactgtgcaccaatgtcagagagcagctcctgtttccaattaaaagagactttccagtggaactgatgagtcatggctcaacatggcagagaggtcttatttatttttttcaaattttctttttagttttaatgatagtcacagcgtcacacatttttgttcattagcatagatggggcctaaggttacaaaagctgtggtaagaatcgtccttaattgcaagggttattctaggatttacatgagaaaaaaaaccccataaatggcaacccaggcagacacaggcatctgtgagcatcttataaaatatctgtaactatagtgtaaatggcaaaacgttatctagtcttttacttaatatgacatttgggtgaaattgcatcttgattcatttgatcttgctgtttttctttaatatgaaattagaaaaaagtagtttcacttttgtttttagtcacattttgaaataatagaagtcaaaataaatccagttgtctgaaaaatgtatctgtttctaaatattctataaaccattggaaactgtattagtccattctcacactgctaataaagacatgctcaagactgggtaatttataaaggaaagagatttaatttattcacagttccacagctctggggaggcctcaggaaacttacaatcatggcagaagggaaagcaaacatgtccttcttcacacggaggcagcaaggagaagtacagagcaaaggtgggggataccccttataaaaccaaatctcgtgagaactcactcactatcatgagaatagcatggaagtaaacactcccatgattcaattacctcccactaggtccctcccatgacacatggggataatgggaagtacaattcaagatgagatttgggtggggacacagtcaaaccatatcagaagctttgcagatcattgtctctctctgttagacctatgattatctaattaaatttctattccaggctttgctgtacaaacaatactgtattcatttggcacaataaaaattaaaacagaaatatttgtcccggaaaatgtaaaggtatgaaatacctttcagaaaaaatgcatgtgtatttgtgtgcatgtctgactgcacacacatacacatacactcccaaaggagataatttagttggttttctttgttttctgattgccaaataaatttctctgctgaatacattgcaagtctaccctcatgattccagtttgtcatactgtgtttttatattccttccaattgaggatgttatgcctaaacatacaatgttccaaagagtctacttcacttcatactatattccccttagcaacattgaatccttaagacatccgttaaaagtcaggagcattcagttaacagcttaatagggttgggatctgtagaaatttatcaaacaaattaacattattgacttttaaacagacactgtagacagtttcaaagaatatcacgaggattttgtaaaagccacatcatactgtggatattaaatattcctggtggaataagatagctggcacagttaaaagaaactgagatattgcaaggccaggagcactgctctcctctgttgcccatgaatcttctaaggaaagaaaagtgctttcttgccacttcagagttgtttttggtttcctgaaactgtcataatttaattaaagcactcagtgtcctgcatatgtgacaccatctagttgacagaatcattccactcgatttttctaacaggggacaagatgcaggtgccaggcagctgctcatacagtatgagaatgggaggggcctctgtccaaaatgtctcctgtcagacgaattaaaatgattatgggctaaagctgggtgctaaaaatgtgtctgtgtgtacgtcacatgaggagggggctttaaccaaatggaaaacttaaacacacacacacacacacacacacacacacacacacacacatcccccaccccctaaaacccaagcaactttttgggactcctaagactgtaagtgagttatcgttactgatgggaatgggttctgtcccataggtgagtcagaacggagaaacggatgcctgtggcaaggcagtgttgtcagagacagaaagcacatccccttgtcggcctgtaaccacaaggtctggatgagctgaataaaaagaatagtagacacccctggtgagcgtccccgcagatgggctcagtccccctgaaggcctgtagcagggcagcgggagggccttctcaggctgagtgggacctttccataggcagacggtgctctgagcctcctgtatacagtagaatgggctcagcactgacctgtggcaactcatgtaatccccacaagtatctccatcttacagacaagaaagtgtgttcttaggaaagctaagcaacttgctgcaggtcacacagctagtaagcactagggtgtttccaaagcctaactgttcaatagcactcttactttctactcaactcaccccaagaacaggcacgaggactcaaggagagctggggatcacctggacacgaggatggaagttgaggtgggctcgccatcctttggggttggtcttcccaggagagaagagccgtggaatttacctggagatgctctgtcttgggcctcaccaatttcgaatttgttcatcataggctgccctccacattagtaggcttcaagcaggtcataagaactcaaaaaagtccaactaatcaacaaatgcgagtactttcccttttaaaatactttttcacaattgagagaaaggaagagaagagttaaggatctgctgagtgtggcatttcctcagaacttctgtatgtcttctccctagagcaagctgtgggcttcgcatagcatccctgttctcaccccaaagaacccgaggccaggacagtgatgttgaagcgggcagacggtgaggccgatgctccttcctcagggccgtaattaaaacgggagacttaggagctggcagaatccttgggaatcattttgtctgacctccttattggagataccatggccagtgatagttgataatttaccaaaccccaaattccttagtggtgaagtagaaaaaagagtagatttctggtttctaatccagatctctgttccttatgctgtaaataaggtgcaaacaaacaaaaaacatcaaccagaaaaatttaaaagccaaagagaaatcattttggaatatagtagaatcgcttctctacataactgactataatcaaagaacaggtagactcctgttcaaatgaatactgttagaacatctggtcttataaaatgagcctatttacatgtgctgacagatggcccacagtgaaaatgctttgctagtctgattacaacaaatcctaataaacccgaatcctctctcaggtgccttcctcagcccccattcatgtgagaggcaatctctattacaaggacatcggtgtgcaggcatttttcaataatttgccatacaactctatctgagcatcatcagacgcactacattgaaagaatcccggattttatgcaaagctatcttcattgggttttattttgctgctttttttcctggaggaggggcccggtggaaggaggttgacagctgcagaggcagtgactcagtgaaaagtggagagttccagagtcccaggtaggtgaagagcttgggggccgttgaattggtgggggattaatgatcaaggaaatctcagaactttaagtaactaacgcacttccctagacaatcctgaaagagctctaattaaaaataaagtaaatgtgtccaggcttttttgatatttcatcaaatttttgcaggaggggaagtgcttgtaagagcccaccaagggctgaatgtgaagacaggtgccccttcatccacacatgccccagggctgtgtcctcaaccctgacaccctgcaacctccttcagtcctctccatcctggtgcccccgaaacatgagtctcccatctcgagtctcccaggcactatgagcaggccgttgtgctgagggcagcacagagctagagacaaggccaccctgacaaggcactgtgctgggcatgtgatgtgctgggcacatgacagcactcactatgtcagcacaggacagcctaggggagccgcatgtccactgcccctgctctatccacagctctgtgcaggatgtgcatatttgtctcccagccctgatttgtgggcaggaggctcagagaaagggctggcaggggccagagggcaggagcagcgggcaaggctctccctgccacctctcgcaagggggctgtccattccggagacactgggccggacctctgtggatataatcccctgtctttcaggctgctgctgcagctgctggtgaacagtcatggcatgggggctgctgtgagtgaaagcagggagcgtggtccttaatgcacatgcgggagtgcccctttgatacagagttcccctgacttaactatttgcaacgaaagagccacttgctcctgtttcggaatgcccatgggaaggatggaaatgccaaagagcaaactcacaaagccactgtgggaggctgaggcaggatgatcgcttgaggcaggagttcaagaccagccagggaaacatagccagaccctgtctctatgtatatataaaaaaaatacaaagtcgagattaaacaggaggcccaacagaaatacaggcctgtggtccacacaggatgtttacaggctgtttcagagcttcagtccgacctacagaaaggcaggaggagggatgaccggccgcacgtcaacagctgtaagcacactggagaactgcctgagcgctcaggtctgttcatgttcattttagatgaagttttgcagaaaaagaacacctgttaccaaaagtgccacgccatcacataaaatgcctcatcagaatgtatcagccactgcagctctgagaggctgatggagcacgacctcataaaaggcttgaaatgaagcttaaagtaaatccctgttggtggaagaggtaagatgtttttataaaccgctaaatcatgctgaaattggaagtgtgtctgctgaggatctgaggtttttctaaggtattcatgcatgtaggaaatgcttctgagggtcccttcaccttggtgacaccatgcttctgcaccgccacttaaatgtactaggtgtgacttgggagtccattaacgcctggcaggcaaggaggttacatcatgggaatccatttcattaccataaataaatgtcatatggctgccatacattttattgattaaactgtcaagaacaaaattgtgtaagaacaaaaactttttattcctgtggcaaaaaaaaaaaggagggaaagaaaaagaaatgaaaatatctacataatttaatgtctctggccctctaacttcttacccagaataaaagaacaaagcccagcttactgctcccttggaggctgcagcacgacctgcctttcgtgtttctacagaacaaggtagccttttctcctctgcgttcccaggcctgttgtcaactctaaagaattgcttaaaagcacctcttcaggtagtagagcttatcttgagatgaaactaaaaaatagactcatttgccttttatccttaaaaaaaaaaaaaaaaacttacaggttggtaaaaagttaagttctttggattggccccaattctgtttaggatacagtttttctgcttcccttacttgagagcaaatagctgttgacctagaggcaaaatttgggcgtgctcccagaggggaggtggcccaatccaaggtgactgatcccaagtgtgactggggcaaaggtcttgatcccaggtttcctgtcaaaatagctagaggtagagttggctttccatacagtcttaaacttttttctcttgtgcttgcttttatttttctatccccttattgggccagggtattttttttcagtccaaggacaaacaatgcctcccaccatcacagataataattacaaaactttacctttgcacagagccttgcagtctgcagtgatattcacccctggtttttttttttcgagactgaatctctctcttttgcccaggctggagtgcagtggcacgatctcagctcactgcaacctccacctgctgggttgaagccattctcgtgcctcagcctcctgagtagctgggactacaggcacatgccaccatgccaggctaaatttttttgtgtttcagtagagatggggtttcaccatgttgcccagggtagtctcgaactcctcagctcaggcaatcttcctgcctcggcgtcccaaagtgctaggattacaggtgtgagccatcgtgtccggccacactgctgattttcttaaacaatcttgtccatctatgaaggcattatttatccctgatttacaaatgagacagaggctcagagaatgacttggcagaggtcaaatgccaggaagtcctacagctgggactagaaatccctagtaatatggtttgactatgtccccactcaaatctcatcttgaattgtagttcccataatccccatgtgttgtgggagggacccagtgggaggtaatttaaccatgggggcagttaccctcatgctgtttttgtaatagtgagtgagttctcacgagatctgatttttttttttttttttttttgagacagactctcactctttcagccaggctggagtgcagtggcacgatctcggcttactgcaacctccacctcccgggctcatgcaattctcctgcctcagcctcctgagaagctgggattacaggcgtgtgccaccatacctagctaatttctgtatttttagtacagacggggtttcaccatgttggctgcgctggtctcaaactcctgacctcaggtaatccacctgcctcagtctcccaaagtgctgggattacaggcgtgaaccactgtgcccagccgatctgacggtttttcccccttttgctcggcacttctccttgctgccgccatgtgaagaaggacatgtttgctttcccttccgccataagtgtaagtttcctgaggtctctccagccctgtggaactttgagtcaattaaagctctttcctttataaattagccagtctcaggtacaactttattagcagtgtgagaatggacaaatagacctagtctccaagtgcagagctccttctagactctgctgtggtcaaatgaccattggggatcagtccaatgaccatacaggatcgagtacgttcacatcttgaaaagcaattgttagcgcaacgtcggcacactctcttttctggcttcatctttccccatggagggtcaccaggtagcagaaacactcctggcctcgcctgtactcctcactccctcttccccaggaaaggaaaaaggagtgtttgaaatttgggagctaaacctggtggtaatgctcagccctggtcctcccacctcctcaaccctgtttgcctgcactgtacgctgcctggactgcacctccgggaaatatgtttgctagagacagcccagccccgatccagccccatggagagggaggcctcaggtgtctgccctgcacaggactagagtgagagccagcaccaaccctctgtgtatctttgccacattctccattattagtctttttagtcacagtcaactctgtctcagttggttcagaactcaggcaaggaggaggggctatttattggattccctcatcctgtaacacaaagcagttgatatttttgcacaaggcgcaatgcctaccaccccatcaaattctgctctgtgggggactgctgactgtgctactcagaataccatgaggctgcttctagtaaaattctttcccagatgactaggggctccagagagatttcattcaaaactgttggcaagtccccagggggcttgagtccttcaagaaccagagctcttttaacgtctcctggggactgcagtggtcttgtgcttaggctaaccagcactgtatgtattttattcttctttcacactttttgtttatttccaaccacttaatcctttttccattaaaattatgcaaaagcctcactttcctcattcatatgaaaatactttttcttctcttccacccccagttttctggttgtagttttactcctaaaatcagcaagacttgtttcacataatgaaagaagctattatacgtcttaaaaacttgcttttcattagcttctaaaacatatacagataaagtgaaaattccaaaactttatggagcattttagttttatgtggtctggaaggcactcactggggtagtcttggagcacatatgggcacctgggcagctgcttatgcttagctgtgtcgcacagacagatgtgattattagtgtcaattagtctcaactggtatgaaacaagagacaacgagatatggaatacaaaatattggcctacataataggttacctcttcagcttgagaataaaaagggagtatatcccactgggactctggcagcagtggtcgacatcctattttttgaccaggcttgagttgacagactcagccacggcctttaccaccgaggtttctttcaggaaaggaaagacaccaagtgaagggaaactattcaggctggtggcaccaacagcaacagccacatcctccccagaactaacacagaattgctgtattttacacagttttctcaggttagtgtgatcaactggagaaaaaaagctaacaattatatttctgagggatggaaataaagtttaaagggtgctgtgctgaataaattaactttataggaagggtacgtccagtgatctttcgaagccctgagctcagcaagaaggctggaaagccggctccctgcaggaatgaagccacctttgcgaaagtataactgagaaaattattatagtgaaagagatctgaccaaaccaactccatcttccttctcatctccaagctatcattgttcattcccgggcataggacaaactgactttgggagaaacttagttgataaaataactttgaaacaaagacggtaacagcccttttccaaaacaaacccccttcctgcctagggactagactgcttttgcaggacacaataaattagctacaaggttagaaatgatggtttaggagtcatgcagctggaggctgcaaaattctcaaccttctgaaattgctcctgggtataacatcattattgtaaaacctaaaatctgtgcttgagagattttgctgaccctgcattcaatggatcagttgggaccacccagatggataaagtggctcatctggtcagaaaatgactcagcacaagagggcagctttgatttcatttctccctatgatttcatttctgaccaaaccaatcagctccccacttttcaacttcttacctaccaaattatccttaaaagtcccatccccgagttttctgggagactgacagagtaataataaaactctggtctcccgtacagccagatctgtgtgaatgaaactctttctctattgcaattccccagccttgataaatcggctctgtctaggcaatgggcaaggagaacccattgggcagtataggatgaggaactcaaactcttcatctgatattttgcatcatattcagaatactttcacagccccaggcaaaaaggagtgtaacaaaggcaaagtgccctgtggcgcttaaagcttctgtgccatacaccatcctgatgggctgggtagtaccattcctgtaaattcccttgcagacaacattaaaaggcaggccacctaccaatgaaccaagctcattaccaaacatttcccaacaatgttgaagtttctgctagtgtaaagagtttacatacttcttttcccctccagtgtggggaagcaattctctaagaaagaagtttaatttatgaatgtctggctgccacaaaataataaggattttcccccactactgtagattaaattatcttatgaaatggattagaaagcaaagggtctgtcttatttaaaataataaaaagaaaaaatctttccaagctgatttgaaaatctacctagaagtcatttagctgtctgttccttttgttttagtatttccatctatcagggaattagttttgtccataaatgtaatcaatatggaatataaagtcatcaaattaaaaaatagatttagagttttcatgataaagtgtacctttaacttgagttaatacaaatgtaaattagatatagatatttgatgccttgcttattgcatttctttggtatgtgacagaaaaatgatcacagtgcttattttaattaaaaatttgttctctttctagaattattgtgatatttatggactgtaatagagaatttctgatgtatacaagaacacaatatcctctttcattctggaaatcaaaaggaagatcaaaggagtcttaactgagttactagtcaatcactttttaaaaaaagacaaaaaataaggtgtcaggtgtaacagagaggtctaagaagtcagtggaggtatacacatactaagtacccacaaaaattttaaaaactacaacaacaataacaacaacaaaaagtcagtggaggaattgggagaagttggaaaaaagaaaagccaaaataagaatttctggtgagaagagaggcagagccaaggatagaaggaactccttactatgatgtaaatgtggtgggttaatcagaaaattgatgcatgttttattatttctaaaaacatttaaacatacacttatatagcaatcttttaatggaagatcaaagcctgttttattttttaaagcatagatctacttcttggagtgtccagtcatcattcttttaaatcagtctttctagtttctggtttcaatttctttaaagtaaaactaggacataaggacagtaacaatgcaatctgaagtcagaattggtttcgagttttagattctttcatttttatagtaattctgcatgcaaatagctcaacaatagttttctaataagcctgctttattaaatctttgcaaatcactcaacttagttttttgtagaaacacttcttttttcattgatggtttcctggcttacttgatttttttaattaaattaagaaatccatattaagcacaactagtaaaaacaggtctgcaaaggaacacaactgacttgttaaaacacacaattaaaccggagggaggagaaatgctgaagctctctagtctcaaatatttagcatgctatggacatcactagggatgtatttcagaggaactgaaggatgttggttaacttgtgagcctcttctatatacattgctaggagaacattttttatgctactaaatttagataactcaaattcaatagtgtttactctcggaaaaataatatattctaaatggacatctttaaccaaaaagttaaattcatttaaacataggccagtgaacagatattaagaagtgtatattgcaatctactttatttaggtattccaaagatgtcatataactatctctcaatagctaagatgattcagttcttaaacctggctaacgcattagatagagagggacatcagtgtcatctcaaaaattatctgaatcttgagttttataccatctattctcattaatctctctcgacccactttttactactaaaacaagtaaaattttttttaaaaaaactttcatattaggcataataataacaacaatgacatttacaaaattacttccatggcataaagtactttctccagtattatttatttcattagcattgattgaatgtctgttatatgccagtttgacatgtgaattttttttagcctgtcttaagatatcttggtggggggggccacagttcatcaatgccagaggagcaagtaaaaaactattaacttcagtagctgcttcttgtgacaactggtagggtcccgcaggaaggagaatctttcctccaaggtggctcacctccaatctcagagggaaaaagcatagtctttttgagaggggttctaactcttggctgtgagcaatgagggatgcttggagtcagctaattaggaggcttaaaatttggaaaacccaaattccctgacccaaactaaccagactgttgggtgcaaagttagggattcactcaggttagggcatttatctacagattgatcatccataaaaatggtatctggatcaggctaggaaatgcatgtcagttttgaaagacatgactcatcttgctgttattgtatgtgagagagttgcatattagttaaggatagtctttgaaggtttataaatgggaagaaagtacatttggattctgtctgtcctccctggaagaggtggtagacacgtggatttcgcctgcctggcatgtcttccggcagctacatctttccctgcccttagttcgtttgattcaagtgggcttgtctcatctcccaggtccaagtgtgggcgcctgacctaggcactgccattcagatctctcatgtcttcatggcgtctgttggcttggacatatggttttggctaagccagggaaatatagatagggaactacctgtgctcatctctgctaccacctggggagagagtctatttgagagcagtaaacatggcatgagagccgagtgaagggaagacagacagcttcgagacgtcatttgaggacatgcacccaggcaggccaacagccaaggctgcccgaaatgactcagctgcacaaataattctcttttttgttaaagctaactttagttggattctattacaatggagatcatcctgactaataaaaccagactggaagcagaagtaggggtaagacctagaatctgtccttgccaacctgcatatcatttatccttatagccaacccaggagtgagtagaattggttagattttgtttctgtgacattttatcaataagaaaaaaaaattcaaagatgggaagccaatggtccaatattagatggttaatatttggcagagcagtgactaaaacccaagtattctgactctacttcctactataattgtgcaaaatatatgactgatgatgtttcaaaatcttacggaataatctcaggactaatttcctcaataaatagccaaaaaaaaaaaaaaatgaattacggaaacatactaaccgatatttggggatgtagatgcttaacttaaaccacagataccattcaacttgtcaaccatgatctgaaacgcacttgacaaaggtatgttcaggtaaactcatggaaatcagttggaattattggtctcatttaatcattgggataaatgataacattactgaatttccaaattcctgaaaatcactgtagtcattatagcaatcatttcaaaacattcaacttaaacgtttataaaatgaaaattcttactaaaattttttatagagcataatcctataaagcagtttgattgatttggttttattcccattcaactattttgcagtttcattcaatttatattatgttagatggatgttaatgtcctagctatatgtgcatttggcattgttgcctaattaaaacttcccttaatttatcaatgaaatcacaataaagtgtccatcactttgtattgcatggacacggggtttaagagcagaataatggcactgtgccctcttcaaagtcattatacagatgaaatcatgccaacatgtccagtagaaacagtcttgaaaagggaaataagttagaaaaggccgctgtctcagccatgccagcgcaggtggcggaggaggcggcgtatcagtgacagtggtgactgcgtgtgcatgcgtggcggaggaggtggcgtatcagtgacagtggtcactgcgtgtgcgtgcgtggcggaggaggtggcgtatcagtgacagtggtgactgcgtgtgcatgcgtggtggaggaggcggcgtatcagtgacagtggtgactgcgtgtgcgtgcgtggcggaggaggcggcgtatcagtgacagtggtcactgcgtgtgcgtgcgtggcggaggaggcggcgtatcagtgacagtggtgactgcgtgtgcgtgcgtggtggaggaggcggcgtatcagtgacagtggtgactgcgtgtgcgtgcgtggcggaggaggtggcgtatcagtgacagtggtgactgcgtgtgcgtgcgtggcggaggaggtggcgtatcagtgacagtggtgactgcgtgtgcgtgcgtggcggaggaggtggcgtatgagtgacagtggtgactgcgtgtgcgtgcgtggcggaggaggtggcgtatcagtgacagtggtcactgcgtgtgcgtgcgtggtggaggaggcggcgtattagtgacagtggtgactgcgtgtgcatgcgtggtggaggaggtggcgtatgagtgacagtggtgactgcgtgtgcgtgcgtggcggaggaggtggcgtgtcagtgagagtggtgactgcgtgtgcgtgcgtggcggaggaggtggtgtatcagtgacagtagtcactgcgttcatacgcgtggaggaggcgaaacgtcagtgacagggctcattgtatggatgggtggtgtttgatgcagcctcctaagccatggatgcatttacaaatagcccctattggttaagcacagtgggaccctgggagttgaatgccacaacccaaacaggattgggatcttgagtttaggatcttcagactcctttagttctggtcccctacaatttgtactgatggttccattgctgttctagaatcctgggcacttttaaaaaattcatactaaatttggcccctgtaggaaagaaagtacatttatctgtttcaaatttatttttgataaaacacttaatttcctattggctctgaactacaataagatcagtggcaatcaagtggaaatatgagacattgaatgttgatatttttctctctgaaggaaattgtgctcataatgtaatatggtgcaggggaaattgtattaatagtaacaggttgtggaaggtgtcctacacctgtccccaactagctgtgtaacccagagtgattcaccgaacccttccctgagacgtacatccttacctataaggatttccattcagagccttttcatatattgtttccaactgttatcttctgaacagtatgcagaacatacaaaataagagagggtctgatagggcatgacaggggcagagcaaaaactggttaatagcatctcgtcgacaggcgtggctctctgcccctgctcaccctgcagtggcttcttcagtcagggctaaggtctctgagcagccatcgtgcagagtgtgtgaagtcaataaatatttaaaaacagagcatagtaagcagagatgacaagtgcagccaccaccacagctcagtcaattaaatcctgctgccagcacaaacttcctgtgtttaaaagtgcaactgggtatgggcccatactcagagagtatattccttgtcaacatttttttttttcaatagaaatagtaagagttttcagatttgggctgtgctgatacaaacatgctcaaaatcccattgagaaaaacatattagtcatctaaatgaagaagtttgctaatgttctaaatctttctatcctgggatataattttgttttattgagtttcttcagtgttaagcatattgtgtcacagaagtgcttttagcattaggaaaagaatcatgttttaattttaatcctttcagataatttattaaaacaaaataagagcatgcaaagagcccagttaaagtgagcaataaaggcctagatattttcgtgcttctgagaaatttagtacggtatgagatttgctggaataaaatcaatagaattggttttatggctatagcattgctatttcatctctttgtttacttgggcatttattactggtgcatgatgcacagaatgggtagaaatgctgaaatgtggtcttttggctctcttccagccagggattattcaggtggagacaaaacaagcttgcttctccagtaaaagatctgatagccttgagatgcccaaggacagtggccagaagtaattgtagttttgccttattatttttttaaactcacacagatatggattgtacagaaatgcattttcatattctgaaagtgtaataaaagcctcaaagtcaacagctcagtagtatgtagacaaagctttgatccataagggaggtcttactgagtatatatcccttctgcccattatcccagtatataagccatcaatagatcgggggcaagggtgtgtgtccatcagagtttaatgaaacagtagggaggagaacaaacacctaggctcatgtttataggggccagggatagtctgtggactttcctgcaactgtccatggagccagccctatagttcttaattgccaatgtggattctcataaaattaaacagtattattctgtcttcactattaagagtagccatagtaaatcacctcctctccagttttctgttttaactgtgaggtgtagttcattctctggatagggatggcttctgtttgcctttgtaattcgttgcagaaaacctattatttgcatttcaagcttaggttcaggtgtctgcagtagatcaacagcataattctttgtactaaacttaagcattcaagcccagtctagaacacatttcacagaatgtcacagtgtcctagagccaaaaacacagccatagagtcaaccatgaacttggaaaatcctccagagtatgcagagctatcaagggcaacgtctcttaggaataaagcaattaattcagaaattaaattttctactttactctttctgcaagaccttagtcacatatatgactttcttcagggatccttaaaactatattagccatctgtgagtttgcaagtagctaaatacaccacctgtaattattagtttaattattataacatagtatcctcacaaagcattgctacatttgtcaaatgtgctgaaatcagttctaaccagagaaagtgttgaaaagacagtgagacaattcttctcaaaattggaggaacataaaagaggcccagctgactcacatcagtacatttgcatgactgaccccctctctcatatggtctccttatggtgagcgccgttcacaatgcaccctcctggcctcttgcttgccttagggctgagtgcacctgtgctgagaaccagggccattcaactcattattgtcatgatgcaacagtgaagaagtacttgaaacagtaaggatgcttctctggcttaaagaaaatattgagggattaatggtgttgattgcttctctgtttgcaacatgactgtatataaaataaaagaagtacgtgtttgattttacccaatggctgacaagcatttgggacatacttcttaagctgtttatataaaccaggttcagaatggtttagagacgtagttcatggacctatttcctatgaaaaggacataagagacttttgtgttttatttctcaccttctgaagtaatatatttcaaggcttttaatcagaaagaatgaattaaatgactaaaatgccagacccaaagtatggccaactgtatcttccaaagatggctgtcacatatttatcatttgaatgttcttctcacaatgtcaggttgacactccgccactgagtggtagggacaatgttgtctctccccaagctcaggcagaacactgtgagtgtctcaaccaacagggtacagtgacactatgtgactttgaaggctaaggtcataaacatgtcatgcacttccaccttgtttccttgacaggacccaacttggaagtcagccaccatgttgtgaggaagcccaagccacatggaagggtcgctgcaggtgtgccagcccagagtctcagctgaggcctcagaagacagccaacatctactgtgatgacgcccagatcataccagtccccagaggtcaagttatctcaacctacaggtcgttccagatgataacccagtaattttgcaacaaaggcaagccagctcctatgttctgcttatatgcctgacccacagagtccacgagcataatgcaatatttgtttatgtcagctgtggtatagttttttactaacttttctttatgagtttgtacagggagagagaattaagagactcagatgccagaccctaaagataaggtgctttgttacgataaggaattctctttccagacatttataatttaaggtatgttgatgtatttagtgcctaaatgtcttagcatggtatttccttgtgttttatacagtttgtctttctctactccccagcactacaacgaacatatgtacaaacttgtgtcaccagaaattgtaagtgacatctgcaaagagagagattgagagaaagagaaagagagagagagagaagacaaacagagacagggagagagaggcagagagaaatggagaccgagagagattgatttatcctgtaaacatccacatcactttacttaacctcttttggtactcggcctttcaattttgtaatacggccaatgaggaatttcggcaaatctcatatctaggagacctaggagcttgtgaagtccttgtccatcagtggctgtgcattcactggctcctggcatggtgtctggtcttgagtgtagacagtcagccttggagaatgtttactaaatgcacagtgaagggagcatgtgcatctcaccttcctggctaccttagttctcatgatatcctcagaggagctctttctaataatggttatttgtcatttccaagggtgtgctacattttgcatttatttaacatcctgaaattgttacataatacgtttattatattataatctcctttgtgtctctggtaatatgcacttttgttaaattttcatatgtatcattgctttatctaatagatcacatttaggacaagcaatggattaagactgccttatcagggaaatctaatgcttgtctttaagaagagaggtttagcttcaattaagacatatacatctaagatttatcactgcaagtagatacttaatgtctgtgtttggaatgtactaattaggttccaattagcagggtcaaaatatgtaaatcaaaagcacttcatcccctttggtgtctctttctctcccataactaattatctgtactcttcttggtcccagcaaacaccacggaccatgtctttaagtctctaatatggtttcttcaagtatgggccaggtgctgtcaacctgtatgttcctcctgaataagtccctgagggtgggagcagagggtctgcattttaccaagaagaccaagtaatctcactggaaaatatagcttgagaaatactattctttagccacttaggcattttcactatgatatctttagggtttatctgatggatacttaccaagtgtttctcatctctccaggggctgtgagtagcataagaaagcctaacccaccgccctatcctggaagtgtggtcaggttattaaggtattgcagatgacaatcatcatacagggcagctttttcagtgactcaaagaaaacccttagtattccataagctgatataccttttaaagttcatttctaaactaaacattgcaaaaagtttcttgtcaaaagagatttcagatgtctctatatactgtttcttgtataaatcacacacccttaccaagagccctgagctgggacccacaaatggaaatcaaaggtaatgtgttcctccattatataataggaatttcataaaacccatacaacagtcatctgtgttatacagaaaaacattcatcactgagcatttgaacattttgatgtttctgaagtacagaattcatgacactctgcaagtttttccaaccaatttacaaattattttcatccctcatcttattatcctacctagtgtcaacttgttctttcggcataatcaatctgaatgactggtaaggtttcatagtgcagcactttagtttatgcagacatctgcccaaaagcatctcaatcactcatagcaagaaacaggggcagcattagccatgaggaaatgctgttttgttacacatgtatatctaaagacagggctatttgtataaaagaaagtcagggtagtgatagacagaactaatgtatcaatgtcagcagaaaatgcaagtcaaggtatggcagcaaaaatcagcctcacagggtacctggaacaccattaatttaaatttaaagcccttgtggggaaacggatatgatataatcactaaattatcattcataaatgaaggtctatcaagtagactatagtattatatttatataagaaaatcttttcaccttgcattcacacataggggtttatgttgctttaagtatttttctagttttatcattacattcttaaactacagtccaatgtgtagcgataagggattactgacatttatagtaagttatttgttcttattattctaaaacaatagataattttgatatagaaattaagaaataacttatgtatgtagatataaagaagtaaaacatgatatatgattctaatggagaagataatgtgatactctctagctatttatgtgactttggaaattacttattgcatgctagaatacaaccaaaccagctattaaaagttaagaggaggtggcaaagcagaaaatactttaaaggaaacttccaaagagccccaggtgatgtaaagttataaaagctgaatttgcttttaataccaattcaacatagtttttcaaactgacgaaaagtacctagatggcattaaacccaaacataaaatctgtctgcaattaaccataaatccttcactatcccgtacacatcttgcttcatcggaatcaatgttgacttatcatgagcaatacctctgattctttagaagtatgtgctacataagatacaaattggctgggcgcggtggcttatgcctgtaatcccagcactttgggaggccgaggtgggtggatcacaaggtcaaagatcgagaccatcctggccaacatggtgaaaccccgtctctattaaaaatacaaaaaaaaatagctgggcgtggtggcgcatgcctgtagtcccagctactcagcaggctgaggcaggagaattgcttgaacccaggaggcggaggttgcagtgagccgagatcacgccactgcactccagcctggcaacagagtgagactgaatcttctcaaaaacaacaacaaaacaacaacaaagatgcaaatcaacagtgctgcatgaagaagtactcacccagaccctggctgggtactcatggcatgctccctcattgaaaaccgccatcatcagtattagcctctccacctcacacacatcataaaatgctcccagtaaatatcatccgggtgcgtgccatgaatttcatgtagttccctctaggaactttgttccactaactgcaacattctctctagccatttaggaataactagttcatacttcccactgtctgtcctccaccacagaatagagaagtacatcgtatatatactataaatacttcatttggtgattaaggtctgatgtatctgttgtatattgtgggtctttatagattttcttttgttaggagagcacatttaagggtaagattccaaagattggaaacattactggactgaagattctttgatgtaactgtgaagactcctaagaggaaaattctgcttgtaaactggccggccagccttcagggaaacatgtcacaggagcacgctggggtcacattgcctagcacaaaacagaactctattaaacatttgggatctgatagtctctaatgttatttagataactgaataaaatgcattttttttttaaagatggggatcttgccatgttgttgaggctggtctcgactcttggccacaagtgatcctctggcctcagcctcctgagtagctaggagcgcaggtgtgagccaccgcacttggctctaaaaggcatttttaaaaatgaaggtgaaaacaattaaaaaaaagtcgagtcaataaaaatttagccaattttcacatccagagaatcattttttataaacttaattatgttattttccttttgcatttggattggccctacctgaaaatgtatacatcatttggtttatgcttacccgtgtggctactgtgaaagatatcaaatcatgtaccccggaagcccttcatttattatggctccagggcaaaggggagcaaaggccacttccgggaggacgcactgatgacacagcaaagtctccagcagccatgaagaagcctggcccctgcaatgccgagagggaggaggatagaagacgatcaaggaagggccaggggcttggacccagatccctttcttggtctcctttctggtctgtcagtctggaaggtggcagtttcttagaaaacttctaacatctaaggtttaggaaatcccagggcagtggggcttttaaaaattgcttcggatgcagacaaagaaacctcaggcctactgtgtgcacctcccacgtgtgtatctacgtaggatgtagagaagacaaagggacacagtgagcatggtggtggcgaaaggtcacctgtctcccacggaggcatggcttcccatggagagaaggaggccagcaaaggccacaggggcataaccagcttaccacgccccctgggagggaccctttcagaagagacaagggtggatggcccactctaggagtgcagccttgcccagatcctggaagacagggtggtgtgactatggtgtgccactcagctccaaaggaacaagggtagaagctctggtctgagagctgacagggtgaggacagctgcagtcagagccagacgaggtgtcagcatgggcccagtccctcatcaccaccaaggtgcaccgtcacagaggcattcctgggcccacccaggctctcagcgtcattagcatgggcctggcccctcatcaccagcaaggtgcccagttacagaggcattcctgggcccacccaggctctcagcatcattagcatgggcctggcccctcatcaccagcaaggtgcccagttacagaggcattcctgggcccacccatgctctcagcgtcattagcatgggcctggcccctcatcaccaccaaggtgcactgtcacagaggcattcctgggcccacccaggctctcaccgtcattagcatgggcctggcccctcatcaccagcaaggtacccagttacagaggcgttcctgggcccacccaggctctcaccaccattggcacgggcctggcccctcatcaccaccaaggtgcactgtcacagaggcgttcctgggcccacccagcctctcacctccgtcagcacatggaagaagagaacagggaagagacccctctgcagacagtccactccatctggggctaagctttgccaaaccgagagagaaaggctttaaactgtgaacaatgtccacaataacgacaatactggaatcaactggatactgtcaaaaagagtctaggttttaaaccagaagtagctaaaaaatgattacactgattttactaggttggactaaatttagttctcctgctgctgagagaaattggcagcttgtcaaagaaaagttacagaaaataaaatgagttgacacatgttgattattgatttccagttcaaactcaccacacaggcatatcaacacacatgcacacacacacacacacatacacacacacacacacacacacacacacacacggtcatatgcataaatatttcagtcacattctttgattcacgtgtatggtataaatcagaaagcaactgagcatcttcctggctgcttccagaataaaccacgtttgttacagctttctagtctggggagacagccgaggtagcccgctgcctccaaaagctgactgtggcagctcgggtaactttggagcttgttttctccacttcagaatattaacttgcgggaagatgacattctgaaagaagacctgttctccaaaccattcggtcaaggagcgaaatcctcagcgatgggcgtgcagactgaaagtcagcgctcgggcccctgctgcatctttgagttgcttcaggagcctcccacctgactgctctgccatccatccgcgcctctcacacttctgttcctccccgtcttaggccccagtgttgcatgtccttggactgatgtcctgataggcttcactggctttgattttccacccgcctccagaacacagcattaggggttctgctaccagtcttcctaagctaaccccacaggacaggggcactctctgcagcaccccccactgctctgagctgttggagttgggaggaggcctgcagagaccttccagggactctgagatgccgtggaacatgcctactggttcctaaatccaatgaaacgtttcagtcctttaaccagcatctcaacgaggatgattccaaatctctgtctctagccccaacttttcatttgaattccagatcctgatgaggggcacagaggccttctctgaacttgatcaagtagctcccacccttggccccttggtcactctcaaccacagtgtcctaatttatcttctccaaaatactcaccagcatctaaaattatcttattgatttgttctcatgtttattgtatatccccctacctcttcccaaattcaccagacaggtgacgtgatattctaaggaaatcatataatactgctttagggtcaaataaaacacacgaatgtcaacgaagacggggactcgtaagttgtgtgtttctgaccctagaatggtacttggcgccaacagattctccaaaaaatatttggttactgactcaccaatctgtatcacagaagtcaacttgacacttccacctggacatctctcagacactaaaaattcagtccaaaattgagtgcacaacagttctttattatcattctgtctaatcataagccaagggcactactctctgttcagttccaaatccagacacccgagaatcaccttaactcttcgttctctttgacccccacatctcagcttgtcccagtgacctcacggctctggatcgcccatgccgccacttctcatgtagatttctgggacagtcttctctctggctggcttcctattaggcccttttagacataattagttttttaaaggcgaatatgaataagatgctcttttatttcaaatctcctcagtggcttgccactgctcctaggatcctgctccacatctctggaagagcattcaagaccctgtgtgagtggcctctccacccgcacccacaggctggcctttcctgatgctctagcttttcattagtaattttttaaaaatcctgcaaacacctgtcttattttcctaaggagatggaactcacttccaaaacattcaacgttgcaacaaccaaattgctaacagtccaccagtttaagggctgagaatatgaactctgcttctgtttcttgacacagcctcactcgacattaaaaataaattggttccccatctagatcaacttgaaacatgaattaaaaacgagtatactaggctgggcacggtggctcacacttgtaatcccagcactttgggaggccgtggtgggtgaatcactttaggccaggagttggagacgggcatggccaatatggtgaaaccttgtctctactaaaaatacaaaaaaaattagctggcatggtggcaggtgcccactcgggaggctgaggcaggagaatcgctggaacccgggaggaggaggttgcagtgagtgaagattgccccattgcactccagcctgatcaacagactgagactctgtctcaaaaaaaaaaaaaaaaaaagaaaagaaaagaaaaaaacggtgtgccagttgaaactactcacattttaaaaggatgtcacacaaatttcagccacattgtagagttttcttatttccatttaccttgcatgataagctccaccaacaaaaagcaacagaatttactatggcatgtatatattaaattgtatttttttttcagaaatgcaatttctttctgagattactttaatcaaaagaataattgcattattcatgagccatgctccgttaattggaagtgttggtcaattattacatgagatcgcatcacctttcaataaagagaaaagagttctcttgtgctggtctttcaaccacaattaccccctctcagtccagtgacttataacacagcagcaaagttaatcatttaaaactagaaatcatctttgaaaagtcaaccagtggaaacatgtttctaacaacaataacagcgggagagtgtactttagaggaattcataagtgcctctgcaacaggatctggataaaggtcatatttttaattactatgggtacaaattttacaaatcacatgctgtctttaccggtacaaaaaatttatcagaggtggagcttggggacatgcgaaataatagggctttgagtagttcctccaactttacaaatatttcatccttaagaagcagacatttaaaaaaattcactgaggaagggaatgcgatattctatgatactcacagcatactgtttagggatcaaatagaagaagtaaatattcaacagcaaggagctgttattacaatgggcttgatttttaaccccttatgttgtccaggtcctgcacattaaaagttctatgtgtgacaattcattgttttattcattaattctgtctgtctagaagattctgaacctgcttcagagggcatagaataagaaactgaggacgagaggaggcccagtgctgagtccctggaactcatgttgtgctgagcacagcgactaccatttagtacatgtttaactgccccataactgctggtctctccattgtccttgactgtgactgcctgacaaatctatgttctgtgcttcagctatgctgagcaccacattctcagttaggtatagaagatgtggtttatatagcacttcttacagtgcctctaagtcagtgacacttagtattccagggcattgagatgtaaatgtatcctgggcacatagagcatatacgctgtgtcacaattgttcaaaattaattatatataattcttttcttaatataggagtccagtggctacctctttgaggactcatttgagccttgcacagtgtagatgacactaaaaatgcatgatatgttgaatttcacacacatgtttaagcaggcctggtgatggtacagtggttgagactgtcctatttgtctatgttggcatgagattgaagcacagagctttctggaaggctagttcactgctgaggatacagagcagtgctaagtgtggggcagataaggccaggggctatgggctgggcataaggatggacagggcgggactctcactgggaaggggctatgggaaggtgcttggtgtcactcgagggactgggaggaaggctgacacaaaagcaggtgggcaacggccctggaggacatggtctccaggtcgggttttggagtcagacaggcctgaggtcagatctcggcttgtcgtcactggctgtgtgatcttggcaagttatgaatggtctttctaagcccctgggtatctgcagaaggaggcggtgactcaggactgcttactatccacacttattcaggttctacatgtggataatgagatgcttgatactgagtctggacagagatgtgttatctaaatcccattcattaccgagttcatacagtcagagttcaggtagggaggggtactggttataataactcttcttagagttgctgcaacaattaaatgagatgatgtatccgaatggcagcagctgggacttactaaggtctcaaaaagcattgtgactgctgttgctactactactactactacaactattactataatgattagaactattagtctgctatacaactatcacagataatattacttaattagaagggtagcggatggaggccatggctctgcttgaatgaagtggtttgaccttgattcacgtagtacgcattgctgagctgaagcaggagaatcacagaattatagcagtgctctgaaagcctggtatggctgcaggactcagatgagccagatggtcaaagtggaagagttggtaaatcaaggttattgcaataactcagttagtactaataagggccagggatgaatacggtagttacgaaacttgaaaggacaggcacaattctaaaaaccattcaaaggaaaaaacagggatggaataaaaactaaaaggtcatttctgtgaagatcaaagacacacagctgaagattcacaaggaaaaaatggtgagctggcaagagagatgatgagcatggcccattccttagaaaggagtctgattgtgaacaaaagaaaaaaccagacgtgaacagcggcagtggcctcacctctctgagctgccttcccatgtcctgggccgctctttcccctttgctgtctggtcctcctctcacaagtctggactctgttgctgcaggctcaggtttagaccctgcctttgctctgcgcacatgtccttcccgatctcatccattcttcttgcctttaaagaccacctatttgatgatgatggcacgtcctgactcagtttgaacatcccattggatgctgaatctcaaactattgatttttacccaaaacctgctcctcccactgccctccctatctcagtaagtggacacccagtcttccgtgactcaggccgagtcccacggtgccatctttcactctgctgcctgtctcatgccagtatctaacccacatacctctcgtatgtgcagagactggtggcttctcactgacctcagcacgcccactgctggtggaaacctccatcatctctgatctgggttagcacaagagacttctgtgtcatcatcttcactccagctacagaattctcccagcatggtagcccctaaagtaaggtctgactttctgcttagaactcttcaatcctttctcatcttatcctaaagaaaagtggagaccctcacggagtctgacagggccctctgaacacagggccctgctacttctctgcacccaccttgctcttctccacactcactgggccctggcaggttacatccactgctgtctactcaaccacacaggagccatctcagggcctgtgtgtctgcagctccatctgcctggaactcccctcccagatatctgtgtggctgcccatcccagttcctttggatctatcttcagatatcatgtaccacagaggccttccctgaccacctcctagaccgcaggaactcccttccccaccactacctgccccagcctctgtcacctgcttccattttttttttttctgtagcaagtgctgtctcatttctgtatatttgcttattaatttcttgtccattttcactaccaaagtacaggttctgtgaaggcagaggtgttgtactgtatacagccacatcatcaacatctagaacagtgcctgaaagatacgtattgaataaatgtgtggtacaagtacgctgggcacagtggctcccacgtgtaatcacagcactttgggaggccgacgtgggaggatcacctgaggtcaggagtttaagaccagcctggccaatatggtgaaaccccgtctctactaaaaatacaaaaattagccgggtgtggtggtgggcacctggaatcccagctactcgggaggctgaggcaggtgggtcatttgaactcaggaggcagaggttgcagtgagccaagattgcaccactgcactccagcctgggcaacagagcgagactctgtctcaaacaaacaaacaaaaaaaccatgtagtacaagtaaatacttaaaaaaaataagtatcccattctgtatggaaagatgaggaatgagctgcacagagggaaagttcgtaacgtgaatgttggctcaaaaaaaattcttcagtaagccatcaggggtggaataaaaagctttaaaaagtgcacgtagagggggttctaagaggaatgtgctattttgcgatgagatttagcctgactgcactctgcctgtgctgacctggatgcagacagtcgctgcctccaccgaggagggcgtgcatctcttcacccactcggctgaacttcagcagcttccacagtgacaggaacggatgggagaatggactttgttgtttcgagggatggtggtggtggtggtatttttatttgctcatttatcttggaagtatcgagtggtagacagtggcacatggcagtggcaggtgcagcagcctccagggagttaaatcctagccctgccactggacttctgactttggctaagggttgcctggtgaatggcagacagtggcacgtggcagtggcaagtgcagcagcttctggggagtgaaatcctagctctgccaccagacctccaactttagcaaagtctctgaccactttgtgtctttgtttccttctctgtaatatgagaatatgaatgtgggttcctaacctgtatctgaaacccaaggtttcagagcttttcagattttaggaaggtaatacagagtacaggctgtattttatggagcacccacagcagggtctaatcgaacacatgaggatatctgtggtgaaatacatgaacattcatacctagtgggataaatcgaggatattgatatggtttggatgtgtccccacccaaatttcatcttgaattgtagctcccataatccccacatgtcgtggaagaaatccggtaggaggtaagtgaatcataggggtgggtttttcccgtgctgttgtcatgataatgaataagtctcacaagagctgatggttttataaaggggagttcccctgaacatgctctctctcttgcctgccgccatggaagatgtgactttgctcctcctttgccttctgccaggaatgtgaggcttcccagtcacgtggaactgtgagtccattatgcctctttttctttataaattacccaatctcaggtatgtctttattagcagcatgagaatagactaatacatgtggcggtggcaagtgcagcagcctctggggagtgaaatcctagctctgacaccggaccttcgactttggcgaagtctctgaccactctgtgtctttgtttccttccctgtaatatgagaatatgaatgtgggttcctaactcgtatctgaaatctgaggttccagaacttttcagattttaggaaggtaatacagagtacaggccatattttatgtagacccacagcagggtctaatcgaacacatggatacaactgtggtgaaatatatgaatattcatacttagtgggataaatcaaggatataaacagcctcactgcagttcatgccaggatttgccaccaagagtgcatgtcaggcaagttttgtctccagatgagtcagaaatattagactttatctgtcaggttaatgtatttaacaacttggactttttattaaactgcaaaggatttcactttatgtatgattttaataacaatatttggcctaagttaaactctttccttctccctccattcttcccttgcctccttctttcctatgattctctaagctcccaacagccggccctgtggtgagagggtggctggtggaccacgaggagcagccgccgggagagaggctgggatgctgcacatgggggagtggcttgggttggctttggctccgcccctagctggccccagaatcaacagaaccctgaggtcaaaacagtgctcccgggagctccgctaatgcagcttctctctggggcccgcttccacactgatcttgcccctaaacccctttgatttatcaattctggccccatttctggtaagtcactccctgggaggcaagcttctccaatgcatggaagtcaggagcttatggaggagaagtgacctgggtcccttacatgccaggttatgtaaagcaaccccaaatatccagctgtgaggagtccgccagaaatgccaacagacgagcacttttcagggaaaaatagagacacagctccctctcacggtttaaatgtattgggtagagatgagcacagcaaaagaaatagagggtcttcctgttacgggaaaggggtgtacaaatggcacttaagtcaaggatgttcaatttgttctcactgtcaacatagggtaaagtggttctgttcagctttctaaatggccaggctattggctgagtacagcctatctgttcgagtaactgtcactttatttatagttacggcaacttcttagaaccggtatcctttaaaatacagcctaatactagagccagatgggaaaaaatcctagggtaaaatattaaattgtgactagtcatttaatagaacaaagttattcatgacagcttatatatgtcaaagcctatatgctggcttgtctataaactggcagatggatttttttccaaatactgagaagaatttcagtctggattttaaaacgagtaagttatttcaaaacaaaactgaccaataaaagaactgataaaaatttgtttaagcttattttattaaaaacaacaactgactttttctttttttttttttgagacagagtcttgctctgtcacccaggctggagtgtagtggtgcgatctcagctcactacaaactccagctcccaggttcaagcgattcttctgcctcagcctcccgagtagctgggattacaggtgtgcaccagcacacctggctaattttgtaattgtagtagagatggggtttcaccatattggccaggctggtctcgaactcctgacctcgtgatccacccatcttggcctcccaaagtgttgggattacaggcgtaagccaccacgcctggcccaacaactgactttaaaactcaaaaggctttatttaaattatactagtaaaaaaaccaatgaacattcttatttatcttctaaaccatgggaatatttaaataattttatattttattatttaatatagatttagtattatgttcctaaatctgggatatggctatttttttctgttgaaaaaccaaaaaaggccaactctatatgtggccagtatacaggtaactgaggctgacatagaagagagttacatgtatccaccaaacaaactcaacctatgaagatcttaaacattttttttctgttgattttcttgagttttcatgactattgcataatggtagatttatactatttccatgtggatgacaggagataatgtccaacatcttctacccctacaaatcagatctgaaatttctttatgatttcttaatactatcatcgagcattcaggtaggctccatgccggaaatttagactcttctttactgcttcttccttgctcccatcttctaataggtcacccaaccttgttcattctacatcaaaatctcctttggaagttggttcactcaccctacattagtatcaaacattttaggtcaaggtggcaattctgacttccagtagtgatttttaaactcaataatgacaacaataacaaaacacgtcatcggccttttcttcatattaagtcttatatgaacgcccattgtgtgaaacgctgaactgacagcctcccctttaccctctcagcagccccaaggcatcctcaccactgatgcggaatattagggccctctgtcttgtcttttccaacagcctggatgtctacccactccagcccatgcccagcatggacatcagagtctgctcctgcctcctggctcaggttcctgggggcagcgtgtggagctgagaagactgcatcgcctggattccatcccagctgggcggcttactagcccatcacacctgggcagtcccgtgagcctcttctatcctgtttcttcatcactaagatcgagaataaattacaatatctattttggggcatcctcagacaaacccactacagggcagggggtccccaacctcccgagccatggaccagtacctgtccgtagcctgttaggaaccaggccgcacagccagaggtgagtgggtgagcgagaattatcacccgagctccacctcttgtcagatcagtggtggcattaccttctcataggagcatgaaccttatcgtgaactacacatgcatgggatgtaagttgtgtgctccttatgaggatctaactaatgcctgatgatctgaggtggaacagtttcatctgcaaccactccactcaccctgtttgtggaaaaattttcttccacggaaactggtccctggtgccaaaaaggttagggaccactgccataggacctttggttcttccaacactcacacatagctgcccctcaccactacttattgattttaagtaagaaaaaagccagtgagtcattgcaacaaataaaaactacatgcaaggcaaatttactacaaaatgtctgactttcccagaaattatggttgctttttaaaacatattttattaaagaaaaggaaaaaataaaaacctctgcccctcactgtcctgaatgatataagactatctgattggatactagtataagtctgatgttgctgcctggaagaaagcagtgagaggcgtcagaacactccagcacactttggaatggccagggagttttgctggcagacactcagcagaagatgccttacactccctacctcaccagtccccacagtaggcggtggaccttcatgtaatgggagactcacaccttctgtgcaagagccaggcacatgggtaactccaggctttaccccatgctgcatttatgagaagaaataagacaatgaatgagcctgttaggccagtgtctgtcttctatgattaacacagccaaggaaagtctggcccacacagaaagagcagccctgcagaaacactagtccccctgagctttgtgcttcagcttttccaaacccaactcaatccaccatatagaaaactcagcaggagttttagccgtcatcattattaccctggatctcacaccactacaggataaactccacagttcctagcatgactacaaggccctccaccctgcagcccccaccttctgctagactttcttgctggtccattgctgacaggcagctgtgctctggcctcagggactccatccctggccccttcctagagcatcccctgatgcacatctgtggatcctgcaagcttcgcatggccaggcttatccccactctttccttctccagcccacaggtcaatctcctgcgatgctttctccaccccttcacgcagagtttattttcttctctaaactaccagaatcttttgttaatatccttgttagagggtttattgggtgctctcataattacagccaactataaactcctagaggtcaagagctggttttatcattcttcgtatctctagtatcttccctagtccctgatagatgctacataatcaataactatgtgttgaccaaatagatgattaagtcagcattatgttttaaattttatttaagttcacaaaaagacaacatattatgacacaaaactgttaatagttccttaaatccaggcagtgaaattacaggtaattcttattataatatttaaacttttcttcatttcctaaatttcataacacagcaataatcatagaaaataaaagagtgagaaaaacctgggagggtttatttatttaacatttcagataatcaaacaatgttaagtactaatattagtgttggcctctcctgctaaatattatgggaacttaccattgcttacatgaatgtatggattagtgcaataaaaattacattggaattctctagatcttgatgtatgttttcttaatttattctgacctaattcattagcttaagtggttcatacatttcacagctataagtcttgttcgctcatctgggaataaatctggtagtatatgctgacacttactaaaatgtaacaatatgattctatttttctgttagagacctttagcccagaaaaaactcccattaaaaaaaaaaagaagaaacaggtttttcatataaagaaaaaaaaaaaaaggcttcagtacaattggcatcttgaatgtcatggccaaaaactagagttccatgaaactgggtacagatctcattatgagcataaaaacaacacacgctcttaaatacaatgcaaaatttcctgctgattaaaaatacaaacaacaatgaacaaagcataatatgagtacaggaaaaacccatctatggattctatgctttagttatgtaacattttcacattagggcaggttctaatgttgatcaccatcatgaccagaaagagttgcaccaacatgaacaagaggtccctaagatattaagctccattaattcttctctgtgtaggcagttagggtcggacaagtacaggagggatggacttattataatgaggcctgggatggtttcttttataatagtctatattgtgcagaaaaaaatacattatacttacaaatatttggcacatagtagatggataatcaatattaactaattaacaatcctatggcgcaggaagatttttcataagcatgttgtggtgacagtgacttctcacatgaggccagctgtctatctcacccacatcctgtgacctgcttctaccccactggttctaccccactgaccttcttctaccccactgtgactaaggcactcctctccacatgctatatggtctgcatgtttgtgaccctccaaaattcatgttaaaacctaatttccattatggggatgttaagaagtgggcctttgggagatgattaggccacgagggtggagtgtggagccctcatcaatgggattagtgcccttatagaagaggcctgagagagctcatctgccactttcactatgggaagtcacagcaaaaagacacaatcctttacaaacaaggaagtgggccctcatcctacaccaaatctgccagcgtcttgatcttggacttcccagcaccttcccagcacccagaactgtgagaaatagatgttgttgtttgtaagatactgagtttattaagttttattatagcagcctgaagggaccaagacaccatcttcacagtgaccgcctccagctactttaatcatgggacagcttcctcctccccatccaatttgcacacaggggtcagccccagtcagtgcctcccctgcagccacagcaatgtttggctgggcttggaacaccacctgctaaaaaatgaccatcccttgggtttcactgtgaaatcttattaatgtcagcattgtatgtttccgatgttccaatgtaatggaagcaaaattcactaaggattgttcttcaagggtcagcatgcccaatatgtaacctgtcttaccacacagagagacaggttcatttacgtctctttaaaaatggttcttctgcttcaaccactagggattctcaactcccagaagaaagtgaaggactgatcatgcttttatctgctgcagtgttggtaacaacagctgactgtgggatgatcactgtttctacatgtggtgtgaggagcctccatctattaactcatatcatctggatgcagtgatgtcattagtcccgtttcaccatccaggtaactgaagtcacagagctggaaagcagcagcagtgggggtcacgtgagcccagcctgcagcgcacaggctctcagcccccagcatgctgcccctttgcagaacgggccctgagaaatgggaagcttttggttttcaagagtctctggatctcagtctggcatccagtgacataggaatgtgtgttagagatgactgaagatctgagagacataagcgatgtggcagaagtatttcacaattttgacctcataacttcttttctgttttgaagccctgggtgttggcaggtatagaacaatagagtggcttcaaagaagtgactctccgggtactatcctctgtgcgcttcccagagcccagctgtgttcaagccaggactttaggagaggaggtaggagataatgaagggacgtgattagctttgtgggacagccacaaactgggtggctagaaacaacagaaacgcatcctctcgcagttctggagcgggtgttggtggagctgcttccttctggaggctctgagggcaaatctgttccaccttctcttgtggtttcgggtggctgccaacaacccttggcattccttggtgtgtggactcatcattccgatctctgcctctgtatgcatgtgagtctcctctctgtgtctttgtgtcccttctcttcttataaaatacaccagtcaagctgggcgcagtggctcacgcctgtaatcccagcactttgggaggccgaggcgggtggatcatgaggtcaggagatcgagaccatcctggctaacatagtgaaaccccgtctctactaaaaaatacaaaaaattagccgggcgtggtggcgggtgcctgttgtcccagctactcgggaggctgaggcaggagaatggcatgaacccgggaggcagagcttgcagtgagctgaaataatgccactgcactccagcctagcaacagagcgagactctgtctcaaaaacaaacaaacaaacaaacaaaacccaccagtcacattgaattttgacccaccaaatccagtatgaccttatcttaccctgattacacctgcacagactctatttccaaataaaggcacattcatgggtgttggggattagcacttcaacattatctttttgggggacataattcgacccataacaggaaatgaagtgttttttcgtgtgttttcttcatgtttgtttttttccctcaagcactaaaaaataatgcaatttggctcctgacaacatgaatctaaaatctaattctgtgagcaggactctctgagcccgggcgcagatgggatacctgcatggggaggggcttgtgtcttgctctcagaaacataataaaccaagagattctgctgcattttcaacacatctctaagaataggcagcagtgcacctccttcttagtgttggcagtgaggctgacgtgacagtctgaatggtacatgcgtcccaggaacctcatgtcatggtaacagaggctacagcacctcacactgaaataagacgggctcagaccccccactgcaaccggctgcattgtcaccttctggggtacacatccgcggcatggagcttctttattctgttatcatccaggctatgagtcggagtattcaacattttaatgctccatatatcaataaattaagtgtgatgctggatggatgtgacattttcaatattccacagtatgactgacgggctaccgtagttcctcccctgtttgtaatttgagtaatctggatgggggacatgaactggccggccaataaaagtgaagactagtggaaagagcaaagtcataaagcaagcatggtccttcagagactgtattaaaagattatcgttttgtatatcattgttttttctttccagagcatgtaatcataaactgaaaagagaagagacaaaatgtaatgttgaccagaataaacaacgctgtgttcatcacttaatgttattacccagtcccttggttgtcttgtcctctgtttgttatcattttcgagggttttattctagacacattttttggtctcagtcagatttagtacagactaatataaagttctgctgctccacagtggtagccgacgcttctggaaactgcagtgaaatctcatgaactcgatagagttcactcttgcttggagcggtccacacacttcctttgtttaagcagcaatgatatgtcatgccaagctgagttcaactttcttggtaactcttgaagacaaatcaaccacactaataaattattcgacctgcaggttatatgagtaacaatggaccaccctaaactctaggcagcacagtctgatttccaacaaaagacaggagatgcagataacgtgtagatactaaatgtataaattgtattgtaattctgataggaaaataaaaccccaaaccctgaacaccattaattcaccatatgtcaacttaaaaaaatgtgaatgctagataataaaactttatgcccatgtaaatgtctaaacacaattttaataactataaataatgtagagatttatttcttattcattttaacaagcttttcactgaactatgatatggtattctaatattaatcttaaagatatcccagcatattctcaacttaaaatttaaaatatggctgggtgcagtggctcatgtctgtaatcccaacactttggcaggccaaagccagtggatcacctgaggtcaggagttcgagaccagcctggacaacatggtgaaaacccgtctctatgaaaaatacaaaaattagctgggtgtggtggcagatgtctgtaatcccagctatttgggaaggtgagacaggagaatcacttgaacccgggaggtggaggttgcagtaagccgagatcacaccactgcactccagcctgggtgacagagcaagactccattacacaaaacaaaacaaaacaaaaatttaaaatacgatgaaataaggcctttcctgtactaaactatgagcaatttatttcacaagaactcttgagtctctgacctattctagaatcatccaaaattgaaattattataaagtgttttctatgaatttcctacccaccaggcatcaaatgacagtatcaatggaacatgcacaaccgaaaaggatctcggccagcactgatgagatccttcataactataaagcaacaggactgatgaaccacacagtgaatccagccacataacttcataatcacccgtgcagaacacacttctggaatgctgtccactcggcccggcactcccctgaggactagggatagagagtgaatcgtagggagatggtctccaccctcacacacactcatccaagaaggcaagacagagcccaccatgcacaccgcaggagacaaacatggaaacccaagtcccatggggataagtgtgcggggtgggggctgggaatgcctggagaaggaggcaagtcctcagagaagaccactgatgataaagttgcttttcagcagagacctaaatgaagtcaggtgtgagccttctggaaactgggaaagggttccaggcagaaggaacaagggagcaagaccctgacgggaagcagattgaggtttgagagaaaggcttgaaaggatggcagtgactcagcaggggccagggcacattggccaggcacccattttaactactttggcttattccaagggagctgagaagccattggagtctgagcagagttgggacgttatttgacttcaattttaaaatgactgctctggcatctgtttggagaccaggctggaaggagaagcagcagagaagtggggaggtggaagatcagctgggggctgttgcagtaatccaggaaacagcccatggtggcttgggccacggtccaagccatggtcagattgtggaaggtgttttgaaggaattgtctgcaggatttgctgatgggtaggtagcatgtgtggtgtgagagcaagagaggagtcaagataacttggagatgatgcttgtgtccatttatggaggtgatgatgactgaagcaaaagaaggatcacacattcatatttggcattatgaagcaggagacaccattaggaactatggggaagtcagggtggcagctagaggtttaattttggggatcaagggtaaagttggagctaaagctatacattttggaattatcagcatatggtgagtatttaagtcaatgatgcaaggataagactacctacggagggaatacagactgggaaaaaagaaacaaagggggagaaggggtctaagactaagccccagggaatcacaacgtttagactgagttctgggctgggagttaaagaagaaccacaagatcatataatatcatgaagtatcctaagtatgaactgaaggcttatcagctgtcaacatagtagactggctgtcaaaggatggctttgctgtataattgttttatttttaatctagtatctcaaataaataaatttaaataaattgctctgtaaattttaaattaccacactcatctgcattatcattactgctcctatagtctctattaggttaaccacagttggtggctgttcaaggatttactccaataatgattatgtttcctttattttaaaatgcacatttttcccacattttaacatccctgaaatcacaatgtatcatacaattgacagcatcttagaactataattttttaaaaatttaaattttagattcaggaggtacacgtgcttgtttgtttcatggatattacatgcgtaattgtgggggttgggcttctaatgtacccatcaccctaacactgacatttatgatcagaactgatgctattttttccttcttagaggaatacacaaaaaagatacatcatataatctgtgacatctcagctctgatcaaataaaatatgtatttctaaagtcacagctctgttctattgtctttggttgatgtacaagtagaagagttggtctctgcacagctgccctctggggctagtgtctactgggatgatgaagagtcaagggtaggaaggaggcagcgccaaggagccccttgtgggcaagcctcttgacagtcaccgtattttgcccagggcttgctattgattagctctgggtgtcatacacctccagtgacttttgccttagcaagaagacagatacagttggaaacttacacaagggcttgctctggtttcattctccaggcattcttttcccctggagtcatacatccctgaagaatagaagccgtgtctctattaccttttaatccccagaactgagcacaatgcataaatatagctggtgctcaataaccattttatttaaattgaaacccaactccccagtatttggaaagacttgtggcctacaacctcagaggaaatgtacaacagattccctccctgggctgcggtagttgaagatcaccgactaactacggtcacataaggtatcatgtctgagtgcccagtactagatcctggtgtagtctccatggaaacatagagaggagcgcttgtatccttgcagagaaacaacaaatgcatcctttataatgataataaaatgcagcatttatagagaggataatcacctgtgttatgaaacaggcaatttaataactctgtctgataaaaacgcaaagacaactgtgatgctgtattttacttctgggggtgtcggcatctgagttcacgggcagtggtgtgagcagcaagaatgaatcttcttcatctccttgtcaacctgttatatgctctcttgctgcttactatgccgttttgtctttttctcctcattatattccccagctcatacatcctaacctactattccacttatttcttcctttacatcatgacctgtagtctatattcctcacaagaaggtcctcaaggaattacaaaggacttttagaaataaagacataaaatattttttacagttcctgcggaaggctttttgtgaagattgtgctttacatgtattaaaaacacctctgagagtagccataaaagtaaatttgaaaatgcatttgaaatgtaaatagtgtttgcagcactcaggtgaggctgcttcaggtcacatgtagcaagagctctgcttaagtcttgagttatcttttccttccagtttcctgaattatgtgacctctgagaggcactctgagtcctaaatgggtagtactcggcagtgactacgattcctaaacaattcctgtcctctctttcactccaggatcttccaagcctgcagcccctggctgcactctggtgccactagaaactgtgggccatgaaggagagatgctggcctgggttcgtacttggccacccaagagaagtaggatgtagtgctatctaacaatgtctctccaacaaggagttcttgagtctcttttaatcagggacccactacattaatttgcataatctgatctggagttcaatagatcaatgattcaaggtaaagaaagctcctgcagcagttcctagcccagccatttcctagccagctaaaatgccttggagctcaggtcagcaaactggctctgatctaagaatggtttttactttttcaaatggttgggaaaaaatttcaaagaatactatttcatgatgacagaaaataatataaaattcaaatgtcagtgtctgtaagtaaagtctgattggaactcagcagcctcactcattcgttcatggactgtctagggctccttttgtgctgcgacagcgtggttgagtagctgggacagagaccctatggcctgcaaaatccaaaatacataatattatctggctctctgcaggaaaagcctgcagacccttgccttagattggcaggcctagtcaaaggctggcctgttttggggactttccagcaatctggtttcatgtagggtgctgctgtgagacatgctgattgaattctgaaggacagggtgagacacaagcagggaataacattctgagaaaaaaagttggctctgtcagactacagggatgagaaaaaaacagctccttggtggtgtaattagtagtttaagtagctttgtctgcaatgatgctagagtaatctgcggtctttcatcatgttcaaggagaatgcacaaaaccactcagctcactataattgcaaatagcccttaatgaatatatatttgctttggctcctctgctctattttacatcaattcttgtgattttccaagtcataaaatgccccagatgcctttcactaaggcattttcacctggataaaaagatgtaaacagattagaccatttctaggtgagttatccaggaaacaggggtgatacaagtggattatctattttccgatctggaaaagtaggagtgatatagaagagaatcaatagttctctacaatgaaatcttagccttggagaagtgtttggtgaggggggtgaagatgggggaagtggcattgcgagagatgcagttactcactgatgccttgcatggtatcacatgatgtcacatgacactgtatgatatcacaaatagaaatgcggactctgatgagctagaactgagtgtcggcttctccgttgccatgcagcccaaggtaaaccactgactgctgcaagccttggtttccttgtctgtgaagtggtagcacgaagccagcactgctgtgacctcccaatgaggtagacggagcaagggtgccttctatgctggcagctggtgctcacctcggcagcacacacactgcactggtggatgggaacttctatgactgacgccaaatagcacactgaaatttgaacacagtgtttatgatcctgaggttgaaattttaaaaaatttctcaatggcaagcatcaacctcaggacactaagtggagaaagtgagatgttattaccaaatctcaagcttgactaacattaaggtgcttgacttgaatcagtgtttctaaaagaaaatgaaaacttctccttcactgtgactcacaaataaccagtaaacaagaataatatgttatagaggtgaaaccagctactcatggactcaaattttcagttgtactgaagtgaactgggcaaaaaatcttttaagaactgcctccaggagtgttggctattttgtaaatagtcaaggatgatggttttcagactgtctagataaccttaacctcaccatgaaatgcaaattatttgctttaaatggcaaaaagtagaaaagctctattttgaatggtattttgtttttaaaatactcttactctttaaagtaagagtcaagaaataaaagacatttatttgggcttagaacacaatttatctgagattttatggtaataacaatactgaatcacttttttttttttttttttttttttttttttttggtgaaccacaggcccataagatcctggctctaattctggctttaccattcctagctgtatgagaattggaaaattccttaatttctctgaggctcttcattttcttctatacaatggggacaagtgtaataatggtattaacaaagtggatgtaaacatgaaataagataataagtgtaaagctcttaccacaaattaagagcataaaaagttatcagaaatggtcatgtatccttggttataaatacaggtcatatatcaattctggcatttatttaagcaaaaaacctttaaattccactcttattttggtgcctgatttttttttttttttttttttgagacagagtcttgctctctcacccagactggagtgcagcagcacaatctcagctcactgcacctcccgggttcaagcaattctcctgcctcaacctcccgagtagctggggttacaggtgtgcaccaccatgcctggctaatttttttgtatttttaatagagatggggtttcaccacattgcccaggctagtcttgaactcctgagctcaggcaatccacgcaccttggcctcccaaagtgcggagattacaggcatgagccgctgtgcccagcctaggtgcctgattttatttttaaaaattaattttcaggcatggcaacaaataaagaaaaaacacacccatttcacgatgcttattggtgacccccaggagaagtgaattgagctatttgagggaaggacagacacacacacgcacatgcatgtgtgtgcaggtgcacatgtctctaaacatagtataaatagattatgccaaccagcacagctccagatgagagtgtctgatgccacagcggcacatcatgagcagtcacccttcactcaacttctagcttgaatagaggacagagatttcaggagcatcgccaagtgatgggtttgggcctggcagatgtgattctgagtagctactgcagcttcggtgcctataggactaatactgcagagatacagtgttttatctttcaaagccagtacattccagggaggctgtatcctggggctgctaaagacgcctgcaagactggcctggaagaaatcctgggagggtctgcttcaggccactgagctaggctggaaacacctgggacagcgcgcctctgacccctgagccacactcgggaggaaccccacactctggcaacaaggactgggaatgtcctagttaggcctccctccctccaccacagcctcggaaggtacttcccgcttgggctctttcttggcaagctggagtttcaagtctttttttttttttttttttttttaaacaccaacctagacatctctagacagtacaaaagtactggaaaatggggaagcaagttttaataataggtacctttggtttataatagaaccaccccccccccttttttttttttaagaaacaggatttaaagaaaaaatgttttcagttcagagccagctttttttttttttttttttttttttttttttgagatggagtctcactctgtcacccaggctggagtgcagtggcacgatctcagctcactgcaagctccgcctcctgggttaacaccattctcctgcctcagcccccccaggagctgggactacaggcgcctgccaccagcctggctaccttttttttatttttagtagagacggggtttcaccgtgttagccaggatggtctcgatctcctgacctcatgatctgcccgcctcagcgtcccaaagtgctgggattacaggcatgagccaccgtgccctggccagagccagccatttttaagtgggacaattccagtacaattggccttgttgctgggcaaagacactaggattcattgtgctattctaaataaacttttcgatcaagagatggaaatgcacaacacatcataaaggatgtgaaggaacatttccccctttctccttaattagagcacttggtatttgtgatgaattaggctgactcggtaacctacaggacataaatctgcagaacaattctattttccaattgctagctaggttaacacgccttaataaacaaataaatatctccatatggactattatccaaagcaattgtgaatccttgcagtacggggcagcgtgtggtggtgacatcctgtgaatggccgagttctgaggccgtcctcgagcgtccatttgagtagtggcctaaatgaggggtgcccttcacggatggaataaggtaacattttgattaatgcaatgagcatgctgctgaatgttacagtcagtattaaaatggcatgtgctaatttaaaatcttagttgtcattagattagagtgcaaaggagagccaccttttgagaagacttacttcatctcagggggcagaaacaagcctgtctctgtttgccactgcaggtgtctggccaacaatgcttgggctctgaaaacatcctgaaatacatatatatatatatatatatatatatatatatatatatatatatatatatttttttttttttttcttttcctaaaacaacatggaaaggtactaagcagcttacttgtggaaatgtataaaactaaatcaaagactttaatacaactgcaaaaagtcacaaagtggaaaaagggcagaattgaaaagcaatgtgattcatgtctggtaataggtttttgagtttttaaaattttttaaattttttattttttgagacagagtcttgctctgttgcccaggctagagtgcagtggcacagtctctgctcactgtaacctctaccgcctgggctcaagtgattctcctgcctcagcctccccagtagctggaattacaggcacctgccaccacgcccagtgaatttttgtattttgagtagagacagggtttttgccatgttggccaggctgatcttgaactcctgacctcaactgacctgcccacctgtgcctcccaaagtgctgggattacaggcctaagcgactgcacccagccttgttaataggtttttaaagatgggtatgcttttgtggccaaaatgcaaaagacgtatttttgtcagcaactaaatattatttggaatttcttctcatgatctctagaaaatacttgatcaggaaaaataacttaagttatcatttttacctttttccaattgcaactctttttaaagagtccaagtaaatcttttttttttttctcctgattgtctttggaagtattgatccagaaatacttcatttcaatggttacaagtaacaataaatttaaaatagcatctgatttcctacaatgctcatttctgtatttatttgaaaatgagacttgcagggagccattatccacactgtgctttgacgccaggtggcttcgctcctggttctgatgggcagctcaagtggcgctggagcttttgctggccacacactcactggaggaccctgtgtcagacagtgcatggccgatgacacagctgtggtcaggacctgccgctgccctttggagctcacagtcccaaggggtaggcagatatgtgtggccagataatgtactaagtcacactgtgttcacctgaagttctcgttcttcatgccaaagggcatagagccctttgtacctgtgcagaggacgtctgcaatgccaagagcaaagggctcctgcagatagaccagggaccgcctcctgggttctgtgaaagccgcagttccccaagtctcctggactcctgagaggaaagagagagtcagggacgagtggctgtgaggagaagagagaggacagggtaaagacggcagataccaaaagaggaagaaaggaccagcgctctgcacgcactgggctcagctccctggaagcccccatgggaggtggccaggtgtccacagggagggctgcccaatgggccccacgaggcagctccactgggcatggcagcagtggagcaaccacttgggaacacacaggtgtggaaaagggcaacatccagagatttttcggattccatagaggcctccctgaggcttgggtgatgccggggaggaaaagagagccgggaatgctgagatggaatttgctggtcagccaagagtcagatttaatttgattttaagaaactaaagaagtatggcatttcttgcacatttaagtttgtggtttaaattttgaactcaccaaaacatgtacagaaatggttagggtgcattgtgaggactgaggaacaagactaccctgggcagaggcaggagtgagatcggagctggggaaaggcctcctgtggaggggctgcggggagcaggctcttgagggtagagtgcaagggggttgggtggagaaagatggggggcattctcaggcactgcgttcaggagaagggccctggaggtgaaacaaacagcttctcttttgtcttctgtggtttctcagcctttcattcggaaacacttggcaacatgggagggagcagagggccgctctgcaagacgcgaggcctggtgggaagccaggcgagaggagcagaacatggccacagcatgaagaaccatccctgcaccacacagtagagggtgagcagatgcctggatgcaccccaatcccccagcaaagccctgagctgctttgagcctcagttacctcggtggcccaatggagactgcactgtctcccggcaaggctgctgggcagctcacggaaaggacaactgtaagatacaggtgttttctgcctggcggtggtgagggctcctcacatttttcttttatcctaaaagcaacaaggagcagcagcagtttttagggaggagcatgcatggcacgacctacgtgccctttactcatctggcaagggcccaagctgagtgaaatctgacatcgtagtagagcaggtcctttgggcctatgaggaggcagaagggaaggaagaaggacggcttccctggtgttgactcagcaataaagctttcacctgcagagaagggtcgggatgctgacagcagcccactgattgcaactcagtctctcttgttccagtttcccagacgcgtctgggtcctgggaaaagaggactggagtgtcaaaatggggaagaatcatttcattctaatctgcactcgatcttagccaaaagtctgagaagcaatttccattctaattgtaaaacaagtggcaagagctaggcatctctgggactcctttaacagaagacgaacaaaggggaagaccattgcctctttctctcaatccctttcctctcccctcagctcagagctccaggtggctccagcagctctgacatcacctgcacccatagcgcttgacagggcagcacctgaacgcttgtaagtcagacctgacaggagcacctgtgctgcttggcagggtggtgtggggcgaactggagtgaatctgtccttgggtacatggaaaacatactctaaggactcctgaaattgaagaaggcttactgctgtgaccatggccatattgatagctgtaggcaggctgttggggtgtggtgagacgggcattataagacagggatagcagtggcacagaaggattgatgtggacaaagagccacagcaaaaacaccagcgagaagacagctgccatgatttaaatgagagaatatagggctctgaaatttaaaaactgacaaaggtgacacaaattcttcacttaaatttcatatccctgaattatctgcataaaacaaagggtaaaagggagaaggtggattttaatcttagcatggaaacacccacatttaaatgtaaagatgtgaatatattctaagtattttaaaaagatatattcaaaataattaaaatgtttctcattttaaagaaataagatgtcagatgaaagatgttggacagttattcttgaaagtggtctaagattgtttacaaatcatgtctgcttggagaaaacatttttcaaaaaaatttatttaaaaaaaattttcattttaaggctgttaaaaaaatttatttattattacaacttttttttgtagagatgagggtcttaccatgttgcccaggctggtctcaagcaatcctcccaccttggcctctcaaagtgctgggattacacgtgtgagttacccaccgtgcccaatctcaaaaaaatatttaataagaggaaaatccatgtattggctcctatcaatcactgcccactattcagcctttctccccaattgactaagaaatttatgtcacatgatagaagtgaagaaaaattaagtatattcacgttatatctaaagctttgtataatatctaattattccaacaccaataaaatctgttatcacctattagagggaaaaaatgtccactatttagaaaatgtatagagaaatgacctggaaataatgaccattctaaagacacatgtaaatatctatagttttaaagcatattttaaaatgagataatttaacaaataagagttacaatgataaaacaacaattatttcactaaagtctatattttaggtcatagaaagtgcttttttaaaaggaaaaaaaaaaaaacattcctgtgcagcattttacagatttcaaagcatcattaaacaactgagaagtgaatttcttttcagaacaggagaggccatgcatctcttacaccacatctccatctatttcatcagcagttgtgttaaaattcctagatgagggatcagaaagctttggaacttgaaatcagtttgtcctcaagactggtggttaacatgatatcattgactattggaaacaactgaaaaactcttttttttcctattagaacatcgaatacttctacagaatatttctattctatgttctaatgtaaaaatattcattttttaaattttttaattcttttaaggctttaaattttgacaggtttgccagtactcttgctcggcagttttttctacttcatctgttagtctgccctcctccctgtctggaatgatctgcatagaaaggattgtgcaaattctcatcggccacaaacgttctgctcacatgtaccagatgaccctagtgccttgcaagaaacttgagacccatcgcatgatttctccagaatcagatccaacaggatgcactgctcctgctgaacaactaagaaacgttattttcaaccccagcttgaaaacttgatagatagtgttttcttattagtaatgacccactggctaagcccttttcagacatctaacaggtcatgagtatgtgattatcatgctcaaatttacacatatgaggggccctagtatggtttctctctttctatatagtgcaaaaacctaacgattaaatattgatttaaaagagtgtttggagctcagccagtaattgtgcagcccggttcctaacaggtcacagccaagtacgagcctgaggctcaggggctggggacccctgatgtataccactggcgagggactctaataatgggaaagactacacatgtatgatggatatgagggcaaagggtatatggggtatctctgtaccttcctctcaactttgctgtgaacccaaaactgctgtaacaaattaaggtcttaaaatacatatattacttctcttcatcactgaggtttctgatacccccttaaattttgtactccaggccaatgcctcagcaacctcaccccggtcccaggcctgtggctcatcatatgtttccaaatcaccgatgggttttgcttctagtgacttatgtaaatataagcattattttacaatgtttttaaatttaatgacaaaaatactgcacactcataaaaagtaaaaagtagaaaacagcaaaaaaaaaaaaaaaaaagagtgggtaaattgttgactggtcatgattttgtagaaaatagtaaatttgagagcataagaagtttgagatcagctttgaagttcctgagttcaggtcattagcatttaattatcaatgccacctttcagccatggttctccatttttataagtggatgcctagagcacttggtgggatttcagcaatactttcatagctctccaggtgatgtcaatggctagggtaaatggtgtgggtggcatgatacagaacatctgactttcccctcattcttcccatatgtttacatcctacttatctacatagatcaaccaataaaccctttgcgtaaaaattacatacacactataatgctcttataaatcttcacactttgttgacacttagtaaatattaaaaaccataaatcacagaaaaaatattattaagttttgttattatgggtccaatctacccagtggcttaccatgatctacggaataaatttcatactccttagatttgaattaaacatccccagagtctgttgccaagattttccagcttctttcaaactacttcctatccatacacagggctccagtgagttaggaattatattctccgagaggaccctggaatgtctgccttcgtatctttgctagttttgttcctttgacttcaaacacacttagcccagactccctattcaaagcaaaccacagccatctccttaggaaactttctccattccccacaagggcgtgcctccatggccccacactgcacacatccctacagtaccaggaaccacgcctgaccttggagctggagttgtttgttactggctagtttcctccaggacaaagtaaactcactgaagacagagaaggtttcttatagcttcttccttgctgtgcactttatagagaatgaaaaagtgttccattgaatggaatagaatcaagaagtcatgtttgggtagtagaaatggaatggacaatcctcttttttaaagaatacaacactggccagtcacggtggctcatgcctgtaatcccagcactttgggaggccaaggcgggcagactgcctgaggtcaggagttcgagactagtctggccaacatggtgaaactctgtctctactaaaaatacaaaaaaattggccaggcttggtggcatgtgcctgtaatcccagctactcgggaggctgagacaggggaattgcttgaaccagggaggtggaggttgcagtgagccgagatcgcaccactgcattccagcctgggagacagagagagactccatctcaaaaaaaaaaaaaaaaaaaaaaaaaaagaatacaacattaacaaaataagatatatctttttttttaaattaaaaaaaaatgtatgttttgagatagagtctctgtcacccaggctggagtgcagtggcaccatctcggctcactgcaacctctgcctcctgggttcaagcaatttttctgcctcagcttcctgagtagctgggactgcaggcgcgaaccaccacgcccggctaatttttgtatttttaatagagacggggtgtcaccatattggccaggctggtctcgaactgctagacctgatgatccgcctgcctcagcctctcaaagtgctgggattacaggtttgagccaccgcgccgggccaagatatatctattaaaaatatattaaacatgttttcctgtctttagagtcatatcctgttgtgtctgtcctttcaaatggaaaccttgacacagctgcagtacactctgctttaattacttacttaatttgaagaatgttaaaggtaaaattgtaataagaaattgtttcccaacatactttccttaggttccctgctacctctttagttttgtttttttcttttcattccatatctccaatccacacagaatgaattttatttccttccctcgtcagtctttcaacctcccccgcaattctcaaccctgcaattcaacactctgctcccaaaccagccttcttgtcacttccaactcatcttcttatttaagctgcattgcttttccgtgaattagactggatcttaagtgaaggagacacaaaccaactgcaaatgatgaataaataccatcagtggggacttagtgaatggctaggtcattttcacccccagtgccaggaccatcatgggaaagtcgtccttttggctgttccggaagaagtggcagcatagtgactttctcctttccctgtggatagcatgcaacaggaccaaagggagtattctgggctcccaaaacatggggaagagcctatgctctcatgtttggacattcctagcaacgggttccattaaaaagctgtcctaaactctaggcttatcaagacttttacataaaaagactattgcatttttaaaacataaatttcattcctttatgaacttcaaatttgctgctactaaaaacatgattgctcttgtttccatgggacttttcttctagtgagtctttgtggaatgcctgtgatggccaggtactagtatagcggcgcaaatacaacagcaactagtcagacacacctacactcaaggaatttacatttgtgttagtgaaacaggcaataaagaagggaatgacaagcccacctttttgctcttgttcaccactcagtgaaggtccatgggctgaggtgggctgtgggtctctttgtctggtgcaccttgttctgaagcaagggcatcccaacagacaacagctgcccttgtgtggcccaaggctcaatattgtccttgacgtggacatggaaggaaacacagaaatttcaacctctgcttccgagaaatgattgccaattcattcagaggttagtctgcagagctgactgagatcaccaagggaaactggaagcttattgccttccaactttatttctttgagtgcaaagcctatgaagataatctgttctcagtcaaagagaaatttaatatagcactccctgatttcttctatttaattcatagtctcctggcaatccctaaagtacattcactgtgtgttcaagttttgccttgttgtttgcttgcatcaaagagagaattaaattgtacacacacacacacacacacacacacacacacacacacacacacacacaaagtgaacccagatcccggttccctcaaggctggcctaaaagttattgttttcatatcaggtttaatcaacagcttctgtcatattccatatgccacctcgttctattgctaacacttttattttctaatgattaaccttaacacacacaattttgccttagcttagccattttagttatataatcattctgaaggaaaaggtcaaatttatgaatttctagactgttcagcaccctgtagggactgtcaaaaccttttaaaataaaagtgattattttccatgccaagaaatcgctgggtcattgggaacagtgggcgcatcttgcttcccatgccagcatgccctgagtgtccctggccaatgcatttctaggggtttccatgctagatgtcctctttagacataaacagttttcacgcccagcttaatcatttatccgagggttctttaaaatgtgaaagtcattctataaagaaaaatttttttttttgagacaagagttttgctgtttttgcccaggctggagtacagtggcgcgatcttggctcactgcaacctctgcctcccaggttcaagtgattctcctacctcaactgcccaagtagctgggattacatacaggtgccaccacacctggctaattttgtatttttagtagagatgggatttcaccatgttggccaggctggtctcgagctcctgacctcaagggatacacgcccgcctcggcctcccaaagtgctgggattacagacatgacacaccgcagctggccagaattttaaaatttaatttagaattaaatgattaagaaaaataaattttgcagctgaagatggaaattccatgctctaacttccccatgccaccagtgattacactgtaaggtggatcctaaaacatgaggtcattatagggagacaccactctgtgccttggtgtgagtcccccactctctctaccagactttttactgtcttgtctttgcctttccattcagtcagggctgtcctggcaatggaaggcactgctgcgcaccctccttacactctggccattgagagtttggtgtgtaaaggacagcagggatttacaatcccacagacacagagtttgaattggaactttcctctaatgtcagcaggctgagctccattatggacacatcccagagtccttacaagaggaagaatctggaagatgctggaatggcttggacttaaagagccttctaacctgactcactgttaacttcctgtgatggttaattttatacatccacttgacaaaatcatgggatgcccagatatctggctaaacattatttctggttgtgtccgtgagggtgtttctggattagcatttgagttgagaaaagcagatggcctccccagaatggatgggcagcatcccatcactaaggacccgaacagaacaaaaaggcagaggaactctgaattttccctccgcctgacctcttgagctgggacatcaatcctctcctgccctcagcactcctagttcttaggcctcagactctgactggaatgcacaccattggctctccagctcccaggccttcaaacggcatcagcagctttcgtatgactccagcttgcagatggcagattgtgggacttttcagcctccataaacgcaagaaccaatttctcataataaatttctattaatctatctatctgtgtatcgatcgattgaacaatccatccatccatccatccatccatccatccatccatccatccatccaaccatccgtccatccatccgtcctcctttcctttccatccatccatccatccatccatccatccatccacccacccctatcctattcctatctatccatctatccacctattcctcaatccatctatctttcctattggttctgtttctccagagagccttaacatactgctttagaaacctccatctcttccacatactgcagtctaccagttggatcttttgtaggcttcaaccctaacctctcacttcctgagttcagtgcctggaaaaacagcctcttgggtctaatcttttcttccgaagcaaggcccctgcaggcagctctcacccgggtttgccaggcttcatggcaggttcagttctacttttactatatctctaacccataagttctgctttccaagactttttctaaaattggggatcaagaagtgctggggctgaaagcctaacaaatatctaggaaggagaatctacttaacatggggaataggactttctgcatctctgtttttgaatagagattatctggagcctgtctaggttatctgctcatgctgaaaaaggcttctctaacacatgtattttctccacaaggcacatcatagccttcttgcacttaggaatactagacagcactatgcttggggggcattttaaacagtaagatcaccaacaaaaagcacaaaaatgtaaaaaccacggtactaaataggccatgaaaaggacatccttgttcatagcatgagagctgaaacaagaaggcagagcattgctctttcatccacagcagacagcaagagtgttgggtgagtcaaactttgttgctctgcaaatgtcgatgaagatcttaaaggcgtctggaatactgattttggggttacaaataagacttagcgagtgggcaaacagcaaagacagaaactgtgatgacactgtcatcacacactttgaatacaatgttttctgagtttgccgatttgtggactatcctgaatttgtgctcaatttttatctctctccaactgcttatgttttgcctctctctccatgtcaacagattacactctataagggaaaatggaaataaagatgcaggcgaaacttgaatatcggtgtgggttttgcatggcaaacactgacgccaaatttgcctctactctgaatgctcaagttgtgggagcgctactttaagatggaaatatgtgctctaagggaaataataaccagaataactttagttttaaaattatataccaagaggaaaaaaaatagtaaaaacccaactccttcttactaagtttttaaagaaacactcaaaaaagtaaaattaaacccccagagtataattcccattctaatgaccactgagcacgtcattgcttttggttgataaaataagcacatgttcttctctttacctcgaaaacttgaatgatttcaaagacaacaagtaggcagtaatttaaagtctttttttgtgagcttgccattctgctcttcgtggggatctttgtgatgggaaactgtaaatacagttttagaagtaaaagctttcatcttaatgactataggattagaaaaagataagaagctactataggaaaagtgggtgggctgggcacagtggcttacgcctgcaatcccagcactgggaggctgaggggggcggatcatttgaggtcgagaatttgagaccagcctggccaacatgttgaaagtgtgtctgctataaaaacaaacaaaacaaacaaacaaacgaacaaacaaaaccaacccccccacaaaaattagctggcatggtagcgcacacctgtaatcccagctacttgggaggctgaggcatgaggattgcttgaacctgagaggctgaggttgcagtgagcagagatcataccactgcactctaacctgggcaacagagtgagactctgtctcaaaaaaaaaaaaaaaaaagaaaaaagtggatggatattaccacatatttttaaataaaatttagcaatcctggtaattttgggttcttgattttaaacacaatatatttctgattataaaaatatttttctgatcataaaaatagatgtctttagaattaaaaaaacacataaacataaaaaggagataatttaaaaagcttataaaacatagaagaaaaactagccctaaatatttctgaaaaccaatataatgtcattttaaatggcacacagggcaataccaacatagatctctttgttcgaaagatagattttttctgtcttttaatttatctaaaaataaatcatggtgtatttttttccctccattctttacaggagtatgggtgttttatcttatcagatttccttcatggggaaaatgtatgtgacttagtcacccagccaggtgatggttgactacaggtggaccaaggaatgaaagttggcaagtttgggcactttttttatattcaattctcaggaaagagatacccaaaattatgtgtctctgctgaacaatacatacaattatgaccagcaataggagttgtggaggccatagctctggggttcaaaatgatcctgaaataaagtattagaaaccctctcatttctttctaatattggaaaagtcacatgtcttttaaaattaacaaccacattatcatgagcaattctaattttccccaatgtaatcatcacgaaaacatttgtgattgacaggttttctaccccagatgtaaatttttggaaatactaatatacaattacttttcataatgggtgcacagctactaaatgatgtatggccaattcccaaagtttcaaatggataaatattagtctaatgtgctcaatcaatgcagagaaatagctctaagcccttttcctgcaagggaaaatatttaccgtatatcacagatagattggccacaggcactaagcagtgatggagaagcctagaaatccttgtaaatgtccttgtacttcagtgaaggacatcctcaaaagacagaaaggaaaaagaaaagaaaactctgaatggtgttacctcaagcattctctaaaacacagcacttagaatcagacctgcatcagcacgttgctgcttgacacacgaaagcccctttgcatttaacaacaacacaacaaaggttacagagaacttttgatatccttcatttaccagattatttcttccatccatagtttacagcactgaattagagattgttaatagtaataataataagaaaaaaagattttgaccatggactatgatgtaacccatcatagtggatcaactgtatactgagtctgactagaaaaaaatcaaaacagtaaaataccaatcagatgcacttcacataatgttgtccttttaaattttgaattgtggtacaatatacataacgtaaataccctttggggtttttttttaagcaattaggcacacagtgtgcaatttataactgctatgaaataaccctacccctctttatttgggcaaaggtcactatggattttttttttaatttttaactgtagaaaaggatggaatttcccacctttccttaaataagaaattccagacaatcacatcatgtccattacatcccaatactcggttttgactaagaactggatgcacatctatctaactgtccaaatccctttttggattctcaaatagtgaatcttcttggaatcagtggttaaagttcccactttttcacctggaccgtatgggtgacagactccctgtttgctaacatgaggatgacagttacagatttcaatgcaaactaaggaagaattctcagctgagttgtgctgtgtagaaaacagaattggcagctttgtgaagtgggggctcccagtacttagaagtcccgaactgtggcttgacactcactgcgggatcagaatctcctggtgggcattcactaaactcagatgcccagacctcatcattaattgtcctcggtgggacccaggcatcggcatttcttaaaaacctccccaggcaattccaatctacattgaagcctgccaatccctgtgtagtcacaggctacaggctcccaggtcaacccaggtggcctctgacatccctaccagccccaggactgtggactaggacacggttttgcctaatgactgattatatcctgccttggttaagggcaatagaattgagaagattagcactgcccccaactggctacaaaaggaatggaaaagctcaaaggaagaaccatggaggtagaatataccgggagccaagaaaattgttttcaactacctgaaatgagagaggttcctctataatgatgaacaaatgacagagaaagcagttttgatctaataatgtccagtccaggggtaaatggggttcttccgctcctaacacttttgttgctctttgcccacttcttggtgtactagtaaccaccctattgggcactcagtgtcttcccaaatccacatgtgttctcagcaaaggcctgatctcagttatttacaccagcaaagtgaatgcaagtttacctggtaacctcactcaaaagtgttgcattttgagccttaactccacaaaatgaagagtctgaaccattttgaaaggaacctaaagacaactgagaaggcaaggacatctttgtagagcagaagtcttttcctgtaagtctgagatctttccatagaagcggctgctagagggaaagatgagagacagggtgaggattaatggggacaaaaccctggaagagaaagttggaaacggtacagtcaatcatgagagcacaggacatttacagagaaaagagtgaggaggtgtttttcaattccataaaatagaaaataggaagagtgagcttagatcatagcgtgatcaattttaagcaaatagacgatgagaaatacttttctgattacatagtggactgggtggcggacagaggctgaagaagtgtttaaaaacaggccatgcattctcatatctgcatagaacatccaagcattacatacgtctctcattattccaaagcattacatacatctctccttagaagagcgatgaagctataggacacaagacccagtccaggatacagcatgaaagagaagatattaaatagctagcagagagtcagatgacaatcagtagataaaaagggcttggaaatggtaagcattatagaattttggaaaaccatttttttcccatagttaagagaccccattcttcaaggccttgatcctgaataaatgtcctttcagggttgacaccctatttttatgacttaaaatatttggacgggatatttggaagtttctaaactctgctgaactaaaatctgctgaacaaataaagggaagaactctgttttgtaccatgtaatttacttaaatgccccactacagtgtaaaagtagactagaccattcacttcatgccctcaggttttcaacatgccagatgtccagttgaggaacgtatctaaatctaaggatattcctaaattcttctgcaaagtttcaaggctattggtaataacatatatttagtggtcaacttggaggctaacgttggtctttctatttctgtaacagcttgcacagtatcatgcaggcatacatgtgagtctagatgtagatctagacatatataacccaatcagtgcatttcaagtatctaattctaccctcttacaaagttttatttattgttaagattatttcagaagcaccatagataggaatatgtatgttaaatttagctaattcatgctattcacacaaatgcactactactttgtgattttattgtaaaaaatgatatttgcatgctcagtcagcctcagtactaagcatccaacttcccgatttgctgattttttgtaggtagaactgtgcatgactcagaaactaaagagaacatgtaagccctacattctttcattgaaatggtgattgcctggatcacatgcacagagccagtattcattgcacataatgtagcttccctgttctcagtgttccctggatctggcagcacctcagggtcatttaaactacacaaacttttcaaggatcctgcactttctgtctgtgtggctccgtgtgaagtagcctgttagtcccttagcagcaaagtatgagtggatcataatatagtatctgaaataaggaaactataagtgattctccacttgggatgacacctttcttgaaactcatcctctggtaatgtggaatttgaagagctgatatttgtaatctctaacttttaggagagaaggaaagacaatgatatcatggaatgcacacattataatatttgctgtgaattacgtgcttcctatgaaaagctacaaagatgaaggcatctctttctctatgtagcaactgtgctctagcaggctgttgcttcagtaagagcactctttactcacagcccctgtacaacctgggctcctacaataaaatattccaaatgtaagcttgccctctcataaagtccaacaaattcagtctctagtctcaacgttctttatctttgttgttggttaatttgctcctctgaactgatagtatgtaaaacagtattctttctctccccaggactgaatagcagaattagaatgtctccctgcctctcttctctaatcttgtaagccattggtaagttcaatatctgtttcaaacacattgtcattgaccattatccaggaaaactcaattcaccatgacctttaagttgaaaatactctttaattaaacatcaaggagggacaattactgaaaatcaatccctggcattttctaattgtggaacaattttttaaatgtcagggtccatgttcatgtaggccattttacatttttatttttcatttttattagttttccctcaattctgtatttatagattcattactcccaacaattacccttataaaaggttccaagtgtttcttttcatgtcttggattaatgggccataatttcacacctaacactttagtaaagaaacatgcttacttataaaacatacaacatgggtcaaaatccaacaaaagcttctaatatgagactaattaaattaaattgtgattagattgaaggagtgaatcaattaaataacaatggcctaaacttcaagttacacttaaagatctatatatttaaaatgtcaacaacatgcaaaaaaaatcacaccaaatacaaatatgcagacaggctacatgtagccagaaggatatagtaggataatgggccttacagatcaacaaattggagaatttacaatggagaaaataacaccaacacataaaaatactatacaagtcaagcaaaggtaaattattcatccattgaaacaaatatttattcaggataatgcctagagtctaaatttgtctaagaaaccacagtagttagaataaatcctaatttggagaaattgatcaactgattctaaagtttatgtggaagggcaaatgacttagaatatgtaaactgtttttttaaaaggacaaatctgaacaactaacactatctgcttttaagacttattagaaatgtacaattatcagaataatgtggtattggtacaaacagaatagatcaagacaaaaggatagagagttcatagatagaacctcacatatatggacaattgattttttgacagaagtacaaaggcaattctgtcaggagaaaacagtatatttaacaagtaatgctaacataatttgatattcatatgcaaataaactttgattcccactgatttgcacaaaatgaataatagatataaaggtaaaacactaaactataaaagttctagcagaaaacagaagagaaaagcatgatccataaaagaacaaactgacaaactggacttcatcaaagtgaaaagatctgctctttgaaagacactattaaaagactgaaacagcaacctttaccttgggagaaaatattttcatgtatctgataaaggacatgtaactagagtatagaaatcactctaaaaactcaataataaaagtgtaattaagtagtggcaaaagagttgaatggatgcctcacaaaagaagatacaagggtggcaaatgagcacatgaaaagaggctcaacatcgttagtcattaagagaatgcaaattaaaaccacacctattagaataaaaccaaaatttaaaacatgaagcatatcaagtgttgagaatgaggtggaggaaatggaaccctgattcactgctagtgggaaggtacaatggtacaaccactttggaaaatagaaacatacactatccaaatggcccagttattccactcctaagtatttacccaatagaaattaaaccatatgttcataaagttgtaaatagtcataacagttttatttttaatagttccaaagtggaatgacccaaacgtccaccaacaggtaaacggataacaaactgtgaaatgtctccaaaagaatgaataaaaaggaatgaactattccattgataagttacaacatggataaccttaatataatctataatctcaataccgtgtatctcaatataattaggctgagtataaaaagccagacctaataagagtacaggttgtattattctatttatataataaaaatttcaggaaatgcaaagtaatctgcattgacaacaagcacagtggttgcctatggatggggaaagacagggttgtgtcagaggaagggattacaaaggatgaggaaactcttgggggtgatagagaagttcaccgtcctgatggtgagggtggtttcaccgatgtgtacatacaacaacatgtatcagactgtacactttcaacatgtgcagttacttcaactatttccaaattacataatcctttgtttttccctcctgtccattatctacaactttgaattggttggagagctttagaagcctttgttggacactattagtggcctgcagggtctgcagtcatgggtatttctaatcttccttgacctgctttgtcttcctttggttcccacctttgttgctgttataagccctttaatcactgcactactagatgccatctagtaggacaccatgttccccatctttgaacatcttttccatcttcttttccaattgcagtgcctgtttggccctcgtttacctccccagctctccttggctatactaattcctcttaattccttcaacataccctacttcaccttgatttggggtcttcttattagaagttctctatttctggaaaactttccttctaacctctttgatcctggctaattcctacttattctttaggcctcagctgcatgttgttttcttgggaaagtccaattatttctcccaccaaagtttggcttcagtggccctgatagaagaccctgaacttcccatcagcacttctccactcaattacattgccctgtttacttaccagtattcctccagggcacagggtcacctcaattcagatctgattagggacctgatgtatatcaggtaatggggttagctgttggaggctacaacttccccatttcctggagtaaatttaaggatatgtccaactaaaaccaaaccaaacatttgtttcctgcctgtgagcacaacataagaaattcaaactaggtgaccaactgtcttattaaacttccatttgtaccaaaagcaacttcttactgagaggacattttggtcctgagaaattcttccctgtagtgttttaggataaggacatttggaatttgaaattgcagtctactgtgtcattttctcaaacctggtcttattacactctagccaaagaaatatgaaatgaagatctgatccaatttgggacccccaaaaggaattgtaatgaaggttatatttcaaattatgtaggctggttacatggtcagtatgtagcagctgactgcctggtgttttattttgtttgtctgtatagatatagcatatctaagaaagacaacttcattttatagagttagaaaaacaacccttgagatttattaggaaagtcttgtgccagtccatcattcctgtaaatatacacgttgatcactaaatggtaagaaaggtgataggaactgaaataaccaaagtaggaaaatgtcacaacaaactcttcttgatcttctgcctgtccctgtacttggctcactgtgcaggaaagagttcttccttgggttaaacaggagcatgctcagcctgaagcagagatgatatgcctttcaattttgaaacacagtttccattgtgtgtgacccattatgtgtgacctcatttgtgggtgattaaaatgtgagtgattagaatgtgatgtcctcatagttactctctcactccctttgaatttcttggaataagtaaaacaataatgtaaaatgaaagttgctgattttttatacctcagatatgaattgctgataaacattttatttagggcacaaccaattcatataaatttaaaagtaaccataagaaatggatttttcagttacatcatctgtagtttttacatttaacctattacaaaataataaatcattgaaccatattcttttcagtgtcataatcaatgccagacaatcaattaaaaatttaggcatatgtattaactagtatagatcaatgtggcttgaatacacaaaatacgtccaaattctgtccaaggtaaataattatgatgctacatggttgttgtgtatatatttcacataaatttagaaattagtatttcaagagacattacaagtcattatgttcattctacgtctcaaacatattatgggaacagaaatacctttatttataaatagcatgtatcccaaaaaaatctatgggaatttgaatggcgggcatccagaaacttcatgtggtcgccagtgggaagtatatttttgacaagccgcatacacttagggccagccacggaagtagtgccaaaccaatgatgctactgcacttttacttagcttattgtgatttattgcaacagttaattctggctttctgtttcagaatgatctagtcatctatatttataatcattttaaatgaatatgtatttcatgttttcagttattcatgatcccttaaaaaatataaatgccttactgctagacacataagaagattaggttctataatagtaaaaatgccatcggaagatgagagaagagaaattctaccaaaattaggtaaaaagataaatttttaggacttcaaaaataaatgcaaggtggaagcaacaagccaagtgttcactgatgaatgactggatctgcagcagcccatccatacaatggaatactgtccagccttgaaaagagggaaattctgacccagcctatgacacaaatggaccttaaagactatgctaagtgaaataagccagtcaccaaaggtcaaataggtatgattgtatgattccacctatataaggtccttggagtagtcaaatgcatagaggaagaaagtaggatggtgaccatgagagaatggggggagggggaggagaggggaattggtgtctaatgggtactgagtgtcagtctgggaagatggaaaatgttctagagatgggtggtggtgatggttgccaacaatgtgaatttactcagtgccactgaactgtacatttgaagtggttaaaatggtaattttaggctatgtatattttaccacaataaaacaataattagaagatataagtgtaaaatgtaaaacatgtaaaagtgttaaaagaaaacacaggagaaaaatcttcatgacctggagttaggcaaataattctgaggcctgataccaaaagcatgagccatagaaataatttgataaattgtattttattataataaaccaattttgatctgcaagaggcactattaaaagaattaaaagactaactgtaggctggaagaaaatatgtacaaatcatgtacctaccaaagaatttaaatatataaacaatgaaaacctctgaagattcaacagtaaaaaaaaaaaaaaaagaaaacaatttaaaaatggataaaaagcaggaggatagcttgaggacaggagtttgagaccagccttggcaaactagtgagacctattgctacaaaaataatttttaaaaaattagccaggcatggtagcacctgtaattctagttacatgggaggctgaggcaggaggatttcttgagcctaggagtttgaggctacagtgagccatgatcactccagccagggcaatggacagagcaagaccttgtctctaacaaacaaaaaacaaacaaaggataaaacagacattttgccaaaggagatatataaatggcaaataagcccatggaaagacaatcaacatcactagtcattagtgaaacataagttaaagtcctgaccaggtatcactacatgcccattagaatggataaaataaaggccagataacaccagggctggcaaagatgcagagcactaaagactccaaatgacaagattgtatacatagaaaatccaaaatcatacaaagcattagagtgattccctgacagccacacgattcccacctcacctctgccaggcttagctctcatgttgacttttcagggaaatctccaaccaccaccttgtttaataaacattgtaatgcctctccaatccattctctcaatcctaggtactttatctcccctctacaaccttagcatatgaaactaaagtcctatttacataatttgtatgtgtctagtcagtttctaccagctggaatgtaaaccacatgaggacacacatctctctctctctctctctctttttttttttttttttttttttttttttttttttttacagagtcttgctctgtcactcaggctagagtgcagtggcacaatctcagctcactgcaacctccaccttccaggttcaagtgaatctgctgcctcagcctcccacgaatctaggattacaggcatgcaccaccacacctggctaatttttgtgtttttagttaagacagggtttcaccatgttggccaggctggtcttgagctcctggcctcaagtgatccaccagccttggcctcccaaagtgctgggattgcaggtgttagccaccacgcccggccgaggacatgcatctttgtttagttcagggatggaaagcagagcctgtgtggcatctagaagacggaacactcccagtacatacttgctgagtgcatgaaggcagtctcaggttgtattctctccagctgttggactattttccccccatgaatcagactaaaataccccaccactggtttggtcatccgctcagctaactaacctaatttcccctcatactctgactcgtgctgccatctttcgtcagtttacctgtgttctctacttaaacctcaccttagattttatccactccctgaaaattagctttcttggtttttcttctttatctcacccgctgaatctggttactctgggattcgtttcgtgccctttttacagtcttgtcccacaggtctcatctaaatcaagggctttacaaactgtcaaatataagcagaaaatctgcacacccaggtcctccggttccccacctaggttagagctgcctcatggtcatctccctgagcctgtgcagtaccacaccaagcccaaaagtgcctcatccggtcatttctgaccagtcctctggtctgacttcccgactgtatccctttctctgtatccaaatgattcttcccatcacccagggctcaaacgttgcaatgatctatgcttcctcctccatcatacttcacatctgctcagctataaagagggttgttcagggtccctcagcagtaccacgtttctcagttacatatgtgctttagaatctacaggggacttttcaaagaatgtggatgattgggctccatcccaaatatcctgatttaattggtttggggttgagaataggcactggcgtttcttaaaggttctctgggtgatgccagcatgcaacacaggatggaattcactggtgatgactatgagctttggagtcatgcatccccttatccaaattattgtgggcatgactgtttgatatgctggagcctcagatcctcaactatatatagaggctcctcgacttacaatgggattacctcccaataagcccattgtaacttgaaaatatcataagtcaaaaatgcgtttaatacacctaacccaccgaacatcacagcttagcctagcctaccttaaatgtgctcagaacacttactctgccttgaagttgggcaaaacaatctgacatgaaacaagttttataataacgtgttgattatcttatgcaatttattgaatactgtacaaaaagtgaaaaacaaggttggattggtacttgaagtatggtttcaaccattgtgtatcacttttgcaccatcataaagtcaaataatcatatattggggactgtctgtgtagggattctaacatcagcctcaaagggttactatgtagattaatagagataaatatttgaaatttctaatgataaacggtaggtccttgatatataataattctctgtctcttcagttttcccatctgtaaaatgggaataaaagtactaagttcactggctgcattgaatgaaagtaaagttcccagtgaggcacctgtccctaactataccgtaccaagctaaagggacagatggaagacgctttaccaggttagacaaaggtttctttgtaaaccttgcttctttgtccattctcattctctgcatttctgtggttctactggtgcatacccctatgttgttgtaccttcttagcttctactccattgtcagattcacattactaatgcagagctccaaccgtgtcattattaaaactcttcaatggctcttcactgaccaccacactaatcatatgctcctcctgctgtcactggaatggaacaaatcagtccttctagccttgcttccagtagccccactctttcccctgcataccagataatgtggcccttcgctgttccacacattgcagcccactttcattcccctcctttccccccacatcctcaattctacctaacaaatctctacccatttcgattcatcctgtcctaatgcactcaacatcaactggatgctgtcatggctttcacgggatccctgggggatatcatctgaagaagccccacagaccaattcacacctctgtgccctctctcaccagcatagctttgcccatgcaagatcccacccgcttttcaggacctagctcaggagtcacctttctgaaggaaactgtcgctgactggcctcagtgggtcttgtgcccaccaaggtgctcccataacaccccgggttcacgcctctcaaaatgcatctcggacacactgtcaagctttgcttcactgtcatttgcttcttgacagcagcaagggtgccttactcatctgttctaggatgcaactggcacgcaggaaggaatcgataaacgaaagacaaggagagaaaagcagcattggaacctgtgcttgcagtattccaggtgactttttttttacagtctctctctgtcacgcaggctggagtgcggtggcgcaatctcggttgaagcaattctcctgtctcagcctcctgaggagctgggattacaggcgtgtaccaccacacacagctaatttttgtatttttagtagggatggggttttgccatgttggccaggctggtctcgaactcctggcctcaggtgatctaaccgcctcggcctcctaaagtgctgggattacaggcgtgagccaccacacccggactgactcatttattctgttcttaaacattaaagaaatattaaacagccagaaagagaaatttttaatgctgtttaacaataattaggaaaggcaagaaaactgtatttttaggaaaagcgatatcgaaaaactttatagaatttttcatggtccaaattctgatagtcacatatttctcataaagctttcaatttttcctgtctcattgtcggttttatacatgtgtttggtagatttgaagcaatgctagttcagtttaaaaaatattgacttcaacattatagctaatttccaaggggatattataccatctagttaaaaataacccttggaaatgtggttacttgtgttatttacacattttaatgttagcaataaaatggaaggttggttacatttaatgaatctgtacagttataagagaaagacagagattaattctgagtaggtcgttgctgctataatcaatagagtacatcataattgtgcgttgaggaaacgccggtatgctaaggcaaaagaacaatagtcatcaaatgagtggtcccttgggagttaatgaagaatctctttctccaataggaaagaaatgctttctaaaatttataataccatatggacacccacacatatggatggctcataaatgctctacatcaaagtgttatttttacattttcgacacaacaaacacactaaacaggtgttttaaatgtcacactttgaacagcagtaatttaatcagcataaaaaattcttagtagtatcattgaaatattagtgggatagagatgttttatttgggatatgcttcaactatatattcaaaggcagttttcgattttaacaaatttaatttttgtactctaagatcagactttccaattcagtgctctaattcctgtgcaatttgacagcagaccagtcctcatcctacacctccgtcactgcctgctgctttttttatccaggcaaggaagcttcctagggcttcaaacatacaatgaatccaaaaggactctgttggttactggctcttaacatttatagattagaaattctccttaataatgcccttctctgaaagtctaaaaatgatctaaatattcaaaaacaagaaaatgactatctcaaaactcacatttcatttttggagtatgttgccctcatttaatgatataatagttttagtgtctagaatcatacctagcatctggaattaagtgtctgattctaactatgaatatgattcttctcaataatataaaaaattataatgatagaattagtgaatactaagtttagtgagaagaccagaatatgaaattgtgcatacggcattgaaacactatgtttttagaagcttgtgaattttttaaaaaatccttaaaaatgactgtctgatggttgaacttagggaacatttattttataatgtctactctagtgtttcaataattttcttttatggaattataaaactttaatgtgaatttaaacatccaaaatattgtaaatattactactctttctctttgcattttaccactgccccaattacctttttcttttctttaaggttctgtagatttggttgatttcagaaaaaaaaaaaaaaaaaggagaaacattatagaaaattggaggattctgtgtatgggggggaggtatttctggacttagtgacattgcaacaggaacgtcattcacttaaccgttctttcaacagatacttactatattttcaaaataattaaacaagcaacagtaacagctagtatataaagagctccttctatgttctgcattttatgccctagattatctcatatatcattagagcaactttgtgaggaaaatattaattttattataaaagagaaaatcaagcctagaacgatgcagcgacgtgccccaggttgcctgtaagcagtggagctggtttctagagcccacatggctacgaataatgttgcccgatgcaacgagggaagctggaaatcccaggtgaagaaaacccagtctctgtcctcaagaaagtgaagaatctaagcaaagctttgcagcaacacttttagtgaaggaaaggttacacatctgtgctgtacagcatgacagccactagccacctatgacaactgagcacttgaaacgtgaattttaaattgtgtttaattttaattaatttctacttaactttaaagagttaaatatgactagtggataaatgattggacatcttagttttaaaggttgaggaagatataaagaggcatttataaaacactgcaggagctaatatgttttaaaaataaaatagtaatccaaatactcttgggaaaggagatctctgctacaattgcaatgtatatatgctgctttctgagaataatttaaagtttctcacttcaactgaaaatacaattttaattactttaaatgaaaataactggcattcaacttgttagatggcatatatttttatttctactctaacatgaatttatcagactcaattaattttatatgattgtgcatgagagctcttttttcagagaaaaagtagaaacatttcttgcttttctctcataacacatactttgtaaagtaccaaagtctgaacaaataattcacgtggaaattttgatattaatttaacctctaggagtacaattctaacctttgttctaagcatacaaatactacattttgaaagaagaattgtgggccaactgggtatgtatttagtttggttaatagcagatcatgagactcaataatctgaataaagagcagagactgttaaaagccaaacacttcacctgttatttccctttatttattgtatttgatttgctgtctccattaaatctcaaatcccaaataacctcagagtttccatgtattaagctttaagcattatataagaattctatatgtaaaacatctaagacaaagtttaaggatgaataaaattaccccaaaacatacaaattaccaagataccttaaatgtctttggaatatagcacaatataaataaatatttttgtagaaacgcaaatatattagaaaagttattcctcataagcaaaattatcactcttcctcaacagtcagtgcttcatggagatttcagtgagctttctgggtgaacttctaattaaatggcttccatgattaagtgtaactcagctcagaaaattggtatttgcatatatttgacaaccaaaaatgacaagcattggaataattccaattaaaaaaaaaaacctacagaaaagagagggaaaaattccccatgaagctttgtcaattgttcaattccttcatccttaaaaaaaaagaacctagataatcttatgtcatccttaaaacaatagctatatagatggtccctgacttactatggtatgcctcaggatggttcagccttatgatggtgtaatgctttcagcacgctcattcacttcccatggggttacatccacgtaaacccgtcctaagttgaaaataccatttgtgacttaatgatattttcaatttaggatgggtttactggaacatgacaccatcataagtcaaggagtatctgttgtatgttttttcttcttcttcttcttcatatcctcagttttaagctaagaacataggcatggagtgtgtgcatatctgtgtgcatgtgtatatgactgctcactgttctacaggcatttaaacatcataagaatgatttgatgatccagtcttctgttagaggtctagacatattccacttctacacttctagagaactgttctaggccatctgccaacaagccaaagctagctgctcaccaccgggctctgtccgcaggagtcacagcaagaaataagacattttcttgcttcttgaatcttgaatgtgcctgcctgcttaacttccttccttcttttctttcttccttccttccctccctccctctttccttccttccttccccctttccttcttcccttcccttccctttccttccttccttccttctctccctccctttccttcctcctccctttccttccttcctcaccccttccttccttccttccccactccctccctcccttctccctcctaccctcttttcccctttccttcctttcttccatttgattgtagacatggagaaaggatatttcttattcccgttgatctgaaagacaaactagataagaaatctaaaaacctatcttttcagacacttaaaaaaataggcacaaggagaggggtcatatcatctgatcattttcattatgtatcattgtttgggttgaaaaacatgaaaagcattccaaggacaaaagacattacaggtctggttcctgcctttgatagttttactgttagaatggaagaaagggaaatacatataacgatgagaaagcagcacgatggtaatgcaaatggaggaagcattgttactacagtaaaaatacacactgatgcatgtatacattatacatgaattaatacatatagaaaggtacatatatgcattgtatgtctatgactgtgtgtatacagaatgtgtcagaagagaagtcgtcatatgtggaaaagaggtttaactgcttcagaattcaagatttgtctaaatttgaataataataaatacatttagattggcagaaaggagaaatttagaagaacaaagttgagaggagtgatggttaatactgagtgttaatttgattggattgaaggatgcaaagtatttttcctgggtgtttctgtgagggtgttgccaaaggagattaacatttgagtcagtgagctgggagaagcagacaccctcaacctgggtgggcaccatctaatcagctgccagcacagctagaataaggcagcagcagaagatggaaagagcagactggctgagtcttccagccttcatctttctcccatgctggatgccttttgccctcaaacatcaggctcctagttcttcagcttttgactcttggacttaaaccagtggtttgccaggggctattgggccttcagccacagactgaaggttgcactatcggctttcctacttttgaggttttgggacttggcctgatcaccactggcttttttgctcctcaacttgcagaaggcctaccgtgggactttatcttgtgatcatgtgagtcaattatctttaataaactccctttcatatatacaacacctatcctattagttctgtccctctagagaaccctgactaatacatgaggtgaggtaacaactcagttagcattatggtaacagagaccagatattgaaagtgggaaatcacttgggagaatattcaaatgtgggcctcaagtaaatgaatttcacataacaagcagtaatggagtcactactgacacttaaaatggcttaaagttaggttattagcaaataggttattctaatagaaacaatggggtcaactggatgaaatgtgggcaggaagctgggttaggatgttgctatactgactctgtaacacataaggatacattccgtatcttagctcttaatactcctcaaagaacatctatgacacctttccatccagtattagaatccattttacgatacttctgaaactagtccattcagactctcaaaaaaaccttccaatacctgggagcttatgatttctctaggagtctcattccatttttcaatagcactaattctaaaatttgtttttattttgaatataaatctgttccttattaaatttacttccatatggatctaagttcttctgtaagaaacaacacagatgaactctactctctttttcacttgataggactcaaatatctaaaaacatatacgtatataaatgtcatgactatctcacagattctccccaatctccaccatatctgttctggaataaggaaaacaaaaacaaaaacaaaaacaaactgtttttgtccttgcactcagacactcaacacagaacacttctatgaccagatggtggtgggggggacttgccacatataccaagcagttctccagtggacaccaactgggtatcctataattcaactcgattctgattctacctacctggaaatagcatcagatcccacagattgagggctcagccccacaagactagagacctcaatcacaagttggggccacctgtacctcagaccgatgggctacaaaccaaggttcccacaatttcctcaatgggtaagattaatttgctggaacagttcacagaactcacagaactcatgaaaacacttatatttattggtttattctaaggcattataaaggatgctgatgaacaccagacgaagagatgaatagggtgaggtggggggatgcagcttccatgcccttgctggagctgccacccttgcagcatctctacatgttcagtaccccagaagctcatcaaatcttgttgttcaagagtttatagggagcttggtctctagtacccccttcccagaggtcaatgggtggggctgaaagttccagccctctaatcttcaaattacttggtctttctgggccaatctggaggctctctagggggtgcaccctgagtaaatgcattagcataaacataagagttatccaaggggctaattatgaataacaaaatatactactatcactccaaaatttccagaggtttttaggacctctatgacagtaactggggacaaagaccaaatatagttcctattacaccacagctcttcttcagactagactcacacatttttcaactgttccttgtacgacctcactgtccatcactctggctcatactcacttgttcacatttatgctgctctaaaaagggtgctccaggtttgtaacaccgtggtatggtttgactctgtccccacccaaatctcatcttgaattgtagctccataatccccacctgctgtaggaggaacctggcgggaggtaattgaatcatggggccgggtttttgccatgctgttctcgtgggagtgaataagtctcatgagatctgatggttctataaagggcagttcccctgcacacgctctcttgcctgtcaccatgaaagatatgtctttgctcctccttccccttctgccatgattgtgaggcctccccagccatgtggaactgtcagtccattaaacttctttttctttataaattatccagcctcaggtatgtctttattggcaacgtgagaacgacggatacacacggtgattcacagtggcttgatctgagcaaaatacactgtaattcaatattagcaatagatgacaagcaactatggccatggtgaatctcagatgctgaaaagaggggaagaaagagagccccagccctcaccataaggcttagaagggagtgctatggtttgaatgtgtcccctccaaaaatcaggtgttgccaatgcagtattattaagaaatggcttctttaagatgtgattaggccacgagggctcctcccccatgaatgggatttagatacttataaaagaggctttactccgcattaggctctcttgccttttgccatgtgaagacacagcaaggaggtgtcatcgtgcaagcagagagcagccctcaccagacaccagtgctgaagtctttatcttggacttcccggcctccagagctcagggtgataaatttctgttctttataaatgacccagtctgtggcattttgttgtagcagcacaaacagactaagacagggagtgtccatgtactccatgtaaaacactttttttaaatggccatttaagaccgtaaacacagaaaagagaaaaacaaagacaactttctcatttactttcacacttacaaaacagttctcaaatgaacacacagagattagtgaatgcattatgaaagaatgaagatggtaagacacttgttcttattcccaggacagaaccggtgagagatgtgttcgcttttgttccccaccgccaccccacaaagacacatatcagtgtttacttccttgaaattggcattttcaggattggaatatccccacaataaacttccagatgcctgcacatctttcaaatacggcatcttaaggatgccatatttgaacggtattcttaccattatccttcccgcctgcttcctaaaacactttcataaccagagataataacattcctcgtctacaaggcagctgcatgccaaagacacaagcagctgcacctccgctcagtccacattgctgggtttttataacgaaaatgtgcacattagacttttttatggttttgccttcctggaggcggagtagctctgaggtccatcattcactgatattagaaggctgcctgtggtaacacagaacccaatgtagcagataacaaaaggcaaatataatttgaatcagagaatggcaggactggaagactcaacagaaaaaatcccgttgtcttcctgactttcggtgatgatctgaattacctctgaatatctggaacgccatagcagccttttcttggtggtgggattatgcgtatttcttagttctcttatttttgtttatctgtatgttatttttactcagtgaatatgtatccctcttcaagacaaatatatgtgttcattaaaaataaaggagattaggttagtcatgatagttttatgttcatttaaagatgtgtcctcctaacagcttttatagatttagggtggctggctagttctaaataaaaactgacattgttccttcttaaacatgcggtgaaaactagaggttcaccactgttgcccaggccccagtttccatccagttgagttaggatgttgctcagttaaatctcagctgacagaggacgttacatagccagctgtggctgagaggatccagtgtttctagagctgatgcagaaccccagtcactggggggaatgacgggaagcttctcagtcctcacaagctcccctaccatccactaggaccctctgctctgctgtttgccagagcagtagctctcagggactccacaccagcaccatcagcaacatctatgaatttgttagaaactcaaattatgatactccaccctagacagactgggtgagaagcgctggggtggggccctgtgatctatatttaacaagctcttctggggaattggatctggtttagcgacacagccaccatgctgtgctgggcccatcttaccgactcctctcctgaatccccccagagctcctctaagcaccactgtgtctccagttcctggtcaaatagaatacagaggagactgggttaatttgatgctcacagcaaccttgtatctgatgctcttttcatattattgctgttggagtaatattctattgccagatgtcagtgctgataaagaattcagaaatgaggaggaactagaggcattttctgggcctctgctgtttctctttatttccaacatgccactggcatgaaatatagctggctgcattgaaagtagcagtgcttttttccccctaaatgtatagaaatctgttttccttatgcgtgggtggcaatttgctgctggtagcttcaaaaccatggctgcactatgaacaaaaaaaatgctcttaccgtctcagccctgttaacctctttctcccaaacaaacaaataaacctaaacgctatgtctaagcccatctgtcaacaggcatttactgagtacctattgtgtttaagggattttatgtgcaaggtgtctcaagagggggggaaaagaaacaaaggctatgtacttaagatattttcactgaggttgggcagacaaggcttgagaacaattatcaggaaatctattagaccaacaatggtgaaacaaaacagtgccaagtggacgctggaaggcagcggcaatgcagtgggggcagcgtgggaggtgaagtggcccccaaggtggcatggccagagcagaatgtgatgagagaccaggcggctgggaagaggccttcagcttagaaacaataagcaacagggaaccacttggagttcttgagcgagggaaagacaagatgagcctggtaaccataattagagaagcatcacactgaagtgtgggctggttatcggagggtaacacgggcatgtgttctaattgctgtgtgcagagcatgtcatgtaggctgggctggccaacacccagctgtcagaggtcttatgttctactagggacagatgtgaaacaaccatggcaagaaacacacaggatgtgttagtccatttgtggtcctgtaacaggctaactgagatggataatttataaagaacagacatttctttcttacagttctagactgggaagtccaacatcgagaggaggccatccagtgcgggccttcttgctgtaccagcccatgatggaatgcggacgggcaagaggactgagaatggcatgaatcccccttcacctcccaaaggtcccacccacctcccaacactggtgcatttccacacttgaactttgaggagcacattcaaaccatagcacaggataactttacaccataataagtgctgtgaagacactagaacaccatgagagagtcaaagggtgggggtcctgcttcaagacacatctgtgttctgacatcgcaccaagggctggtctgtctacgagactgtggggagcaggaatatgaggaggaagaagcagattgcggagatggtggggcggtagagggaaatgtcttccggtgttcctaattcgtgaatactttgattcttattcatatcttctggtcagcaaatcaatattagtatttgtatcaatcataacatctcacatttgaattatactttgtagtagccatgataactctgtgaagtagacacagaaactctttacacaagaccttctaagagaggaagggggtgcctgtgtgtcacgcccgcgaggggtgggacttggatcctgcctgagagttttggcccaggcccgcttccatcccgctgtgctcatgcaggcagctttccccttccatggtgagtggagcctgctcaggtcctcagtgtcattgtgcatgagagtgaagaggatgcccagagggaaaagcgctcagctgtgtgtgtttccagcaaaacagacgcatggcagaacgtggggagaaacacatcgaccagagctagctactacgtatcactaaaattgagccgttttataaatattttatattcatacaatgtgccttgcgatggttggaagatacatttttcaagatggtcttttttcactgcccttagttgagcctattaataattaaggtaactttcttaaatgagaaaacggatttgaaagccaggcaaagtgttgtgtactgggaagagaggtttcacacattctcaaggagcgtccatagcaatcaccaagaggcacctcaaaccctggcatccagggtgcaactgcaggaagactgagatgggcactaaacatcattcgcctaataattcccatatgactcagtttccctactgagactgatccagtgtggaggacatgggtgctacttctttatatcccacactagagagtgcatgtagaaggtaattgacaaatattctttggaggcatgaatgatggtgccttgggaaccaaggaaactagtcaatgaaaaaaataaatgagtccacccaatttcagggggctagagatgtgctgggcaaaggtgtggccttctcagggtcattctcattccctagggtgggcaccccgagagaaacagcccagtggcctcgggactatccctagcaggcacctgccagtaaggctgcacccataatagacaaaccctctgatggcctgatacctgttgtaaacaggttattagatattgtaaatatcactctttctggaaatgatgggtgcaactggcttttaaatcttcctcccgttcagtgactcaagaggtcttctatccttcaagtgtgttatcctgcagaaaaaaaatttaagaataactgctccagaacatcttctgagtctcatgattagagggccagtgaaggggctttagcggcatctcacaattatagataatctcatggagcaggctaattacattccaatcccttcactcataactaagactgttatcaataagcctgacattattgctgattacaaagactttcttatttgctcgctgtttaattactcagcttttaaatgttccttgaagaaaaactagaaaatggagataaacaaaataagaaaggggaaaaaaatcacccctcatcgcctagcgaagggtacggattgccaacattctcgagtctctccttccagagatttccctgttgtgctgacagtcttcattaatggagttttttttttttaagtatttttaagtatttctcaagagttgcaggagaaataaagaaagtaaagagagaagagaggaaggaaaaaggagaagagagggcaagcaaagtttcagaagactaccttgccaggcatctagtgtagggtgggcaaatgttttctgtgaaggaccagctaaccaacattacaggctttgtggggcttgcagtctctatagcaactacccaacaacacctttgtaccacaaaagctttcttgtctgcaacactgctttcagatatgtgactagggctatcatgtgtgattatggacatcatgatataatttaagtcatctctgtgtgcacatttaaaaatcaggaataaaatgaattgaatataatactatttagcctgtatctttcatagggtgtccctcttatataagtcttttgttctcctatcatgataagagaagctcatgtaatactgcctgatgacccttgctaatccaactcctgcgttcaagccatcctcctgccttagcctgctgagtacctgggactacagacatgcaccaccatgtatggctattttgttttttaaatattttgtagagacggtttctcgctatggtgcccaagctggtcttgaactcctggcctcaagcgatcctccagccttggcctcccaaagtgctgggattataggcataggccactgcacccagcccgctgttctaacccacttcactgagtccgtggctctgcagtctttctcgtgtaactccagttttgcctccccgtttgcactatgctccagttttccgtggttctgcttcctggtcttactaggattacagcacaacaaaccaacagagaaaaccattggattccactggaaagtcgaaaaaaataattaaggctaaagtataagaataatcacaagcctgaagtgctgccacctgataattattaaccatactaacaataataaaaaacattatcaacaattaaaaagttcaaaagagtagcagcagtcattaagagctaatcacccaccaggtatgacgtgaaggtcttcatgtgcattatctcatagcagccctaccacaggtaactactatctccctaccttatgcaggagggtaactcacagctggtacctggagaaatctgaacttatgcatcctgaattgggactcaatgctgtcaatcctcctgtgccccgacactgcagggtctgctctggaagcacatctggaggcaccgcaaactcatctgccccacatttcagagggcactgatgggcacaggtgggggggggcaggtgggcagaagaaagtcaccccctgcagagaggaggcctggcattcatctgagaaggggctctccatcctacagacaatgtgcaactgtcttcatcaataatattgaaggtttaaatgtacagtttcctaaccaggatgattaagaaaaatatctgtcatcaatgaaaatgccctttgctttcaaaatagaaaattctacaagaagttagtatattctcataggtacttttaaaactatttttttttttttaactatttttaagtcctgtatatttcttcattcatcctgcaaataaagatatcttgaccttacaaattagcaaatgttgttctcaatcagttctactccaaaagagtaaagagagattaagtgaaccttatcatttcagaagtatgcattacttcccgttcataatgcagacagactgtttttaattaaagcttttggacttaggctggattttctagaggaatatcatggaaaaactttcccaatggttggtaatcacatttgatatgaataagatgaaggtgcgacataacatccgatccatgggcagaggtccctcaagtttataaagtttgtcgtttgggaaagataaattgttattgttgttatttttaactaaacagaaaagtcaaattaaaatgtgattttgatccaactgtgtatgtataaaatgtataaaagtataaaataaagctgtcccttgaaatatgaccaactgatttgtaaaagtcaatttcattagaatatgcagaatagagagaacatttgagcatttttatttcaaaattcactttgctagtgcatttaggaccgatgtgagggtgggatacatagtttctctagcagggcagcatccctgccttgcccatggctttcctcgtgcctgcatctgctcaagggccagccctcctgactaaaaacggagatgccagatctacatagaggacactagagctttaaggctaagtagtgattatttacttcttgataaaataataaaaagtaataaaaaataaaatttaaaaaggcttctaaggccagttgtttatgcagtcccatcacaccagaaaacataaatggattttatggacgcacctgttcagggccctctttggtgggctctgggtcccccccgtgctggggctgcgtggatggcccgtcagccacgccacccaccgtgatctgctgccttcagagggctgctgcctccctgggtcatggtgtcacccctactcggtgaacagaaaaaagttcaaacacttaaaaatcactgctcccaaacacagttctgcttgggtaagtggcagattccatgtgaatctcagtttttacagattaagtggaactgtttgaccccagctttcaggtccggataaaatgagaagtttttgaaaaggggattagaaaaagaccttagaagcacttggtttggaagctaattttttccactcagactcacagggagggaatccattgaaagcaccaattactccttctttcatagtctgggaaactggcctctaaatctccgcctttactggtaagtcaggctcagcaaccctccttaggcttgagttaaacaccttaacacctgcctctgctcccaacatgcacacaaaccacaaccaaaccaaaaaactattttctgagtatatagaaaattcggggggaaaagcaggaaagcacaaatccccataatgcccccagcatacaaatatcataatatttttgtgtgcattgatttttacgtaactggattcataatgtatacattattttacaatatcattgtacttagtatatttcatattagtaaatacttatctacaagaagggttttggtagcacagagttctcctcctaacactgtattataatttagttagctcagcacctgttgttgaactctgacttgtttccactttgtcacagctataagcaacgctctacagaacaatgaacataaccctggctacatatctggtaattttcttaggataaatttctaacagtctattttctggtccaaacgtgtaaacattttcaatattttgatatatcagcaaatttctgccccacgaagttgatccaatttatactcctgtcagtattttttgtgattccatgaatccagggcaaaatggaacattgaatgcatttaaaaatattttataatgagataaaaatggtgttttattcttcttttaatttgacattaatttgtctatgcctcttatttaaggaattgtttggtcttgcatttttacaatttttctttaaaaattctctaagaagtttttctttttgaggtcattgggttttctctcctgactttaacctttaaagatttccctctacttttagctcttgaaacatctcccttagacctttaagttctcccattctcctaaaaagagtcctcatttaggagttaaacagtgcacgctggctgggcacggtggctcatgcctgtaatcccagcactttgggaggccaaggcgggtggatcacttgaggtcaagagttcgagaccagcttgacctacatagtgaaaccccatctctactaaaatacaaaaattagctgagtgtggaggtgagtgcctgtaatcccagcttcttgagaaggtgaggcaggagaatcgcttgaaccccaggaggcagagtttgcagtgagccgagattgcaccactgcactccagcctgggcaacagagcaagactccctctcaaaaaaaaaaaaaagtgcatgtctacatgattaaagtgacacacaacagatcactgtttattacaaatcctcatgtcttttaaagttcatggtaatatgtttatgttttaacccaaagtctctgttcctctcctattcccaccactacttagagcaaggatctttgcattggaaagcattggtgtgggaggggaaacctacagtttctgctggggtccccatcttgcatattttggctttctggctcctgttgttggcggctgggagaaatgacctatgcagggtccatgggcagccctagaggttgaagttcaaactcagggatgaaagaaagaaagacagacactttctttcacgactgtagacatgatcaatggcctgcacaaaaatgagtctatcactttacacccagggccactagtcaccttggaaactgaatcacacactctctgaaaaaagaaagtggagccacagatctgggcacagtcctccccatgctctgagaatccacgcaggctgcctttgccgctcccttctttctcctctcatgggtgtttcctgtggatgcttccctcaagctggttcagcagacctgttctgccctcacggcctcaacagggaagacagagaacagtagggggctcggtcttcaagacacctgtctccaccaccctctccactgcgcactcacctacagctccttccactgtgagtgcgtggaagcagctccttccattgtgagtgtgttttagaaaatgtgggaaggtagatgtttcagcaacatttctccattcagtgatgctgggggaagtagagcttcttgcctggtgagtctgcaatgtctagatttaagggtccccatctactgtccctgaaaggacgggcacatggaataagagtccttatctgccaagtcctagtaatgctactgcagaggggaacggctgaagagctaatagctccctttcatgttaaatgattcaaagtgatcgtgaatagcatattttgatacaaggatattgcaactttctaaatttgaaaggatatacatgtgctaatgcagaaaagcttatgtatggacatactacaagtgacagtcatattctgcatttgtaaaagagacctggttgaaaaatatggtaagcgttcatactttcaggaattgcttctctctcagggatggtgcctctgatgatagtgtgaattggaaagctgaaaaattatactctcagtactgctggttacatttgcaatttctgctcaaattttgatttgtccaaagcctgatacattttatctagccatctaatatcatttagtttctggatgctgaggctgtaataattttcatagcctctgtactaaaatgctacattttgtttttctttgtattttatcatgcagggtgaaaaatatgaacacatttttataattctgggaccagttatatacccggaggtctggcaattactagaattccccaccaattattagaatgataatatcaataactaaagtttaattgtgggtgatataatttggatatatgtccctaaccaaatctcatgttgaattgtaatccccaatgctggagatggggcctggtaggaggtgtttgggtcataggggtgaaaccctcatggcttggtgctgtcttcacaaatagtgagtgagttctcataagatctggttatttcaaagtgtgtggcacctccccttcgccccactgtcttgctcttgctctcccatgtgagataccacttttgcttttcctcctgccatgagtcaaagttccttgaggcctccgtaggagcctagcagacgctggcgccatgcttcctgtacaacctgcagaaccatgagccaatgaaacctctttcctttataaatgacccagcctcaggtatttctttatagtaatgcaggacggcctaacacggtggataaatgttcaaatgattaaaaattttgtttaatgcaaacatttaaataattcaacaaaccaggtctctggaattataaagacaatgggtagggtaacctcagaccagttcactagatcataaattgattgaaggcagtagactcaggacaaataaaagtaagaactacattacttggtgcctgatgaagtggggaatcatttatcttcaaagatagtaccacctaaatatttcattagattccagaagggttcatggatgatagatgcagaagtgatttgctaaaggcacaggcagggaagagcctgaatcttttaaggtacaaatttcaaagacagcacaggtattcacaaagcatcccttctagtcactggctaaccgcatggctcaccctacccatttccgcagtttgtggcagtcattattgccaacactaaaaagagcctgctgggttttggaggtacctggagccctgagccccaaagtctcaggaagatcaattaactttaatacttagcttcctcatccacaaaataaagaaaattctttgtttgcagggttgaaatgagcattaaatgagatgattttggcaaagatcccagtaccatgcctggcacatgctgtgattctcagggaccagtccctcttctcccatcctcggtcattgctcttgagtttttgatcttccatatactgtcagagcaggaggttaactacagcagctctgagttttgtcccttcaaatgaaatatgtcccacatttatttcagcacattcaatgaccattataccaggagaaggcagtgtcgtatgcagctggaaatgagggcactgacttcacttcacaaatcaaaaggcataaagttagtctgaggctctcgtcaatgtgcaccttgtaaatctgcggccctgctatgagacactcattcctgcagagagggactgaaataaaatttagttcactttctgtagtagaaatgacagtttttctatgtaaaaatagcattccagtggattcaaagatgtgtcatatcattcaatgtgtttctggaaactctgttactgttaagaattctgaggaccacttgctgtagtaaaaatggcatttattctatgtaaacagagtaaatctataacaagacagatcattcagttgttgcacgtggaaaaaaaatctgccaaagtaacctatgtcgtgaaagcacttaatgtgttatccggcacatggcaggtgcttagtaagtgtgggtttccctttcatttccttttcctaaggagtgatccatggagtcatcttgatcttgaatccaagaatgtccctctaggaccatcatttgaatacagttggtaagaagaaaaataaattcatcatttatgagtaattgatttgctaaatgatcctctacttagtagatttacataagtgacatttacaaaatgaaaatatgccaaaactgaaaaaccatgacatacaaatttgatgagagaggcaaaaacaaagataatgataataaacatggaagaaaaaaagagatagatgcctgataggtcagatagagagatgccctagaggaccctataggccctcccaatcaggaatcacaactcattttctgaaactatgaaaataaaatctaggcttgtattctttcaatttaaggaagttcttcttgttctagatctttgtttggctcttccaaaatagtgatactggccagtcacatctgaaagtaggctgcttctgtcctggatgttgtcactaggtcagaaacaggggaaagaccctgacttctcggttcccctcttcccctgcctgtagtgtctggacgaggcggatcttttcattcacaaggatcttgtcatggatcctaagagaacaggagacacacacaggagaaaccaagggtggcgatgggctccataactcccagggagctgctggctagctgtcgtttcttcacaatgggagtcctattttcttgtcctggacaaaggcagtggggaggaacaatctcacacctctcagccgtccaaccaacccctgcagggcaaatgcattagttcccgctgttatcctgaggactgtttctctgcagagggacagaagagggagtgctcagagcacacagtgagccgggtccccaaccttcctcctctcctgcaactcacagtgcaactcagtgatggatccttcccataaataacagggcctaatgtgctcatgagaggggattgcttttagataacaaggatgtaatggaagcagcctcaaatgaagaaacttgcaaatgattaattatggatcaataaaagatgatccaattgattgtagagaaagtctgcagcatgacttcctggattcgctcaatgtatggtctttttaaaatgcttgctgtgatcatcctgtgttgatggatctacttcacagggagggacagtctaagtccccctttaagccttctgtgtctgcctttagcaacttaacacacaggcatcagaacacaggacattgcattagctgttattcctaccagacttcatgatgtcaataaaggaggccagtaaaggctgtcactatgcaacttacaaaaaggttttgcttttttgttctgtttcagtaagactggcttatttattgccgtgtattcctacttacttttctctgaataacaagattaatttaatgaaaagaaaacccaattccataccccagaaaatgatcctgaacatatcatcttattaaaaacagattttaaaaattaataaattaattgagaactggggcctctggtattccagtggaagatgcccgtcatcacccattttcgcttcactgatgggaatttccaagagcgaaaggtttgtctcatcatttcagtgtaaaaattagcgctttgacaatactttgcatgggctaaaagatgctgggaaagtttttgacaatttgaaaagatgtctatctgtttaaagttctctcagttctcagcaggtggagctaggagaatgattgtttttctcctaccaaaatgtgagaaaaaaaaaaacattccacacctatagaaattttaatcacagaaaatgagtgattctcaaaatgaaaccaataatagtgtcttctttagctagcaaatcttgcctctctattttgcttttaattttcaagaacaaccagtcacattagcctacactgccctccaaaaccccgtgtgagggatcccaccagactcgcactgcacctgccaaggttgagaggaagaggggcttgtcaccgccccccacctgattgaaagtagaatatatagcaggagaaccaggctgcacacgtactgtacaaatttggggggaaaatattgttttacacaatcacataatagatgctcatggttaaaaacaaacacaggaaaaaaaggagaggctttcttcaagtgtgtatttatttatcttctgatggaatattctttttgggcttttgaacccagcaatgccctcaggagcgaggggtgaggggcattttgctccccatgatgatggcatgtaggctcctggggcacaaggcaaaaccaccgtatgagttcccagctccactattcttcaaaacataaacaggccaaaccaggcaggagcctaatagcaggaacatattttgtattataaaaatacacagtagcatatacttaacaaatcttcttacgcagtgacccctctcctgcaggaaaagtaatcatggcattctagagtttgcctgcattcaaccaacataaaatcaaactcaaatgtgcctagatgtacatctaaagcctctgaaataattctaacagttgaaaaagatgaatgagataaacagaaggaattaacatacaacaattattcttcctttgttcaactcttcccatgaagtataatttcttttactattgtaattctcaaattcagcttaggcagctgagaatgtgtatcactgctctttaatgaagaaggtttaatattattcacattgactattatactctcctatatgcttagacacttcaactctaataacaccactaggtaacactaaaaggacaccaagctttacataaaacccaaggtcaaaaataattaaggggaaaaaagtcaactttttaagaaattctttggatggaattcttaaaaattaaaaatgacagtttttttttgcgcatgtgtgtaaagtaacagttaagtcaactctatttttaagtgaagatattattacatttgattattataggttggaaaaatgtcttcaggtagaggaataatcaattcaaaaaatgtcttccaactttacatttgtagaccattttacagttcaaggcaatttctcattccttatttcacttaagccagttaaaaaacccagttttacctgactcattgagatgtctgactcagatgtgatgtgtgtcaaaaggagtctgtgattactgagggagcactaaaattggcaaattaaaaatatatagttcaagaatatgttcaagatgaaacttgtgaggacttcattctaaggcttttgctttctgatgtgttacattctgaggtgttgcattctgacatgctgcattcttcctgatatgttgcatattctgacatgttgcattctttctgatgtgctgcattctgacatgttgcattctttctgatgtgttgcatattctggcatgttgcattctttctgatgtgctgcattctgacatgttgcattctttctgatgtgttgcattctgatgtgttgcattcttgctgatgtgttgcattctgatatgttgcattctttctgatgtgttgcattctgatgtgttgtattctttctggtgtgttgcattctgatgtgttgcattctttctgatatgttgcactctgatgtgttgcattctttctgatgtgttgcattctgatgtgttggattctttctgatgtgttgcattctttctgatgtgttgcattctgatgtgttgcattctttctgtgttgcattctgatgtgttgcattctttctgatatgttgcagtctgatgtgttgccctctgatatgttgcattctttcagatatgttgcattctgatgtgttgtattctttctggtgtgttgcattctgaagtgttgcattctttctgatatgttgcattctgatgtgttgcattctttcagatatgttgcattctgacgtgctgcattctttctgatatgttgcattctgatgtgttgcattctttttgatgtgttccattctgatgtgttgcattctttctgatatgttgcagtctgatgtgttgcattctgaagtgttgcattctttctgatgtgttgcattctgatatgttgcattctttctgatgtgttgcattctgatgtgttgcattctttctgatacatcacattctgatgtgttgcattctttctgatgtgttgccctccgatatgttgcattctttcagatatgtggcattctgatgtgttgtattctttctggtgtgttgcattctgaagtgttgcattctttctgatatattgcattctgatgtgttgtattctttctggtgtgttgcattctgaagtgttgcattctttcagatatgttgcattctgatgtgttgcattctttctggtgtgttgcattctgaagtgttgcattctttctgatatgttgcattctggcgtgttgcattctttcagatatgttgcattctgacgtgttgcattctttctgatgtgttgcattctgatgtgttgcattctttctgatatgttgcagcctgatgtgttgcattctgaagtgctgcattcgttctgatatcttgcagtctgatatgttgcattctgaagtgttgcattctttctgatatgttgcattctttctgatgtgttgcattctttctgttatgttgtattctgatgtgttgaatcctgatatgttgcactctgatgtgttgcattctgatatgttttcttgttgagtttaaaagatggagctgtatgcagggttacaggaataaggcacaaacaatggacccatccatgggtgtgaagcacatgtgcggccagaacccacctggtgggtcatgactgaaaaaacactgtgaactattgcctaggcccatctcatggttgatatctttcctgctactctgaactctctgtgactgtctataataactgtaggcatttctacacaaccaatagttttttggaagcaggctaagattttttacatgtatcattaaataaatttacttattttgaatttaacataaagcataaaagatttaaaagtaaaagtatgtattttgagtaggtatttccttacattgtgtacaccgtgtatgcattttgaatgtttgtttatctaataaaagttgtaaaggcttttggaaatataaaactgaatgatcccccacatttctgaagaaatgtgaatggcaaattataggatgaatgggatggattacaagtcagaaattaaactctataaagataaacagagactgaagaagacagagaaatgcaattggaaatgaaggctaattaaacaaaagcactaaatatgtctaagcagcaagctacaattaacatggaagacaaattgtgagcacaactgcattgtgaatatacacacaccaaatataaatattatgttaataactgtgacgacttggtagaaaggtgtatgtttcagtaggtatagccattacatttactttttttggtatttttttttaacttttgttttagattcagaagtacatgtgcaggtttgttacacaggtaaactgcatgtcacgggggtttggtgtacagataatttcatcacccaagtactaagcctaatacccaacaggtactttttcttgttctatttttttttttttgagatggagtcttgctctgtcacccacgctggagtgtaatggtgcaatctcagcacgctggaacctccgcctcctgggttcaagcgattctcctgcctcagctccctgagtagctgggattacaggtgtgtgccaccatgcctggctaatttttgtatgtttagtacagacagggtttcaccatgttggccaggctggtcttaaactcctgacctcaggtgatccatccacctcagcctcctaaactaacaggtactttttctggtcctctccctcatcccaccctccatgctcaggtaggctccagtgtctgctgttcctgtctttgtgtcaatgtgttctcattgttcagcttgcatttcttcagaggttttttttttttgtgtgtgtgtgtgtgtggagataattcacttttatatttccgaaagcctttaaaacttttattagataaacaaacattcaagatgcatacagtgtacacgatgcaaagaaatacctactcaaaatatatactcttattttaaaagtgagaacatgcaacatttggttttctgttgctgtgttagtttgcttaggataatggccgtcacctccatccatgctgctgcaaaggccatgatctcattctttttaatcagccattacattaaagatgtcagagttttatggggctatttgagcttcagttagcatccagggttctttgcattgtctcgatgacctggtctcatgcaaacaatgtctggactcaccctcacttgttagcagtgagcagattgagtttgcctcaggagaattttctagggacaaatggagatctctaatgttgccctcatattccccctttggagcaacagcaccataatgagggcgtaggaacctctcagtaaagattgcctttctacttcagaaaatgctgctaacagaaaaaaacaaaaacaaaaagaaaaacggatttttatcaaattggtaatgaaacacttatttcatgctactgggtatatgaggtattattatcagaaagatatcaaacagttaaacttcacctctactagctacctaggaaaaatatgtccaaattttatctaatttaggacaatatggatttttaagtcttaaaactgatgggaaagtctatggaatctccttatatggaaaagtatgaaaataagccagaattaaaagaactgagtaagataatctcatgaaaccctttgcaggtttataatttaattttttattgttaaaatgcccatggtttatgaaccttaacttagaatcctcctgtaatagccctgttgaataaacaacacccgggtataatcatcttcagatacgaaaggcaactgcattcgcatttcttgggataacagccagaatactacaggtagtaaactttgggagtgattaccaaaccacctaggagataaaactcccttagcttccagctgatgccttattctcaagatttgtcatgacataattgcccagaatataagactcgaggtaattcactttgcttaactgaaacaaagcttgatcccaaagagagaaaattttcagtccttgccaagactgctgaccatttctttccaaaaatagtgacttggggtcagtggatcatttaatatccctgcttagtattgttgaaaattcccagggggtgaaaaaaaaaaaaaatatatatatatatgtatatatatatatatatatatatgtattccaaagtgaatgacacagaatgtgtaagtgcttatatttttaaactacaagtctgtctccaaaaaataactttcatcttttctcttctaataaatactttttaaatgacctctcttttattgaaaattcatttacacacacacacacacacacacacacacacacacacacacacacacatatttgctaatggaaaaaagaacacaacacaacaaagaagtgtatcataaggaaagtttccctaaagttcatctggatgtggttttacatcatccttccagccagtgaacacacagatgtgaagacatgtgcaagccatgtttgttaatttataaagtactgtacctcggttttcctgcaaattttaaagcaactgaaaatgaactgcagcttacattgctaacattttccagcccatacaaagtcataagataaccaaaaatcatgtttcaacccacggtattccatacaatgaatgctttcactccaggcctgcgaattaggctgacatcttccctagctgtaatatctccatcccaaaatacgttcattcaatatgttcatcaaacacagtgagaatttctgttttcatactgagattagtattgtgtggagccacctgtacaggattatgaaaggcagatcgcaaagtcttgtgatggtcaagaccctctctgatcagcagaggaccttggtactcaggcctggacttgtggaaactgaggggtaatacatttgtgttaagtgtgtggtaatttgttgagctgcggcaatagaaaatgaatacagtgactaatttccctaaacatttagaggaaatttcttggcataggtgagtttttaatgctaaaatttaaaacagttgcttttttcacttgatgttttacaaattccagtgaattgaataaatcttccaagccaatgctattgagtgggacctgagtgaataaggtatgtacactctgtactgaactgaatatttttcatagttttaccaagtttcatgtgtccctttcccatttgcctatatcacaatgatgacgcacctaacagaaataaatattaatagtctgaatgtggatatcaccactaataatttccttttaattaaacacatgcttacaaacacaatttccttagaaaaatattttctttttccaacacaagagaattttagggattataaacaagcaaaaaaaaaaaaaaaagcacatgccccctccagtgttagttgctgccttcctgttaggtgtcttctccagcctctgttccccttgtagagagaggctgaggagggtggatcacaaggtcaagagtttgagaccagtctggccaacatggtgaagggtacagttgacccttggatgacacaagtttgagctgtacacacaagtccccctcatgtggattttcttccacctctgccacccctgagacagcaagactaacctctccccttcttcctcctcagcctacccaacataaagacgataaggatgaagacctttatgatgatccacttccacttaatgaagagtaaatatattttctcttccctatgattttcttaacattttcctttctctagcttacttgaggatatttatataatacaaatagcatccacaataggtgttagtcgactattttcgtcatcagtaaggttttcaatgaagaatcaactattagttgttaagttttttggagagtcaaaagttgtacacagatttgcaactgtgcaggggctcagaacacctaacgcctgtgttgctcaaggatcaactgtatttttaaaagtgagactgtaaggccaggcatggtggctcacgcctgtaatcccagcacctcgggagactgaggagggtggatcacgaggtcaggaattcgagaccagtctggccaacatggtgaaactccatctctactaaaaatacaaaaattagctgggtgtgatggagggcgcctgtagtcccagctactcgggaggctgaggcaggagaattgcttgaacccgggaggcagaggttgtggtgagccgagattgctccattgtactccagcctgggcaacagagcgagactctgtctcagaaaaaacaaaaaaaaaagtgagactataaaaatctattttgcatccttcttcttaaaaaattcttccttttacagaaaataagtcccaatcaatacctgttacctgctatgtataacacagcacatccttccctggaatcacgggaagaaaacaaatgtctctgttcattcattctttcactcattcatccattcattcatttgctgttcactgaagtctaagcctgtacaatgtgtaagggacgtacaaaacaccacctgtcaaagaactcaaaatctcatggcaaggctgatgttcacatgaattatcaaagagaaagggcttttgaataacacagacttctgtggagatcctccctgtcctgcttgcagctgtttatactcttggcaaattatgtaacctctctgtactcctttaattgtctgtaaaatgtagaaaatcatatctacctttctgagcagcagtaaaggtgagaagagatcatacatgtagaacacatacttaggactgcagttgttcagtggctaatcggttgtggaagccctggataaacactgtgacaacacatgtctgagaagagggagttgcaaccagcctgccattcactccctccccttaccgggggccatccccagggcaaagaaaaggaggctgagacctggtctaatctccttgtcaaccaggattgttggaaggaagaagccttgtctctgaagtccttagcaggacatccagctaggaataatctgttagtaaacagaacccaagattcctaagacatgacttcccagagaatgtcatgtaagatatacaactttctgggggtacaaattagaaatgttttatattttgaatgttccctgctgtctgagaaaccccaagacctcatctattctgggtcagaagggtaagcccaaagtgggaagaaaggtcctgttctcacagctccaaatttgtgttttgtctgaggcttcaatggcctgagtctctgacatggtttagtgaagctcaacactgtgtaaagtctctggtttgtgtgagtcggagctcacagtctgaccaagcatagctcagcgttctgctcatgcaggaaggagtacagtgaaggggaggcggaggcattcacaggcagaagaaagagatgcagagatgagagagggcatggtgcaatcaggcaatgggatgtgtcaattctgcaagagcatactggaaatgggagacaaaggcccgagtgcaggtgcacaggaagaggaggggctgacggcgaggtccaggcacacctggtgaagtcatctggccttcaccaggaaggcaaggggaatccacttaaaggggaatgaactaaatcaggggactgcttgaccagaacaatgtcccttaagagggaattaggatggagcgatgaggacagcgggcgcccttgcgaaggctgaggttcacatgagggacagaacatgaatgaagagcagaggcagggatggagaggggagaacaatctgaaaactatctaaggatatataagactttaaagcagctttaacaagggaaataaagtgtggatagaaataagtacgaaaagaattataagatctaatatgatcacatttttgagcttcacattatggcattcaatgctgtatgtgcctgaaatatattaactcaataaaaccttacactaaccctttgaagtaggctctgttattattcccatttgaaaactgtggtaagtgaagcccagcaagattacagagctactgagtggcagggccttggactgtaaagcaaaactgcctagaacaaagccatgaccataccagatgactccataaacatggcaggaaacacagaagccagggcgagatggcactcaaaaagcaatcgctgttcagggcaggatgcgatttctggctagttacataaggctgatcaagaagaagtgggctcaagtttcagaacactctgcattacatccagcgtatcacatattacatcccgtttaactcactgaaccactattaccatttggaaagattctatctgcattcctccaaaataatagtttggaaaagttcatttaacgagccctcctatttgaacctggcctgccttgattgataagacttcaatatcaaatgtagcagccttgagttttgactctcgttcaaaagtgagtttcaaaagtagatttttcttaaaaatgcagatgatttcctcttctttattttactatttttctataaatagtaaaatatactttcatttctctgaaaagtaacaccaaagcttcacctataagaataacttattactgaattggtgtctttctcaggaatttaatccaggggaaaacacctttgtcactcgaaggtgtattcaagccaacagacgattctagcatcggatgtcaggaaggaccaggggtgctcccgtcatctttaaaatcttccattctgccctccatcttctgaattcacatttcatgtcctctatcttagtggtgagaggcttagcttttataaacgtgaaaagtcactgaaatggacctaatattgaaggaaaggaagtaacatgacattattgtctttaaggtaacatagcaaagggtaaaatgtgtccctgagtaatcaaagcacaggcaccacaggctccccgtgccaccagctcccacacacgcagatgctggagaggcatggctttgaacctggtaccaagtagggtagatgacaactagtgtgtgtggtcaccaggtgtagaggctgctccccgaaaccctgggtgcagtcaccactgatgggttctacatccgtcttagacctgcaggtgggggtccagcatcaggctggctggagcctgcaaccacctacttaaatcagaagtcaaatgtgagtgctggccacagtgatattctattgaccataaatctgcctgaggttcatcctgctgaggcctacacaggcatctacactagagcatctaataatttcactaagtgttagagaactgacaaaaaataataataaggcaaactgtgggaaacaggtatacagtttttgtgagataagatgatgtgggttactggtcaaagcccctactggaaataagaagatattgatatgccaggatcctcttaacgtgatttaagctaactcatttgacttcactggatccgtattttctccattgtatattaagtggagaggggcagggcggccaggtgcagtggctcacacctgtaatcccagcacttggggaggccaaggtgggaggatcacttgaggtcaggagttcaagaccagtctggccaacatggcaagatcccatctctaccaaaaacataaaaattcaccaggtatggtggcgtatgcatgtaatcccagctaccagggtggctgaggtgggagaatcgctggaacctgggagatggaggttgcggtgagctgaaattgcaccactgcactccagcctgggcgacagcgagactatgcctaaaaataaataaattaattaaattaaaacaagcaggagatgcactattttaagtgccttttattcataaaatttaaaaaacgtatttgcaatataaaaactgaagaggtgtaatagctattcatacttacgtgtataatcggattagtcgggaagagtcggcatgaggtgtttaaattctctcaccatcaacatttcctttcactacttttccaaactgctacacttgaaagatgtttgccaaataaaccgtatttcagcaattttctttttcttccttttttcctttcctttctctctgtacctctgtctttttttaactcaaagacacatgtaacaattttttttcttgtttcttttcttttttttgagacggagtcttgctctgtcctgcaggctggagtgcagtggcacgatttctactcactccaacctccacctcccgggttcaagcgattttcctacctcagcctcctgagtagctgagattacaggtgcacaccaccacgcccagctagtttttgtatttttagtaaagacagggtttctccatgttggcccggctggtctcgaactcctgacctcaggtgatctgcccagctcgtcctcccaaagtgctgggattacaggcctgagccactgcgcccggccaacacatgtaactattaatgaggacttcagatcagcctgagttaaccaatgttatcaaacgagttgatacaatttctgcccaaagcgacttgacatttcaattaaattgtgcagccttttcaaaggaaaagatatactttcctttaagtgcttttgaaatattaaaaatagcacctggatgcccatgattaattttatggatcctcgaatgggagctatgcatacgcactttgtccctttgaacctaaggatgttattgtcctcgtctatatcaactacgtacacaaaggttcacccctgcatttcctgaggcctggaccccatttccacagctcgttactgctacttgccctacctgtttcactgggactgcagggctcttttacctgtgacttcctgcctcagtttaccccaggcagtctctaatcacttgatccagacagatatgcctctgggccagcactgctcccatgtaggtggcctccctcggtcccacgtcctccagtgataattctgaatgggccgtttgcaacattgatgaacacatttagaaaccggatgtggtagttgaatcaagttcgggttttacaactgtaatgaacggctgacacttgggcaggcagctttgccatagacaggtgtggaacaggcagtgagcccaagctttgcagctgattcagtgcagagtctcacatcaagacctttgacttgttggtcattaaggaatttatcagggcaataacttttagtaaaacagtgaagaagaaagtctatcaaaaaacaaacagtaggcccgtgtggtggagaaaccacaagctaggtttcattctgatccaaggaacaggtgggctttccctatgcacaaaattgtctcactccctggactgaattgatggtccagaggctttaaaatactcacggacctagcttaagaataactgggtaaatttacaaataattgacaactactctgtaagggccagaattaacccaaagaaacacatttgctagtgtgtccacagccatacatttgcattcttaattcagcctattctcctgggttcacgctgagtccaacttttgacatcgtccttgcagtcattcatgcaactctgtctatctactctaaaaagctgaagggcatctgtcagctaatgagacaatttctccaacagctggtactcatgtgagggtaattccgtggatttattcagtggtcatgccatctaatagtttctccgaggacctgattcaaagccctcaaaattgaagtgtgggaacagaagcataagagtaacaagacactcgatgagacaaatctcagaggcagggcaaggaaactgaacggagttgacaccaaggccgaaggtggctgccttgtaccggacggggaatccgaggatcaaagtatcttgtggcaaagtctccctggggatagtgtctgtgtgccctagagcatcacatcagggggcctctgtctttccagaaaggcagtcaggttcttcatccttcagacacgatccccactgacctgggagaaatgcttgtcccagtatcagccccatggatgaggcctgggcagtaaacacaccacgagggttcaaactggtctggggtgatcctctgttgaatacacaagcagattgattgcattcaacctctttgtctcgggaaggacgttacttacaccatcccaaattaataagaactatcctccaaataactcccatgtgatatggtttggctgtgtccccacccaaatctcattgtgaattgtaataatccccacatgttaagggcgggcccagtggagataattgaatcatgggggtggtttcccccatactgttctcatggtagtgaataagtctcatgagatctgatgggatttatttatttatttatttatttatttatttatttatttattttgagacggagtcttgctcttgtcaccgaggctggagtgcagtggcacgatcttggcacgctgcaacctccgcctccgaggctcaagtgattctcctgcctcagcctcctgagtacccgggattacaggcgtgcaccaccattcccagctaatttttgtatttttagtagagacgggattttaccatgttggccaggctggtctcgaactcctgacctcaggtgattcacccatctcagcctcccaaagtgctgggattacaggcatgagccactgcgcccagccctgatggttttgggagttcccctgcacaagctctctcttgccagctgtcatgtaagatgcgtcttgcttcccctttgctttctgccatgattgtgaggcttctccagccatgtggaacggtgagtcaattaaacctctttcctttataaataagggaaaatcctgggtatgtctttattagcagcatgagaacagactaatacactggaatatttgagaatcttcatgacgctttcaaaacaatattttagtcatctgccctgaaacacctccagggtcttcccatgtgcattgtggaaagcaagaactggttgctctccttgatgaagctctcacatatgcaaggacatttcaggctcaaagtgtccacagttattgccttgctcatccccttcacttttttgaagagaaaacagaagtgataaagaaagctagtttttatggagcctctctaatcacgccaggcattttcacaagttagctcattggattctcacagccgcgcagagtagcaccatggcattttgacagaggaggaggcaaaacctggaccacacagctggtgaatgcccacagaggggtggcgccccctcatctgacaaccaggcccaccctttctctgaaggccgcagaggttgagagagaagagtccaggtttccaatccaacctggttcctggtctttcctgcttctgatagagaatatttagtttaagattctctaagctatatctgaagactgtaatactctaagaagcatcagtccctcattgccttcataataaaacttgttttccctaagtttcaacttattggctgaaatgaatttttttttccccacagattagatttggaatgaatattttacaatgtggaaattattcttcctgctgttctgccctggcactcccaacctctccttgcctgtctatactggtttctaccttttttttttttttttttttttttttgagacggagtctctctgtcgcccaggctggagtgcagtggtgcaatctcggctcactgcaagctccgcctcccgggttcatgccattctcctgcctcagcctcccgagcagctgggactacaggcgcccgccaccacatccagcttttttatttatttatttatttatttatttatttattttgtatttttagtagagatggggtttcaccacgttagccagaatggtctcgatctcctgaccttgtgatccgcctgcctcggcctcccaaagtgctgggattacaggcacgagccactgcgcctggacttggtttctatcttatctcacaatgatcaccaccctccaacccaacatataattcacgtccatccctttgtcctccgcccccacttgcgtaagtccctgcaaggccgggagtgagctctccctagaacactgccgggcacaccgtgagccccgaggaaggcctcactctgataacttacaacaaagggaacttttgaggggaagtacatgcatatgttaatgagtatagccaacagtatcattctatattgtatacattctgggcaccaattctgacaaaataaatcatcgagaagtctggtcaattctgttggaggcttgccctatggtccctgaatataattcttacgtgcctgtgcttttcagggctgcgtctttgctagaaacaagtgattaccaaactgttccacggagccctggggtttttctcgtgacttcgggggcctctgagagggacagctagggcagcacctgattcatccacttgggtatatgtggtttctgcttcagagatcatagaagagtagagctcatggatttttatatgtatgaatatgttttttaaaagccaactataaatattcactctataactcagcttaacaaaagtctattttgctaattatttactgtttttttttcttttttttttcaaactgggtataatgctcctcaaattgggaaactttcagatctccaaattacagtttccaaataaccatacatgcagcacagatgtgaacagtgggtccaaaataagcaccttagattaagccacacgatgaatcacttcgctttcaaaaacaataaaagccagaggccatgttgcacatggcacagagaagcaacagagtccatttctgtaataagcatgacccctcactgaatgcttgctatgggagatgtgtgcctcctgctgtgcgggctggttcccaacaggccatgaaccagcaccggttgctccatggcccagggcttcgagatccctgccctagagactatattaatgaattaggaataacattaacattcctaataataggagatgatgactaggaggtggattaacatggtcaaggacccaaagctggaagatcccccaggcagcattgactcgtggtctattccttcactgtactgacgctcctagcttcgagaatgatgcatgggcaggcctgttccattaacgttttgtcaagtgactaaatgaaacataagttcaagaaggcaccttccaccagagatgctggctcagagattaacaaaagccacatcaacggcatttggaatcactcatttaattacggtgatagatgccagcagcagctcccattattaccacatgcttaccattgccagacactactcgaagcactcaattgtcttaaatggctctaaaaggtcaatattagcgttatgtccacttggtagatgagaaagcagaggtacagaaaagctttaaaatgtgcctatgttttcacagctgtaagcaatggagcaggattggaacgtaggcagttttactctagagctcagatttttaatgctgagctctgattttaaaacttacaggactatgaagccattacctataatatagaagttacattagatctggttcttcccttaaaagagtttctgatctaatcagggaggcatgaaataataacataaaataaaataagatattactctgtacatgtttccagagggggccctcagtgtggacaggtgaagtcagggcaggcttcctggaggtggtggccttgccagagccttggagtagttctgagcaaggctgaaagcatttcctaacaggggaacccaggagtcatggggtcatggaaagggagtcttttcagaggatgctgacctaaccaggcgacaaggagagatgcaagaagaaaagcaggatacaaagtgttcagctttatggccaagagcaagcatgccacacctgcgaccaggggcaccaagcaacctggggtcaggatgcatgctttctcttgctgttggaacgtgaatatcttgtaggcagtttgtatactctccagttgacccctaaggacagcaaacaattaacaccctatttaaaggctagaatataggaaaaggaggatctgaaatccagtagactttccagataagagaggagaccctgggaaggcagacggcaaggggaggattccaggtgggatcaaagctgagcaaatgtctgatgtctctaacagcccgactggaagaacaagtgaccagtattttccagtcaattagacacaaagcatgattgttgcagcctggtgtgtattcaattaggactgtaatatgatgaagctaagaacagattattttgcagactttcttgtgtctgtgcctgagagcttgctcagaggatcctgggtgacagctctctgtgggggcctgtggccaggaggggagacgaggcctcatcgtggcattttcagggctgaaatgccaaaacaaaatgctcacattcgttaggaacctcctatgatccaggcaggtttgtgggtacagcacaagtctctccatgaattaggcaaaattatcccccttgcactaatgaaataagggcctgggtgcccgagtaatttcctaaagtgaaactaagatgtaaatacaagtctctctgttgccaaaacccaggaccttttcattgtgccacactgccttctgtgtgtgctctgatgaagagcttttgtaggtgttcttcaagatggaactgaaaattgagtaagacttcccagagacccagctgtgggggactatccgcagatggagaccctgggctaaagaggcaaactcttattttataagtaggggctaattggctgggtctaagtccagaatccccccagctgttatccccaagcctaatgctcaaacagacacatacaaaaaaagacaagtcaacaagaacggagaaaaatcaacccagaaaacaaaaaaagctgtaatagttgggtaaggtacatttatctatttttttatatatatatatttatatatatatatatacacacacacattatacacacacatacatagatatatacacatatatgtatatatgtatatatctatatagatatatatgtatatctatagatatatctatataggtatatgtatatatgtatatatagatatatatgtctatatctagattctagatatgcacatatatatctatatagatatatatgtctatatctagaatctagatatgcacagacatatatatctatgtatatgtctatatatgtatatatctatatgtatgtatctatatatctacgtatatatctatatctatatatctatgtatgtatgtataatactgaagctgtcatgtgactaccctagcaaagatcttatccacaaatataattataattataaatgcccaattatctgttgagatatcagctcatgatcatcttattgtagaaacgttttcgattgattttcaagcattcataagcattggctgagagactgcggtctgtaaagcactggcagaatacaaatgcttgttgagtcaacgggcatttattgagcatgtattatgtgctggtctttgaagactgaaaatttaaaaaacaaggcccctgtcctataatataacctattgcttggaatggagttttaaaaaccatgccaaggagaaattgtcatcaatgcctccttcctctctttggagatttctgtgacagggtaatgaaaattataatcactttagatatcaacctacttgcctaaagagaaactaaagagaaattgtcctgaattcacataaaccaaggtaatggaagtgatatgtttctcttttttttttttctcatcagaaaactgattattttaaacaaattgcagagaaagagagagagaggatgagatgaaggaaatgtattgacttcagagttgactcatgaactgtcatagtataagaaactgcatgaaattctgtagtgcagccaaatattaattgaaacaattaactgtagaaaacacgtgggcacgacaatattagcagtgcataatcatttgtagttaagaggtccttaccggattactgcagaaaagctctggagttctaattacttgtggaagtcccacaaggttactgcaaaacatggtaattagacggttgtaatataaggtgttagcaggggattgaggatttgctctaagcaccttggtgttttcgtggctatttactgagcagagtaccagaatttaatggaatttggtagaattctccaatgactcctatgagcacgtagttaacaaacgtatcttaatgtgagttccatggttttcttgaaagtgatgaacatcgccatctttaactactataaggagaaaatataacctaaatgaggtggattatgtggatttatttttgggatttattgctcttgtctttcggtggcatttgagtcaggtgtattacacagctttgagatcttggcttcactaggcataacccagcattagaaaggaagtagcttggtgcttctctgcaactccagctcagacttctgtgtgacagtccttttttacaacagaattgggacatcgctgcatacgtttttctcagctttgaggatgcttctacaacccatgcatgcacaatgaaagaaatattatacatttagtgatgggcacaatgtacttattcaaaaatgtcagtaaatataaaagatttatcaggtgagtgaaggagacacgtcttttttttttctttctcctttttgctgatcccgaatcactctcttacgttttttttttgtctgtgtaccacaaatgtgtacctaaaaatgaaactcagactataaactgccctaagctcccagagtagaaagcatgaaactaatctaaagaaaatattggcagaactcccacccgcgctttgattttggctcagaaaatcacctcctccttctatagggtctggttcgcctccgacagcagaatcaggggcagattccatcagtccatggaaatggggttcctggaagtaacactggctttctcatcttggtccaggcaaggggcacttgtcgggtcactgacaaaggcattcattaagagtcagttattttctgcaggtgcctttagtgagacaacagtgagaaggggcacttgggaagacgcggggagtgtatggagagccataccccactgcttctttggggttccaaacctctaagagaatttcccttatgctttagctgttgagaattgaaagtctcctttcaaacatttaagcagagcaagaggggatagctgctttgctacagttacctgttagtcaaaagcttaaaggagaaattcccttgcctgtcatgtgtattccacaacgcatgaaaagaccagacaaagcgaaacaaaacaaaccaacccgccgccagggggcagctgggaaacatttcgaagggctgggagagatggaaggttggcaaaaccaaggggagggggtccttgtacttggtgaacagatgactctctatagtaaggattcagggccgggaggcgggcaagcaggtacgcctaagcttcttgtgttgctaaccccctccgggtctaccccagttagcaatgtctactgggacctagaggggcgcagcttcgcctatttctctgacaagactgtaacatcttggaagggagaagctgtgtcacatctatctttgtaagccacagagcaacgagcaaagtgctgagtacatatatatacatgcatgcatatatgtgcatatgtacgcacatacacatgtatgtgtataatcgtataccttacatataaatctataattatgcatcatctgtatctgttaagttatacatcattttagtgcttttatggaggaaggaaagtaatttgcaggatcaatttctatgcagaagtgattcctggtacagattttaatgcattaaattttcacaaagtcttcaactccagcaatttaagttttatcaagggccctgggttttgctggctctcttcacctgtacctcttatcattaagagggaaaaagaaaaatatcctttcctgtagccccatggtacactgcaaacccctctgagaagctgtaatgagctggggaagctgtagtggggaggaggggaaaggctctgtaatccctcggcctcggggctgacatggggcacatcaggactcccctggcgaggctctgtcacttgacaaacttgtgtagttggagccataaattctccttgtactccgttgctccccacccacattcaccctgcacctctcacctacaagaagtgacagtcagagtactttaaaaaacaacaaaaactcaacagattttatcctttgtaaaagcctaccatttccacatttgtctaaaatgctgattttatagtcctctgtgtttgcattgcgtttgttatgagaactaactcctttatataggaatagcccagttgaagcaataccacttgactggatattttcaattcataggatattaatggatatagcacacataggacatatatatatatatatatatacacacacacacacacacacacacatatataaattagtacaaaattgttttgcctcctaacttgcaaggcctgtaaacccattcttttttctttttacatagatatgttgagatttttacatcttggcaaaatataggctgtaatttaattgacttagcaacactaccaaataaaacacttattcccaagggaaatttctttccacactttctgctggaacttctaattgacatctatttctgaataattgttgaaactaatgtgttggaagggctggtgatctcaaatagctataaatgaggcatcatggcatgtttttttcttcctgacaaatccataagtgaataaatattttaagtcagtattggccaggtgtggtggctcatacttgtaatcccagcacttggggaggccgaggcgggtggatcacttgagatcaggaggttgagaccggcctgaccaacatggtgaaaacccgtctctactaaaagtacaaaagtagacaggcatggtggcacatgcctgtaatcccagctactagggaggctgaggcaggagaattgcttgaacccaggaggcagaggttgcagtgagccgagatcacaccactgcactccagcctgggcaacaagtgtgaaactcttgtctcaaaaaaaaaaaaaaaagtattaaaaattctgtccacggaattgatttaatagatgaatcaataagtctggtatgaccatcatagagcaagcagataaggctctaggtacaacaaatatataattgtattagtcatcgaaaaggaatgcaatatatttcactagtcagagaaatagcaatgtggaatagaaagaaaatatgtaaaaactgatggacttttatttgaaatttggttgaacattaactgtggttctccctaaatatcatatacattttctttcacttcattggtgatgagccattaatatcataaataatacatactggtagaatgagtaaaaaaaagttcagtagaaccaattaacaaacaatgtaaaacatgtagatttagaatacctgtcatttactcaggtctacctttttgcccaaatttcataattctcctatcttggtcaacatctacaaggacaagatgaataaatctctctctgtgtgtagaacatcgtctgtttggtttcctccaagtagaaagccaggaatgattcttccttcacatttcctatcaatcataattctatcagccagctgaatagcttggtacactcagcgcctatcaaatattaaagccttcccattcttgaaattcacataatagcttggtttgttatcttgcactaaatctgtactacattacacatttatgattacctgtaaatttcacactgatatttaagttgtaaaatatgttgatgcctttaaaagtgtgtgagaacataaaattacacaatcataaagtaagttaaaaattacggcagcataaatactaaagtccaaattcttgtcttacataatccaagtgataattgttgtgctcttactctgtggctgaggacactgtgacaagcatggagaattcagctgtgagccagattacacgatccctgccttctgggagatgataccaaataaactcaccaatgaataagtatcgcaaattattacgtggggtataaagaaaacaaagaggaagctgtgaccaggtaccaggcttatggtatgggacttttcaaagccaagccttgaaggatgagaaggagctatgcacacagcaggtgaaggagaaggggcagtgaactggctggagaagagcaggtgcaaaggccctgcacgggaaggtggttcagcatctgcaggattagcgaggaggcctgtacaactgccacagggcaggcaagggaaggagagatatgaaaggaacctgcggaacattatggagaatattatgaagaatttgtatttttcctaaggaatccgttttgggacagggaactgatttaatttacatttttgaaaaaccctctcaggaggctgaggtgggtggatcacgaggtcaagagatcgagaccatcctggccaacgtggtgaaaccctgtctctactaaaaatacaaaaactagctgggtgtgatagcacgtgcctgtagtcccagctactcgagaggctgaggcaggagaattgcttgaactcagggcagaggctgcagtgagccgagatcgcgccactgcactctagcctggtgacagagcgagactctgtctcaaacaaacaaaaaaacaaaacaaaacaaacaaaaaactcgctcaaggttgggtgcagcagctcatgccagtaatcccagcactttgggaggctgaggctggctaatgacctgagcccaaaagttcaagaccagctgaggcaatatggggaaaccccgtctgcataaaaatataacaattagctgggtgcattggtgcgcacctgtagtcccagatactcaggaggctgaggtgggaggactgctcaagcctggaaggtcaaggctgcagtgagctatgatcatgccactatattccagcctgggtaacacagcaagaccccgtctcaaacaaacaaacaaaaaacatgctggcttttgtgtcgcaaatggattgtagtatatccaagaaaggaagtagagagatcatttagtagacttttacgcaagttcagtaaacagatactagaggcttggactagagtggtggcccaaagacagagggtaatgaaaatattccaggtactttgggagcaggaatcaacagaaattggtgatgggttatcaggggcatcaggaagggagggacagagaatggcatcagtatgggcagtggtaacgcttgtgtgaggaacagtgtcagaggaacaggtgtaaagggtgtgtgggttatggtgcggttagaatcaagaccgacttggaaacaagctaagtttgagatgcctttgagaatccaagtggagttttcaaggagtcagtttaccatgaaattcagaagttctgcagagagttcaggagataagacataaatttagaagtcatgagtaggtaaatgatattaaagtaatgctgatgaagagttgcatgatagttgtctgggagtgagaagtctggttggggaggagaagctaataaaggagacagaaggagccaccaccgagggagaaggaacacagagagggcatggagatctggaagcccatagtaagcacgcagtgaggattagtgttactatcatttggcattaaattgtcttatccagtggaatatcccagtgggatggaggggaaaaaagccaggttggaaagagagaagaaggaatgggaggcaagtcagtggggacaacatatggcaaccactcttagaagcagtacgaagaaggataaaaaattctgcggagggggataagaggtttatgggtggacttttgtttgctgttcagttattgactggctgagcatgggagaggagagcatgtttgtaggatgtaggagatgaagcagggagggagggcccatgaaacctagagtgcagatgactcaagagccaaccccgagtgggggagcccaagcccaatgggggcgggggggctcggcttggagcaaggccaattctctcctggtaatgggaacacaagtgccagagaaggatgcaaatggcaaggaggttgagactgggttgtgaggcaatgagaaaggtcccttctgatagtttctactttatcattttacattttaaaaagatgtgtgcagtgcagccatggagtaagggagggagagcagaggagaggttaggaaaggtcagagggtaagctatgaagagctgcataggagcacgggaaatccagcagccagagaagaggaggacgatcccagacggtgcccagtgtgtatctgcggaggaatttaaagtaaaatgggtgagcccagttgtgtaattatctccagctctgcaaagtggacattcatgtggggttcagattggccactggaatggaggcaggatttctaggggagagaaagcctcaacagcttacagggaaggcctggcagacccaatgttgcatgacaaggaggaagagtaggcgggtgagacaaatgacctgaagctcacagcaggccatgctcaggaggaacgtgctgatctcaaagagaaaagtgtgggctgagaggacaccagcttgactccgagggcctaggagatgtggagagggaggggcaagcagaggaaggggtttccttgagagacgacctggttccggagaagttcctgcagcaaaaacacgcggggcatccagggaagtgcacgggccatggcggaggctgtccgaggggtggggacacgagggccatgaggtgggtgcttgtgggaggctgcggtgcgtgattagcagcaggtgagagtagagaagacagcggaattgaagacaactgggagctaagactggagggtccctgcggcctctcagagggatgggggctgagccctcccatggtcaggtcacaggccctgcaggtgctgggggccaactcacatcccttttcttccctctcccttagggtctcaccacttccgtgcaaagatgacaaatattgtgtaaacgaatattcaatatccctaacattcacaatattcctcatatctagctcacatactttagatcctcaaattcctattttaaacaaaaatgcaactgtcgtggtgccagatgatggcatttagcctctttagtgtgttacagaatcttttcctgagacacttaggaaagcacaaactttttcacccaaacaatgttgaagatggcagagcctggtttgagaatccccactcagggggagaaatagtcccagggtgccagtatccagagagctgacctaccagggaaagtgcttatgtttctttcaggataggcagtatggcaaacaaagtcccaaacacatcaatatgtcattgatcacttgacccaacttaaattttttattcctttgttcattgataacattgcatacccatagcgtgtgacagttttctcaggggctgaggatgcagccacagacaagcccagcttcttgccagtaggggaggtgcatgacagaaagcgttttgattctttttatcatccatactctctgcaatgattctcacagacaacgcactctcccaacatactgcacccacgtgacagtgggagcagcctccctacactatctccataactctgcttggtgacctctcagatgacagtaaacatcatcactcccagatagttctgaaattgtcatgttggaaagtacttgataactgttaacacaaaagggactcagtaatatcgaagggttatggatatatattcctattatgtgaaaaatacatatcttgcattcctagcagacagtagtaggttattgctggtactttcatatgttggggggaaaaacatgtacttaaaacagtgcctcgactacggcaagcagaattgaaattatgatgatgataatgatgaaaataacattactttcattatgaaacagtgcaaaatggatagtagacaaacactatccgtaattcaatgtggataattcaacgtgaagacactggaagtaaaacaatactttgaggatccagaacttcctcatttcacattctgttaatcagggttgacgtgtgctgttggctggctgtcttcatgtcagccagatcatcaagaatgtcttatcaagcaggtgagtgggaaacagactctcccctacaggccagcacaagtggctactgccctctgttgccaatagacagtgggcaataggtgttggaaaaaacgccaaggatattaaaatgtgagccttgaaaaaggactcatgagcaattgacaattagcaatcagctgggttgaaattgatcaatgagggattcaaagtaataaaaaataatgagtccgattaaaggcaaagcagcaaaaaaaagctagtagcttctacttagaacacatagttcatgaaaattactataactaaacattgtatttaagaacactttctcggccagacgcggtggctcatgcctgtaactccagcactttgggaggccaaggcaggcagattacttgatgtcaggagttcgagatcaccgtggccaaaacggtgaaaccctgtctctgctacgagtacaaaaatcagccaggcatggtcgtgcacacccgtaatcccagctatttggaaggctgaggagggagaatcgcttgaacctgggaggtggaggctgcagtgagctgagatcacaccactgcactccagccagggtgacagagtgaaaccttgtctcgaaaaaaaaaaaaaaaaaaaaaaaaaaaacactttctctcagcttttaatttttattgctgtttcccaaattattctttctttagaactgtttatcacatgacaagaccaaaagatttttctttccttttcttctttccttctctctctctctccccctacctcctcttttttctttcttgctgtctttatgtctttcttttttttaaatagagattcatggcctgtgtgggctagtgaaatacccactgggttaggggttgaaagatatggaggcaagtcccagcaacctcacttcaaactctgagtcataagataataacatgaacctagaatagctaagataactttgaaaaggaagaacaaagttaaaggataaatgcttcatgatttcaacactaaatgtaaatctacagaaatcaagacagtacgctattggcatacagatacccagatagatcagtgacacagagcgcagagaacagaaatagaccctccagtacatggccaactgactttcaacaaaggtgcaagatcagttcagtagcaaaaggatactctcttcagtggatgctgtttgaaaaaaataaataccaataatataaaagaaactttgattcctaacttgtatcatacacaaaagataattcaaaatagatcagatatcttaatataaaacataaagcttctagaagaaaacataggggaaaaccttcatgacattttgttaggcaaagatttcttaggtatgctacataaagcacaatccataaaagaacaagctggcaaattggatttaactgaaattaaaaacttctgctctttgaaagacactgttaagaaaatgaaataataagccacacacagagagaaaacatttgcaaatcatacatctgataaaatacttgcatgtagaatatataaagaattcttacatttttatagtaagaatgcaactcatattttaaaatatgagcaaccactgcactccagcctgaacgacagagactccgtgtcaccataaaaataataataaaatatgtgcaaaagattttaacaggcacttcaccaaagaaagtaagagaatggcaaataaacacataaaaagatagtcaggccaggcgcagtggcttatgcctgtaatcccagcactttgggaggctgaggtgggtggatcacctgaggtcaggtgttcaagaccagcctgaccaacatggcaaaatcccatctctactaaaaatacaaaaattagctgggcatggtggcgtgtgcctgtaatcccagctactcggggggctgaggcaagagaatcgcttgaacccgggatgcagaggttgcagtttgctgagatcgcaccattgcactccagcctgggcaatagagcaaaactccatctctctctctctctctctctctctctctctctctctctgtgtatatatatatacacacacacacacacacacacacacacacacacatctctctctctgtatatatatgtatatatatatacagttaaatatatatatatatatttaacatcattagtcattaggaaatgcaacataattccatagtgagacaccactacacacttaatggaatgtgaaaacttaaaagattgatgataccaagtgttgagtaggaactggagcaactagaactctcgtacattctgggtgggcatgtaaaatggaaatggtacaaccaccacggaaagtagtttggcagttccttaaaaagaaactctaaaatatgatttagtcaccccacttctaggtatttacacaagataaaaagaaacatatctacatgtacaaagacttgcataaaatttcatagatgcttgttggtaatgcctggcaactggaaacaagcccagcattcatcagcagtggaaaggataagcaaattgtggttgtatacataaaatatacacaattcagcagtagaaaggagtaaacttttcttatacacaacaatgataaatttcaaaataattttgctgtatcaaagaaatcctacaaaaagagagtacatactctacggtagcatttatatacaattctagaaaatgtaaacaaataaataattgcttggcagggacacatgggaggggtcaatggctatgttccttacattgattgttttactggcatatacgtgtgtaaaacttatcaaatggtacattttaaatatgggcctcttgtatgtcaataaagctgttaaaaacaatataaaccaacattagccatttaattaacacaggcccacttaaagatgatagatcaggaagtcaaagctcagagaaataaaaggactggcctgaagtcacaaagctgaagagacttgaaattcagtctcaggtctgtctgagtatacaacctgtctcttccgtcctataccacacaaacacatcttaacctcttttgttttgaaaatctctcatttcaggccgggcgcagtggctcatgcctgtaatcctagcactttgggaggccgaggcaggtggatcacgaggccaggagttcaagaccagcctggccaagatggtgaaaccccgtctctactaaaaatacacaaattagccaggcgtggtggtgggcacctgtagtcccagctactcaggaggctgaggcaggagaatagcttgaactccagaggcagaggttgcagtgagctgagattgcaccactgcattccagcctggcgacagagtgagactgtttaaaaaaaaaaaaaacaaaattaaaacaagagataatctctcatttcaaagacatcaaaattccttcaagttgtgtaatcaggatggcaagcattttaatgtatgagttcatggcacgcctgcatcttccccctcagtaactaggatctaggggcttcctaggtcagttggtagaatgcattggattggaaaggttggccagtcactgtaaatttaaaggtgtttttctgaatgcttcagaaagtaccaaaaagccattaaaaatgaaagactaatggaacaattatgtcccattttgacttgtaaaaaccaggattctttgtgtcttcagtatttctagtatttctaagatgttaatcattccaataaagctgaatggcatgacagattttcggcacctatcagagtggcagccatttccaacttcttttttattctatatactgtcaatgtcactaacatagattacatttcaattacctttttctattcactgactcacatacatttcacttaattgctagatccttccacgcagttttcccattgtctggcttccacaaccttatttctgtcacaggttgtacagccaatggtcaccacattgcagagtatatatctggtgtttcaagtgggttttagggttccccagatttagaaatatgtacacctgaacataaaactgggttcagttttctgaagtctgaccaatgagctgacatactgatagctcactgaggtaaaagaagctttgtgatacaactgaaggatgtttatactttcagtgaacgaggcatagcagcctaaatgcaaccgattgaaccacaaataatacttctcaatcaaatggccttttatctttcttgtctctaaatatacccttttaccacacagctcgttcttaaaaaaaaaaaaaatccggtggtcacaatgtcaattgctaactttattttctatttatatcgtccactttatgaatacccttttcctcaatttaattagttagtgtcactcacactttaactgggaacattgtaagactgagctgaatttgaaaacaatgccacgatgtcagactgagtcacatcaattttctaactgcccaccacagccacagcgcaactcaacgacacccacacgggtatctgcgtcctggaattggacttttacatttttattttaatgaaaatgatgtattacatataagtaaaacaacacctttaaagatggaaaagaccctttttttcaagcctcaatttcagttctagtgggacagccaggtgggagggggtccctggagaaactccaaccagcctgccctctgcagtggggaggagcctggcccctcctcctcctgtgtggaacccgagattcaggctgagcgccggaagccgtctagcagggactctggcctagcgagagtccctgtttcccccttttcttccttttcacctaataaaaccctgtcttacccaccctttaaattgtcttgcaagcctgaatttttgtggtcgtgggacacagaaccccgtccatggctgaactaaggaaaagtcctgcaacatcagaaccttcagttccgcataattaaagctcaatgcaaaagaatcatgagcataagtcctctaagagcataaataatcaagtgttgctgatgttccctaatatttgtgcgttttcagcctacacccgcacatatctaaactgttatcaatggcatgaatgagtcaagacttcagtgaggcagcacatatttcaatacaatgcaacttcgctggccacaatcaatagagtgtttttcactatgccatgctttgagtattcagcaatcacttcagaatggcagactgccgtaaaatagaggccaaatcctacccagagaaattttatggtttaaacagatgttctagagaattactgaaaattaatgtcccagtcctaaggtattatggccagttaataagtgacatggtgaaccattgtgttgcaacaaaacatagtaggtacttgccttgaataaatcaattctttattgtcatatttttgtgtctttctccagataagacgggctgctctttgaaagtaaaaagtacgtctttttgctttgtatttctatgactagcactgtggccgagctacggtgtgcagtggatggatggatggatgatggatgaatggatggatagacaaatgcatggatcaatatgtgcatgtatgcctttgtgccacatggtacaatgtaacaggagacctcggccaatggttgcaaatgctcacatgacaaatgacaatcatcagatttaccagatgcacaagttacagtcagaaataggtagtatctgataatatcaagatatataatgggacccaagaaatagattaaagactgactttataaaaatacagaactgtaagcatcagcatctgaccagcccaatctcctggcttccaagtaagaaaaccattctgaaatgttaaaggaaaggccaatcatacatagagagctagaagcagagctataatcagaaaacagaggtaccaacttcagtccaaggcttgtatcaccttaggaattctatcaagtacacactcatgaagtgacatttcctgaggaggttggcactgggaaaaacggaatcccaaggaagaacaagatttgaaggtttttcccaaaatggttataatttaagtggatttatcaagaacaatttgtatctggtaattaggtagtgattccagaatggaacaggacatgagcaccttggaggacaggacatttggcctagggaggtctgggttggtggaggacaggacatatctggagctacagagcgagagtgggcaggcagttcaggcattctccagttggcatagacgggacagaattcctacgggtgagggctgaaaaaacaacaggcacacatgaagtcgtgctctgggagttaatgagaggaatttaggtagccaagaaagaaaactaggctgatgtgaggcaacagtaagaaaaaatacgaagccacagtaggctggaccagaacactgttgtggtaaaaatggaatctcaattagcataagacagtgagcgaatggacagcagtgggagaacctgacaatgaggaattttgaggttcttgtagattcaggagtagaataaagtctgaatgctaatagtgaccaagttagaacagaaagcaaaccaaaaagacagatgcactagaaacgtgattgaaaaagacccagaagggttaagtcagggtcttttaatgcagaagttactttcaagctattaatgaacaaattaaagactacttgatgtcaggctgtgcaatggacatttctatgacggtggaaatactctatgcctgaactaatattgtatccactgaacgtatttacattgttttgtaatcatgagaaactgaaatttaatttcatataatctatataaatttagatttaaataactacaaaaaccggtggccacatgtgaagtttggcacacaatgcattcagtgtactatagagctatgaaatgcctaaggaaaaggaataaaattctacacataataagttttatactgttatattcttgatgcataattgctacattctaggccaccattgctctcaaatatactggcaccaagaaattctattgccattttcaagttgaagttttcaattatctttcctttcctgtaacattctagaaaggatctgagacaattatacaaatgtataccaataacatttaagtagacaaaaaatggagagaacatgaaatactgagagactactgaggacaaaagataaagagagcatatagaaataaaacccagaatagatgacagtttcttaagataagtcctgaccttcctagtggcctaaggagagtcaacattgtactctgtaaccgttgtattacctatagcatagaaaacttatgtgtcattcaggagaactaatatttttcctggactgaagtttgaatcacgcaaatgtctttgaatcgcacaaatcatttgcccaaatcgtgcgactctctgtaagcttgtgagccgtgagttggcacgttcctgccggaattggagaagcaaaggctgaaagaagcaggcagattgacaggtgatgtagatgcatggagacaaagaaggggtctttggaccaatggttctgttgcccccgagacccacccctgtccctgggaaacaggagacacccccatccttgatagtaaccccctcctctcttcttatattagctttagttggttctgttcctgtcaaccagatgagccttagtgcagaggggaacatcttgcaggagttgacgaagagcggagcagtgttagtgggtgatttcctcagcgaccacgttgtaagaggagattgtgcatctgtttctgtctctgtttcttgcactgcccgttgctgtgagttgagagtttaaggctgaggcacattcagcaagggtcatttacagaacttcaacagcacactcaccagcccctttcccccccacaacgtgcaaagtgcaatatcacccatattaaattgattgaaagttaaatttttgtcatggattccatgataccactcacgagcatttgtgagctacaagctgaagacctacccgtcctgagctgaatcgagaaacctaagcattaccttcaacgcctgcctgcccttcctccacacgaggcccatcacgagtcccactgaatttggtctttcacctctcctcttgcccctttgcaaccattttcctccctccagcaggagtattcttttaaaaatgcagatctgatcatgccacttctcttatatgaagcttccagcatctgacttccaggactgcatcctccagggtgggcttgctgggccctgcccatttgctggtctctttcactctcctccagccactctggtctctccatgctacagacatgctttgctctctcctgtctcaaggttttacctcaagttgttcctttcttcccctgtcctgcctcacttcctccgtttcttccatctcttatctaatctgtaattatatagctgcatggtttttcataaatatctgaaacccccactgaattgcaagctccttgaggggaagaagcttatctattctgcaaaccgttgcttctccctgtgacgcagagcctgcagtgtagtagatactgcctataaaatggacaggatgcttggatttgctttatctgacattttaaggacacactttataaattgtagaggcctatgcaaccgtctttgtttttacttagaggatacaaattatatcattcaacaggatgccacagttccatatatttctcaaaatgtgaccagatgcaccatttttaatgaaaattaagctctacttccaagttaagggaaaattattttaagctattgatacaagttttaagaattcagtaatttaattgtgcatttctatgtgaaataaaaacaggaaacttattagggtgttttctgtaatatgaataattaatatttgcaatttagaaatctatctccctacaatgtagctgtagtctcagaaggaaagtgtattaaaacaatagctaaatgctttcaattcaaagtacttggtattaaatccctcaggcatcaaaatagctctgtagtcttttctagaatagtatgccaagcagtcttaaacacatattttattggcatcagaaaagcaactgcaaatgttttctcttgtattcaaactcctttaaaaaaaagattccattgctgagctctgacaaatatgcctcctactaccacaccaggttcctttgcaaacacacaattcacaattaaaagcaattttgtaaaatgccttggagtggttaaatatgtaattgggtaattttctgaaatgcttattacttacttcagcctcatttcagtctcactggtaaacagtatattcctgttaagtgttattatccccaaaaacgcttccataatcttcagtgttcctttaacattcctataaacacatcatatattacttggggacgtggatcatgaaacacagaagctacccgtgccagtcccttatttaaatggcaaagtggtcttccttgtctctgaacccgggttttctaaatcattcgcatagtggaaaatgaacaataggacttttaaacctccttatgatttagattatatcttagctggttgcaaatctcattatcagctttacagcttgatttatttttatttttggatcagaaggaagaatggcaaaattacagcctagacgtttgctttggaaaataaagtttgaagttagctgttgttgatttatacccagtatgctatacttagcatgagtgtacagttaagcatactttataggtaattactccttctattgatatgatgatagctacagaagctgtgtacaaccgagaacaacacccaattcttgaaacagtaccttctaaagtggtatattaggcaaataaagtgtgatgatggtggtggtatttcatccaacaagagatattagataaataaattgtgatgatgatggtggcatttcatccaacaagaggtcttactccctctgaaaccaacatcttttactacttgcttagttatatatgaacaataaaaactcaccaagatcactgattttgttgaaatgaagagaaagtaaacagtctctaactgaaacgagcatgttcaaattaaaatagggagtaacaaatcaaaaacaaaataaaacaaaatgctttgaattgtttttgaaggcaaagtgtcccaaatacttttacttctatgctctattattttaggtcctacttttctacaccataacacagtattttaatattaataaactagtttccctctatgttaataacagagatcaattaaaatttggtctttgtcattttgcagttaggttattttaactcacaatacaacatgtacagttcttttattctacaaaaatatatagtattaagaaaccaaaaccattttaatcaaaatttctgctatgacttgaagactacagaagcccctatttttgcctgttgttcccttgataaagtattgatatggaagtctcaattactaaaacagaaaaaacttatgcctgctgtcattgaccacatttttttttttttagacagagtctcgatctgtcaccaggctggagtgcagtggctcaatcttggctcactgcaacctccacctcccgggttcaagtaattcttctgcctcagcctcctgagtagctgggactacaggtgcacgccaccatgcccagctaatttttctgtattttcagtagagacggggtttcaccatgttggccaggatggtctcgatttcttgaccttgtgatcctcccaccttttttgttgtaaaataatccttgatatgctttatggacaacccctccccacggttccacagaacacagtttgataaacatcaatctaaaggtactgcagagaggctgagatgctagtgtgtcttgcagagccattaggaggcactgtctccacgtactgatttgattgtattttttcatgctgagtctgaccaatttcatggattcagtaaatagtaagacttggtttaggggccagcagacaaggatcataacatctttgaggtggaagaagtcctagacatgaaagaggttttgtgaataaaaggtggagagggaaaatgaactttacagtcaggcagacctatgtttacatttagcttctgagagccttagtttcctcatctgcagaaggagattattagtatcaaccacagagaatcactgtgaggcttatatatggtaatgtacgcaaaaggcctgccctagtatccagtagctagaaagtaacgtgaccaaaataaccaggttaagttggggtagagtcaggattagcctcacgacttatagttcagtactatttctaccatagtgatctaatttgaagaacaagttagctaatgagtgcatcttgctgtaggtccaaaaacaacctccaagacaaactcagcatttcccttacaacaatcagcatgggccgggcacggtggctcatgcctgtaatcccagcactttgggaggctgaggcgggcggatcactaggtcaggagatcgagaccatcctggctaacacggtgaaacgccatctctactaaaaatacaaaaacaaaattagtcgggtgtggtggcgggcgcctgtagtcccagctactcaggaggctgaagcaggagaatggcgtgagcccgggaggcggagcttgcagtgagccaagatcaggccactgcactcccgcctgggcgacagagcaaaactccttctcaaaaaaaaaaaaacaaaaaccaatcagcatggcagaaaaaagaacgctccgaagcaaagctgcaagcattaactattgtacttctgatgcccatctaaagacacacaggaaatttgcttagaaattataacacggtggagaagtaaacagttagaagtcactctcaactgaggctgtttaggtatttgtaactatgttaccttaaaggttactgttctaataataaagttgtcctgtcctggctgggggtggggggctgggggtgtggggatgggagtgcagggaggtaggggtcttccggacactgcatcaggggaggtagcagcccctcactcaggtgtgactaggctgggataacatggatactgtggtatccctagagtatccatgttatctggctttagtgatggcattcctgaaaatgaaatgtgtatctgaaatgtgctttctgttaagatgtatcaaaaatttatgttttcctgaattttaaaactgactggtttagaaaaatgaatggatgacttcattttttctactttgttcaaatctagtctaattaagttttttttttttctgcagcgtaagacatgagttatgtcagaaacaagaggttctgatatttgaaatgactaaacacgaagggggctcccaagggaagttagggtattccttctgaaagtccttcaagacagggttgatttttaagtgtttgggatggctcaaatgcatctgaaatagattaaaactgaaaatattagtgcatcacatatagtaggaaagtattattttgtgaaagggttttcaattacatgcgtgtgtacattttatatgtttatagctcttgatgtaaaatgtatctctttccataggtagcagcaacgtaactttgaaatccactggcctagatcagtgctctccaaaattttggtggaaaacccctattagtaaaaataaagaattgattatgaataccaatactgattcaatgcaaatactgcttctattttatatacatttaaacacatggaaaacaaaagatagaaaaacaaaaaaaatttaaaggaggatataaaaagtaaatcaaacacagaaattataaagttttcttcctgtagcccaatgaaccatagtctggagtccacttcttttagtgtagctcccaattccattagaataccgtgaccccaatttcaaactacatatctgtttaatatcatacttgatttcagtccacaagcacataaatgagttttattcattactcatctgcagcctattcagaatacaaaattttctggaaaggacttagaagttatactaacaacccagttaaagcagcctaccaatgctatcagtgagaagagaaaaataatacagagtggtagcctcagtaatgccgctatttatactcctacatatacctctttctgaaaaagattagtttagaaaatctggttttgtgcaatagatctaatataagaattttataaagaactatcaataactttccaagttatttgttttcacaagcacgtatttatggaacgttttacatttcttataatgttaatccctgattcaaaggaattaattattcctatatcaaagtattaatgtagaaaatgtcaaaaagaaaataagatttttacttttcaactatacaacttcaattaaacctacatcgcagcttcaggtttcccgtgtgagtcacgcgtttctagaatgcattctaaaactggtgcataggtttggtggtgactgggtaccaggtactgtgccagtcatttttatataccatctgatttatgacctctgagttcagaattctcttcattttaaaacgaggaaatcagctcgacatccagttgagtgggctggtcaatgaattggcaccatctgagtacagggtcctcactttgcccaaggttcctgaagcatgaacataaccaagcctactccttggaagctgggctcccagtacccctagaggaatatctttttgacagaggctgccagatgtccgcctaaattcctcttttctctggttcctaggcctctactcaagggtccattactgagactccctcgaaggtatatatagccaaatgactaaggcctagcttaaggatcttaggggtgtgtgctatttctgggctgggattatatgaaagatgcatgcctagtttataatttcattcccctctgccagctggatcttggatgtggggattaagcttgaccatggagatatggaccaggcccagtgggataataaaggcaaaagatacaaatgcccctcagaagataaccaccacccacctgaaacgcccaccccaggcaagaattatgctgcggttgtgtgtgagccactgattacattgttggctttactgtaactgttggcagtttagtccacaataactggacgcctcaggtcctgacaatccatcctgggagagccagggactgagacatgaccacaaatgctgtcctagccacctgcacccccaagaagatgcttgaatctttacatttacaaagcacaggaaagttaggaggatccatcctgaaacgtctgctagtgagtctagattttcaaatcagaaaattggcagaaagagccctgcattccccagggacactgcgttgaagctcaggaaaccagcccacatggagcatggggaagggcttttgggaaggctggaggacaaggcgtgtcttaggaacacccagtagcttaaccgcagggagcagaacttacatacagagggctcacgttcaataggccttttctgaacttgggggtgctgagtatttaaaaactatttcagaattgagaaactgattgttataggataaaatgtgtacccccaaattcatacattgaagttctaaccccagttcctcaggatgtgactctatttggcaatagagcctttatttatttatttatttatttattcatttatgagacagagtttcattctgtcacccaggctggagtgcaatggtgccgtctcagctcactgtaacctccgcttcccaggtgcaagtgattctcctgcctcagcctcccgagtagctgggattacaggcgtgcaccaccacgcccaactaatttttgtatttttagtaaagacgggatttcaccatgttggtcagtctggtcttgaactcctgacctcaggagatccacccgcctcagcctcccaaaatggtggcattacaggcgggagtcactgtgcctggccggcaacagggcctttaaagaggtaacatgaggctattggtgtagatcttcacccaatctgactggtgtccttagaagacgaggagatgaggacagaggcacagagggaaaatagaccacaggaggacacaggcaggacgatatctaccagccaaggagagaggcttcaggagaaatcaaccctgctgacaccttcatctcagacttccagcctccagaactgtgggaaaattaattcctgccgtttaagccacccgggctgcggtattttgtaatagaagcctgggcaaactgagacagtagttgatggccgggcgcagtggctcatgcctgtaatcccagcactttgggaggccgaggtgggcggattacgaggtcaggagatcgagaccatcctggctaacacggtgaaaccctgtctctactaaaaatataaaaaattagcctggcatcatggcgggcacctgtggtcccagctactcaggaggctgaggcaggagaatggtgtgaaattgggaggcagagcttgcagtgagccgagatcgcgccactgcgctccagcttgggcgacagaacaagactccacctcaaaaaaaaaaaaaaaataaaataaaataaaataaaataaaataaaagcactgctgtgcttgagccacaagaaagagctgtcacaggtagcagcttgggggagggatcaggagtgatgctgaggaagtaaataagattacttctttgaatgctgttcttattcctccttccttgtgtttcaccactgccttttgtacagtgttttcctctataaatatataattccaagactggtgatgtctagtaatggttcaaaaagcagaaaatataagaaatattattttttccaaacactcgagtagaatcagtgatggaacatgtgagatcacctggagggcattcagactttactgcaaataaataatacaattacttggtttgggtattagatatttatgttcatcttgacattagaatattaagccactcctcctcttgctaacttggtatgcattgaaaacatgaaattctctcagtctcctgctttggaaccaaacagtataaaccctcataaatatgtaaatcaacccctctaagcacattattaattatttcaaagatagtaggaggtcactagctcatagcaatttctatgcatgaagtctcagtaacacaagacatcgcacagggaggaagaataaagttttatcacagttaccgaatgtgtgtgtgtatgtgtgtgtgtgtttgtatgtaagtggccaaagcaacatacagtattgaatgcagcaccactaggctctgaatagacgcctgtgggtgatgatgatggcggtagtgatgaaggaacggaatctacagctagaacagtatttttttttgaacctgtctgcaccaggaataatatttttaaaatccaaagggattccagcctcagatacacttaaattgttcttgacccacatggccctgctttcttctggaataaagttctgactagttgcaaaaatccatagctcaggaagatatagcaggcatctcatttcctgtgacactgcagagatcacagactgtgttgctcaatgtgtctctaatgttgcatattgccgagcggctctctggctgctgtaagtcagcttcgtttaggtgattctcagcaatcgacatgttctgatataggccgtggggctcgctgaggtggaaccacccaaaacaccaaatctgaagcagttgaggacgttggatacaacactgacagatgatggaggatatttaacacaggcaatgaactctgctttttacaattcatcaaacaaatataagacgcactctcaccaaagtgcaataaactgatcttgtcatccaagcaattcttcccagtcactagtccagtttgcttttaaatctctgattgtaagcttaaaatttatctgatgaaaaagataataaactattttcacacccaataacacacatccctcaacccaatgaggaagacagccattatctagtgtaattaacaaaatatatataacaaaaataagaatgaaaaaaccttgaatggaataatttgcacatatattcagaggttcaggactaggagtattactggaatttagatggttctggagagggacatttggcaaaacctttcaagcactactagtttgaaagttaaaagcaggcaaaaacttgcattatttagggttgtatatataggtggtagtgctacaaagaaaagcagggaatgataattattaagatcagatagtagttatatctagacaggcagaggaagcggctatggaggagatcacacggaggcttctgggctgctggctcacattgtgtgatccaggtggtggttacagaggttttctataactatgcaaatctataactatacaagtgctataagcactcttgtgtatgcataatatggctcataataaatttaagaatacatcaaaccatttaaaatgatatatttaaaggtcaattagtattttattgactacgttagaatcctcccagcctcaggaggtgcccactctgatgacaatgcagaatgcatacattcaaaaattgtgccaactgctgacgaggcagggggaaagaattcaggccattctactatctgtttatctatctatcatctatctatctattatcaatcaatcaacccatccatccattcatctatccatttatctatctgcacatacacactacacaaacacacactaaaaagaagaagaaatcctaaagacagctgttttgagcaacttttgtagctaccttaagtactgacagacatctttccacatttctttgcataagtaataaatttatagctaaaaattgtttgtgtttgccctcataaaacaaaggtagaatgtgctttttaagagtttttggcagaaatgggtggaaaaaattatttttattctctctgctattcagaacattcccaccttatttttgctttctcaaatgttattttatctttaaacacttaataagatgcagaaaaagaagaagaagaaggggaaagaagtcagtttggagagtcgaaattcaaggaaagtaagaactgggcaaagttgtcttggcgttcctcccagagaggaagggagtgatgctgctggagctgtttcaaacggacggacggaatcacttcatctgtaatccagacacatgcatgcatcaggcaaacataaaattctgttgtcttctctgaagtagaattctataaaggcagcatttccaaggccaaaaagatgaccgaacagacagtgccctgttgatccagctagaatgagctctgcaacaccatcaattttgtcctacagctctttttctggtccttgtccgtgtaccagtcactccttataatgaagtcacttgattgagtgttgttcctgttgcaagcagggagaggaaagctgagaagccattcaataaatgttatgtttcgccctcctctccaccagcgttagagactgctgtgtgttgacagcccgtttgctttttctccttggcacagggccagatcctgtttcctcccccatcctttctactccctgagcacacacacacacacacacacacacacacacacacacacacacacacacacggcgtggctaggcagggccatgtggctgagttctggtacaaggaacgtggaaataagtgacatgctccatttgcaggcctgggatctaaacctgagtctccagtgtggtgtgctgcttgctcttcctccgccagctggccccatgaagaggatcgagctgagacacaggggctgctgtgggtgacagaaccagaagatggcaggattcgggtctgggtccctggataacggagtggagcagaggccccttggccaacccacactggaccatgacatgaagggaaatcaatcttgaccctgttcagccactgcgattccagtgttgctttggttagagaagttagactattaccctgactttacaccgcctcatgcatccaaatcaaaggaaaactgtcaaaattgctaaatcattcccaaaaataaaacaggaaggagtttaaactccgaagcttaggaagtttgatttaatttcaatcaatttggaggcagaaggaactttgaacttggactacaagcacatcaggagttagtttcaatgtggcttcaatcctggtgccaccattttcacagtggcaattataattatacaaggtccaggagctagaaagagaatggactgtctgtttcagcgaggcaggcaaacagacaggcagacacatggagattgcatgtggataggctctgggtagtttaacattttaaagcttataatacggattgccaaattgctttatggaaatatatgaatttatattcttacctcttttgaatgtgtgtccatcattttatattttatgctttaagttagcaattcttttttttttaagacagggtctcactcagtcactcaggctggagtgaaatggcacaatcatggctcactgcaacctcagcctcccaagctcaagcaatcctcccacctcagcttcccaagtagctgagactgtagatatgccccaacacactgacctaatttttaaattttttgtagaaaaggggtctccctgtgttgcaccaggctagcctcaaattcctaggcttaagtgattcacgtagccctcccaaagtgctaggattacaggcttaagccagggcacccagcctaagttagcaattccgtagcaactaattatgttgaatttttaatatgcgtgttggccatttgcatatattcttttgtaacgcatcttttaatatatttacctagttttccaatgtgttttaggagttatattaacatgattatttgtatttaggagagcaatgttcgaaaaccaaaaaatattccttcatattagattttatgttttgctccctaagtaggtgtctgcaacccaagtttcttgactccctaggcatcgagaatatctctgtatctaaacaggatcagaactgtctgtctcatgctgcactatgactgacaacaaccaagaagcataacggactatagttggtgagctgagataatagatggaaagggaattgcattctaagttaggtgaaaactagaattacatgaaaagtgacctgggagtacaacagtaaaaacaaaaaacaaaaggcaaaaacataaccgatggacttgaatggtactaatggtgaggctgatggcatttcatagggaaggtgggaaactacttcctcagcccctagagcaacagaaaaatctgtgctaccagggcttataaaggacaagaagtaagtgcattttgcatagtagccatcattctacagtagcactctcaacaaatcaacctaaatacatgaagctccaccaagttgggtgagtgctactcagttttaaaaggagatgcagagggtgcttcatcatttcaaaacaattccgagcatagactactagtaatagctggcagcaaacctttcaggataattaaaaagattttaccaaagcccatacctttaggtaagagtttgtcagaggttctggaaataggctgttttggctatgtttgtcaatcttattttcaacttcatcaaaatgtactgaaaaactcatgctagctagcaagtcaaatcactagagattacatagacatgggcagagggagtatttttgcatttatgaatgctacagactcccattgaaaatgccttcttgcttacagactgcccaccccagagtagttcttaaatatttaaacgtgggaactttaacaaaccatgatgcctaacctaaaaggttaccatttaattggtctgaggcatggccttggcattgggatctttaaaaacttccatgtaactgaaaagcatatctggggttgaagaccacagcctagggagaggcagggcagcagagaagcaggagtacggagctctggagccaatcgtatctgggttaaactctcagctttcctcctcctaactctgtgatcctggttgcttaatgatatcgagcctttacttcttcctctgtacaaataagaataataatttctaccttatagttgttttaaatatgaaatagtgctaataaattagaaatgttcttttcttgaccttcttcccatagaactttcaaaggtatgatagtttaactgttgaggcaggcttatctattcacacagtgattaggaacgcaggcgctagagccataactctctggctttgtacaccagcatgtgcaatttaatgaacttctgaggttccattccttcatttataaaaatgagaagaataacaacatccatcctaatagggttttctggagattcaatggaggtttatgagtaagcactaagaatggcaccatatttatagtaagcgctcattaatcattactcgtttttgaattttagggaaataaaatttcatatcctacccttagaaagtataacacaatatctggtcaaagaatgagttcacactaggagagcagggtttctacctggatggtattttaagccagttttaattattcaccatcataattttgtcaatgaaaaagattggttcattgttgcctggccataccttgaagaatgtataaggtgtttagcttaagaagtttgaaagagacacaaaaaactagacgatggaaacagaaaagaacatcttattacacacatcttgatagcaagaggtattagatatttatctagaaatgaatatatacagacactgttaagacgtttggtgcatgagaccagtgtaatttggaaaatggtttgctaactctacggatattctcatatatatatattatatatatgagaatatatatataatatatatatacacaatatataagagatattttatatacatatatatctatatatgtatatatagatatatatgtatatgtatatatgtatatatgtatatgtatatatgatatatgtatatatgtatatatgtgtatatatgtatatgtatacgtatatatgtatatatgtgtatatatgtatatgtatacgtatatatgtatatatatgtatacatatatatgtgtatatatatgtatgtatatctagttaacagtcccaggggtttaaaaattattattatggtcttataacatctgtattcaaattctattacatgatttcctaggctaaggagacactaaataatgaatttgggggaaaggaccatttgtatgggctaggggcagggtggagaggaggtgagggctatagctgcatttatggaaaagcacagaagatcctggaacagtgccatgcatgggacatttgcttcttccacaggttgagtggtgactatgccaccccagcaggaggagtcattccaatttgtggtgatcaaagtcctttggaccacaccaagatagaaatacaaccaccaaacaaattcaaagaacatatttaccaataaatctaccccatttgcagcttcattcacactcctaagttcaggaaaatcaaggaatggattggagctatggattccagtaccagattaatccatcttttatgattagatagaaactttatcattgaaaggaaccgatggctttagggataaaatgtcctttgattgcataaataaatcttgctttaattttcttggaggaattacaatccaaaaatagccagtagtccccacgggggctcaaaacaattcgcacaggcattttaagctgggatggtggagaggttaatggaccactcttcagagaaatcagcaagggccactcccaagattccatacgtcaaagacaacactggggtctgactctggaggtccagccattttatacaattagaattgctgaggaggtcagccaagaacctccagagaaacattccacagcaccaggagtgcacgatcagcaacgtgcccaaagtgcccatcgtgttgtcaggggctgtgctgcatctgaccacagacaggatcaggcatggactctgaagccttcccgtagcagtccagcttccataaagctgtgctttcaatacattatttgtttctttacagaattaactgtcatttctgttttccatacgtattattaatatatgttatttatttatttattttttgagactgagtcttgctctgtcgcccaggctggagtgcaatgatctcggctcactgcaacctccacctctctggttcaagtgattctcctgcctcagcctcccgagtagctgggactacaggcacctgccaccacgcctggctaatttttgtattttcactggacacggggtttcaccacgttggccaggctggtctcgaactgctgacctcaggtgattcgcccaccttggcctcccaaagtgctgggattataggcatgagccactgcgcctagccaacatatgttatttataagattcatagacattgatataacctttagctccaccacagaagaaagctgtgccctgggagtaatatgggttccatcagctcttgttcctgataatctaccattttgatttatagtttgataagctttgatcctattctttcctttcctttcttttcttttttttctctttttcttttcttttcttttttttttttttttttttttgagatggagtctcgctctgtcactcagtctggagtgcagtggtgtgatcgtggctcactgcaacttccatcacctgggttcaagcgattctcctgtctcagcctccccagtagctgggattataggcatgtgccaccacacctagctaatttttgtatttttagtagagacagggtttcatcatgttggcctggctggtctcatgcctagcctcaagtgatctgcctacctcgtcctaccaaagtgttgggattacaggcgtgagtcactgtgcccagactataaactttgattttctatttctattttgttatcattttattttatgtgtcttgttctatgctccacgaatcaaggcaaagccaaataaaccaagaagagagatcaccagatagatgggtaattggctgatttatgcattgaattataggaaatcccaatcccaacctacaatgaaagaatgtccaaatgcatgtttctctgtaaatatacacatacatgcagacatagacacaaacacaatatgtatatgtttactggagtgcatgcttaaatcacaaccaaaataacaaaagccagtgtacattgcgtgcctactgtcttcagcatgtaccctaaaggtacttcataaggcattattttaatgtgtccacataaaatgatgctaatgcattatccccattttacctaagatgaaatcaagtcacactaaggtgaagaaccttgccctgtattatgtatatagtaagattcagagccagcatttgaactaggcttttctgaggtgccgtatataaaccaggatttgtgaaaaatggttcactggtttatgggggtaatattaggacttacacaggtattatgcaaaaaatatgaaaagaattgacctccacaaagacttaatgtacagaatgatatgtgtaccatctcataccctagcctgtatattggatggtcatatgtcatgtattgcaaaggggttatcccaagggaacagggagtcccacaaccaccactggagagtggagccctctcttgtcagtcacctttcagcagaaggtcatctgtgcttggctaaaagaataatgaataacttatctcattttaattaaattaaccctattaaaacagataggtgacttaaaaataatccttcaaagaaactattaattaaagatagaagtaataatctaaacatgaggaaaatgagaaaacggcaacactgacgatgtcggtacatacgtgaacatcaatgtgattataaaataggctccgagacagaagctaacgagagtagggagccattatatttagcaagacatttaaaaactaagcaagtaataaacaaaatgagtgtctctgttgagcaaatattaaagaaaatccagtttgttcttgacaaaataaaatctatgacatctgaaagtttctctttgcataatatagggaaacattgtaattggatatacagtttttaaaaaggctgaaataacacatgctaaacaatcttgtgacaaaccgaactatattttctcatgagtgagtacttacggagatacatactaaaacatggctgaagctatgaagaaacagggatggaaccgaaccatgccatgtggaagactgactacacagttgaatggcagtacagttgtttctagcctgtctcagcttctggttactagttcattttttaaaatagcaaaacacacaaatatgtaactttagcacttgtagttattaaacattaaggaaaagaggtgccagggaatataagttctcaatagcaactggtattttaaaaaataaaagcaaatttctatgagtattatatttaagtaaccagtgatgaggtggccacattcacaaaaaatgtgtagaaggattccaaagaaactttgcaacgcaacatctttccatccattcatccctgcctcactccctattaaaaccaagaagttgaacccaagagtgcataagattctgaggatggcattggcatactgaatttaaaaataaaagtctaaaaggtgtttaaaacacaattaatatttagtagaatccatataatgcattttaacaacatagagcttgaccacgcaaaattcttttcaaggaggttgttagttatctcgtggcaaagaaccaccgaaattaaagttaatttacgcacattctttacaagtgacccaactttgctaatcttttctgtatctacaaggggctgtcaacagtgtgctatacagaaaatatttttgaaaataatatatgtaacctgtccctgaaagaaaaggtgatgttttcaacatgactgagaaaaagaaacaccaaaggatcctaaacacatgaaaagatgctcaactttgtttaaaattaaaaagaaacatacagccaactacatagaataacatttctcaaatatataattagaaacaaagcaaaagccttgcggctcccctgttggggaggaagtggagagcctgatactgcactttgcaattgctgatgggcatggaaagcgcaccactactgggagagaaatttggaaacagtaaaataaatacacattttccctttggtgcagtaacccctcttctagggagcagatcccagtaatactctgacaacaatatgaaaatacgggtgcacacaagtctattagttgtagcaatatttacagtaaaaaaatgaaaacttagtgtttgccagtaaggaaaaagtaagctatacctacacaaaggaattcaataatgctatatatttttatatgtaagaaaatatctatatcggactagggagtgatctttaaaatataataggtactatagagtgaaaaaagcaaggtaaagaaaaatgtgtataatctactttctacttaagaaggtgacacatctataccatttttgatatcatctatagtatgtttacctatttttaaaataggtgattgtttttaataaacgtttacctttgggagagaaaaggaatattatttacctttatttatttattatttacctttgggagagaaagagaacgtagataaagggtgtatttctttgaatatagcatgttttgtagcttttgctttggaataatggaaatattttacatattatgaaaacacaataaatttaaaagcaatgaaaggccaggtgcagtggctcatgcctgtaatcccagcaccttgggaggctgaggtgggcggatcacctgaggtcaggagttagagaccagcctggttaacatggcgaaaccccatctctactaaaaatacaaaaattagcagggcatggtggcatgcacctgtagtcccagctacttgggaggctgaggcaggagaatcacttgaacccgggaggccaaggttgcagtgagccgagatcatgccactgcactccagcctcggcgacagagcaagactccatctcaaaaaaataaattaattaattaaaaaatttaaaaaaaagcaatgagaaatacatattcaattgatgacataactatacattaacttatatgagtttatatccctataaggatataccctaatgacaaaacaaactgcaaaaatcttaacattgttttcaataatcacacttaggtgatggtgtcgatactgtaatactgatactgttgtgggtgcattccaaagtaaggcaaatgagtaattttgttggtatcactcagtaacagaatttttgccaagggtgaaagaaacaacagttgtaatattggtgacttttcaatgaaaatttggtaacactggatttgaactgaaaatgttagtataactaatattgcatttgtacttaaaaaaaaaaaagtctcctagcttattccactaggcctagaaacagtaaccaacatggtgacaatgagcattccaagcaccaagacttttaaatactatttcctacgaaagggagccagaggtcctgagaaaaatggctgcttgcaggtcattcggcgagaattacaagaaaggtcgagagcaccttggtacactgcaaatcctgactaatgggtgcaggaaggttcactgtagtatttttccttacttttgtatgtttgaaatcgtctaaaataaaaagatacacattaaaagaaaatgggttcaaaatgaactgataactaaaaagatagagtgtgaagggaagacttgaaaatgtgtgtttagaaatgtttctattgtttgtggctttgtgaaggcagaaggcttaccaaaacaaaattgtcacattaaaagcattacagagttttccaatctgtaaataataaacttcactagattttggatgcttttgttaaaaagaaaggcacaataactttcaacaagttttccttaacaatatgttaacatatattatgtgaatcttagttttaaaaatcattgcattattggtagatatgcttaaaagtgagtatcataatttacaaagtcaacaaagaaattaatttattccatttggatctttttatcatttggaggtatatttttcagctataattgacattaaaactaaatcttgaaataaattgaacttaaaacctcaccattgagtcaaggtatcccatagtttcaaattaagttttgaagaattaatgaaacatatttagtcacattgcagtcatttatacatagagagagataggaacttttacttcactccaggtacataaattacctcaaactagattaatgacctaaatacaagaggtaagctattggtagaaaatatggaagcaaatcatcatgatctcagatatggcaatgaagtcttttgtttgacacaaaaagtattagcaacaacaacaaaaacagataaattgcatttcatcaaaactagaaacttttgttcaccaaaggacgttatgaagaaagtgaaaagacaacctatagaatgggagaaatatgtgcatatcctatatctggtaaggatccagtatccagaatatataaagaactcttacaactcaacaacaaaaacataactcaatttaaaaatgagcaaagaaaggacttgaaccgacattcttataaggaagagatatgaattaagataatcaacatcacagtcattagagaaatgaaaatcaaatccacaataagacaccacttcacacttactaggatgactagttagaaacagtaacaagtgacgacaagaatgtggagagagagaaacctgggacattgctacactgctggtggcaatataaaacggtacagcagctgtggaacacagtgggcagttctcctaaaggttaaacttcgaattctgcttctcggtatatatccaaggtaaatgaaagcaaatgttcatacagaaacttatatatgaatgtttacaacggcattattcataatagccaaaaagacggaaacaacacaaatgcccatcagcagatgaatggacacacaaattgtggggtatccacacagtggaatattattcagccacaaagaggaaagaaatattcatacacgctacaacttgaataaacctcaaatacactatgctaagtgaaataaggcagacacgaaaggtcacctattgtacgatttcttttataggaaatacctacaataggcaaatccatagagaaagaaagtgattggtggtggccagggctaggacagggggtcacaggcagtgattagctgggtaggaggtgttcagaaagttttgaagccaggcagaggtagtggttgtgcaacattgtgaatgcacaaaatgccactgaattgtacacttgtaaatggttaattggttacatgaatttcacttccattaaaatgtatatatgtaataacagtatagtacaagtaaagggtgctttgtaatgtgaaaagataaaatattaagtagttcaggtttatctcattctgctttctttttcacatatgttattttatatatattgggtatgtgttcaacattttgagtgatagaggtatacgatttaaaaattaggtaatactgctctagttccacggtaacaaatctagaacatggagagtgactctaacccacagaaaaacttagtataccttggctgaataatattgacaaacttattctcaatgcctttatgcaaataatgcattttccagttcaacacaattccttcattccccagaacttttatcttttgcgatccaaacattaatgtttcatatccagcaatgatcaaatttaaattcttctgctagggtttacgtatatctaagccagttttacatcaataattgttcttctgttcttcattagcattagagatggagagaaaacatgctagacttacccacacaaggcagggagtagccaagttgagggtcgtgaacaaactgccgatcattgagtcttgtcacacagtataagtggaaacagtctaagcaaatcacgtggcgggagttgcactggaaaaccaggacggggctcctgcagagagaaaggaagatgtttcctctagtacctgtcagtgtggaaaggcagcacgtgctttagaccaatttctgtaatcctggagggttgtgtagactgtgctctgtgcaaagaccggagctgctaagcattaagctcatgtataccaacacaacatcttaaaaattggaggcactcaatgaactacatagaaaactgattctcctaattttacattttttatgttaacacatttatcaatcttttgattaaacctgagctaaaatataatctctttctggaagtcttccctgactcagaattcccaattaacctatcaaatcatcccatctgcttgtatatatttctattgatccgttattacaccacagtattcatatcttctcctttctcatagactgtgatctcctggaaagtagttcctatgtttattttgctattcccatagtaccaggcattgtaaagttttaaatgaatgttttaaaaatttaaatctttaaaacattttaaatatttttttcctccaaagtattttaagggaatcaaaaaaatttaggacttgtatatagtgatttactagtaatcccataaacataattagagaaaattcaacagtgaaataacagattttcaaaattctgctatcccacttattttaaagcaatatgtaatacaaaacaaagaaaataaaattccttggtaatttaattataactatgttataacaatagaatctgaatttccccactatcaaaagaaaaattactattgcatcaaagtaaaaacgttaaacattttctcacattttattggcaaataaaaaagtagaatttagggataaaaggttatccaacagggattcttctactgcaagattttgtctattgtgccatctcgaaaccatccaaatattcagtttctcagagtatggttatgggattactaattaatcaatatatataaatcctaattttttttatccctttaaaatactctgtagaaaaaaaaatcttaaaagccatgtatttttactggaaaacgaaccacacaagtttatgtcaaacaggagacaagctcaatacatgaatttgaaatcagccccaaggcgattttaatagtaagaaagttattggagtctatttagataagcctatttcctatgtaattgtaacaaaatacaaaataaacatgttcattttatacccaatctttaacgcctataagagctcttcaaaagccctttttctagagaaatgaataatactaataatataaaagataatttcttaacacctaaaagattttcaaaattctgttatcccacttacttcaaagcaatatgtaatacaaacaaagaaaatacaattccttggtattttaatgccatggatgtgtaagtaatcggtcaacttaatctgagcaagggcgcacctaaaggtgcggcttctcctttcccctcttggaacctatccaagtccttcataatgctttcctatttctaaccaaacagtcactcgcatacacatgctcaagcacacacatacttttttcactttgcgaccctatgaagctgctgtattctacctttttctctcacagctgttatgtgaaaaatattctccatcttgctttcagcaacatggtagactaaaacctttatagacctcccaatctgctactaattcatggagaaaatattagaacatttatgaaaatgtgcctgtatataacaaagttaaaaagaaagcttagaggccaggcgtggtggctcacgcctgtaatcccagcactttgggaggctgaggcaggcggatcacgaggtcaggagatggagatcatcctggctaacacagcgaaagcccgtctctaccaaaaatacaaaaaattagcccggcgtggtggcgggcgcctgtaatcccagctactcaggaggctgaggcaggtgaatggcatgaacgcgggagcttgcagtgagccgagatcgcaccactgcactccagcctgggctacagagtgaggctctgcctcaaaaacaaacaaacaaaaaagcttagaaatgaccctgtagaggaaacataaagaaaacttacagagcctaaatggtcagcccacgaactcccgccacagtggcccagaaagccatggctgcgtggtatgcggccatcagtgtagcttctgcaggcttttccattcctgttagaagagttctctctcacatggatggacaacagcacacttctatagttgtctccttcagttttaatatgatcccaaatgactcataccatctagacaacacatggaacatcaattgtcctactctattaatgacatcctgctatttggagaacattaacaagaaacaagcactacgttggcggccatggtgtgaaatcaaccctgtgcagtgacaggagccattagggacattagggaaagtttagaggtccaagtcttggggcctggaagtgcacaccttccaatataaatagtccatcttacccatcctgcaactggcagtgaagcatagacagctgcagatgcggtgggtccagagttttggttcccacagagtgaagtgtatcttcctagggacacaggaagagtcctactgaaaactaagctacagctgcaccaggccacctcaacctccttgaactgaggatgtctaccttgaataaaaaataggagaaattggcaccaggtaacagtgggttaccagagagtgagcagtgaagggactagcattggaagtgaagacagagactcatgtaactcccttgaagaaacgccactgcccagacgcaggtgtggaatgcaaccggggaagctggaatgttgtgtgtgtttctgcatgtcctcttcggaaaagaaagaaatttacaagttacagggagtcaaaaatgataaatgagtcattcaggaattctgattgtctattactatacatacacagtcaacttggatatatacctatatacagatatagataaatgatagatacagatatcaatatatgaatgtatgtgctaagatacacagatgaagatatagaaaagtatatatgctgcctttatacacacacacgcacatacacagataatgttataaagacggtgtatatgtgcatttcacatagaattatcagtcacctggaattcttgatacagctgtgagctaagattgctcctctcctattaagatattccttgtagttttggaaagttaggtgaggaataaacatgacaccaataaaaagttattagattaatcacctaaggaaaggagtaaaaatcttttcatggctagaaggtctacatcattaacttcctaaatgctaaatcaaagaggaggggaaagctagtgtttatgggcacctacttcgggttaggtggcttgctaggaacttcgcagacttcctttcatttcatcctcgtaaaataaactgcccctcccctaccgtccatcctgttctctccgcacctccgtcccctccagctgggaaggtccttgcgtagcctaggattcttctagttcctgtacacctagatgcatgctctttgccatctagtctcacggtaatactcaccttcatattcaaagccaaatcacaaattcctaggtccagttcaagactaaagatctccaaggaactttctctggagcctaacacctcactgcctcttccctttttctttacctttcttcaatagttatttaaaaagttcatctgtaatgtacttcaatactggcctgacttttgtttaaagtgtttcatatactccttccttagctatcaacattaaatgaaaagtcatgaaattgtagagaccctacttgcttaaccctttcatgacccatgcctcatcaaatacaatgctgagcacctgatcgttttgtaatcaagagttattgattattctagtggataaatgaatgggtcactatttttgtagtttctcatacttttataatttctctgctctcatttacatgttgttcactaaatttcttattgaacatctactttgactaaagtaggcacttagtaaatgcatgtggactacagcacccagtgagtggataaataccttatagttatacttggcttacacaatcacagggcgtagttgagagacataagattaccatggaacaagtattacaaggaagtatctgtaatccccaaactctgggagcccgaaagttaggaaaagagaattattgagtcaggatggatccattagggaacttgaattgaatttaaagaaacgggaggattgatgtttggtcactggaaagaaatgttgtttctaagcaggaaggaatcacagacatgcaagtatgcttggaacagaagagaaatcaggtgggctgatcaaaaagatgtatcaggaaaatggtgggggacaagatgaaaagagttgagaacagaggagattctggccagggatcagggttgactctaggagacacacctagcataaggcctctagactgtgggattcactgaaggtttctgctatggtctgaatgtttgtgttccccaaaattcgtatgttaaaatccttatctccaaaatgatggtgttagaacacggggtctttaggaagtgaatggtgtgagagaagagccctcatgaataaaatgagtgcccttttaaagagaccccggaaagctcccacacacgttccaccatatgaggacacagtgagaagccaccgtctatgaaccaggaagtggggatctcaccagacactggatctgccagtgctttgatctaggacttcccagtctccggaaccgtgagaaataaattcctgttgtttataagccaccagtttatgggattttgttatagcagccagaatgtactaagagagtttttaaacatgggaagggaatgatgttttagtaagtttagctccgacagaagtatggagggaaagctggaagtagtgagaactacttgaggtcattttgataatttagacatgagttactaagaactggactatgatgtgcaaatggctctgggagtggaaatgagaagaagaacgggtgacatttcagagcaggacccgccaggacttatcctctcatgggtcttttgttcctcctgacattcctgtgtgccctttgctctaattatctacatataaatgttaattgatcgatccagagatgatttcaccccaatgggccaggttaaagagcggtaaattaaaggttaagtaaagttctcaattatatataaaaagacttataaatgctttccttgacaatgccaaagagttatttgtaaccaatgatttctctgttttgataaaaagcgaccctttgtttgcagaatatttaagcacaattgaaggagtttgagttacaaataatgtggcaagtcattcacatacattaaaaaagtagaatatggttacacagtgttccaaatatttaaattcttgtaaagttagtattctagcatctacaaaaatagcatgcgagtttttatgtttatctagaaaaatgtgcaatttactctgctgtccaccttgtttgttctctctcatttgccctccttcacacactctctggcaaaatctgtctgtttctctttctctccatttgcctgattctttcccatgtgtacatcttcatttatactcattaagagagaggctgtggatgaaatgtgacatatatcgaaagcaatgtgccagatatttcaagctatgcaaagatgaggaagcaaatctaagctctcaaggacatataaatccagtagagtgggcaggagagggaaacaaatacttactatacaggacagaatattttaagtcatgttagagagataggatatattgccacgctcacgctctggggtaagcagccttcaagatgttctccagtgagctccacctcctctgtagttcctctccacattgaatggattgactcacatgcaataggaaaagtgcagaaacggcaatgtgtgacttccaagagtaggtcagaaaagacaccgcagcctctgtctgtgctcttacagatcacttgctctgaggaaagcgagcagccatgttgggaggacactcaagcagtactatggtgaagtccatgtagcaagaaactggggccttctaacaacagctggcatctacttggcagccagttggcaagccctaggatgactgaagccctggctgatattttgactataactgcatgagataccctgagcaagaactatccagctaacttgctcccaaattcctgacctgctgaaactgtgagaggcaatgtttattattttcttcagccactaagttatgggatactttgttattcagcaatatctaactaattcaggttcagaggaggaggaggtcatatataggttgaagaccagaaaagaattcatgaatgtaggggcatttgaaaaacggtcaggattccagtgcataaagatgcagacaacacctgaggtcaagagaaaagaatggagctgtgaaagcacagagcaggaaaagagaatgctcagttatcaagagtggctggtttcttcattctccccagtggaaagcaaagttattacatatgtatgaagagcagcagcatctgaaatgcaatgaaaagcagcacaagttaaaataaaaatattacgtgcaaaatccttgaggaaataaaaactaaatttcctcacttgagggagagagtcttgcaatttagctaacacttgacccttgaaaattcacacattgtttccactgttcttagtttgtgcaatagtaacacagaagtcatgccccagttagcaatctttcaaagctctctgcaaactccacacatggagaactatgactcctgggcatttaacacagtatttgattagataaaagtaattaaaagaggaaagctacaccattaaaaaacatgaatttatcttcttaacgactgtcactttaagccccttttagttagagatggcttataaacaagaaataaatgactgaaatctcagagaccaaatgcattttaatttgatctatatttggcaaaattacatactaattgccaaagtgcacgactgacaaagaagtaaccggcacagcgcctgcccacaacaatgccagagagagcatttcagcccacgtgggtcgtatgagttcattatttgaattagccaagtgagcaacccccctcactggagaggagcctgctccgagatactaattgatagactcaacttttagaaattaacataagcttcaacagttgaatgatcttcaaaattccttccagcagccaagtctaaaatcctgaaatcagttcagttgtccattggcctgcttagaatcacagtcctattaaggcactggcagatcctgaatcagctcactaactaccccttctggtttttcttgcctcctctgctcatgttctccctgttttatccagtccactctgctgcatggaagagggtttactttggttctgtaagcttatttgcagaagtcccaatatttcagcatatacaacgtagccaaggtaaaattcatttatgtctacatttttgaatcacttttattcacccattctgccaacacagtggaccggccactagatgccaggcagtgtcatgtcacatcctataaaagtgaacaagaatgttccatctcctcaggaggtcacagtctatagagttgaagacaaataattaattattcatagtgtggtaagcactaccataaggatgaatttggagacacctagcctatctctggggttggaggaagggctcccaagatagctcatggctcagtgcatccagtctatatagtgagaagaggctgaacaaactaaatggcttttcctgtttataaaggtttttaacaaattactacataaaataatattgtaaatatgttacaaaggattatgaaaatataaattctctatctcctttcctaagagttcccttctcctcttaaattctcatccagtaagtcaacatcccatctggggtattcaatattgttaaattcaagagactttctaacctcggtgtttgtttccaagtttgactctgctgctatctgccctcggcactctgtggaccctcctgtcaggcacgttccctttcactcctgggcaacgacttgattttatgcatctcgtggcattggcttgtgtctacctggaatttttttatttaaaagttccctatcaaattaattatgttcccattgataggttaactcattttatttactgtcatgaaaggaaatagaaaagtttcaagtaacagccactttttctgttgcagacatactcccttcaatatatacctgctgaggttgagagtctgcaacacaggtgctataaaaataattgagtcaagatttaggagtggccacggtgcagtgtgccccagagcaatggattaggtctcatgagtgttggcggagtctgaattctcacgagcgtctgtctggccaagacctacatcagcaccgaggctgtctccatcccctcttccctccctggaccccctgtctgatcccagcagctcaccccagcaacactgttctaaagaggcttccatcctgacagttcttggccccaaaatatgaactagtttcgcagtgcccatgtattaaggcctcaggtttttcttctatcttttggagcctccataagctggattcaccctatggaatgtctttccctctttcccattcacgaatccctctgtttctctcaagtcagtctctttgctgctttcttccttatgctcccatccctacaggcaagactcctcctcttagtccttattccccccaaaactacaaggttcagctgaggcgcaacctcccccataagctttttcaataaaactccagataacatcgatgtgctattcactgtctaatttcttgtaatgtttacatttagaaagtattgcttttatatttaacttagcattttttttttgaggtggagtctcgttctgtcacccaggctggagtgcagtggcgcgatctcagctcactgcaagctccgcctcccgggttcacgccattctcttgcctcagcctcccgagtagctgggactacaggcacccaccaccacacccagctaattttttgtatttttagtagagacggggtttcaccaagctagccaggatggtctcaatctcctgacctcatgatccacccgcctcggcctcccaaagtgctgggattacaggcatgagtcaccgtgcctggcctaacttagtattattacatgttatttgtattactgttttcttttctttttttttttttttcttttctgagacagggtctcactctctagctcaggctggagtgcagtggcgcaatctcggctcactgtagccttcgtctcccaggttcaaatgattctcatgcctcagcctcccaagtagctgggactacagtcacctgccaccatgcctggctaatctttcctatttttggtagagatggggtctcgccatgttggccaggctggtcttgaactcctgacctcaagtgatccgcccgcctcagcctcccagtgctgggattacaggtgtgagccaccgagtccagcctcctttgtattgttttctacctgctttatgaacctgcaccaggtctctccaactcaaattcaacatatactaattggaaggctactatgcaccggtccctgcactagacctgagagggggatgcagctgttgctctcaggaagtctgtctgatgatgagaaaactcagtcagggacaccttggaagatctaataagaggccactcagtccaatgttggtcaggcacaggatatttcctgaaagaaggaaaatacaaactaaggccgaaaaagcaaaaatgagttagcctgaccaagaaactatagggaagtgggaaaaagatgtgaaaacacttcagatggagtaaaattaggtaagatcagggaaccatgctgtatacggtattttcatactgtcttctcaggctttattaaagtcccaaattcttccagaaattaaaaattatattaaaatataatgataatgcttctataagccacatacataaatctgcgttttaggtttatataatatcccaagtgtggttgaattgggttccattgtttacaacattttgagccattgacaataaactggctacgcaaaatagaaatacaaagccacgattacaagatggaattaatgtattattaattttctccagatgatttcagtcctggaagatacccatttgcctttagtctaatttgtgtattgcatttctaaatataattactgttgacaggttgaacccaaacataacccattaacttctcaaagtgctagattgaaaacattacaatgtaacaagagatattagaaataaaaaaattaacttctgttctttttaaaaagtaagttaaaagcaaagatgtcagtcctgttttgtagtaatttgttagaatgatttggtttaccctagctttcttgccgaggcttttatactagaaaacagacactgacatgtaattgtaaatagtggataaatcataatgaaataattgttgcgtgtaaaaagaaaagaaaagaaactaaaaattccaaagggtatttggcccatgggagaaaaacgcagctcataaaaaattatcacgatactttcctatcccccagttaatggagttatgttttttcaaggatgctcaaaattacgtttataatagtccaagttcttcagactctaatttcaggtcacattctattcagactgtcgatatgtataactaaaaaaagctcaagccagatttaacataaaatagtttctgggtcatatcatttgcacagagctgttatgtggcacaactatttagctgttggagatgccatctgtaatacatactaactcatgcacatatcttgtctttgtttttgcctctgtgcaaaacagctagaagcagataatgcccagatccactgcaaaagcattctgctaaattgagaaagatatgaagacagatcttgtttggataagaaccccactgtgaaataaattgttctgatgtatccccaaacctcatgacaggaagaattaatgtgctaagaatcagtccagtggccataaatgttagaagctatttaacataagaaattatttcagacacagagtggttttaaaaagatacatcttttgctgttgactcaccaaaaccctgcacaaacaattgtgtaccggtttttcattcattcttaaaatgaatgaatgtaatcgtatgctgggtcttttcttttctttttattctttctttctttctgtttttttgagacagagtctcactcggtcacccaggctggagtgcagtggcacgatcttggctctacaacctccggctcactgcaacctctgcctcctgggttcaagtgattcttgtgcctcagccccctacgtagctgggactataggcacacaccaccacatctggctaatttgtgtatttttagtagatggggtttcgccatgttggccaggctggtctcaagctcctgacctcaagtgatccacctgcctcagcctcccaaactgctgggatttaaaggcaagagctactgtgcccagtgggccttttatttcttttattagaggaatatttaaaaatcaggttgtctgaagtagagtggtttgaaatgaggagtctgccgaaaagattgtagacatcttaaaacagttcaacaatgaaaatgtctcaacatgagaaggtactgtgaaatttctaaggtatcattagatgagttcagcattaaaatattgacataagaatttctggcatatagtagataaaattattttcccaacttagttgtttttgcttgttttacgtgtatccagaaaaggattgtataccatcccaaagtattttccaaaatataataaaaatcaatatggcataacaatacaaatcaaaatgaattcagagccaggcgcagtggctcatgcctgtaatcccagcactttgggaggccgaggtgggtggatcaccaggtgaggagatcaagaccattctggctaacatggtgaaaccctgtctctactaaaactacaaaaaattaatcgggcgtggtggcacgcacctgtagtcccagctacttgggaggctaaggcgggagaatggcttgaactcaggaggcggaggttgcagtgagctgagatcgcaccactgcactccagcctgggtgacagagggagactccttctcaaaacaaacaagcaaacaaaccaaaccaaacaaacaaaaaaaatgagttcaggtgcaaacccaagataaaggaattcatgcaaagatgtgactgtccacccagcacatgggatgcagctggtggttgagcgaggtttgtaaagagccctaggagggtggtgtgagccggctgcagcattagctggcctcagaatcccatttctgtgaaacgaggacctgtgacatcagcaggttagatgggaccatctccagagactttctggatatagaggtattgccatcttcaatttatatgatcacaacatttcttttttatcgaaagcttgtaggacttaatcctcacttgaaagcacatacaaagcctattcatattttggatttcacctttcttgaattaatgcatatgctgcaagcaagggtgagaaactggagatttctagagattttactccctgggagacttatgagagggagatcttgatccagagtattccaggaagatcagaaaagatgttttggtgttaaaaacaaaaaaggccacaaaatattacatatagcttttagttttaaggctcctttgttcttttttcaactaagtcagctgatcaccagggccaggcacgcttacatggaagaagagcctgtgcagacaggctccctgggtcagcctgggcctccctgggtcaggcgcccctccactgtgctcggggctcccccacacactgccctcacccttttcatcacaggtccccggggtactcacccactggcttcaatgtctatgttctcgccagactagaggccagaaaactgggatttggccctcagactgcttttgccaataaagttttattggaagccagccattttacatattactcgtggctgcttttgtgccataatagcagcattcactagctgtgacaggtcctagatgggccaccaagcctaagttacttcctatttggcccttatcaggacatgtttgcttattcctgttcgaggctgttgactccacaaacacagggctatctttctgtattcccaatgcctggcctgtggctggtgtttggtcaatgtttatgttctcagtgactgacagtttgactcaaggaatgaatgactatcaaggaacagggacaaaagcgaggcaaacaacaatttttgcagtgtccagaggtctgcagtagatgactggttttgagctaagccattcaactgctgtcaaaagctgaaaacaccatctccccccatctgccagagttaggctcatccgttcagagagctgagtccagtttggagagcacccaatacttgcgacttccacataatggaaaggaaaaggcacaagaactttgaagagggcaaataggacaaagaacatattgattcccttattgaacaaaaatgtactgcatgcctactatgggccaggcacttagcattcaggatgtcattgtctcttcagattggaagggataggtattaagcaaacaagtaaaaactagcaatgaaaagtgacagcaaggaaatgccatgggatcatgtgatagtgctggtgcactgcccatgctgggtggcctgggaaggcctggggatgggacatttgcattgccatctcaatgacaagccatgtgcaggtctggcgtaagagggtttgcagggaaggagcaagtggaaaggcacttaggtaggaatgctgggcatttgtgaagaattaatcagggggttagtgttttggggacacagttaccaaggaggcagtggagcaagatgaggtctgaggagatgaaggaagccacatggggcctttaagacatactcaggaattcagcgcttggacaatggcaagtcaggacaaaattttaagtagggatgcaacataataccatttatgttttaaaaaatcactctaacttgaggtaacgaatggactggagcagggctacaaaggaagggagatgcatggacatggtgaaagccatccaagtaagaaaagagagtgccgtggatcaagcagtggagagggagaggcaacgacaggtagacaatatgtttggggcaatcgagtgcttgatgtctcctacctagctttgctttcctactaccatttgcagatttctcgctttttaggaaatctcagaatcatgccccaacatccatgggttcatggttctaaaagtcacacctttcatattactttaaatggaaatgaaccctttctggttctaagcaaatttaaaatctttgcttagagcccagattaaatgataatgagcctggtaacaaaatactatattaatacagttttaaaactatagctccctttaaaaaacatccactggattgactgatcccctctaccatgcccagtgctgggcacagagcagtgggcatgggatgcatgggctctgctcccactgatgacctgttgtgggcagtgtctggcctatgaagccccgtgaggctgttgggggaccatagctgatatcttcaacaggggagtgacggcactgggggacaaaagtgggaggtgtcagatatttaggaactaaaattgtcaagattcagagactcattaaccagagtcagaaaggggattcaggcacaatgtctggtgactcttctcatcatttagtgaatgcttctaatgtgccatgtttcctgctaagtgctttctcggcatcactattttaatctgcagaatgatctgcagaatgattctggagggcagggcccactcctgtgttttctctgcaatctcactgcctaatgctgggcctgtacctaggaggagctccaaaaatagtggcttaatgcatgaatgcatggctcccccacccctcccatgacaacaacagtgaaatccctaccatagagaaggacacgggaggaaacggaggcctagggcgctatcaaacacccactgtccacagcccaccggtgacggagcaggcaccagagccagcgctgcataagttccacccacattcctcaattccgcatgccagggcccggcctctgcggatgctacggacatttgctgacacagtacagtgactggaggagcagcagggctggaaactgagtcttctggttctaggcttgctgagtttgagatggctttgggatgtcccagcgaagatgtgcagaagtcagtttagttcacggttctttcgggagaaagatggggctataaagggcctggggacccatccatggagagatggcaatcacagccatgggagcgggtggggccaccccaaggaaatgctgagattaccgtgtgactgatttgattacggggctttaacttattgagctataaacatcgaacagtgtcacggtttctaagacctgcctctgtgcatctgtcaaacacagtgggcaacaacctagagtccacgactttcagccacttttacctgtggctgcttttcagttatgaaaataatcgaacgggccttagatcagccggttttaaccttccatctcacacctcactggaagctctttcttccccacagtcaagaccaggaccggctccagctgcttcagatgtgaggcgcagggaaggcctgtgcaactgcgtgtgtccaggactgggcaccccaggtttcgggtgaacaatgggatgtaatgaagggacccctctttttcttgtctcccactggaatctgcttgcatacaagcaggtatttctggttttcattccttcattcaactaatggttgtgctgagggttaaacaacaggcaaggcagagaaagtttctcctcaaattgaacttgcagattcacaaggaaggtgacatacacaaacaaggaattcgtgctaaatgaagtgttaccgagagttgcaagaatggagaggagtagagaagactaaggaacaggctgacctaagctagtgtcaatctcagcaaaggctcattggaggaagagtcattattctccaaacagcaaccagaagatgctttcaaaatcaaagttatagcctctcactcctctgctcagtctctgcaatggctccccctggtcattcagaaaaaggtccaagtcctaatggtgactttaatccatcctctaagcctgccacactgccccttctctgtcccttagctccttctcttctcccactcgctgtgatccaggctcagtgaactctgtgaccctccccacacaggccccacatatgacacacacacaccccacacaagccccacatgacccacacacgccccacacacacaccccacatatgacccacacacgccccccacacaccccacatatgacccacacatgccccacacacacctggctcccagcctttctccggctcctcctgtgcgagcgtgcttccccaatggtcacgtggctcacaccctgccctcctgcagctcttccaatgtctcctttgcaacgagcccctctaaccaccacctgctcatgtaaaacggtggtgaccccaccctacattcccacattcccaattcccatggcctgttttagtctttgtctccataacatcaatcacttcctatagtagatttgccttcttactcgcaatgcctcaaccctccctgttccccagccattgacctgactttgtctttcctcagttagaagctgcatatatttccccatccagttgatggtgagctgagccacgtggctttgtagggtggctgaatatgtcaccccaaaatatgccattttggccatataattacttaaagctaaaggcccttgaaaaaaacaggtgatgtgagaagggtgttctgatctccccttttatacctggaaacaggagatgaaaactcccatgtgaaagacaccctccttgcatgaggagaaaaaccactcttcaattgggacttatagcagagtgaattctgcacaaacagccctcattagggtatgtatgccttatcttcccttagcctccaaacacttgagttacttttccacaattgcctctgctggttcaacccaacacaaaagaatgctggttttgccacttctttgggtcttcatttcctaatgagggctcctgtgtcacataacgcttttattaaacttgcatgctttcctcctgttcatctgtttcctgtctatttcattctcaggcccagttgggactctgggtagaagaaaagctttgcctcccctgcagcttcctttgccaataggatagtagtgtatgtgacataatccagtacgtggcatgtgcttgtttggtgaggcctgcccttctgaattcctgcctttcaccacgagaagaactgtccttgggtagccactggcttaaggatgatggactcattgagcagactggaaacatccacattcactgcccgaagcagggccaagctcagcccagccccagctcaactcgggtggagccgagaggtgtgagaaggctggacgtagtgtcaggggccagtgagctgcccggtttcttagtactcagccatagctgaccagtgaccttctgtacagttaccgatttattagatgtgtgacctattgtctgtctcttatcacaagaagggaagctgcattagggccgagagcttttccgcactgctgcctcctaagttcctggcatgtggcgggtctgcgacacagatgcatttcataaaggaagcaaagacctcaagtccgaacccccaccaaagtgagaagcaggagtttgtcaggtactatttcgctaaaaggaatgaaagaagatggaaccaaagaaggaggcggtgttgccgatgtgtagaggtcagaagtgggcctgctgccatcagacacatggggggtggcacagcctccaggtgacctgcagctgccacagcaggagaacactgacggtaacacatagcaagtgcacggacgcctcagggacaggtttcaatgtcaatgaaggtcattattggctgagcagcacaagggttccctaacaatcacgaataatgaagagcgcagagtatccacccatctcccaggacactgagccacctgaatgcaggctcgacacccaagaggagagaggacaatggggcctgaatgaacttggggtgatgcagcagcagaacttgatctatgaggctctggtgatgagcagtgtggacactgataggcaggtgctcagatgctgccagctgtttttaggtttcagaacagaatctttggggcagctccaccaacgtgcctcgatgtaggaggaaggcaaggctggtggccttcagctctggatcctgcaaggacatctgaaatctgcctctgccatctgcctctgaactccctctccatccccttccctcccctccactggtgaggttggacccataaggagaaggagaaggtaacttggaaggattgaagtaaactctggtgtattgaagagatttggagacaaggttgacaattcatagaaaataaatcatatatctattttaataacacttagctatatattaattggcaaactctgttgcatctacacattgtcccaacaatgcgttttagagttctgcaacaataataaccacaaaacactgaaaaagtttcaaacatcttccagcacttggaaacaaattctagattctattttcccaatctattgctgtctatgagcagtgctatggcagaagggcctaatccagtactcaactttctaagcctgacattttccacatatgtaaataggtcttcttgaatttctattaatacttttatagataagaaagttggactattaactgagactaaataacttgccaaaggtgacagagtggtttggcatcattcagactatgagtttcaacatacaagtcatgagaatctaggttatcgtatggccactaaaccacatttccactttgcctcccactacaaaagaatgcaaattgaagaaatttaacagtgggaggcttctgaatacagtcatgaattttctgcctgggctactgtagaaacaatgtgtctcaattcacagctggtatgttaaaaatcatcttccccaagtcaataaatcccctctgtcgcctcaacttgaaactgcctgttcttcgttcttcatgtttactcgatgcttatttccatatcgtgtcacagaagcagtgccttttccaatatccatcctcacagaccttataccctcatcacatctggaagcgttcttctggataagcatctgaggatgccatcgaggtcccgctagggagccctccttctgtggccttcctgagtacacacatgcacacacacacacacacacacacacacatgcatgtacacacacatgtacacatagagctccctgtttgtgctttcatcttctgatgaccagatcctgtctttactatttcctgttgctctagtgagtctcttccagggctccagcgcaggccctccgatggccatcactacccccggctcctctgtgtgcattggtttgcacactcttctgacttcatttgctttacaatgaggcaaggattctgttttctagaacacaggagaattatcatttgatgtgtctgaaggatctttattgcaggagaaacagctgttgatggagagccggggtggttgggggtggaggggagtggtgatggtatccatctcagctccaccttgaatagatgctgtccctcctatttgccccatgggtccacctggcctggaacactctaaatgcagcaagtccacgtacacctgtgctgcttctgcctgtcagcagctctgcttagcaagcttagccaagagaaagtcctgctcctcattagggtcgacgagttcttccccacagagcagcctactccctggcataggccttctgggatgaactggtgcccagaagcaaaatcaaaaaagaaattccatcgtaaatattggagattcattttctgtccacttcaaaatcaaggcctctgatgatcaacgtgattggtcgtccaagcagccatgtcattaccaacctgccccacaacacagttgctcacacatgaccagcgacagctagacaccaaagtagtgaagcagcctgcccatctgcagcagagggtcccacagaggccaccgctcctggaactgacgggccctgatatcgcacacaggaacagcactcacggttgtggcttcccgaacacaggacagaggcagcgcatgatgtttggactcgaaagcacccgcatcatttctcctttcccaactcatactgaactctgcatggacaggttccctccttagcagcaaaacttccccagtcagacttacaagccagacttgcccagtctctcttgtttcttcaacaagagagagttcagaccctatgtggctatgaagcacctcaccaggtcatccctcgaggaggctggagaaggaggcagctctccaccgagctctgattctggaggagcgagcaggctctccacctccacccagctcttattctgtaggacggaacactccaatgcaggatgcaagacaagattcatcactaagctgttgcctaaatgtcaatttagcctttattgaacatccatctggtatttgaatgtgcattggggatctgggggaattttgtttagaaatagaaaacacagacccttcttcaagaggccataatcgagttggagaaatgtttgatattaagctgtaaagagagtcacgcaggatcaattgagaacatgtgaaatttttcgcaaatagtgagaaatcatccgaacaccacctgcataaaaacccacctaactcccactgtaagctccatctgaacctaatgaggatggtagttaccgatttccaaaaaggttgtcttcattcctttgatttgcgctgtaagtgttaaactttaaaaatagtctaaaggtactaaaaatgatttcatgtttttctcagtacaattttgttaggtttatgtttaattagccaagtgttacattgaggatatgagaacgagcaatattctgttgctataaatccttcagttactaaaccatacggagatttcagtaaagagaggtggaggcaacagtcacacgtgtgcacacacacacgaatacacacacatacacacataaacatgcttatacacagatacacgcatgcaaacatatatatacacaaagatacacgcacacatacacatgcatatacacaaacacatgcatacacgcacagagctacatggacacacacaggtgcatacacacataaacagacacatatacacatacatatacacatagattgctagggctgccatgacaaagtaccacaaaccaggcaactaaaaaaacacaaattgattctctcacagctctggaggtagaaagtcaaaaaccaaaggccacgcttcgtctgaaacctgggagaggagcctttcttgcctcttcctggcttctggtgttgccagcaatctttcacattccttgtcttggagatgcctccctccagtctctgcctctgtcccccaggggcagttcccctgtgtctcctcacatcacactgcctctgtacgtcttccctctcctccccttgtctctcgtcctataaggacaccagttagatttgattaaggccctaccctactccagtaaaacctcatcttaacttagatcttcataacatctgcaaggactccatttccaaataaactgccactcacaggtaccagagattagggcccaacatctttttctgggaacacaattcaacccacaggtacacacaccctccacaaacaaataatgttggcttagtttttaattaattgtgctgaagtgatatgtcatttacattttctgtctgagttcctgtattgtgcgatcttgaattttccagagtaattgacttaatctattcatttctaagatacagaataaggtacccctaacttttaccattgcatagctcaggcaggactagtataaatgatgaagacaggaagattattaatattttcatcacagacccctcatattttcattatttaacacataataatcttctaagactactcaatcttctaataatatttaaattttcaatttaaaatattatttttattctgcaaaggacatcattgggtcagctgacaaaattggaaaacagctggtaacttagataaaagcactgtatcaatgttaaattgacttgaataactgtactgtcttaatgtaagagaatataagttgcttaactgaacactaaagtatttattagtaaaagaccatcatatctgcaaatttctcttaaatagtacagaaaattgtaatgaataacgtgtgtgtgttgaaagacacagaaaaggagatatagcaaatagggtgaaatatgaacaatagctcaactgtgacagatgttataaagggtgttcttaatattatttttgtattatctataaatttgaaattttcaaatgaaaacttaaaaagagattaaactgcatttttaattgtattgagagatgagtctaagaaacaacaaaatacactctccaattttcaaaccatgctccttatcttggtgggaggacttcaaaaaggtgccatagtcatatgacaaatgaaaagtaattaaacttagtttactccattatcaagactgcgataaaagtcatattctggtattttgttctgttttgttttgttttgtttttcagacagggtctcactctgttgctgaggctggagcgcggtggtgcgatcacagttcgctgtagcctcaaactcctgagctcaatcgatcctcccacttcagcctcctgagtagttgggaccacaggcatgcaccacaatgcctgggtaatttttgtatattttgtagagatggggtttctacttgttgccaaggctgatctcaaactcctgggctcaggcagtccgcccacctcagcctcccaaagtactgggattataggcataagccacagagcccggtcagatcatattcatttaactttaaagttgaaaggatgacacagatagaaaatattttttagttataaataccatattgggtgtaccccttacccacacatcaacagtcctcaaaggcagggggggaagggggatgactcagaaatcccgagtcctgaggaattaccacttggggctgggtacttgatcatacgagaaggtgaggaggtggattctggacttgcatttatggtgacaatgaatctgaagtacaatgtcaagggtttagataacaatgttaagaaaaaaatgttagggagaaactgggtcaaggtatatgcattttggaattattggttctgtgtgggctctagaaataaagcgacaaaaaaaatagcaaatatcccagttgcttaatagcttattgtcctgcgtagcgaacttttttcttaagggaaatatctattttttggatttaacattatttaacatgtaagtcaccttattcactcatcaatttttgaaaactaaaaatataaatcattccattttggtgataaaattttaatttcctatactgataataaatttttccttgacaaatgcacttagggcacccttcacactgaaaaactacaagagacaagtcccacatcatcaacagaatgtaagaatgtaggtggatgaaggataccacctgagactctacatttctgttaaactggcttcaaattattaagtagctaatctaaacaagtgtgcctgtttctgctctaaagcaatgtggaattctttcaatcccttaggacgtgtttttaataataaacttttaaaaatgtgtttaataaaatataacaaactttataatgagtattcatactcatacatacatagtattacaggttgagctgtgcccccttaaaattcgtgcattgaagtcctaacccctagtgcctcagaatgtgattatagttggagatggggccttcaaagagttaattaaggttaaatgaggtcagatatgtggaacttaattcaacatgactggagtccttacaagaagcagagactatgacacagatatgtacagagggaagcccatctggagatacagggagaagacagccatctgcaagcgaggaagagaggcctcagaagaaaccaaccttttcaacaccttgatcttgggcttctggtctgtgaggaaatacatttctgttatttaagccacctggtctgtagtaggcagcctgagcaaactaatatacatgtatattttagttttgtctaagaaaactcttgaatggattatgacagactggaattctagactgataataaattactgtgtgacctccttaaaatttagagataagaggaggtcctagacaacgtctaacgtttcatcattttatacccatatacaaaagctttttttctgaaacagaaagcatcataccttggttgggaagctgacattcccttggatcaagacatggctgctaactgtaggagtgactacttatgtaacagtcattcaaatgaaaatacctatgctaaaaatgattatttgcaacattcatgtatttacttcttattagacaagtaattattaagcatatggcatataccttatactaggcattggaaaaatcaaaaaataaaatacagtcattatccttaggattctaattcaaattcaacacgatgtatgctatagcagagacataaatacagccaaggtggtgtctagctttacctggggaacttgaggaaggcttcccagaggaggaaagtcttttgagctatatctttaaggatgggcaggggttcgtctgatggggaagaggaagaaagggtactccaagcagagggaagactatctggtaaaatagtaattctcaaaatgatctgtagattcgaaataatcccttttgaaatatcatcaaagtttttaaagaactagacaaactaactctaaaatttatatggaaatataatgatctgtattagccaaagcaattctgaaaaatgaaacaaaatctcaggccttaaacttcctgatttcaggacttgctataatgcagcacacaagccaataaactaggccaatcaattgtcagaaagaaagttttctgggttttactaatgattccaagcagtaattgtcctttagtttctcaaaaaaaaaattgtttaattttctagttcacctggcaaaatgaaagacagttttagacatcatcatatacagttacagaaatcaagccagtgtggtactggcatcaggatggataaatagatcaacagaacagaagagtgagtctaacagaggagccaaggtagctcaacgggagagggctggtcatttcaatatacggggcttggacaagaggagaaacatatgcacgatagcaacagtaacataaccattgtcccttacatcacaccaaacacaaagattaacaagaaattgaccaaggatctaaatgaaagagctattactttaaatcttctagaaggggccgggcacggtggctcacacctgtaatcccagcactttgggaggccgaggcgggtggatcacctgaggtcaggagttcaagaccagcctggccaacatagtgaaactccatctctactaaaaatacaaaaattagccgggtgtggtggcatgcacctgtagtcccgctactcaggaggctgaggcaggggtatcgcttgaacctgggaggtggaggttgcagtgagttgagatcgtgtctttgcactccagcctgggtgacagagcaagactctgtctcaaaaataaataaataaataaataaaaattaaaaaaaaatctagaaggaaaaatataacagacattttctttgtaaccttgagcaagacaacaatttctagataagataaaccaaaaaatgaacagtaaaagcaaaaaatcaatatattggacttcatcaaaattaaaattaaaatgttgttgaagccaggcatggtagttcacacctacaatcccagtgctttgggaagctgagacgggaggactgcttgatcccaggagattgaggccagcctgggcaacacagggagaccctgtctctaaaagaataaaaataaaaataattactcaggtgtggtggtgtttgcctgtagtcccagatactcaggaggctaaggcagggggtgggagtccctttaggccagaagtttgaggctgcagattacggcactgtactccagcttgggcaacagagcaaaagcctgtgtccaaaagggggaaaaaaaactttgaaagtcaccataaagatgaaaaggcaaccttcagactggcagaaaatacatacaaatcatctgtctgagaaaggacctatgttgagagtatacataaaaaaacttacagtttagtattaagaaaacaaccaagcaaccaacaacccaattaaaaatggagaaaaatttgaatagatgccacagtaaagaagatagcagaatgtcaaatgtgcacatgaaaagatggtgcagatcattacacaacagggaaatgcaaattaaaacaatgtaagatattatcatgcacctactaaaatatccaaaattaaaaagactgacaataccaagtgttggcaaggatatagagaaactaaagcccttaaatattattgtggagatactttaaaatgttttaaaaatagtttggcagtttctttaaaactgtaaagtttctttaaaaattgaatatatgctaccacagagtttggcaattccacaaagtctgctcccaagaggagtgaaaacatgtatacacaaaggcgtttacacaaatggtcacagcagcattatttatgatagtcaaaagtgatgaaagaattagaataaaacctgaataggacatggaaccagaagttttcaggcaggaagtaacaaagtgaggcttgtttattcaaaagataaatcagacatggaagttggactgaagcaggtgagagactcgtagcaggaagaccagatgcttaacctccttggatggattctgttttaactgacaggaagacagttggatttcctaaaggagaggcttagcttgtgggaggaagtgcagtggaaaggatatgaacttctcatcatcctggttcagcatcccaggtgcgcacctgagcatgtgagtccccctttgcccaacctccagtctcaggcgcctcacccaccacaggaggggatgtccccagcctcaccgggctgcggcgaggcggtgcagtatctgtggacagcttctggctgatgcctgccacatgggtgggactcggggtagctgagtttccttctccttctcttctaacttcttatccaaggaaaaggaaaagacctgtctggccttccataatcagtaaggtaaattcatccatccacagagaaaataaccgggaagcctacagtgcacattttctctctgcccccaccccctatgcccatgccgcatcaccatgacgactctctgccctgccaggcttgctctgcatcccagaaagttgggcccttggggctgtacccacaaggctcccctgatctctggctgccagctgccacccagctctgggtcacattttctgacagtggcttcatccttccctgctacagatcctcttggccatcctcttcctctcctccatgcctcctggagctgcggcagcactaagcaggccacttacttctgaaagactggggtgctgatggagctggcagtttctgggttcctcactaccactgcccacatctctgcaaattcatctttgtcattaaagcatctagaattatttggattgattctgtttcatactcagaccccaattcaaagggtctaaaacaggtaaaatggacagaggtggggcaaatatatccaaataaaagaggatccttttatcttatgctcagggccttgctgacagaaggtagcatctttggtgatgcgacgttttttcctctccaggagcaaacatccaaggagcacaaactgccagtctctagttgtagtgagcaacactggctacactgctttctactcttattcaagcattgtgctgtgagtgaattaatattgtgctgtttccattcctgttaaaatattcttcatagtgacaaagaatacacaaaaatgtccagactgacataacggtgccacctgaagcataactcttggaagtcaaatgtgctgtgaccaaagaggtttctaaagagacacagtgtattcgtccattctcatgttgctaataaagactcacagtttcacatggctaaggaggcctcacaattatagcagaaggcgaaagaggagcaaaagcatgtcttacatggtggcaggtaagagagtgtgtgcaggggaactgcctttttttcttttttttgagatggagtttcactcttgttgcccaggctggagtgcaatggcccaatcttggctcaccgcaacctccgcctcccgggttcaagcaattctcctgcctcagcctcccaagtagctgagattacaggcatgtgccaccacgcccagctaattttgtatttttagtagagacagggtttctccatgttggtcaggctggtctcgaactcccgacctcaggtgatctgcccacctcagcctcccaaagtgctaggattacaggcatgagtaaccgcgcccagccgggaactgcctttcatagaactatcaggtctcatgaaacttattcattatcaggagagcagcatgggaaagacccgcccccatgattcaattacctcccacagggtccctcccatgacacatgggaattatgggagctcaagatgagattgggtggagacacaaccaaatcatatcacacagtttcttctctgaatttatgggtctttgaggtacttttatgacaatgagaaaaactctctctaggtgtgtgcaaccacataccagggaactaagtctagggaacagaccataagccgcatttcatccccaattcattgctgcagccaggtatgcctgtgcagtatacaacctacacaactgcaagtggcagccgttacttcatatgattctaggacactcgcacttacttcttggactcaattttcatatgtataaaatgaataatgctatacacttttcacctagctttatacaactagaggtattgtactttgaattcaaagaactataacttatctaaaaacattcaggtatacaaagttcaaccatccaaagtgttcacctatacaaagaaaagttaccattcttttgtgggctgattataggttacttagcaggggactttttgttcctggtggttaacgcagatcctaatatccaacttggtcaactttcaaaagtgccttatcagactttcacttctggctacaatggaataacaagcactgaatttatctccctccctgaagcaacctaataattccacaaaatatatgaaacaatggttttcaagacagtgacatgagacaatgtgggacaaaggtccgtgagagacaggaagcaagcgtgctgagtcctgcaatcactccagcctcctgccttcagagagtggccaggccctggttcagggagggagaccccagcgggagctcagcagacttgcggaattgaacccacaggtctgtgtgtagggggaagacggggcagctggagttaacagaactgagcagagagagctgcacagagaagactagaaaactgtacgacgggttcacctgaagcgtctggctgctggtgtaaacctgcgctttggaaaatggtatgcacacgtacactcactatggaaaaatagtttggcaatttcttaaaaaggtgaacatgtatctaacaggagatccagccattcttctccagaatttctaaccaatgcagagaaaacccgtgtgcatgcaaaaacttgtacacaaatgctcctggcagctctgtttgaaatagccccaaacaggaagccacccaaatgttcctcaactgatgagtgaataaactggtggatccctgcagtccatgtggcggcaggctgctcagtaccaacgaggagggagctgggacatatgcagcagcatgcgtgagtcttaaaataatgatgctgtgtgaaagaagacaagcagaaagaaacacacactgggtaactccacttccaaaacctctaaaaaatggtaactaatctatggggacagagaacagatcagtggtctccaggagatgagaaggggaggcagagtggggtgggagggagagaatccaaagaaacctgaggcaattgtgggggtgatgggttcactgactgtgatagtggtcttaccggtgtatacatgtatcatgactaattgaattgcacactttcaatatgtgtgttttatcacacaccacttatacctcagtgaaaaatttcatgcacagaaaaaaggtttaagaatacagtggcttgtttaaccaaagattttcatatgtggctgtcttctcacaatgcagctggagggaggccacaagaagaatgtgttcacaccccaggagttggaggttgcagtgagccgagatcacgccactgcactccagcttgggtgacagagtgagactccatctcaaaaaaaaaaaaaaattgttcatgcgcagtcactttcttaaccccaattttgctattgagcaacgtgtaaaaggattgtcactatgctgcatttgaaagcatgccctgtttcagatgtcccaaatggcaacagggtcactcacaaagagaacagggttcagtatatgccttgattcctgtcctccaaaacggtacccataggtaagttctccctgcaaaagggaactgaaaaaatgaggtcctggctttgggctttcattactttcatacacacacacgcacatgcacacgtactcacacacacataaagtttttgttttgttattctaatttgtgcttcgatttgcccaggagactgggtcctagaatttgatcaattctaccttcccggtccactgctagagaattaatctggaatcacattaaaaactcctggagcccccatcactatagcttctgaaggaaaagaataggaagaaaaatcaatgtgctttgtgtattcacagacttctgataaactctgggcatgaatcctgtctcgattttaagaggctctaaatggtagtgaattgtgagcctcactgcagagctaagaagtagccccctcagaactggagagtaaacagggccacgtgggtttcccatgcccagtccccagggatttagacctagtgtatgtttgtcaccaccaactagtgacaaggacaaattttccaattagaagaaagtcctttatttgaaactatatatttcccagatttcctgttaaaatgattcccttttattaagtgatgttgagactagatacttttgttactgtgtttttaaacatccttacatggtaaaatgaaatattgtaaacctatattgctcagtcctccactttatttttaagaaaagttaacttgttaataaaactgaaaagtcttaaatgtatcaatacttgtcattgcatgtggaaaattttatcgacattttggttttggtttatatagactaagttacaataaaaacaaagaactgtgaacacaatcacacatgatcacgaatgacaacgctactcctacagcgtaagaaatctcatcttaaatttcctcaacccaatattttcaaaaagaacttgacctgccaagcttccagaaaacacaaataaggaggcagaataatcacttcccaccgttgctccaaggagacccccgaagagcctgaagatgtgaagctctgataaggtaactaataattccttggatagtctactggcgtaggagccatggaaacagagaaacagcattggcaccaatgaaggttaatcaaatcataacacagacatgcattttattactctgacggcacacagcaacacagagttatcaggtgcagatgaacctaattagattgggtagggggaaatggacagctgtgaggtgactgctttgagctctcctgaaagataaggtcagatttaccaaagacacataggtggaaactcaaagaccagtttttggtagaggggcaggtccttgtgagactcagtcctactatcctgaggtcaagaagttcaaaacaaagtggaaagactggacatctgattcacttgttttaattttttttttttttaatttttagagatggggtctcactctgtcacccaggctggagtgcagtggtgcgatcacagctcactgctgcctcaacctcccatgcccaagtatctcctgcctcagcctcctaattagctgggactacaggcctatgccaccatgcctggctaagttttgaatttttctgcagagataggatcttgctatgttgcccaggctgatcaccaacacctggactaaagcgatcctcctgcgttggactccctagtgctgggattctgggtgtgagccaccgtgcccagcccctagtcactttcaaacagaatttagcaagtttggaaaggttactagatagcaaggaaaaccattttcacagaaggcagtaagacagtagcaatgatgtaatttttccctcaaaaaaactagaaggcaagagatctccaacaacaagggcctgggaatttgacacacttgtttccacacacttcatagagctacgaactggagaagtctttgaatgtggggtaagatagggaaggtcaagccctgtaggtatacaggtgggcatgggagccagacggagtcagtggacaggtgaagagggccttatccatctaacatgtactgtggttaggcctggagacattcaataagtggcatctgagtgcatgaatgtttcaataccctcaacgcactgcggttatgttcttgaaaatgtacattgcattcaaacattatactccgaacttaggtgcccaaatgaacagtattgataaatggaaatttcatttctcatagagtccttgactgtcctctcatatcataaaaaataaaggggatacataggtagatgaatacagatgtgataccctttaaaaataatagcaggccaggcatgtgggctcatgcctgtaatactttgggaggctaaggtgggcagatcgctagaagtcaggagttcaagccagcctggacaacatggtgaaaccctatctctactaaaaatacaaacattagccaagcatggtggcatgtgcctgtaatcccagctactagggaggctaaggcaggagaatcgcttgaacctgggaggcggaggttgcagtgagctgaggtcacgcactgcactccagcctgggtgacaagagtgagactctgtctcaaaaaaataaaaataaaaataatagcaaataatgagcataaaagtaacaaagatttatgttaaactcctaaatgtttcttgtatctctataggtattacccccaatcaaattcccaaattaaataaattttataaaaatacatgcagagcttctaataacagaaattccactctactctaaggatgtcagtacaatagtgctattaaaaacacatttggtttacattcaaaggctacctttcagagattaaggcacatcacattttaaagcgaatctcaaagaaaaagtagataaatttattttatccaccactgaagtccaatcactaagcatagcagcagatatttaacatgtgcttagaaaatatttttcaaataaaaaatgatttatcaaaactcgtaagagatacttcaaagcataatatccaaaacagcataaaattaactggccaaattaagcctaaaaatattagtaataagtaacactgaaaaaattattatcctcagtatataaagagctcttacaatttagtaaaaacatgctattatcaagccacagaaaataggccagtgacataaacgtacctatcccagtaaatgcttgaaactgtttaacctcattattaatagtaatttaaacttttttaccagaaagagagcattttgctcatcaaatttacaatctttctaaaaattcaataaccaccattgaataaaaattcaatggtagttagctctggcaaaatgggttcactcatacattgctagtgggaatataaattagcaaaacctctctgaaaaacaaactggtaatataattcatatcaagagttttaaaaagtttataactttcaacacagcaactcctagtaataatctctcctgtgacaataaaatatatgggcaaagatggtgtatgaagatgtttattacaaataattttttaaatatttatattttcatttataatgttaaagtttatatgtttataaatatttatataatatatactatgtaatttttcataatttaaaaaataaaaattttattcatttactttataaaaaattacaaataaatataaaatatataaacaaatattacaaatataattacataatatacagtatacaatatgcaaatatttataaaaatatatgaataaaatttttattttataaatggcaatttttataagtataaaattttatgcataaataaaattatataattatatattcatttataggtgtatatatttataagcataaatatataaacaattgtttataaatatatttttaaattgcaaacaacttaaattttcaagaattggaagtggttatgtgtaacatagtatgcgtatgaagaaaatcattaaaataaacctttgaagtataaacgcctttggaaaatacccccaatatgacactatgtaataaaatcaatacaaaaactctctgtacagcgtgattctatctatactatcttatgaatataataattcacagacacagatatacatacacatttatgcatctaaaaaatggacaaaaagcccaccatatggttcatagcagtgaatgactatgtgtattatatgttttcattaaaaatattttcagagaaaataatttttgtaaaaatactaattatataaagcaaaaagtaaaatcccccaattaccaaaaacccccaaacatactcactctttgtcctccaccaacatacccactgatatcagtctgaagcataggatgtatttaaacataaatcttttaaaaatataggcagaattaaatctttttaaaatataggcagaattatcctgtgcatatcgatccatcttggagatctttcctagcccgtacataatcatcattcttattaatgtctggttataattctatggctatataaaaatgtgtttaacccatcccaataaaagggattttttttttaatccagactttcactattacaaataatgttgtatgaaacagcttagtacacttctttctatcctctttaagaaacatatccagaagtgttaactttcaggaaaaagtgatcacacattcattttcacagacaatggcaaattttcctcctaattatccctaccactttatatccccaaaatagtacaggagagaacttacatccctacagccttgactgagtattttctttctgcttcacttttggaaaatatttccactggtgttctttttttttttttttttttttttttttttttttttttttttttttttgagatgcagtctcattctgtcacccaggctggagtgcagtggtgcaatctcggctcactgcaacttctgcgccctgggttgaagtgattctcctgcctcagcctccccagtagctgggactacagatgtgcatcaccatgctcagctgatttttgtatttttagtagagacggggtttcaccatgtggaccaggctggtcttgaactcctgacctcagatgatccacctgcctggcccctggcatctttaaaattactagtgagttcactttttaagttgcttggctattgacatttctattgataatggtttatttatatctggagctcagaccatttgctgttctctaatattcactcactcagtctttcttagcaataacaccccaatatttaatgggacatgcggtcatacaggatgaagactacattgccaagtctcttttaaagttagggatactcatgtgactaaacactgggcaaggggacatgaagaaaagggtttgttataagacttccagaaagtgattttaaaggaaaagtgcacatctttcctagttgttggaatgtagacgcaacagcagaagctgaggcatgcatcttggacgatgaataaaagacacatatggctgggcacggtggctcacgcctgtaatcccagcactttaggaagccaaggcaggcggatcacctgatgttaggagttcaacaccagcctggccaacatggcgaaaccccgtctcaactaaaaatacaaaaatcagccaggcatggtggtgtgtgcctgaaatcccagctacgcgggaggctgaggcaggagaattgcttgaaccttggaggcagaggttgcagtgagccgaggttgcaccactacattctagtctgggcaacagagtgaaacgctgtcaaaaaaaaaagacaaatgttttggatgttacagtaacaaaccagaggggtctcagatcatgataatgtttgagaagccaccttaccagtcattgaccatttacctctggacattgtttatgtgagaattaaatgtttgtcttgttaaaaacccttttatcataaattttctatcatcttcaatttgacctaattgtatcctttgccaattttttaattggcttgtttacttatatccttgccaatttttttaactggtttacttattaattatttattttttgagatagggttttctctgtcactcaggctggagtccagtgacatgaatgtggctctgcagccttgaccgcttgggctcaagtgatgctcccacctcagcttcccaagtagctgggacgagaagcacatgctactatgccaggctaattttttttttttttttttagagatggggtctttctatgttgcccaggctaatctcaaacccctgggctcaagtgatccctctgccttgttcccccaaagtattgggattgcaggtgtgagccactgtgcccatcctggtttttctttttttcctgttggcatgtacttctttatgaaataaatagaatttcttctgtcggcagcaaatcatgaaataaattccattcattcatctattcataaattagcttaataattcattatcatatgcaactttcacccaaaggcaatgcgtgggtgtggctatgggtgtgatgggctgggtacactgcagacactaggaggaatccaaacaaacgaatctttaaaatcctgtccataagtgtatgaaatatttggcattcaagttaccctaggagaagaagatatttttctcattttcagtaaagaaaaacagaaacctaacttcttgcttctttcattggccgaaaggatggtattacagatttgctttaagagaaaataatctcaaaatctcatcttttaaaatgttagggtaacccattaaagccacatttggcaagtcaggtttcatgactgcagatgcaaatatttaggtgcacactcccttggtgtgcaaaccccgtgcactgaggaaggtttttctgcgaactgctgaagctgaagcttcagggctgttcacttgcttgggcctgtcaggaggtctagtgaggactgagcaaggtgatcacatggctatgtattccccaaaatttaagaagatattttcacagctgttgcttaggacaggtgcccctttccactccagcactgcctctggtagaaatccccctgtgtcaggcggccttggagtggtaatgggtatttgggaagctgagctatatatgtgcagtttgtctgccatttagtgagatgtggtatggagtttacagttattccttcactgaagtaacatactcccaggtgtttcagtgtaagcatggcttccaaggatcctcctcgcacagactgtgtccacacacccacccaacgccacgaagtagggaagatcagagttctgatatggcacccagcacctgaaacgtgtggatggagaaaaaggaagcaggtttgaagtttagggagccagaagcctgtctgtggataattctttcaatcattagatgtgccaagtcataagtgcaaggtgcgattctcatcaacaccttgtcaaacagaagttcattttggccaagaatatacttgataaggccttgtgcataaacacaaatgaatcatgtacgctttttgtttattttaatggaaaccacttgagagagaatttaccggtatttccacacttgaagtgcagaaacctgtagaaataaatactacagtgaatatggcagttatgaagttgcgtgatttatacaccctaatgtactagatcatgtcttactgtatcggaaacatctcaaaccaaagaaatctgggctccagatgaaaatagtacacaaattgccacatcctaacaaaatgcctgcagaagcaagtgctatattccagtgactaaattgctacatttatctactaataatgaactgcgtgtagcaatgaacaggccattcaagtatttgctaattaactaagagaaataatcatagggccacattgaaaaaaagatttaaatgttttcctgatttgacatgatatactaacattgactaagataacattcatttcataatatgccaacacaaaaggacatattgaagacatattcattgatgagttttgtcaattgatcaaatatgtaagcagtcactatgcaataagacttgaaatgctctgcaatcttacacaccagaaataatggaaaattattagaagttacctcaaatttgaaaacaagcctcaaagttgtcatatttccaataatttgtaaaactaaaaggtacttttcaaaaccatcaataataaaaataaattgtaatcgactatgcttggaagactaaattattttctattctttttatacaaagcaatacaataaaagtcatatgccaagaggcatatgaccaaaaatcataggaaaaagagtattaaagggaatatcacacagcaagaaaattgaaatatgttatttttctaaaagtatgattttcctggtatctactgaatttttaaaatttataatctgttgtaattttcttattatcaattatagtaatacttttgcattctgtttcttaaagaaggtctcccaaatggtgtaatttaagatccccacaaaatctgaacttgtctctgcttagttaagcacctcctcaggaccccttggcctcgtcaatatttccaaaatccttctggtctgggctgctcatggccatgtccctttccaggaagtgtccttgtcaaactctcaagagatttaactttaaccaagttagtcctgggtttacccggccctcatccccactcaagggacttttcagcatggagcttccgctctactcccaagcttgaatgaaatctcttgatcttctgggcatggggttttgcttcctgggcaagtgcaaggaaatgtgatgtgaactggaaatgcgagggtgtctgctccccccgggacacaccttcatccatagtaatgggagacaggaggattctgggtaaacaaaggcctccttcccttctccttgccttcagagggctggtccaagttgtggtttcttccttgcaaattttcactaagagtcctctgtgtcatacaaacacacctgctaaggaccaactgtggctctttagggcccctgaagctgcggccggcaagaatgcttcgagttgcttctcatgtttccttgcctttattcccctctatttttcaccctagccatcccgggcttccaccttccaaagaaagtgtcagctctcactcttgccccaagctctgctctctagaggaccctggctaaaatgcaaaccatctaacagaaattaaaaagcctggcaatctagcaggtaggagccctcattactgtagctattatcattaccacgaagattcataccaaaacatgtcagtacggatgaccttgggtcactgctctgaaattcaatacaaggaattagagaaatgaatgaaattcatgtaaaaagtagaaaaatcatatttaagacaaattttaaaacaaaagaaaattaaaaataaattattagcttggaaaatgatagcataaaaatgagctttattttgataagctccattttgggttaagcttgataaatacaaaatacaatacatgcatctatttatacacacataggcatatgatgactatagcaaaaatagtatatttctgctcatccttgcagaaaacccattaatgtacaaatgcaaaagtgaaggtttctaaaagttctatttgtggacgtctgcacccgtgttttatccattgccatttttctcctatggaaggaggtgaccaacccatctcagacgcaggacaagcttccttgttccacccagtcagttctagacagatggccacaatacacatttttgaatcatgccaaaacaaagattgaatctggcagaggctttaacccataacttcttttcccaaagacattaaatacatttgcttggtatcctttctgacagcaccaattcaacagagaggcatgtaggaacggacacgctgagtgagttttaggggagaaagtcaggcaaatatgcatgatcgaaatagcctcccaaacaggaagacttatgttcttctctcttctggaaatctaaatcccatagtgtgtaattttgatttgcattggcaggacaagaatatagctcaataagatgacacagcaccacgtccaagtgtacacctcatacctgctcttcacaatggggaggcttaattgtaggtagggaatgagcttggaggactatgacatatataaaatgagccaggaaaattctgtctgcctaacttacatggattcatggccaaactgttctcctttaattaacacatctttccacatctcagataagggggtccttacaacaccacatttcttcccactcacacttaatcacagtgagcacgagctatggaaggggctctgttcatctgaagaccctgaagatgctgtctttttcacatgttgttttcctctcagatcagaggtagtctagggaactgagatttcccaatgggtttgagttttactgcaattaccagaaggctattgaaagatgggtttttagaatctgagcaaattatcactgcaggtaggtattcagaggatacatgtatctatataactgtggcattgaatttttaaaaaatataatcattttagactagaaattagggctctaccttgtattcacctcaattgattttacttttttttttttttttttgagacagagtctcaatctgtcacccaggctggagtgcagtggcgtgatctcggctccctgaaacctctgcctctggttcaagcaattcttgtgcctcagcctcctgagtagctgggactacaggtgtgtgccaccacaccgggctaatttttgtatttttaatagagatgaggtttcactatgttggccagtctgctcttgaactcctgaccttaggtgatccacccaccttggcctcccaaagttctgggattacaagcgtgagccagcacacccggcccttgattttactttttaaattgtagtccacttgctcaaatttggaaactaaaagacaacagaattctatttctaccaagttttattgactatttagttaccagctttactgatcacaaccaagtttactaactgactttgccttttctagagtgccaccgttctgctcatgaatttgaaattatactggttttcatgcacttattacatacataattattctgtgtgatgaacagctcaagaccttaggaataaaggaataaaagacctctgtgttttgaaaataagaatctgaataaatagaaagattccctttcaatcaaatcttatttaccacacaacttgtgagtaacctgcaaaatactgtaggcaataacagaagtaacagaccctgctcctttcctcaaagaattcaaaatttagtcaattaagccaaataaagccttaccagtaactatttagcttaataatttcttgtttttctggcactttcagaaaatgaaccctacataaagcaccaaaatatttttaatcttatttgagtgaatctttgatgtgacatcctgttcccaagagtattacaaatacgactctgtggttcagggtcttcacggcaaacagtgatgcacaacagcacggcagacccttgggagcaatctagtgctggctgcttcctgtgggccccccgacctcacgccactgtgcttctgcccaaaggggctgctggtttgcttttcctgcccctcccacaggcgtcagctctgcttcccgcccctctgtttctcactggctgcctctcactgtgctgtgttgagagagggcactaaagaatatgcagaacaggccaggcactctgtctctcagcactctgggaggctgaggtgggcggatcacctgaggtcaggagttcgaatccagcctgtccaaaatgacaaaaccccatctctactaaaaatacaacaataacaaaaacattagttgggtctggtggcagctgcctgtagtcccagctacttgggacgctgaggcgggagaattgcttaaacctgggagatggaggttgcagtgagctgagatcacgccattgcactctagtctggaaaacaaagtgagactccatctcaaaaaaaaaaaaaagagccggttgcgacggctcacacctgtaatcccagcactttgggaggccaaggtgggtggatcccttgaggtcaggagttcaagaccagcctggccaacatggtgaaacctgtctctagtaaaaatacaaaaattagccaggcatagtggcatgtgcctgtaatcccagctacttgggaggctgaggcaggaaaatcacttgaacctgagaggcggaggttgcagtcagccaagatcacacgattgcactccagtctgggtgacagagccagactcaaaacaacaaaaacaaaaacgaaaacaaaaacaaaaaaaacaataacagcagcatagtaagaagccctggaaagtgcaagtgcttttgcacccatgagctcctttgccaaccacagtctggtctgcagggctttcttccaagtagactgcactggtggcattgtgtttcgtgacagttttgttttgttttttcccttggagacattttgatgaatctaggcttttggcggttttcactgatctttaggctctctgtgctccctgcggtctgaggatcagacaagcgggttatgtcagactgacatgaattgaaacaggtttcctgaggtctctttggcctagagagccctgctggtggtcttgccccctgccaggtggatactaacgctcaggaagccactctcaggatgcagcctctgggtaggccccgcaaaggcctccgcagaaagctttgtggacagacgcccctgcaggatgccccggagagcaaagaaagcaaagggaagctgcagcccagctcctccactcccagagcctggtgaacatgtgctctgaaggcaccagagcttcgggaacctgtgtatgaggaccccaagtctttaaccttcatgccacttagcactaaatgccaaaaaaaaaaaaaaaaaaaatgccaatacaagaaccaaggatgggaatataacatatgtagcaagtgaacaagtttgcagagctagggatctgcctctcgccaagtccgtagcttggccgggagctgggtcatattcatgttggtgccctgcttcggctacactggcccctttgtccctactaccatctctcttattcacctcccacagcaatttgtacaggttacaccttactgtcccacttgtagggcgaggtcagtaaggctcagcaaggtaaaaatcaatttgcccaaaaccatgccccacagttaaggactggggttgcccctctggccctggaaccagagtctctgctgcgtgttcctgtctcctagtgtgtcggggttacctttgttttttttgttttttgttttttttttttgagatggagtctcgctctgttgcccaggctggagtgcggtggcgcgatcttggctcactgcaagctccgcctcctgggttcacgccattctcctgcctcagcctcccgaggagctgggactacaggtgcccgccaccatgccgagctaatttttttctgtttttagtagagacagtgtttcaccgtgttagccaggatggtctcgatctcctgacctcgtgatctgcccgcctcggcctcccaaagtgctgggataacaggcgtgagcccccgcacccggcccgcctttgttttactaataacaaggtgtcactgggtcactgctacttggcgcaaggcattttttacatttattagattttcctttttaaattgaaacataaaaattgtatatattcatggtatacaacatggtgctttgatatatatacccattgtgaaacggctacatcaagctaatttagctaacaaatgcattacctcacatacttatgattttttacttatgattttgtatgattttttaactgaagaataaatacaaactccttagcatgggattctgtttgctttgtccgcaacctccttctaatggcatccagcataccaaggagaagaaagaggtgcagcctggagaggaagatggccaaaagtctccctttcctatgaccctgctccccaaccacagcaagggaccaggtcatcaaaaacacaggctggccaagctccacattctggttcatctcactgttatccagatccctttttatcaacaggaaacatcagctctgcagtaacggttatatggtcctgtaagaaccaagaaagagcagctaactggcccataaaggggattgaactcacatactcagcctcattaggaactactttctaaccaagagatgcaaacaactggagaaacatacaggtggtctgcagtttccacttacagcattagcaaaacaaaacacaatgaaataaaaataaaagccctgtattaagaactgacctctatcccaagaatgatgttgattggatgtgaagctgtaatttgtccagatgtatttctaagtacatgtgacatgtcagctgcttacagatcatcggcttcctcctcacatatccagcacaaaatcaacacgaagtgacagagggaagaaacagcattgtcttgtgttctgcttccaaaaccaccttgacaagtcaactgacagcagaaaaatcccaggctccgtggaggttcccgattttcataacattagccatgcatttcaaggaaatgcatttcaagatgatcaacagtgaacttggcgagggagcactggttctgtgcagaagcagcagaaatgttctttgcctctcttaacattttgtggactcttactgtccagtctcatgagtgggaatttaagtgggaatgaaatgtaatctgggtggattcctttaatcatattgtgcaggtaaatgtcagctggcttggtaccctattcagaatccagaaaaaataagaggttcagggagggaaacagggagaggaggcagaaggaagagggtctgccacagccctttcctactacaacacaagtctgttcctggtccaagtccctgcagagaaggcttccaatagcagcagccactttgggccatgccaaatgactggggagccacaagggcctcttgggactccctcaggaaggcccccacgctccaggatccagcaactgtctggctgtcttgtttctgtccccatgtggaagtttctcccatgtaggattggatacatttaccaactggacacattactagattcacatgttcttccttttcaagtcattagtgccccattatttactcttgacacttttcaattagcaaccatttctgcaaaagagcaacttcaagagaaatgcaaatgtatattagggatgcctgatgttttaaaactcaaaataagcatagctttatggggacccatagaaccacgtattttgaaaatatcttagtactttcttgaatagaagtatggtcatgagaataatagcgttgtttttcagatggtaaacatcaatatcggccgggtggggtggctctcacgcctgtaatctcagcactttgggagtccgaggtgggcagattctgaggtcaggagatcgagaccatcctggccaacatggtgaaacctcgtctctagtaaaaatacaaaaaatagctgggtgtggtggcatgtgcctatagtctcagctactcgggaggctgaggcaggagaatcgcttgaacccaggaggcggtggttgcagtgaggtgagatcatgccgctgcactccagcctgggcaacagagtgagattccatctcaaaaaaaaaaaaaaaaaaaaagatcaatatcagtgtatacccgcggaactgtaatacaggccgatccctaaggcctccatggtgtcttacagccacacagtgtgacacaatgacatgcgccatcctggagcagggcatctcaccctccccattctctacggtctgtctggagaaagctttgtggcggcgcctgtgccctgcagggtctccagcagcatccccgctcctgcccactagatgccagcagccttctcctacttgggacgaccaactatgactccaaccattgccgaatgtctggctgagggtgggaggtgatagtgagtgtccccccatccccggccgattgaggagcagtcctagaggtattactatgatccccaggctgcagtcaataggaagcctcatgagacacacatacttgcccaaggtcacatacaattagttcactgtagacaatgcaacgtctactgtgtgctatggaacaaccgggaggaaggagacggagcccgctctaagagatggtgcccactctaagagcccccttttctgattgagctggtagcacagaaaatgtcttataaagccagggcagcctaagaagccgtgatccctggaatggggcaccgccagatacagtctccgggtggccaaatgacttctcgtcactgaagtgcttgcccggaggcctgagcgatttcctaatcctcttgcttaatgtcttctgaaaggctcattttaataagggaatgaagctgttttaagataagttaggtagcttataatatgaagtgctaatccctagcctagaaaaacgcaaaagaaaaggttttgactaaatgtctctagctataacctgatgctgttctaggaccattagcatttttttttccctgggctgcctcagtcttgacacttccttatctctcttcattggtgcgaacaatacctgagctctccctcacagcagccgtctcccacagactcccctcggatgtccgggtgggcaggtggggatggagtgagcagatcggggttggagtttggttatgcaaccattgagaagtgagatgagtctgcagcttctgcctcactgtatggataagtaagttgttgtgtccgaggctagcacccacgacagtggacacagaggtggagaaagggtatgtgggaagcagcactccagctctgttcctatcccatgggtcctgaaggagcctttcggtttcctactagatcttacctagaactatttagattatacatgtagttttgcagtaaacctagcaacttaaaggaactcatgattcgttttttattttggaagctatgtctcagaatctatgggaaaccaattacttagaaaacatggaactctggactttttaattgatcaaacactaaaagacagtgagcaaaagtcccaacctaagacagcggcacagacatcgtgtaagagcagccgctgggattcagggtctccagcacacagtgaggagaggccatgtctcagcttctccatccactcagtcagatcataaaactgaccagttttatgcactgatctaggagccgagaggtttgctgtataaatgcaaagtagtaatccaaacacttctcccttagtcggtctacacagccaaataatccccctccagaaaggcagtggggaaaagctccttcttcctttgcaggtagaaggcctcacacattctcactcttaaacgggtcaggcttctaaggcttcccatggaccatatctaatttacaggaaaaagactagagtacacagccctggtctccacagtttcaaaatagcctgcggtaactaggcattgttattatttaccagttcttatccataacttgtttgggaaatggtaataaactgatgctccgtttgaataacaccatcaatgaggtaagatactttataattattcttctacctggggaacacgctcattaggaacaagccggctggaagcttcagattgttacattgtagacactgcattctgcaaattgctggaagcactgggtagagggaggttcatgtgtgaaaaatgaggatgatgatatccacaggcagaacagtttgagggtttcagagaatgcaagaaaagctgatgctacacacgccctggctctcagggtggctgcgatgggaggggtccctcccaggccagggcaaccattctgggagacagcaagtttgccttgttgtaccattgcctgcctgggatttaaagaaggtctgtgggatgagccaccccacctagctacgtgatgactgaacatgtagcaaataagcctgtgagcacctccaccccaccccaccccggagcacccccgtcagcaggcagagcttggcctatactcactaggcatcatttctgcccgctgtggccaagtcgctctccagggtaagtccgtctcttactgatttcactaattctttctcccctctggagtttcaggatactgaaaactactcagcaaattctttaaaatctgaaatacgacaggagttaaatatgctctaaggaaaagggggaatcatttttatttagtattttcaaataaattaaagacctggcttatttaacccacaggatgggatgctgtgactgtcaccaatccatggggcaaaagggaactgacttgagcgtatggtgagaaggaaggggggcttcctggggcagggaaaattggaaaacagattcacgcagaacccccactccacaccccctgggaaacgtgcttaccccactcttccgtacccttgtttaatctgtgacattgtgattgaaatttgtcactctgggagttacatctgatgttacagcctgcagcggagctaaaccaaaataaacaatctgctctattctgcttagactaatacgacagtgatgtaaggcccgagacactggcagcggcaaaatgcttttcccacaccgcatgctgcagctgggccccatgcgtttccacgccggggataggcggcaccggcttatccacgcatggggagggttggggaggggctcaggcacaagtgcaaactttgcttgtaggcaactgagttatcctgtttcttctatcagccggcagcacgtgctcttaaggtggacttttaaaagcctttttaattttattttcccgggcatgggtgacccctgtctctctaagcctggagggtttgcaaacacgctaactggtggtggaagtgttcattgcagttcacataaagggtgtgtggctccagcacatatcgatttgaagctgcccacacagacgcattttcagttgtcttaaattaaatacccaatttattttttggtacatatttggttgcttgccagcaaatgactctcagtatattcaatggctttttgccagaaagatgacaggcttttttctttaaaaagggggtggcccctaaatagcttcctttctgaagagctcttggtggccctctggtttgtagcagctaactcggagtgcggcctttttacagccagctttgggggtgctaaatctgtgcatttttcaagcctcagtagttctggtctcaatgcagtagtattcgcttgctttcttttctcttttaaaatttccacacagggtcctgagagccctgccatatgtgggctactcatcccagcagcatgcagaggttctgcgatgccagtggtcacagggagtcccctcatctggtcatccttccatccaagatccctggctctggatgagggggaaattgccgtacatgattcagttaaaattccagcctgagtggcctcgattaaatccagcctcctacatgcaatcaattttcaattttatcacctcatacgaagcaaagcgtgaatgagagttcagggaacttggatagagataaagcagggtcctctttaatacacagatgcttgttaaacctgctcattattctacactgtgattttctacgtgtaaaccagagacgatcataattatcatatgcctctccaggatttctccacggagaaaaacctaagagtaagttcatcaaaatggaaggtagaaaacaggaagaagctaaaatgtcatatccaggtgcaaactagaagcccctcgtccaccctggccatgagctccctcccttcctctactaaagcatcccctgaaccggggagagggactccacttcccagttcttgggccttcactgctcccgagcacaagccgtaaaatgacgggagctgtgtgaggtgccaaggtctcaaatgaatgcgggcagcagcacctgtgaagctgataaaacatcagtttgcatttggctcaccttgcaagagggggttttatgcctctcgttttcgctccgctcccacactcctgtcacccagcagctcacactataaagagcatcccctgcgctctgtcttaaggaatgggcactaaataaaagaggcagcatggtgctgttaatttttcagcataggggacgctctgcctgtgacaccagatggaagaaaatgtcctgtagcctcctcccccctcatcaatgctcagtcacacctctctttaagcatccttcagctttcccgagaaactggtggaaaatggtgttgtctgaaaatctgggaatttttcccttcctcctgctaatggcctgggttgaataaacattgaagaggaaaatttagaaaaatgaaagagagaagagaaacgctctacccctagatggggctactgtccgcaagcagagtgtgtttgttttttaaaattcagttcacttacagtgagactgagattaggtatcaacagagaatttacaatttaaatcaaactttgactcatttaattaagtctttagtcctgtgaacctcattcacagccttagcattgggctgctctaggactccaattgataaacttcttaatttcctgggtgtctgggttttttttcctttaaaaaaaaaaaaaacaacccatacatcaaatccaaactgttgaataaactacaaggaaatagtagccagcagcgaatgtttatatgttccagggtaatagataatgaataataagggactgagggtgagggtagacttaacaaaatgcttggaaaagcccaggtgagcttcaatctgtccacttgggaaataagtctgaagaaggagaactgcattccaattaacatctgtaatttgcattgtatgaaagcactagaaaataatagttttgagagcttttttaatgtttccagaggtaggagtacagataatcttatttaagaagcaagcataataggtctttctgtcatttctgagctgctgaatcataggaaggacaggaaactctacctcaagtcatgagaagaaaaggtctgcatgtgtctccttagccttaacccccttgcctaggacagaaagcggctgaaggagggctctgcctcaagtgtttcttaatcattcccttcagcaatggtgctgcttttgttacatgactgctaaaagagctgacgtgtctgtattgtgtactgggcaccattttacatacattgactcatctgctccttaaaaccatgctatggtttaagtattattacaatatttactagaaaattaaataacttgtagaaactcatgacccaaatttttaaaccttattttagattcttctaagaccagggcaattgtgaaaactcagtgttacccataaataaaacagcggggcactctccttatcaggaggcagtgtgccttaaaatcagctttgaagtcaagccagacttagctgcaagtcccccctccatcactgcaggctgcatgcctttgggcaggtcacttcagccttccgagcctcaggttccaagtctgtaaaatgggttagcatcattcccatctggcaggattgtcatggggcttaaatgagataacacattaaaagtgttcaggcctcagcctggatgttagcccaggtctcgcaaatacaagaccagccaccttcctcttcctcatccttaatgcttcctaatattctctctcacctcccacactagcagcgccattgcaggaactgtccccgtcccactgcactggctggcccagtgccacatactgcagggaggagacacaagcatgcggccctggggagcgctggtctctgcacaaacacggctcttgcagctttcaccctgagctcgccctgcgccagggcagccagtcatcttgacaagagcaaggaccgagttataggtcaaggtaagtggcagaagcaactcactttgatctgtaactagagctcagggagtcccattcgaccctgcaaggggcctgacaagcacaagccccacccaggagccaatgtgtctccgcagtgcttgctctagaggaggagggactgggcgaggtggggggaggagcagcctttggttcagaagcaaaatagggggaaaaaagaggcccagaaagaaacagagaggggagaagaagcgctgttaagtgacagagccacaaacagagctctcttgtctactgaagtgatgtaggggaactgaggtggcattggagatatgcctcccacagtgagaaagattgtactgggaagagatggagagaaaggtgcccctgagggaagaaggtaagccggacactgagacaagaaaccaggaaggctgagggagcgcctggagctgggatgggctcactccaggtatacaatgtgcacgtggggataaggctgcactaagtcgggggtcacggctagtaataataagcaaatcactgggaattactctctgggtaggcacaagtgaggcctctcaaaccaccctgacgttcagggtgagggctggagctctctgctcctgacagggagcacagcactgcatcctcgcagcccaggaaagttctggcccattcgaggaggtagccgggggtcccactgactctggaatgcttggggctctattttagtccttggaaccccaggagagtcagatccctcgtctgcaaagctctagatatccctgtcccttgatttttcttgaatcaggaatgtcctctaatttcagaaattaatttgaacaatttaaagccttctgggattcagaggaggcagcttggatgctacgtggagctacaggaggggcgcagccaatcagccactgatcttcactcctcaggaacacacggaaaaaagtccactgagcaaatcagaaggcacatacccgtgtgcaaatacacaaaatgtatcctattataaaattttattagcagtgacagttttaagggagctttagcaatatttcaagctctggcatcaaaatctgacatattcaattttgcttttatcaggttatctgatgacatttctgcaaaagaggcactcgcccatctcaggctcgcccctcctctgctgggcaacacttgcctacagttggcggagccagcatggacagcatctctcttcttctgctgaggaacaaacaagggttcaaccctcaacacacaaagaccaccagcactgcttgccctttcattttatagcaagctcatgtctaaagaaacccgtaggctcgtgggcaggggaccaaatggcaagtgcagatagtgtcattacagaggactggtgagctctgcagatggcatctggggcatcacaggtgacaggcaggctgttgtggggccctgcgtgtttgtgcattattgcaaagaccgggaatcagcagctaaagtgcatctacctggttagggggcagcctgccctggacagctgagagctgggaaagccatctcgaagattgccacatcacaggagaaaagccccatccattccgctctttctttttaacaagttcaggggtacatgtgcaggatgtgcaggtttgttacataggtaaatgtggtcatgggggtttgttgtacagatgatttcatcaccaggcattaagcctagtacgtgtcagttatgatttctgagcctctccctcctcccaccctccaccttctgccaggccccagtgcctgtttttcccctccagtgtatgtgtccatgtgttctcaccatttagccctcacttataagtgagaaaatgtggtatttggttttctgtccctgttttagtttgctaaggataatggcctccagctccacccatgtccctgcaagggaaatggtctcattcttttttttggctacatggtattccacatggtatatacgtaccacattttagaaatgcaaatcaaaaccacaatgagataccatctcacactggtcagaatggctattattaaaaagtcaaaaaaaaacagatgctggtgagactatggagaaaaaggaatgcttatacactgctgatgggattgtaaaaaaagttcagccactgtggaagacagtgtgatgattcctcaaagacctaaaggcagaaataccatttgacccagcaatcccattactgtgtgtataccaaaaggaatataaatctttctatgacaaagacacatgcatatgtttgttgcaacagtattcacaaagcaaagccatggaatcaatttttcttaataaatgaatccaggaacaaaagagaaggctccatgaaacccattaggtgcacagcaagagggtgaggaggttaagagggaatgagcatatctcctaatgacagagtctctccttgacccaacgttagtcaggctcttctgaatcctcttcctatctgccatgacttttaggctttctttttccttttttttttttttgagacagggtctcactctgttgcccaggctggagtgcactggcgtaatctctgctcacagtaaactccactacccaggttcaagctattcttgtgcctcagcctcctgagtagctgggattacaggcgtgtgccaccacgcccagctaatttttgtatttttattagagatggggtttcaccatgttggccaggctggtctcgaactcctgacctcaggtgatctgcccacctcggcctcccaaagtgctgggattacagatgtgagccaccacgcctggcccacttttagactttcttatccatctttgcatccctcaattttagcaagatctggctaagttggtttaccttcaatatctgatcacccttgatataagattggtttcttcattccctgccatcttccaggtgacatctgatcacctcggcctgcctacagcaagaatcctattggcaaataattactttgccttctgagtaattttctatccaacaacccccaaccactctgtctcatcctgctcttggactacaaatccccaatttttccttattgtatttggagttgagtccaatctccttcccctgctgcaaaaccccattgcagtaatcccctccaaataaagcctgccttactgttctttaacaagtgccaggaataatttttaagcactaacccaaatttctttcctgtactccttacaacaagatgtaaggagcacactcggcttgtcctcaggttgcatttattaaacaaaagctaaaatccccctttcaaatatgagaacataaagcatataagagagaagtgtttcctgggtgatccaaattaaaaataagagccatgggccaggtgtggtggctcactcctgtaatcccagcactttgggaggccaaggcaggcacacttaagttcaggagttcaagaccatagtgaaacctcgtctttactaaaaatacaaaatttagctaggcacctgtaatcccagctacttgggaggctgaggcaggaggatcacttgaatctgggaggcaaaggttgcagtgagtggagatggcaccactgcactccagcctgggcaacagaatgagactctaaaaaaaaaaaaaaaatagccatgggcaagagagacatgtccttgctgatttctccccttgaatctggcccactgaggacacctcttccttctcttttttttctttttctttttttgagacagagtctcgctctgtcacccaggctggagtgcaatggcacgatctcagctcactgcaaccaccacttccagggttcacacgattctcctgcctcagcctcacaagtaggtgggattacaggtgcctgccaccatgcctggctaattgagatgggttttcactatgttggccagactggtctcaaactcctgacctcgtgatctgccctcctcggcctcccaaagtgctgggattacaggcgtgagccactgcaccccgcctcttccttctctttattctgcctgaggatgcacgttctcttttgacagtttcagcggattgaggctgaatgttaagttttctgccaaaatgggttcagtatcttgtcagctatttcctctgctgaaacgaactttcatctttaatctactcaggagtgctatgtatgacaggcgatccttggaggagagaagtctgagggacagcctgctactgtatttaaattggcttcacccagacagataaatacaaagataaggttaataagggttaataatttatagtcagaaaagtttaagaggattgcataatttaagcctcccgtgaaggccccaaaccaaactctatattattatcctgaagccgggtctactccgtgactctccttctgaataacagcccctcatgagtctcccagatacctgacctcaaaaccacagagccactgaagccaccttctgtctccttctccatcttctctgagagacagctggttaatcaggtcaaattattcttatctgattattagtcattagcagttatagttattctctagtaccttccacatttgttcttatttttattctcacttggatacttaagaataaaattcttctgcttattttgtttgaatccgtggattttaagaattattcctggctgggcgcagtggctcacgcctataatcccagcactttgagaggccaaggaggggagattacttaaggtcaggagtttgagaccaatctggccaacatggtgaaaccccatctctactaaaaatacaaaaaggaattagataggcatggtggcgggcacctgtaatcccagctacttaggaggctgaggtagaaaaattgcttgaacctgggaggcggaggttagagtgagctgaaattgtgtcactgcactgcagcctgggcaacagagcaagcctccatctctaaataaattcattcattcattcatgcattcattcattccatagtacagctacgatcatgttggtgccccattcaaactcagtttgcatcgagggtgaatctccctcccctccctaggatccctgttgggatctctggagatggtaacctgcgtggaaggctccaggctctggtcctcaccctctctgtgaattccacttgaaagcctttctgcctacgtgaagatgcagatgaaggacccgaggcttaaggcaacaagaaaatttagaatagttagcagccgagataatgaataagaattttcagtaacttctgggcaacataaaagtggagtgctcagtctgcaatttttgccccatcacctttaataagcatgaagcaaaatgaacaaaaagaatattaaacttttaaagactaaaagatctttcaaaatatattcctcgcttataatggtggcaatgaccctttccctttgttacctagctgaaaaaaaattacaaagtcgcatcaaaagcagaaatgaacattgcagaatgggagtagaatagtttgcctccaaggaaagtgattgaaagttgattatccggtttgttaaacagctaacattgaaccctgtggtcgggttttgggtgaagactctaagcctgaaaggccatggtcagggtctctctacggagctggacggttggactttctgctgtcgtggcaatgttctgtatctactctgtccatatcctggctactggctgcatgtggctgttgaaccacaactgaggaactgagtttttgttttattgaattttaattaatttttaaggctaatttaaagagctacatgctgctagaagctaccacattggacagcacagaataaggcattcatgctgctccacctttccccgattcttgttcacaaggtcagaggttgaggaaatgtcaatgcaaaacagaagggggtataaggcagcaggacagaccctccacccccaccccggaagcagaatcacacgcttcgcttcaggcctgcctgcctcctggtgtgcaatgctgatgtcagccgtggagttggcgtatgtgttctgtggaatatctcataagttaaggagtctataattagtactgggaatctaaataataatcatgataacaagaactaaccttgatagagcgtttactaatagaaagtcctttacacaggtacaaaccagttgggtagctttatgtaaatgagcgggacagaggcctagaaaattcaaacagcttggccaagaccataagattaataagtggtagagtcagaacttgaacctacttctctctgactgaaaatcaatcaactcttaaacagtaaacatttaaagtgggattgtggctcagctgctcaaccagtggaccaaacaactaattctctgagaccctgggccaccagtagatgcccaggacagcaagagcccctggccagtagcctctaggctggtggcgtctgtccagaagcagcagtatctctccaccacagtgtgccctacaaatatcatcactgtcttcacgtggaacgaggaaaaaatgtctaggaagcactgaacgacattctaaggaaaaccatgtgggtcattcccaaagagctggtcatgaacaagaccccaaggatgctagcacaccatttgactgactccaagaacagtattggaggcaggaaaatgtcctcacgtgccacaagattttaaattctaatttgcagtagaaggaattataaataggacaaagtcagaaatcaccccaatttttgcatagccagggtcggttaaattcatgaataatgatgagaaaatgaagaccctaggattaaagtggtagcttagtttccgtaaagacattaaagatatatacatctcagtaaagaagcttcctaacactgtcattctcagacaatggtcaaatcaggtgtttccacatggcttcttagagcaaagtttcttcaggacaatgggacatttgtaaaagagacccaagctttgatctgatccatgacagggaggctgctggtattcactgagtctgtcgccacatcaacctggtgaaggcttgggcagcacctgtcaatccgacacgaagaggtgttccatgagtttaatggacaccgtgtgccaactccattttaggttattaatatcaattggagggaaaagaggaaaacggggagagattgctcaatagtggattttaaaagtcttttgttgcatcttgctgaatttggtcccaacttccctcatctaacaaaagataaaaataggctccaaggctgttatgctgagagttaacatgagggaggacttatccctcattttcttgatatctatcccatgtgaagagaagttttgtaactgtgaaatgatatctaatgcgggttctaatatagaaacatatttcttccaatgtctcacactccctttcattcgagcgaccaagtcctgctcacatataattttattagaacttttctcaagggttactattaatactcagaataccaataacaactataatgtatttaccacataccaggtaataggctattttacatagattatcttagaatttccctaaagcccttgaaagataattattatgctctttatgcaacagatttgttcactcattcattcaacgcatatttattgagcacctgcccaacagcagtgggcatttcttacccgttgctgttgggagcacagggcccaagcaggctccctgtccccagtgaggaaaatacaggtatatccaaaggattacatcatagttcttacataaaattattctgttaccatatgctcacatgacaatactgcttctttacaaaatggtatctgcgtgagtgaaaaacaattcagggtgggtgggtgggagactcgggtcttgtgtctccagatttgggtcccaccttaccaaattccatcatgtagaaaaagaaaattcctcaatgtaattgctcctgtgttgatataattgatatccttccagaggaggaaaacctagtttttaatctattttgcattgttcaccttctcagcaccacatacttagaataagcaggaatgatggctctatcactgtaccatgaggagatgagactatggatgctgtgccagggtctgtaagacttttaaacaagagctttgtttgattccattattaatctcatcagagagaggcccaaaagtcatttaagatttggttactgggccaggcacggtggctcacacctgcaatcccagcactgtgggaggccggggtgggcagatcaagaggtcaagagatcgagatcatcctggccaacatggtgaaaccccgtctctactaaaaatacaaaaattagccgggtgtggtggcgggtgcctgtagtcccagctacttgggaggctgaggcaggagaattgcttgaaccagggagttggaggttgcagtgagcggagatggcgccactgtagtccagcctggtgacagagcaagactctgtctaaaaaaaaaaaaatttgttactgaatgtgggtttgaatgggttaaaaagctggcacagaaatgcaaaaaactaccgattttctctaaggagactatcagaagaaatgcaactttgtcctgccttgcccaagggcagagaaggttgcagacatcctctcccctcctcagctgtctacatcaagtggttgaggggtgggtattttgtggcatgaataagaggattattgtgcagcaaacacttgatttctaagcattttacctgtacttttttagattttagtctttgcctttttttttttcctatttgtttcccacttagtaccttagaatttgcctttttaatgcaaaattagcatagtaaaaaaattgaatccggggtgcatcacttagaaaagttaaagaagattttcaaaattaattgttgacaagactcagcaaatatttgctgaatacctgttatgtgccaggtaatgtcataaaccctaggcataggactgggaaccaggtcctctcttcttggaattcacattctatttcacaagggttgggaaagaggaagaaatacagaatggaaactctgccctgagcacaaaacctgtgcatttggttagaagaaggctggtgctctgcacacaggggcctaagagaggaatatgaggtagtggagctctcagtgacctcgctgttagagctgtagggaagatttaggtcaccgccttatcttacaagtgaggaaactgataccaaaagagactggaattattgtctgaggtcacccaggctgtcccactggatgtcaggtaccgcctcttcaggactattcattagcatttgtgaaagtcaagatataacagcatatttcgccttatttctttcttttcctctttatgttgtatttttctttttgggtcattgttttgcattaatgttcatagacaatttttcaccatttatgtaggattagttctcattgaaatattaattccacattttcaataatttatatgatttgatgtcacaaatatctggataatttgatatagcatcaaaaaaaggctttctctaccttcatgtattatcatataatgcattttcttatcatagggaaatcaaaatgtgtctctctaattccttttggttttttaaattttatgagtttaacatgcgtgatatataaatcacagtcaaacattttcttcttacctcatctgatttcgtttgataaaatcaactccatctatatgtatgtcttttagaaatacgtctcagtttttcccaaatgggtatgtcttacatctaatgcgtgagaaaaaattccagtagcacctccctggggaatctgaactaggccctggttatgctaatagaagccaagaggttttcaaagcaaaagaactataataaattattcataaataggtctctctcttgatggttttggtgtttccgaattttccagaccatagaggatatgtgaaacgatacatgcacgctaagctgaagatgttacagagggaaatgggaattgaaaactaattggaattttaaagcattgcatttttgcatttggtacactttctggagctggtttgggcatggacaagacccaggagcctgcttttctggtggtccttggtgactacggatatttttaacaggcagggactggtttctgaggaaagtgtgtcccagttcccaaaggaaaatgactcctcagtgactgttagccctcgaggcagttccagatgaggtgctagacttaattcaggttgccagtctacagaaatgaagactttacttggcatactgctcgtttgcacttggtttgtcagactctctacctcctcttccttctttttcttaaacttgtttttcagtttgttcctctgggtctctacattgccaaacccaagggcacctcctagtctgcgtgacggacccccacgcctggtccagtccacaggtgccatggttttgttgtacctgccaacatttcaactgttttagaattcttttttgtcttaatgggtgttgacaggttttaaaatgtttcctgcttatttctacttgcaattttctgatctctgtaatttaaactaattgcatctactttgttatttattccattttttgtactcatttaatagaaaaaataataatttcttcaacttcagtcttttgtgtttgccgaaacccaccctggcctcacatgttcaagttaagccctgcccccaccttcctcacactcccatagggtcacagaccatgcactgatttacctgcctttaggagcccccaaactccttccttttgagatttttctttgtaatgaatgtcctcgccatgatcacaacccaaataaaaactcttcagtcgtctgctgtattttgtctttaacagtgaacagaattcaattcgaattttgggttcacatttagtcttataatttaagaaagaataggaaaaaacggagagcaacttgatttgaaaaagacaaatctgaggcgggtgagagattctaagtcctgatgtgcttggaacagtccagacctctgtcaattgtcccagcaaaattattaccagcacccccttttacactcagaagatcctggtctagatgaagaatcatatgtgcgtcagctattttcgctaccgtaaagcccagcccagcacagtcccaaggatagagtaagcagccaatatacatttactgagttaggaataaaaagatgccagcggtcaccctccttccctcatggtgggagccagggaagctgacgctactacaaagctatggcgtcacaggtactggacactggctagtcacatatttatatgactcctggaagacagccatgagtagatggctattatccatattttaataatatctgctaagaaaaataacaattttgagatagcacttgtggaatgagtcctccatatttaatgaaccagggaaacataagggaaaggttaaacaattctatgaagccaggcgcggcagctgacgcctataatcccagcactttggaaggctgaggtgcgtggatcacgaggtcaagagatagagaccatcctggccaacatggtgaaacctcatctctactaaaaatacaaaaattagctgggtgtggtggcgcggctgtagtcccggctacttgggaggctgaggcaggagaatcgcttgaacccgggaggcagaggttgcagtgagctgagattgcaccactgcactccagcctggtgacagagcgagactacgtctcaaaaaaaaaaaaaaaaaaaactctacaaaataggagaaatatctaaaagtttttttcttgtttgtctttatgaagggcttcttcccgttcagtaataatttcccttgcaatggagcaaaacttgagacaataagggactcaggaatgtgttgaaagctcatgaggaatttagtctaattccttcattgtgagttgctggcattctactccatttgcattcagcctcctgttaccaccaatgctccccatcagtaacagtcatactaatgtggggtggaatgagaaactctcagtgcttccaatgctataaccacttgcctatcccagtttccaatctcctttaaatactggggatgttaaaggtaactgagtttatgccttggattgtctgtgaaatcgtaggaaaatacatgtgatcttccaatgccccagtacttacaaataacgatactttattgccatggatttaacgtgtcctccaaagttcctaagttggacacttaatccctgatgcaacaatgttgagagatgggacctttaagaggtgattaggttatgagggctctgctctcatgaatggattaatgtcgttctcatgggagtgagttccttatcaaaggatgcatttggcccatttctctttctctttctctctctctctcagtctcttgcccatgtgatgtcttcaccatgttatgaatcagtaggaagaccctcaccagatgcaggccccatgatcttggacttccagactccagaactatgagccaaataagtttctgttaattataaattgcctagtctgtggtattctattatagcagcacaaaagagaataagccgattactatattatgtttcagaagcttttcaagaatcactcttatattatgcacaaataatgtgttttgtttgttttttttttgagacagagtctcactctgttgtccaggctggaatgcagtggcgtgatctcagctcactgcaatctcggcctgatgggctcaagtgattctcgtacgtgcctcagcctcctgagcagctgggaccacaggctcccaccaccatgcctggctaatttttgtatttttggtagagacagggtttcaccctgttggccagtctggtctcgaactcctgacctcaggtgatccacccgctgaagtcctgggattacaggtgtgagtcaccgcacctggcccaaataacgtgtttttaatagttactgtgggccaggtgcagtggctcacgcctgtaatcccagcacttttggaggccgaggcgggcggatcacctgaggtcaggagtttgagaccagcctggccaacatggcgaaaacatatctctaccaaaaatacaaaaattagccgggcgtggtagcacacacctgtggtcccagctgctcaagaggctgaggcaggagaatctcttgaacctgggagacagaggttgcagtgagctgagattgtgccactgcactccagcctgggtgacagagcaggactccgtctcaaaaaaaaaaaaaaaattaattgttactgtgaggaagatgatagccacagagggaattttttaaataaacaacctttcaacaggaagacagagaagaaatataaaacacaatcacatgggaggctgagatgggaggatcccttgaggccaggagtttgagaccagcctggacaacatagtgagactccatctctacaaaaaacaaacaaagaaacaaaatgagccaggtggtggtgcaagcctatagtcttagctactcgggagttggaggcgggaggatcacttgaacccaagagtttgaggctgcaatgagctatgatcacatcactgcactccagcgcgggtgacaaagcaaggctctgtctctaaaccacacactcagacacatatgccatcacacacacacaatcacaaagcatcagtcaggaaggccagcaagagcagaacacagaatgttaggatttcaaggtagaagctcaacactcaattcaaggtaaacttgataagaatttgcaacaagaccaatgatctgctaggtattataatgaatagaaaagcaatatggggttctggctgtaaagcaactgagcttttttgaagaaacattaaatgcacacataaaacccctgaatgtatgtcagcagatgacgaatggctctaaagtggtatggaataaaaaggaaaaatcatgaaaaaagaaggcccaccaaattggaacatctacttggaaaacttgagaaagaacagttttggttgggagtcaagtgcagttaacaggattcagagtgagcaccgcgtgggcctctgaggtcagaaaccagagggaggccagagaaatgagatgagctacaaagtgcctcaggaaagagacagctgggaccagatgacacacacaccatggcctgtttttatgttttatgtcagttttaagagacactgggattttcctaaaacaatatatatttgatggaaaagtgctgtccatttcagtagcaaaatcactttattatattgctgggaaaacttgagaactgaaagttggaagacagcaggtggaggttataaatttgatattaatatggcaatatggagtgagatttatgggctctgatagaatgtgatcttttactgaaaactgtttttactttcttatatgtatctcagtgatttgaccctggttttatgtgaatattgttttaggggatgtagttttctgaatacaatttattttattcaaatgactgcttacggatagatagctatggactagtgcggctacagtttcaataaacagtccaataacattggaagataagttttgaaagactgtaagaagccaaagaataagtttagacaattacatatttggatataattgcttttgaagtcaatattcaattttaaactgtttaagataatatgtttttgcttttatctaaagtatatgagagacttacaccaagcactaaactgaaattgtggtatgcaacatgactctacttaacagagctaggaatactgtcagtttgcaaaggtaaaattacttcgactttttctctggaaaactgaaatgaattcctttggaaattaaagtcctcgttgctttacaaacatcatttcattatgcaggagatctttactcacaaacattcatatcacacaatgtcagaaacacgacaaggagagaaggcatggggctgtggtcaacccacaaaagacaggcttttatccccagctctaagaatttcccacagacattactaacccatcatgcccattcagtgcacacagagtgacaaggtttcaagtggcgctgcagtgagagactactatgacaacgaacacaaaagaacagacattttaaaacactaaaaattggcccggtatggtggctcatgcctgtaatcccaacacttcgggagaccaaggcaggtggatcacttgaggtcaggagttcgaaaccagcctggccatcatggtgaaaccctgtttctacataaaaaaaaaaaaaaaaaaaaattagccaggcatagtggcaggcacctgtaatcccagctacccaggaagccaaggcaggagaatcgcttgaacctgagaggtggaagttgcagtgagccgagatcacgctgttgcattctagcctgggtgacagagcaagattccatatcaaaaacaaacatacaaacaaacaaaaaacaaaccactaaaaattaaatgaaaattaagattaaaaaatattaaaaataaaaaataacagaaaaaaattaactgaaaattcgaaatgcatatgtgatgaaatgttaggcaggaagaatcagcaggagggacaaccgccaaaaatgaaagctgcaaaaagtaattttttctgtctattcaacccacaatcatcacaggctatatttgaaaagtaggtaggtgtacttacctacatatagctgtttgtaggttatatttgaaaagtaggtaaggtgtacttacctacatataactgcacttacatacagttatacatatacctacatctaatgtagttatggttttttaagagagtaaagaataaaatggaagactaccattactgacagtcttctaaaaggcagtcaccatagcatgattaatttattcctggtgttctcttggtcctcacatacttgattctcttgaaaccagtgaaaaactcgcatgtcttactgctagatctagaaaagtggttctcggccgggcgcggtggctcatgcctgtaatcccagcagtctgggaggccgaggcgggtggatcatgaggttaggagttcaagacaagcctggccaacacagtgaaacactgtctctaccaaaaatataaaaattcgctgggcagggtggtgtgtgcctgtagtcccagctactgaggaggctgaggcaggagaattccttgaacccaggaggtggaggttgcagtgagccgagatcatgccactgcactccagcttgggcaacagagtgagacttcatctcaaaaaaaaaaaaaaaagaaaaaaaaaaagaaaaagaaaagtggttctcacaatgcacaccttgcaccagaaccacctggagaactttgtaaaaatgcagctgcttgctcaccacccccagaacctctttctgcgatgatcagggtggggttttgggcactgatatttgtaagatctgcatcaagtgattctaacatgctgccagttaagaaacactggttaacaaggagacacatatgaaacctcatatatcagacatctaacctacccttatttcttttattctcaaatctccatctcagctttcttcttcatttagaatttggatataaaccgtaactattaaaattgactgaatatatctaaaaatcattgattcatttacttattgcacacatacataatccaccattcatctgatgagatcacagcatttagaagagtactccaaacacaggctgctaaatcctcatctgttgattgggtctttaaaacattactattgttcactttcatactgacaacaatgttatgctatagggtaagctcaaatttaattttctttctttacgctgttctttattgtattttttccattaaaataatatttgacagataatccttatacctgttgcttcaaataataaaaataacctaacttattttatgagactaatatcttgttacccaactggataagaacaatgtaagaaaagaaaattacaggccaattttacataaggctatagatataaaaatccttcgtaaatattatctaacataagaaagtgtacagttaaaaaagcagaatcaagcagggttcatcccaaggatttaagaatagtttaacatcagaaaatctatgtatgtagttcatcaggttaacagactagaggagaaacttttcatgctacttagatgctaggaaagcatgagtccaagcacagggtctctgtctctctgcctcaataattctccagattacgatcaaagatctgctaggtgcggtggctcacgcctgtaaacccagcactttgggaggccgaggtgggcagatcacctgaggtcaggagttcaagaccagcctggtcaacacggtgaaacccagtctctactaaaaatacaaaaattagccaggcatgagggcgggcacctgtaatcccagctgctcgggaagctgaggcaggagaatcatttgaacccgggaggcggaggttgcagcgagccgagattgcgccactgcactccagcctggtcaatgagagtgaaatgccatctcaaaataaataaataaataaataaataagattgaaaatgaactgcttcttctacagagcttctgtaggatgaaaaaaaggcgctgatatatgctttctgtaatttgactcaatgggtttttgaatccttcatataaatttataacatcatatttcatttattagaaggtacatatactgtttttttagtagcacatttttaccataaatggtgactgtaatcgataaaacagagtattcaatatatttctacaaatgtgtattcccttctccccagagaacatcatagtataaggtgatctccagttttcttctgattctatgatttaaaaatcatccctgttctgaagctcttaagtattttgtttcttttaggtgcattggaacaccaaaatcactcatctgtttctttattcttgcttcccgctactcaagaacataaaataaaagctctcaagtactaaaatactgggctttatataaactagagtttatataaatactgaaaaatatttcttcctagaggtcagactgtcttcagggtcatggctaacataagcatttgcttagataaaaagttgacatttttttctgtaaagaatcagagagtagtcctggcacagtactttgggaggctgaggcaggtggatcacctgaggtcaggagttcaagaccagcctggccaacgtggtaaaaccccatctctacaaaaatacaaaaattagctgggcatgatggtgggtgcctgtaatcccagctactcgggaggctgaggcaggtgaatcgcttgagcccgggaggcagaagttgcagtgagccaagatcgaaccacggaactccagcctgggcgacagagtgagactccgcctcaaaaaataagaagaatcagagagtaagtgttttggctttgtaaaccatacatcctctatcagaacggctcaactctaccactgcggtgtgaaagcagccacagacaatgcatatgagtagggttgcatttcaatacaactttacttacaaaacaggtggtgggctgcatttggtgcatggatcctagtttgctgacacctggcttagatgcagtgcacccactgaggaacaggtgtgtcctactctgaaagcagcatgagctagtctgactacttatttcaaatcaatactatattttttaaatggcccacattttcaatctagcaaatctacattggggtatgtgtatgggtgtgcccatatgtctgtatctgttaaatgtatcagtttgcttttaaaatgttgagacacagctcacataagcagaatatcagttcaaagcagttctggccaactcagtttaaaaaataacaacattggtgtgttactaatactaccatttctatacgtagcatgatttctcctctctggtttaataacagtcatccaagtgtgacttcaagtaatgatcacttccagtgagctcgagtttactgctaaggtgtgaggttggaaagaggaagacacaacttcatggagatcaaatcactcatgaccttaacagccaaataagtattaaatggctgcaaggtaacaggtaggcaaggtttgttgtagcatccaattatcacgttggtgcaaagacactcagtagacaacaagtatctaatggccaaggagctgaaacttatgaattggctgtttaaaaaatatatttgccataattccttctcacacctaagtttcccaaaaggaatgcataaagcaggtactaataatggaacaaaaataataaagtgcttgccagggtagttgattccttttgaaaactgatcacaagtaagagattttagttacagctttcttttgcttcaatgatttgctaagaatccataaggataacctattcagatactattatcacatgagacatgatatgtgaagcaaaaactgttacgggaatttctgcttgcatgtacactggctgttaggttacagaatagaaataggattcctctgcatatttaacattggttctccatttgtagccggacaaccagatagtactgatttcaaagtcactgttaaaaactctaaaaacttagatttcggtaacatgtcatcacattgcacgaaaactggacctgccactaggcttggagaagctctgatgtgctataaacagccctaaccatcaagatggtaaaggctagtgtgacccagagacttctgctctctgaatacccacccccaccttcacctattccctttataaatgctaacagagcccgggaactttctgttccagagtgagcctgcaacagcattctcttgggtgaaatgctcttcccgttggcggtgagaatccttcctccttattctaacccatgctccccacagaggaggaggaaccctgagcttctcttagggaccatggcagagggttggaggcatggaggcagctctgcatggccttttaatgcttagtatgctcagggtgccgcctttcaattaactagcacagctgtacttttttttttttttttttttgagacagaggctcgctcttgttgcctaggctggagcacagtggcgtgatcttggctcactgcaacctccgtctcctgggttcaagcgattctcctattctcctgcctcggcctcccgagtagctgggattacaggtgcccaccaacatacccagctaatttttgtatttttattagagatggggtttcaccatgttggccaggctggtctcgaactcctgacctcaagtgatccaccacctcggccttccaaagtgctgggattacaggcataagccaccacacaaggccacagcgatactttttgactaagtaaggcttccgtaagagttttcacacacatgccccaaatcctggattatatgagacaaaaataaataggccacgtgtgctaattgcgtacctctctcttctcacatttcggttttctagaaatgagaacgcaggccagacgcggtgactgacgcctgtaatcccagcactttgggaggccaaggcgggtggatcacaaggtcaggagatcgagaccatcctggccaacatgctgaaactccatctctactaaaaatacaaaaataagctgggcatggtggcgcatgcctgtatgcctgtaatctcagctactcgggaggatgtggcagaagaattgcttgaatcagggagttggaggtttcagtgagttgagatcatgccagtgtactccagcctgggtgacagagtgagactctctctcaaaaaaaaaaaaaaaaaaagagaaagagcatttcttgtatgtcttgtgacaagagttaacaaaaacagtcctgcttcttaactgttggtgacatttgtaaaggtcccatggttatgcttattcagtgggattccgtcttcttgcatgtctaatggtgttagaaggcctgaaactatgcctaaaactatggttttatcccagagagaaaaataaattcatatcaagaaaaatactaagatttatatataaagcaacaataatggcaataataattctatggtgtaattcccctgagaaaaactgaacggaacaatggttaatcttaaaatattctacagtagagctcaggacttagtataattgcctgctactagtctcgtgataacagtcgaagctagttttgtggagggtttttttgacacttcaaaattatcatgttgtcttcaaggtcacaaatcaaagtctcatctattagtgtataatagtaagtttacagttttaaaatattttatcattaagaaaatattaactgcaaatttaaaaaaagtactaagtggaagtaagcgaaaagacagatattgtgatgaaaagaaagaccttctttccctgcctttttgagtgtattgattcattcatttaactgatacttgttgagtgtctcctttgttgtggtccttctgtgaagcacctccattcaacagaccctttctttgggtaagtgtgtataagtttcaacaagggaaatccatgtatgcatgcaattgtagagactaggacacttggtgataaaggacttgaaaaggaaattaatatcccacttaaatcttctttttcaacatcagattttacaatatttgcgatctcgcactcactttttctaaaacaactcattggacaccgttgcctcatcacagccctaaaacagaactccctctttcggtcagtaacaccatcatcttcctagttttaaaaccttggagtctgttttttttcttgtaaatttgttgaagttccttgtagattctggatattagacttttgtcaggtgggtagattgcaaaaattatctcccattctgtaggttgcctgttcactctgattatagtttcttgtgctgtgcagaagctctttagttcaaccccatcaaaagaggacaaaggatatgaagagacacttctcaaaagaagacatttatgtgaccaacaaacgtataaacaaaagctcatcatcactggtcattagagaaatgcaaatcaaaaccacaatgagataccatcttacaccagtcagaatggcgattattaaaaagtcaggaaacaacagatgctggcaaagctgtggagaaaaaggaatgctcttacactgttggtgggagtgtaaattagttcagccattgtggaagacagtgtggcgattcctcaatcatctagaaccagaaataccatttgacctggtaatcccattactgggtatatgcccaaaggattataaatcattctactataaagacacatgcacacgtacgtttattgcagcagtatttacaatagcaaagaaccatcccaaatgcccatcaatgatagactggttaaagaaaatgtggcacatatacaccatggaatactatgcagccataaaaaaggatgagtttgtgtcctttgcagggacatggatgaaactggaaagccatcattctcagcaaactaacacaggaacagaaaaccaaacaatgcatgttctcactcataaatgggagttgaacaatgagaacacatggacacagggaggggaacttcacacaccagggcctgttgggcaatggggggtaaaggcagggagagcattagaacaaatacgtaatgcatgtggggcttataacctagatgatgggttgaggggtgcagcaaaccaccatggcaaatgtatacctatgtaacaaacctgcacgttctgcacatgtatcccagaacttaaaagtaaaatttttttaaaaagtataaacattcaaaaaaaaaaaaaaaaaccttagagtcgtcagttgcacccctttttcttctccctcatatgcagataatccccaaatcctaccaactgtcccttgaaatgtctcacaatctgttttttccattcaactaagatataaatgtgaggtatctttcaaaaacctgatagtaattgaaaaatattctaagaacttccacttgagctgatattgaagctgggtgactagatttgtttcctgtcacttcctcaactaatgatcacaaacttgctgccttaatataacagaaatttatctcctatcaaggggaggccagaagtctaacacgactgtgcttgctctgaagagtctatgggagaatatattctttgcctctttcagtttctggtggctgccctggcattcctggatttgggccacatcactgcaatctttgcctctgtcttcatatcttctcttctaaggacatttgttattggatttagggcccacccagataatccaggatgactgactcaaatcaagagccttaatttatctgcaaagacgctttttccacatatggtcatattcacaggttccaaggatgcagacacatgattttggaagccactattcaacccactacagtgaattagttcctccctttccctgaaatgaatgcacaagtctcctagccttttttgagtcaggcttgtcggggattactcgaataggaaattccctaaattgttctagccttggcaactctaagtgggagcagagagagtaaggctggtggtgaaagcagttttccttcctactgcaactttattcacctctgcattggctgagcttaacataatggaaggttaaatacagaaataaatgaatgaataagtgaataggcacaggaatgaaggagtaattaatgaatggactaaagaccaaagggatctcaagagtataaattcccatgagctcccctactgtgaccccagcctggagtaacggggtaaaaaaaaaagattccttttggtctactgagcctgtggaagagagaggaatgaaccaccatggctgtgaggtccagctacaaatgggaggtttgtcccttagaatcaaaggctggtggcagcttcccttccattcagaggcgagaaggagtccaagccattcagaggtaagaaggagtccaagtcacacagaagcaacgaagacccgtctatctctgaagtggtcagaagtaaaagctatttcctgtttggtttgtttttttaagagaaagactatgatgtcagaggtacaagacaccatgatcatattgcaacagtcctaagatggtgacacatgtcagacaatcagatcttctcaaattcttaaaattattatccaggatgaactgattttcacctaaacataaagatcaagaagaatcaagctgcttttgtgttcatatgaacaacaaaatgtctcaaaataagcaaaacctcaattgaaagagaggcttgagattacaacgtgaaaactgtttcttgccattattctgttttgggatattcttctctataatgcatttatcactaaagaacattcaatttttgagacagaagaataacataaaagattattccacaagataaagaaaatgccactttgacacagacctctccttttctgtttgtcattcccttgactttgtaaaaaaggaaaaccatgttccttggatttattaaaaaaaaaaagggaaaaaacattctgtgttgttgtgtatacgtttttaaattatcaatctgctcaggactgacaaacatgaaaagaattaatttaatgccaaaaaatctgagaaataatttatgtttaacaagtatgcccccttattcctgtgtgtgtactgtacaacagtgtcctactcttaagaaaagtgagtttagaaagatatttgctcatgtggtttttcaaaattgagtatgacatttcctggaagtgatggtgaaggtaatctctgtatgacaattaacccagtcatcagcaccatacacctgggcaaggggctcaagaatgaaaatctctacacttcccgcctctactccaggtggaaagtcacagggtgggagggcaggcttgagatccaagagaagacttttaacactttaaggtatataggcatagctcatagctgtcatgggcttggttccagaccaccataataaagggaatactgcaataaagtgagtcccatgaatgttttggtttcccagtgcatataaaagccatgtttatactatgccatagtcatattaagtgtacaagagcattatgtctcaaaaaagtacataccttaatttaaaactattttattgctaaaaatgctaatgatcatctgagcattcagcagcttttaattttttgctggtagagggtcttgcctcaacgctgatggctgctgactgaccagggcagtggttgctgaagattggggtgactatagtggttccatacaataaaacgaagacaaagttggccccatcatttgactcctcctttcatgaaagatttctctgtagcatatggtgctatttgattatattttactcacggtagaattttttcaaaattggagtcaatcctctcaaaccctgctgctgcctcatcaactaagtgtatgtaatattctaaatcctttgttgtcatctcaacaatgttcacaccatcttcaccaggagtagattccatctcaagaagccactttctttgttcacccataagatgcgattcctcacctgttcaagtttgattatgagattacagcaattcagtcacatcttcaggctccacttctcatgctatttctcttgctatttccaccatatctgcagtcacttcctccactgaagtcttgaagctctgaaagtcatccatgagggttgaaaccaactttttcaaagctcctgttaatgttgatattttgtctttcacccatgaatcatgaatcgttttaatgacatctagaatggtgaattctttccaaaaggtgtttttgtttgtttgtttgtttttgttttagtttgttttgtttttttgagacagaatctcgcactgttgcctgggctggagtgcagtggcatgatctcaactcactgcaacctccacgtcccaagttcaagtgattctcctgccctagcctcctgagtagctgggattacagtcgcccaccacacctggctaattttttcgtatttttagtagagacggggtttcactatgttggccagagtggtctcaaactcctgaccttgtgatccgcctgccctggcctcacaaagtgctgggattacaggcgtgaaccatcgtgcccggcctccaaaaggttttcaatgtattttgcccagatccgtcagaggaatcactttgaaaatgtgtttttaaattgcaattcttagaagtcaaaaaaacttcttgatccatgggctgcagaatgggtgttgtgtcagcagggatgaaaacaacattcatgtccttgtacatctccatcagagcgcttgggtgaccaggtacattctcagtgagtagttatattttgaaaggaacccttctttctgagcagtagttttcaacaatgggcttaaaacattgagtaaaccatggtgtaaacagatgtactgtaatcccgactttgttgttccctttatagagcacaggcagagtcaacgtggcctaattcttaagggtcttaggattttaatggtaaatgagcatttgctcccacttaaagtcaccagctgcattagcccctaacaagggagtcagcctatccttggaagctttgaagccaggaatcgatttttttttatccaactatgaaagtcctagatggcatctttttacaacagaaggctgtttcatctgcactgacaatctattgtttaatgtagccagatacatcaaacatttaagctagatcttctggataacttgctgcttcaccttgaactttcatacgatgtagacggcttctttccttaaatctcatgaaccaacctctgctaacttcaaacttttctcatgcaactttctcacctctctcagccttcacagaattgaagagagttagggccttgctctggattaggttttggcttaagggagtgttgtggctggtttgatctatccagaccagagtttttccatatcagcgataaggctgtttcactttcttaacattcacgtgttcactggagtagcacttttaatttccttcaagagctttcactttgcattcacaacttggataacttattggagcaagaggcctagtttttggcctatctcagctttcaacgtcttcctcactaagcttaatcatctctaacttctgatttgaagtaagatgcaattttcctttcacttaaacactttgagcccattgtaaggttattattaataattggtcttatttcaatattgttgtatctctgggattagggaggcccaagggtggggagagagatgtggtgatgggcggtcactggagcagttggaacacacacatttatcaagtacgttcacaatcttatttgggcatggtttttggtactgcaaacaattgcaacagtaacctcaaagatcactgatcacaggtcaccataacagatataataataatgaaaaagttaaatattgtgaaaattaccaaaatgttggccaggcgcagtgactcacacctgtaatcccagcactttgggaggccaaggcgggtggatcacgaggtcaggagattgagaccatcctggccaacacagtgaaaccctgtctctactaaaaatacaaaaaattagccgggcgtggtggcgcatgcctgtagtcccagctacttgggaggctgaggcaggagaatgacatgaacccgggaggcggagcttgcagtgagctgagatcgcaccactgcactctagcctgggcgacagagtaatactctgtttaaaaaaagaaaagaaaagaaaagaaaattaccaaaatgtaacagagacacacaaatgagcacaggctgctggagaaatggcactgatggagtggctcagggcagggttgccacaaaccttcaatctgtaaaaatcacaatatctgccaagtgcgatacgatagacggcaataaaaccaggtgtgcctggacaatttttatagtgattgctgtgagtaggtgtgggaggatgtggggtaaggacagggaggagctggtggaaacaaaccttttaaagtagctcaggctctgggaaaggcctcagtttgttttctctctagagttggctctggctgaagaggatggatggggtgatgaggaaagcttaatttaaatagagtcccacctggactgggatcactgctggcctgagttctctattagctggtgactcaagcataattagtgaggggcccacatgatgagcctcgattttgatccaggtctgaaccatgcattattttagtatctggacaaggaatacatgtttttttcatcagtctttattttatttggatctgttctatattgcgagttgattttgtctttccaactgagattggaaacccttagaattaactgttttttaccttaatgtggtattatcattttttctgtaaaacatgtagaaagggccagatagtaaataatttagcatgtgaggtccatatattcccttctgcaactactcaacttcatgctgttgtgacaacattttatttataggcactggaaattgaatttcatataattttcatgtatcacaaaatattattctttaaacaaagaattgcaaccttgtaaaaatgtaaaatacattcttagctcatgccctgtacaacagcagactgctggccacatttagtcagagggcctcagtgtgctgacctctcaccttgttttattctaaattatggaaaagcagatatataaaaacatgaaaagatgatgatgaaaatagaaaaaaggtggtaatgatgatgtctgtttagattaattacataagcagataaatacttgccatagtaaagagctatttggcatcataatgagtgacacaaaagcaagagaactgggttttattctaactttatctgtcaactattagcaatcatgggaaaaatctttcatttatttatttatttatttatttatttatttatttttgagacagagtctcactctgtcacccaggctggagtgcagcggcacaatcttggctcagtgaaacctccacctcccaggttcaagcgattctcctgcctcagcctcccgagtagctgggattacaggcatgcaccaccatgcctggctaatttttgtatttttagtagagacgaggtttctccatgttggccattctggtcttgaactcctgacctcaggtgatccaccaccctcggcctcccaaagtgctgggattacaggggtgagccattgcgcctggccaaatcttttaatttctttaatcccaatcttttacttctaagataatggaaatggattataatgtttctaagatcattttcactattgagattattccatccttgtttacaactgctatcttctcccgtgtataactagctaccaatttactattgttttacgtatagtatacacaattataagacgcaagatcctaaaataagaggtgattgttacaattgaaaatgaatactttgggcccggcgcagtggctcacacctgtaatcccagcactttgggaggccgaggctggtggatcactcgaagctaggagttcaagaccagcctggctaacgtggcaaaaccccgtctctactaaaaatacaaaaaaattagctgggcatggtggtgcatgcttgtaatcccagttacccaggaggctgaggcaggagaatcacttaaacccaggaggcagaggttgcagtgagctgagatcacaccactgcactccaacctaggtgagagagtgagactctgtctctaaaacaaaacaaaacaaacaaaaggaaattaatactttgctcttaatttgtccttaaagcacaggctgtttgtggagaagcacaatctttaggcctcttaatgatttgtagcatatcatcactaagcagacattttgaaaaggctaagaaagatgaaatcaaagtagaatataaattatacatcagataagtcccattatgaggagggaaaaaaatatttggatgcacatggcctacctcttgctgtcatcaaaagcacttgtcaggatgaggcccttgcagcaggtactagagttctactgatttagacttcaatggctggtgtgttgtattttatagtgtaaaataattacaattactttaaaaattgttatggtccagcacaggccctataaatggcataataaatagtctataaataataatgtgaacctcactggaactaaaccacattttcccatttttctaaagcagaacatgctaagaaatagaagttattaaaaattaaaggggatagctgggcgcgatggcttatgcctgttatcccagcactttgggaggccgaggcgggtggatcacctgaggtcaggagttaaagaccagcctggccaacatgacgaaaccccatgtctgctaaaagtacaaaaatcagttgagcgtggtggcgtgcacctgtaatcccagctactcatgagtctgaggcaggagaattgctggaactcaggaggcagtggctgcagtgagccaagatcacaccactgcactccagcctgagcgacagagcaagactccatctcaaataaaaaataaaaataaaataaaataaaataaaagaaaggcgatggtcaacccatacacatgcttttaagagccctgtgctatgttttgagctgataaatacgaggccaagaagaaattaacctcacaatgattatattttttagtataatggtttctatttaacttgagcatacttaaaacgaatgcatcacctagaagccacatcaccccgcttcaactcagactctgctgtttctgtcaagagaatcacatttcttccactcacaacacaaacatgctgtccttgacccaccctctgcgtcgtcttaatcaccaagccttgtggatccctcctttgaaagagctcttcagctgtcttctcccttttgttttcctgccaacttattcattgtcttcttcccagggcagaccacagttctgccacatacaggagacccaaaattgtctatgaaagggagaagtgaaggtagtcctcagatagtttatgtaccaggacaaactagctacatgtgggaagataatctacacaggtttaattcagctgatgggttgatttcagaagatttcagcccattttattattttgtttcttccttttttacttaaaaaacaaacatatattgagcatttattatgtaccaacaaaacaaaataaaataccaatcatctatgtattgagggtagaggatagaaaagtacattttctcccattcaagtactaaccagggccgaccttgcttagcttccaagatcagaggagatcaggcacgttcagggtggtatggtcatagacagagaagtacgtttcctaatattaagatattgggctgttctcagagtgcctacaattgggaagaaaagtggtacaaagaaaatgacaaaatcagaagcccccccacagctcagcacatactctattaccaaattagtgatacggatgtcaagtgctgtgggtcatgaagaaaaggggatggctgtgtttcaatgtcctttaacttttcatgcactcagacttggtctaattcaggccacacagaacaaagctagctgaatcttgctgtctcccacattctcaaatcaaacacaccttacataattatctcatgttcttctttttagaattatgtatgccactgtttccttttgttggcatgagtcagagtacatttaacacgacttatttacttctctactaaaaaaaatttttaatgtttcatgatcagaaggctatcaatattttatattaatcactgagtaaatatatcagtagagctatttaaaaatcctgctggcctgtgaaggaaaggcaatacgagagaaatgattaattattaactgataaggattaattactgaccatatattatgtgccagcgacagtgccaactgttttcatggacctcctcttctttaattcttgcaatggacattggtgataggtaggtctccttgttatgaagaatgtttttagaggtaactagagaactctggggagttaggctgggaatcatggaatagttcttttgcctaaatgagacatggggaaaaatactgaagagagattttcttgggggatgaaattagagatagggtaatcatctactcttcagagtcagaagatagatgcagaagacagagaaggggagaggagagaggaggaggaggatgaggagagagagagagaaaataagagagagaaaataagaataagagggaaaataagatagatactttgtagcaatttaaacgtatagagattatttctagagttttcagtaagctatgagttttcctgggagctgttttaatcatttcttttttggaaaatacaccatcacagaatgtttcttattttacatcattagacgtatgatggtatctcttccagagacatggcccccaaaagtctgtgatagagaaaaaccatatggtacttttggtgcagtcatttaaggaacatgaagaaagagccctactttgtattaatttggggtctacctggaaaggcccttcagagagaaacttgtgttactattgcctcagccaccctaaagccatgcacacacttagaactcagggtgcagtttttagacattattccaaatgaggatgttgcactctactttaaaaagtataataaaaagtgttatattttacaatcctagactctacaaagaatgataggatattctcagggatcgctttgcagcagagggaactggaccagccagagccctcttccttgcagttggacagcacaaagctccctgtacacactttttaaaacataagttgtacatgtgaaggtatttggtggctatcatatgaagtttaagatgtgtggctatttttcccttccatggatatggataggaaatcaaacatgggttttaagcatgtatttctcagctggtgtagtctgtgttcagaatacttaacatatctgtgctataaaactcccgtgtatatttgcatatgggacacaccacaggcacgaggacgtgaacggctccagcattcactgaccgtcttctgtgtgccaaacctcagtggggcactttaataatcctctcatttaattttcacagaaacctataaaataggtatctgaatcattacatattcaaatatttcagtgactcttcactgagcagcgacttttgccaggtgttcttgcagggctcacagcagacgcatttcagccctatttagcttacattctagtgggagagagaataaatagacaaacaagtgcgataagatgctatggaagggtaagtgcatgaggaactacacagcaggattggggacagagaacgtcagtgggaggacgcagcagctgagtgggggtcctatttttcagaataaggtcaggagatgtctcctgcacagattcgaaaaggtgagaagatgagccataagccattgagtaacttgactaaaatcaccctgagaatgcatttatatatttaaacagggcagcatttaatacctctagggattatgtaggacacttgtattgctttatctttctcaaatcttctccattgcatcaagtatccaatctgttcataaatttgtcttaattaatgccctcatatcagacatacctcatagccagcatcaggcgctcctgtcctcaactccatgtgggccctgatcaaccctggcgctttgcctcctgttctgggctttcctggtcacacagagggcatttactgatacccacaatgcttaatccatggtccctcatattaaagccatctgctgggcttagcagcagccagctccataaagtgtcctagtttccctgcttcactccccggccctcccgcctctgtcctgggactaggactgtaacggagtaagagcacctgagccctctgcctcaggctctgcttcctggagagcccaggctcttatattatatttcaaaatcccagaggagaaggagacctgtcttcatttttcatctctcccagtgtcacaaatagagttattctcctgagggttaaccagaagttattccaattttgggtccaattgtgaactgatggctgtaagacatacagtaatgactttttttttttttccaaaaaacctagatgcgagctagtgtgtggctggttgtcaagcagaaaactggctgataataagggagggagctgggagcttggaacaggggatcgatgaaataaatcggctgaaaatgcagaatgaaataaaggcccgttctcaatgaatctgtgctgagtcccccaaacctccactcacaccccagttgcagtcagtgtgtgtctcttccttcgaagcacgcgtcagtctcagggactccatctctggagcctttcccgggcctgcctctcccggtccttccctgtagaaacggtctctcctaccccagacactcattctcgctccatgtttggaacatgcttactctgaagttagatatcctggggcataagttatactgtggcgtgtttggaaactatgcaagcatgaaatatacacagtcacgagacagaagaggaggcacgaaaaaccaccccgacacccagcttttcctgacgggaactaaatacaatgcgtatcggactcgagaaattccgaggaatggaaaggaaaatcgccggtagcatccaccgcgcatcagacacgagtcacactgacagccagaaaaaaatggaaatccccttcctagaaagaaaagaactattttatatcccaaactacaaaattaaaacaacaacaacaacaaaacaagtctgccagttgaggcgtttgattgtagaaggcaggccactgtgataagcatttgactctcgtcaaaaaaaattcctgtttcccttgaaatctttgccctatttcccctactattaacttggccatagtcactttcctctaagctttcaaaatttcctagaggcttgcgattattttatatatctaaacaatatatttaagacttttaaaagacctgttttttgtttatatataaataaaaattatatactatatataaaatatataaatatataaaatatataatatatataaaagaaatatatattatatgtaaaatataatatataaaatatatatgtaaaatataatatataaaatatatattatatgtaaaatatatataaaatatatattatatgtaaaatataatatataatatatattatatgtaaaatataatatataatatatattatatgtaaaatataatatataatatatattatatgtaaaatataatatatattatatataatatataatatatattatatataatatataatatatattatatgtaaaatataatatatattatatataatatataatatataatatatattatatgtaaaatatataatatatattatatattatatattacatgtaaaatattatatataaaatatatattacatgtaaaatattatatataaaatatatattatatgtaaaatattatatataaaatatatattatatgtaaaatattatatataaaatatatattatatgtaaaatattatatataaaatatatattatatgtaaaatatattatatgtaaaatatatattatatgtaaaatatattatatgtaaaatatatattatatgtaaaatatatattatgtaaaatatatattatatataaaatatatattatgtaaaatatatattgtatgtaaaatatatattacatataatatgtgtaatatataaatatatattacatataaaatgtataataaaatatataatatataaaatgtacaatatatataaaatatataatatataaaatgtacaatatataaaatgtactatatataaaatatataatatatataaaatatataatatataaaatgtataataaataaaatgtataagatatataaaatgtataatatataaaatgtataatatataaaatatataaaatatatataaaatgtaaaatataaaatatataatatataatatataatatatattataaaatataaaatataaaatataatataatatattataggtactttatatataatatataatttattatattatatactttatatataatatattatatattatatataaagtatataatataataaattatatattatatataaagtatatacattatatataaagtatatatgatatattatatataaagtatatatattatatataaagtatatattatatataatatatataaaaatatacaatacatatataatataaaatatatgtgtgtgtgtatatatgtatacatttttttctgagacagagtctcactctgtttcccaggctagagtggagtggcttgatctctgctgactgcaacctcctcctcctgggttcaagttattctcatgcctcagcctcccagtagctgggattacatgtgcgagccatcacacctggctaatttttgtattttttgtagagacggggtttcatcatgttgggcaggctggtcacaactcctgaccccacgttatctgcctgcctcggcctcccaaagtgctgggattacaggcgtgagccactgtgcctggcctgtttatgaatatattctcatcagcacctgtcaactgctgaaactatggaaaatgggctaggagctctgctcaacactgcggctatggcaataagaggtatcatggcagtcctcacaaatctccctcttgttgaatggggatctgatgagagactaacatttagaagaggctctgtccgttttgacacaggaggaacttttagtatttcacgtgggaccccaaggccacaatggcatggaaatgactgtcagcattcacctaactgctctgaggaaatgtgcccgtggtgacataattagtaaagtgagacacaggatcttgacctcgaactcatgtcctatgatcctcccctcactggcatcccactcataagtactggggccatgcaggatgttaccagatgttccatgggtgccgttatgtaacccatgactttgaccttcactcaacactgtaggacctgagacttacattcccaggtagtgaaagactctcagaaggcaggagtatcagaggatgtgctgaaacctacatatcttcagccattgcttttcctgttcattagctaccaaatataaatggtttaatatttttgtgctgaaagacacatatcttatgtcattgcttttcctgtctcattagttaccaaacaaatataaatgttttaacatttttgctttcttttaagccatattgattattacactgcttcttctgggtacttaaactatattactgaatatctcccatcatccttgattttgagattattgtctttccattttttgttttttggatgccaataattttttactcatcgttacttttctgtttttgacacagagtcttgctatgttgtccagacggaagtacagtggcacaatgacagctcactgaagcctcgaccttctgggcttaagcaatcccttcaccccagccacccaagtagttgtgactacaggcgcatgccgtcacacccagctaattttttaaatgttttgtagagacaaagcctcactatgttgcccaggctggtctcaaactcctgagctcaagtgatcctttctccttcgcatttcaaagtgttaggattacaggcgtgagccaccatgcccggctttattttcacttttcttatgaaaaagtgtgtagtgtcatccaagattaatatatccctacattaagatcctattattttcaacatgtatgtgattttgaaaatattcttttattttctactattattttttctattctcctatcacagttggatgtttagaagccagtatctgtagaatattttaagttttatagactaattgatctcctcaaacactgataaagatccctccctccttcttaaaaaatacccactggaaaccattgaaatctttcatattcaattcaaaatgtcaagtctattaaaatttaattcttattgaaatatttgatttgccatttttcagaagtattcatacttcttgactagaactgctcatttgcaatctagagacctattctgagcatcaggtccttttgataaaggatatattgaccatcacaatggacgcaaatgattcaatgcctgaatcctatatgtagtcccgaccttccctcttgcacagagactctttttcaagccacgtagttgcctgaaccttcatttctgatgcaggtgtgcacagtggtagtcatagaggaggaaactgtgaagcagcccaaatcccactggtgtcccccactccagccacggcggccccattcctcctgtctggaccctgctaggtgaggacagcctcaggctcctgtgaagggctcatgttcctgaccatcccagagctctcaccactgccctccatggcccctccagggaaacacctctccaaattttgccatttcatggcctacatcatgactattttaagcaagactaaaggctgataatgcaaatatggaaacatatttgcattttttttttttttttgagacagagcctcgttgtgtcacccaggctggagtgcagtggcgcgatctcagctcactgcaagctcagcctcctgggttcacgctgttctcctgcctcggcctcttgagtaactgagactacaggtgcccgccaccaagcctggctaattttttttttcttttgtatttttagtagagacagggttacaccgtgttagccaggatggtcttgatctactgacctcatgatctgcccgcctcagcctcccaaagtgctgggattacaggcgggagccaccacgcccggcccatatttgcattttaaaaagagctttagttaagagtgaccgaagagagaatgtgaagccccctggcagttgctaggatggcatgtggggtggacaggccttgtaaggtcccctaaattcccccgtgtagacagtgacacactcccatatatgcagtatggcgctcaatgagggagtgggtgggctcattttatgcaaaagggatgtgataacagctaagccatcccatggccgacacttggaggtgttctcttgaagggtgggtcagcctcttcctctctgctggccagtttcttgtgtcaaagagccatggattctctacacagtcggctggagggagctatgaagctagtggctcggaatggggaaagagtaaatgctccaaatcaaaatgaaacgtatttgctgattacaaccgatgagttgctccagtcggctcgatgtcaaaagtagaaagaaataaatttttaaaatgtaatcttctattgaagtataatgtatatacagaaacatttgtaaaccatgtttcctgttaataaaatttcaaaatggaaactcactcatataaccaggaactgaatcaagaaataaaatgctttaagcgccccagaaacctttcttagtggcccctcccaatcaccatcccctttcatcccagagccgaccactgtcctgattttcaacactaaggatttattttttcttccttttgaaatcgcacagtacgaattattttgtgtttgaattttctcatgcaacactgagtgagatttactttatagtaggatcagctactaatttgcaggggccattacgaaatgaaaatgcaaggccattgttgaaaaatcaagaattccaagatagtgacagcagcacattaaaccaagcccagggtccttttagtgcagggccctctgcaactcaaaggtggcagaccccaaagccagccttgtagagaatcccaaagcatgactatactatatttgtccatcttactactgatgaacatatttgtgagatttccattctttggtgctcctacaaacattcttgcacctctttggtgaagatatggatgcatttctaataggtatatagttgtgaatggaattgaaaggtcctaggcagacagatgttcggctttggtagatgcaagcacaaatttgttgtatcaatttacacttctacagtcagtctttgagagttccagtggctcctcatccttaccaccatttcatgtcttatctttttcagcctaggcaggaatttaaagtgccgattcctaccctctgctccaaaccttatatcattagcatttctctccagattctatattttcacagctccccaagcgattctccgttaagttaggaagcactgctaattaactgagctaggaagctatgagaacatcacatgcaatgttctcattgcaccagagtcaaatatgggttgaaggactaagaatattgagctcacacttttaccctctaggtaaatcagcaaatgattaccaagtgtatgggaagtggccaggacagggacattctgtatggtcattatgacatttctgccttttttttttttttttttttgagatggagtcttgctctgttgcccaggctgggtggagtacagtggtgcaatcttggctcactgcaacctccgccttccaggttcaagcaattctcctgcctcagtctcccgagtagctgggactataggcgtgagccaccacaccagctaactttttgtattttgagtagagacgaggtttcaccgtgttaaccaggatggtctcgatctcctgacctcatgatctgcccacctcagactcccaaagtgctgggattacatgtgtgagccaccatgcccagcccattatgatatttctatgaaattgaagggagtagtgtcaaagggtttataaaagagcattatggacttttttaatgttagaaacttgatactctgaaaacacactgaaacttatcgttatagagtctttttcattttcaaccttctaatttttattttagataatcaaagtaaaatcacaccattttacataattacagtgtattttaaagcttttcttttttgtttcagatctgtaggacatccacttagcaacagcatgccattttcttctattttctacactttaggcatatgcacattagaagtagatgaaaatgcacagaataaaggaaattctgtcaaaatatatggttcctcagcaaagaagcttggagtctgatactatgtgaaatataaacagtaacttggggattcagatgtatcatatttatgctcttttcatgtttaattttagaaaaacacattcatggcaatggtatatgtagatactgctatttctaaaatatcttattaaaatgataatagacaatgaatttcaatattttatattttcagagcaaaaatcattcacaaaacaaaaattccttatgccacatggcatatgtgtatggtgcatgtgttccatgttcgataacatgtgctaagatatataataaaaatttctatttctggtcatcctcacataattatattttgaacatgcatatttagagcgtaaatgtaaagctctatggcactgagagatatgatcatatttatcttcattttaggaaatgtaagtatatgggtaatttatataacctcagctatctacatctctgcatcgttatttttcccccacagtattagggtattcttctccgcaagtgggatatgagggcattaccttatacatgtccccggaaagacagtgcggtcacagccaccctgcctggggaggagcaccggcccacgaggtggggtgggaggtttggctgctcctggcttggtctccaccggccatgggaagccagcttttcctacaaggaggcccacttatattcctcaagcccagtgcatcatgagaagaacgcacttcctgggcactacctccccttcccctgcttttcatttccattgaagagtcggtggtgacccgggaaaaggcaagaaacttaatctgtgcttccaagacagccggaaagagcagcggcccttgttctgaaaaagcacccaagaacccctttagattccgccagcacgttcagggttataaggacgtgggagattgtttccccaacacctgattagttaactcaaacagtacctccagaaaactagttatgtggggtttgcttttttcagtttctaagctttcatagttaaagacatattttcatgtaaaaatgaaacctttaaactgcacttgtagaacctacaaagggtagaaaggagggcctcaccaatgcctctgcacatcttcagccctctaccccatactcagggttcccacagaattcgaagaccttgaaacaagtttccctggaaaacagatgttggagggacacatgtcatcctaatgccccctgtgtggagacgcatcagcagccagggaactgctgaaaacagatgtggaagttggaatccaatccgggtttgccaggggagtaggaagttccgccctgccaccctttttctttgcgggagaggtggtacacagagtgggaattatgtgtaaactacaagcgtcggaaaaatgagaggctaatgcaagaatatggacctgtccggtgagtgcagtgtgtttcctgagtggggctgagtggtttagggctgcgaccaccacagtcctcctcacacacgaccagattccatgaatcccactgcaaatatgcattccctcctgcactcggtaaggggccaggacaaatgggaagagcgttgcaaatacgtacaatccccatgggtctgatggtcagcaactcagagcaatggaaatgatacttaatcgtctctaagaaaactggaattcaacaataaggttacatttcacagactatacacctacagcaactcattagagcctcctgacactggggtgggtggaaaggactaagcatgattgtcccgctttacaaaaacattggactcagaaagggcaactgaaaacggacaacacagaagtcgtggctcctttgctcccgatggcaaacccactagtgtccagaggttctggagcatcttctaggcctttctcttttctgatgctgatagggaatgcagtggccagctaggacaggcaccatggcagagtgggaaactgaaactgccaccactgcccatccccccacctgagttttaaaatttaaaactgttggtgggcaaatgatgaaccacccggatagctagcagattattcagaatagctatatagagccttggtaatcacctcaattctagaatagaaacagcaaatataaaattaaacacaatacaaaatccaaacaaaacatgtccattcctgtgctttggaacttcagctcaacagctcaccttgaattatgtaaataacagcatcacctgttattcctgacttcctttttgtttgtactttttattctattttattatgttgtcattttcccacaggtgaaagggcatcgtttctgatgtcaaagcagtaaacactttgatcacagcaacggcatgggggcggggcgggggcgtgcggtgcaagaatcaggcaggtggtgcggccctccagggaggggaggctgcggcaggcagtgagccgcctccccagcccaggcggcagcttccctccgggccttcctgcaggaaagcagcactcccacaatgagctcatcctctgaccattctagtcagcttctcatcaattatcccagttttgggggctctgagtttgggagttaaactgcataaagatcaaactcaggcttctcaagtttcacttactgtgggagagagtacagtcactggagtcaaatatgttttaactgtttcctctcatttccatatcaaagcaaaatgatgtgaagatggatgaagaaggttgaattaagatacaactccacggctgggcgcggtggctcacgcttgtaatcccagcactttgggaggccgaggtgggtggatcacttgaggtcaggagttcgagaccagcctggccaacatggtaaaaccccatctctactaaaaaatacaaaaattagctgggtgtggtggcgggtgcttgtaatcctagctactcaggaggctgaggcatgataatcgcttgaatccgggaggtggaggttgcagtgagccaagatcatgccacagcactccagcctgggcgacaaagtgagactctgactcaaagaaaacaaaaaacaacaacaacaacaaaaaaaaaccaaaaaaactccaggtaggtattttttctttaaaacttacctttacatatagataaagataaagaaaggcagaaatagaggtaagagagataataacatttttgttagagaatagaattgaataaaataaatttcctaaactttggtttaatcatgttttagaaaggaaacatctgaggccaggcatggtggctcatgcctgtcatcctagcactttgggaggccaaggtgggcacatcacttgaggtcaggagtttgagactagcctggccaacatggtgataccccatctctactaaaaatacaaaaattagccaggcaaggtggtgtctgtaatcccagctactcaggaggcagaggcttgagcccaggaggctgaggttgcagtgagctgagatagcgccactgcactccagcctgggtgacagagcaagactctgacaaagggaagggaagggaagggaaggtggggaggggaggggagggcagaaacatctgaaacacaacactgcagactggttacctatatctacctgtgagtagtaactagaaaacacagacacagcatgcagcaaatcataaaatgattttttattaatttatttttatttttattttttttattaagacagagtctcactctgtcgcccaggccagagcgcagtggtgagaactcagctcgctgctgaaacttccaccccttggattcaagcaattttcctgcctcagcctcccaagtagctgggattacagccgcgcgccaccacgcccagccaatttttgtatttttggtagagacggggtttcactatgtcggccaggctggtctcaaactcctgacctcaagtgatccgcccatcttggcctcccaaggtgctgggattacaggcatgagccactgcgcccagcctaaaatgattttctttttgttactcttgaaaatttatgtgattttctttttgttactcttgaaaatgaagtggggtgggcggtaaaatataacattaaacataacatgaaactaactgtcaactaacatgaaactaactaacttacttggttggttatttctggttgtacagccttctagggtttatttaccacgtggacacagtgcccctatatatcactaatgtattttagagtttcatgaaaacacactgatgaaagaaacagctcatgtttttatgtacattagcatgtttctaatgcagtaaatttttgtgaagatgtgtcgtgtcaactaattcaaccatttaagtaggtctatcagtttatatagaatgaaaatgaagtttcaaggcctatgacaatacacagcagaccactgctatgagctgaatttcattttgcagcttagtttcattttaagattctactatgacatatttagctagagaaagatattaaatccaactcttatgtatttaatataattcgactcaagtgcttcaggccttcacctcactttatgtaaccttaaaatgatggatatgcaacttttgatgtagggctctattttaactgtgagattacgatacgaatggtgattcttttatcaagtaatttatttttaaattctgctttctgtcatttctaattttgttgaaatagtaaatccacttagcagagagtactcatgatttagctcataatttgattcaatgaaattagttcttgtacctcttctgaatctgtagtagtcaatgagtctagacgggttatccatgtgtagatctatatatgaaatgtacatttattgtctacacaaagggtcagcaaacattttatatgagaatcaaataatgaatatatttaaattttgcaggtcatgaggtctctgtcacaaccacccaactctaccattgcagcaaagaatagcactagacacataaatgaatgggctgactgtgttccaataaaactttatttacaaaaaaaaaaaaaatgctatctgtagtttatagacccctggtctaaacttttgctattcatgaacgtagttctagacctactgcatcttcattaactagaagcttattataaatgcatttaaccatgagaaagctgatttgaaagaaagaagaaaaactaaaaaaaaaaaaaaaaagaaatgcatattctcaggcttcaccccggacctactgaatctgaacctgcttcttcaagatgcccaaggcattcaatctgcttcttcactgcccagggcatctgagtgaacatcagcgtatgggaagtgctagtttaaaccacagtgactggcttctatctgggttcacagagcagataagggaggtttcatttgtcattttagctgtctattcaacaataagaatgtctgggccgggtgcggtggctcagcctgtaatcccagcactttgggaggccgaggcgggcagatcacgaggtcaggagatagagaccatcctggctaacacagtgaaaccccgtctctactaaaaatacaaaaaaattagccaggcgtggtggcgggcccctgtagtcccagctgctcgggaggctgaggcaggagaatggcgtgaacccgggaggcggagcttgcagtgggccaagattgcaccactgcactccagcctgggtgacagagcgagactctgtctcaaaaaaaaaaaaaaaaaaagaatgtctgagccctcctgtagaacaacattctctgaattaagtcattgggatatcataagaaaaaatgaggataactgttcatataatttttaaaaattttgaaaatataaactgaagttaagaattactgatattcactgtgcaggtggacactggctccatcattcagactctatgtcccaagtttgaggagggaagaaaggagttttcatcacacaaggaggtggcaatggtacctccatcaatgctaacctgtttcctctccaaatgtggggatataaaataatggtttgcatttgcaaaactgagtgaaatgctctaggtttaacaaatgaatcttctccaaacaagtgctttaaagtatttcctgcaaagaagctgcgaaaataaaatgatactaataatataagcacaactgaacagcaagaaaataagacagctatgctctaattcatgtatattctattcacatatcacattatgtaaaaaataagaattaaatttttaacttaaaatgataaatgatgtgatacacaaatagaacatgcatgaattcgacgaaatacagatttactgataaatctcaatctgatagaattctttgaggtttttcattaataatttcttgaaaccataattaaaatctaagcattgaaaacatgaaaacaaacttctccaaagtttgtgatgttggccttggtgctttaaaatcatcaagaatatttaataggctgggtgcagtggctcacgcctgtaatcccagcactataggaggccgaggcgggcggatcatctgaggtcaggagtttgagaccagcctgaccaacacagagaaaccccgtctctactaacaatacaaaattagccaggcatggtggcacgtgcctataatcccagctactcaggaaggctgaggcaggagaatcacttgaacccgggaggtggaggttgcggtgagccgagatcgcgccactgcactctagcctgggcaacaagagcgaaacttgttctcaaaaataaaataaaataacataaaataacataaaataaaataaaataataaaataaaaaaaaataaaataaaatgaatatttaataataaaattctagaagtctcttttgagtttttcttgtttcatttatttagtttcttaatcgtgaaagaagaaaagctatatactttagggaaattttctccgtattgcaacaaaatgactgaaatcatacaaagaaaatactgtggcaataaattgggatatgtttgcttgtcaaaaacttctgaagaaagatgtgtagaaattattactgatgaagcaaagaagcaaatgttagaacaaatacattccaggtttgacacacgtgtcagctgatggtattttatatattctctcccaataatgaagtacctgaaaaacttatttttcataaagcattaagttgtactgtaagagatgtggtctcaacatagtttcttgcattaaaaactattatttgatggttgtgttggattactgtagcactgatggagtaactatcttgatttgagaaaaagactcaagctgaatggttacagaggtagtactggaagagtattcactcaatgtatgacttacaaaaaagatgctgagcaaagaaattaaagccagaagtaaaaagtgctacaagtgttactgatgtagttaatttgataaaaacaaaccttcaacaatgcagtaggctttcctctgctagttggaataaaatagggagggactataaatcctatttgtaccacagaatttcactccttaattcacagtataaacgttgaaagtactgtgaaagagttactcatttttcctttcagcaagttagtgaaacttttcaaggtcgtcatgtatgattgtataagagatgcattcaacaatgttaggggtcaccacttatattattcctaatgtattaatacaaatatctttactctgaaaacattttccagcagatagcaatgtgtcttgaaagaagtttttaaaaatttgcataaaagtgctacttggacttgtgtagagctttgatatcaaatgactgccggtagaaatgcaatctagcagatattttagaaaagtaacaaaaacagttattttgtcccattaaggtcgatgcgatttttaccagatatagaaatatcttttttataaaaggaagttgaactctggagcaaacactttgaagacagatgtttagaatatttccactgttttatgaatttgttttaaaaaataattgtgtcagttatgaaaatgtatatcctcaccctttaaggagcttggaaatagaagtgcatattctgtttaaaaatctttcaaataaaatgtcttagttttgaacatatggtttaaaaatgcaataatggcccaccttctaaaactgcttgacatcaatggagaaatttattaaatttcaagaaaaatttgaccatttgcctaattatcagatgtgatttgaacattaatatcatgttccagtaggcagtagacaatgtgtccttccatttgggggtattatttttgctcattaactccctccaatatcagcatatgacagctgaatgtcagcgcttaccttctacccattcatgttaacagcttctgcagccctcctagctagcatcgaggtcattttcttactttccaacacttctgttgtaatgcggtacaacctcaatgttctcacaacacattcattcatccaaactggcctcaatctttttctcctcacaccatacggtcttgccatcctctcaactttgcccacctctcctggggttgcaccatgtaccagtagttttcaatctctgggagttgctcttgcatccaaaaccaactgaattagcctttctaggagtggggcatggggaactatatttacattttttccggttgattttcacacattgtgacagttgagaaccactggtgtaggcctgtcattatcaataactgcccataatcttcataatcctccagcatcctttgatcatcacttcataccctcagctcaatccctttagtaaccccacttgaataatttttcaactctactagaaccttcaatccattaaccctcctaacttttcattattcattactccctcctgtccttagctccctccttgcccagcttagacttcatgcttcctcaatcccattgctggatttcttttttagagtacttactgacaaagtctctcccaaacatgggaaaataaagttcattaccctattctgtgcctgcctcaagaagctgactttgggcagacaaaaatttacatccttactaatttaaatgtaatttaaacataagaacctaaacttcaagtttatttccataaaaactgtacttggatatatgatcggcaagaaaataaaattaaaagaaataagagaactacggaaataaaaaagatatattccaaggtaaaaagacgaagaacccaacaaagtaaccacgaagtcagagacgcagagatgtggggtatctgagggtcaccgaagaaaagttttaagaatgaagaatggacaaaacaactcaattttgaaaacagagagaaatggagaccgatgatcacacaaacactgtatatgaatgtacacagcagctccaatcgcaactgccaaaaacgagagcccagatgtcccttattgagtaaatgctcaaatacactgtggtgccagccacacaacagtcaccactgagcaacagagagggatgaacaacgggcgcacagcatctcaaaggcattgccctgaataaagggagcgccttaaaggttacctactgcatggttccattcatccagcattctcagacagacagactggagggatggaggccaggtcaggtggtgctgggagatgacgacacagccacagctgcagggatttgcagtgagggaagagttttgaatcctggttatgccggtagccacagtaatttctacaggtgttaacattcaagtgtacatcaaaaggaaagaagtcaacacaactgtaagacaatttaaaagttttaaaaaatagtgttggttgagagaatgcattcaataaatgtaaacttccctcttgagagttttgttaaagaaactgcagaactcttcagagaatatagggctaatgaaaatgacagcttccaattatctgtaatttttttaatgttttcaaagcacttattattatttattgctaagaagcttaaaataaaatgtagtaagaatagaaaccaaaagaagccccatacatttagtaatcagtatatatttgaaagtacacgcattcgaggagcagctggggtctgaggcctctcacttagactcatggggtcagaacaggtctcgtatcagctctccagctcccaacttctattattctgccgtctcccttgtgtgactaaagcaatgagatgatttattcattcaaatcctatgaaaatcagttcttattttacagtattctgagaatgttatcttacttcctagctttttaaaaggctttcttcctgagatgctatttttcaaaatcagatttatttctgaaagagtccctgttctctttgccaacctccttgtagctggcaaacttcccttttttccttcaggatgaaagaggccttaatccatcttacacaatattcagtgtacagcagccctggtcttggcatcgcatcacactcagtaaatgacacagagcttcccaagatttcagactctggggttccacaacggagacgagagcaaaaggatgtagtcatttaatctatgctatgcgttcagaaaagctcactgagtttgggactcatgggctgaagacgaagaggagccatgcggccggatttaagccttgggggaatgctggagaaaaggtggatgctgtctcagatctaatgtggtcctaacagagttgggaagacagatgtctgtctgtgccgtgaacataacactctgtcagggatttaccctgggaaaagtctgtctttctctattcaaggcactgttgattcatttggggaacagaattctacattccagtcaatgaatctacaagacaattgggaaaggatcacattagtttttaaatagaatttattttccatagtgttatttcacagcaaactctgttccatttcccgcgctctgcctccggggtcttagaacaatcacttcttcagaggaggaccttgccaaccagtacactagatgccaggcggaacttgcctttacagcagaaaatgaagtgggctactgtgatctatcgtcagagtttctcaatccattctcaagataccccgagggagatttcactcttgctacaaagcgggaaataacaacaataacaatcaccgctgtaatagaacacattatgagggggcattcttttaaaagcctttaaaatgctaccaggagagttttatggctgctccaagtcagaacttggccgtgtttaaaagcacggggagagggtgttccggaggcggaccccaggggggccacagcgcctccccttcccctgggggctctgctagttttttggctgataggatcacagccaagttcatgggcgccccgaggaaacactaggcacagcttgtgctgttcaaaacaatcttaccataaaagtgacttttctttttaatctaaaaagcactttttgtaatgagaggttgaagctgagatgccagtgagttctgctagtttctgtttacttccttcaatttcgtattgttcggtgtgtgactgaaaattgggtatcaaaggtaagtattagggtcttctcctgggtccctaaacatgaggcttcgaggtcttacaggcttgaataattcttcagaaactacagcaagtttgtttttagagtgtcttccaagtaccagccctttgtctaacatctctacaccctaaacattcctcccaacctttgaaggactccaaattgtggccagactacaggggatttgtgaagtgcatgcatatctacagggggtaagacaaatacatcttcattctgacatcatctaggtttttcagaggtaaaagatgtagagtgtctgagccacctatggagaaagcagttagatctaattatagctcttgggatagaggagctgctgtctcaagaaaagcaaatatgtaggttaagagccctgttcgaccttcagagatcatgctgttgcacgcttgttagagtgatgcccttgtttagtccttacctagacatctcacaaatattcctgtgaagttttcttggaagtggatggtttacgaaattcccaatacatttcctttgcatcctgatggactctctgggtgacctcttaactataacctttcaagaagcaaattttttgaagtttgcaatcaggcaaacaatcctcactcttcttataaattctcatcttccctaagtgcttatatttgaatattcttaaaataatgggctgggtacaggggctcatgcctataatcccagtgctttgggaggttgaggtgggaggatctcttgaaccccagaagttagaggtcagtctaggcaatgtggtaaaaccctgcctctacaaaaaatctttggaccagccacagtggttcacacctggtatcccagcacttagagagaccaaagcaagaggatcgcttgaggccaggtgtttgaaatcagcctgggtaacacagctagactccacctcaaccaaaaaaaaaaataaataagattagttgggcatggtggtgtgtttacttcctccaattccttttgttcggtgtatgactgaaaattgggtatcacaggtaagaactaggggcattttgctgggtccctaaacatgaggctttgaggtcttacaggcttgaataattcttcagaaactacagcaagtttgttttcagaaaccaaagaggctgaggtgggaggatctactcaagaggctgaggcaggaggatctcctgagcgcatgagttagaggatgcagtgagctatgactgtgccactgcactccagccttggtgacagagcaatatcctatctctaaacaataaaaaaaattaaaaattttaagttaaaaattaatggtcattttgtgaaattggtcagagtttaaggttttagagaatgtacctggtggcagaaaccaatatttagttgttttatgagacggagtctcactctatcacccaggctggagtgcagtggtgcaatcttgcctcactgcaacctctgccacccaggtttaaccaattctcctgccttggcctcccgagtagctgggataacaggcacctgccaccacgcccggctaatttttgtatttttagtagagatggggtttcaccatcttggccaggctgatcttgaactcctgacctcgtgatccacctgtctcagtctcccaaagtgctgggattacaggcgtgagccaccgcacccagcccatcaatattttgttttaaaggtgcttaaaaaagacatatttatacattccccttttatagttaaatcaaaagcggcttttggtatgctctttcaaggcaaaggtatagataatcccagccatcaggattttactgagtgattgaaagtagaggggtaccatagaatactaacatatcagtaattagcttagccagttaaagcacagaattgaggagggctggttatctgttcacacgccatgaagttgagttagctttgttctcatcaggaaacaaagtatcctatagatgcctaatgttagaaacaacaataatatagtttaaatagacactgggctcaaaccttaaacactgtctgtgccttcactatgttatcactacgttactgttgcaggaacagagacagactagaggagcgaccttgggcaagttcttcatcttttctgagcctcagtttctacatgtaaaatatggaccagtcagtagtatccacctcagaaagtgtctctgaaaactaaataataggttctttacacacactgcttggtgcctggcaaataataactcaacaaatataagatgataacaatgatcccatccagtcccagccacaaagtgagcaagaaataatgattcagagttttaaaggagctgtgtctttcttattctgttactctgtggattctgagacttgctcaagatgcttcatgcctttctccttaaacctatctgtgttctcctcgacggatctgggtaagtcatctctccactgccaaacattttggcacacgatttgtcacaaagaagaacacaaaattatttttgaatgaacaaacatatgaagtaaaaagccacattcattatcgatcctattcctatccccagctaagttctatgtgctataaatagtgagttctgtttgcattaaatggtgtgaccttctcctgtgtcctcagatggaaagttctcaccattggagacttttctgacactactctctcttcattagctccactacccacctgccaaccccttcgacctaccaaccccaccatgaactactgacaatctttctgtggccactgccttcaatgactttcccatgaattcctttccttttctactgtggtcactgatttcatgcgagtctcattatttccttcctagaccactatggtattcttataacatctctcttcaccccagttcagactataaatgactgacatattaaccttcctcaatcatagctgtaaaaacattcctactttttccaaacttttcagcagttttccattcccttctaaactacaaccaaactcatcaggatgggattccaatcaatcctcaccacagcacctgcctttccaagcctcatttcccatttagtgctttgcttggaccttaatgtatcttaaatacttcctgttttcaaatcgtgcgttactcatgcatttctccatgtctggaatatgctccttgcgatatacttatctttgaaattcttcccgtgtttgtgtcctaagtgaaattagcctttctctatgggaacgttttcacatgcccttccaggtggtcacagatcctagtgatctcttttgtatgcgcttctagacacattgttgatatctggcttgccatattggcagaattattacttacaaacattaaaatgatatgcatgttggacaaatgtggtccatcatttataactgtatttatttaatgaggatatgatttggtcctgttctaaagtctaattatgtgcttattccaccaatgcttaagatggaaaatttgaagcacctccaaaatctgaggtgggaatagatgttatttctgaagatctgacctcactctgttataacaatattttatagaccgcttatttgttgctatttttaaaactttgtattgactttccttacatttggttgctttcatgaccagtgaaaaaactttcaagttaaaatatagctgagaagaatgaaagagaaatggtaatgtaaagcttcacatttaactgccacagcaggaaaactcaaaattgaattccaaccctagctactaaacaccctggtaaagctttgctccagcttcactgagccaggaaatttctctcttttcccctctgacactagagtcggcaagaggagacctgaacgattggcataagaaaataaataccccttccatggagggctcacagaactagagcctgctaaccgtggctggacttgcttgcaccctgaaggtgctgacaaggtgtgcaggtggccaggaatctaaaacacaacactgcctgggtccccctggggagccaaaccccagtgaggcttctgagattcaggagtacgcccaccccacctgccgttatgccccccagtgaggcttctgagattcaggagcacgcccaccccacctgccgttatacaccccagtgaggcttctgagattcaggagcacgcccaccccacctgctgttatgctccccagtgaggcttctgagattcaggagcacgcccacccctcctgctgttatgccccccagtgaggcttctgagattcaggagcacgcccaccccacctgccgttatgctctttttcacccgtagttagctggggtgcctatgagtgcctcagtaaatatctgttgaacaaacaattgaatggacacatgaatgaatggatgagggcacagtgggggtaaggggcagggttggagggaagaattcttagagaagctgagcagtgaaggaaaaataggaattacccagacgaagggagctggaaaggactgaggggcacagaatcagctgagctggtgggaagtgaacaagtaaagctaaggggctagagaccaccttgttatcagtaagaagggaaaatcccctcagcagtgttggaggagagactaaagtgcgggtgaagcagggcaggtgtgacgggtgatgaataaattatgtgagagaaaatatagctgtcaggtatgcttatgagacactacatttatgtgtagaaaggactatggaagaattgaaggtggccatgaattcttttgccctcctcctattgtaaggtggggtctccccttgaacctgggcagactctgtgactactctgctgaatagaagacagtggaagtgctgctctgtcagttttggggctcatgcctaaaaatgggcagcttccattccctgtcttttagatcactctctctgggtgccctgagctctgacactgcccatttagcagaggccatgtgtctatctcccatcaacaaccatagtggaatccattcttccagccacacctaccaagatgcctgacatgtgagcccctccaccagctgagcaccaccaagcaacctcagtcaacgccatatagagtagaaacatcccctgacctagccctgcccaaacccataacccacacaatgataaggcaatagataaggaaaacacggcatgtaagaactaatggcgacgggaggagctgggggagcaggggaggtgatgtatgcttattttcacaggaccaagcttcgtaagtgtttacaagatggtgttgtcactgttgggggccttttccaatattatactcttgcctgtggttccaggttcatttcctttttctatatctcaattcctgatgctgaaattaaatttggaacaatgaaaaaaaaattccactggatctattttctggtcatgttctattcctagataatataatattcagaggacagaagaaaacccgtcattgttgtagaaaggcgtgttcagcacgcacagtcacgtacagcacattgtggtgtaatctcttgggcatgatagaattggaggacaggaagaaatgattccagtaactcaatcaatgaccgatgatatagttttctgagtattcctagtatcttctaactttctcttctacatgttggacactatcactgtctctatcccttggcctagatagcagctaaacagccgatagctgagccaacagtgttcaatactcatatcctcttctttgttcgagctcaagtgaacacgtggcattcattcctaactgcagcctcctcaagcccagaagcctgaatctgttttttaatttagcagtgaagaatgcagctacatcacatgctatgagagcagctggtgtttcatgcttcttctctcctatcatccctctcattcaacttctcttctttttcagatatgcggtcaccttatttatgtatgtgttgaggctccctttcaagactccaaaaggtctaatccaaaaaatagctgctaaagtattatctcttttttaggcccattttccttctgtaagagaagaatgcttcattgggattagggaacatagtggtttgattgattagactgcttaccaaagcaatacaatttcaaatgataaataacagatgtgggtactctatacagcaattgtttaaaaataattttgcttctatagtacattttggcttagaattgtgtgcttctaccctctgtgataatttatgttgttcatggcatataaaatgtctcccagttgcggccgggcgcggtggctcacgcctgtaatcccagcactttgggaggctgaggcgggtggatcacgaggtcaggagatcgagaccaaggtgaaaccccgtctctactgaaaatacaaaaagttccgggcgtagtggcgggcgcctgtagtcccagctactcgggaggctgaggcaggagaatggcgtgaacccgggaggcggagcttgcagtgagctgagatcgcgccactgcactccagcctgggtgacagagcgagactccgtctcaaaaaaaaaaaaaaaaaagtctcccagttgcatagaaaaggtttttctcatctgctacatcttcaattaaatcaagaacaaatctctgattattgagttttaagaaggatgactataacagaacttgtagcaaattttccatagtaaagcaaaatcactataattgatacttgtaattgatactttaagctgccttgtatttgccaattttccagttaaaacgaatctgtaaaactaagatattacaaatgaatttcaatcagcaatcagatcaatttggcacagtgaaccctttgaattacggaagtattttacttaaagtttcatgaggagtcctgatgcatataaggtagaagggaaatgagctacaggttctagggaatcacgaaggtcccacgagcaataatatttacgcattacatctgtatattgctttacactgttcacaatatcctttcatctacataatttttatgtacacttcacaacagttctccaaatggatataattatcttcatcgtgcagctgaggaaacggaggcacatacaatttgtgctcctcacagccatcgtttatgggaaaacgctgtggctgaagtgggtcatgcagatgattactaaatggatgttttcaaagctaaagttgcgggcatctttgctgacagtggaatgtcattttggtactgggcgaagctatctgggtagacagaacttccagagtgataggtggcaagtttcataaaatgtctgagtttcttagcaatagttaaaacatggtttaatcagatgataattttggtgattccccctccctaggctgcaacagctttaattttaagagaactgaggtagtggtctaattcctattgcaaatgtacgcttgtggcttcttcgtaatttgcagtgaagaatctagaaaagtgatggggaataatgtctaaaaggcccggaacgcttataactcagcataaagcagcctatcacagctcaatggcaaatcatcggttgaagtcaagggcaaaagggcagggaatccaagggctcctctgcccaaagcatcgcttacttgaggttggcagctggctgcacagcagcccttggctgccttcaaggaccggccagagtcagcatcctccaccccgcagctatgtcagcgtggcccagacagtgactgtggagtggggaggccctggccagccaggcacacatttcacagatgaggctgaaatgagaaacttcagggagatatttgcataaatatatttcccattgtccaaaaataaggccagacggaaacatctttcagtatgttccgatgagaattacaaaatgttatacaaatcaattttttacaaaggttattatgaggtttattctgacagaggacaaagcctttccccccttattaaaactgttgctgacatcactctgagggaagtcttgggaaaaaccaaaaataatatgtaggtaatattttgcaattttatcaaatatttaccaaaggctcagataaaagatatccagccacaggtgaagggtgttcatcactgggaagtggggttgaggggaatgtttattttctcactcatatttttccatttgctacggtagcacatcctacctttataaacaaagatatttcccactgcctggctcttctcttcagcttatcgatgatatcacctgcttatcttcgaatgggtcagaatcaacaactacttaccaaacatacactgtccttttttctaaccaattatttttctccagtcatctacaaataggtcttcaaggcgtattcccatacgttgtactatgtgtgtattgtgggattgagtacagcagggaagtcatatattttaaaatatggacaaccgggccgggccaggcggctcttgcctgtaatcccagcactttgggaggccgaggtgggcagatcacttgaggttaaagttcaagaccagcctggccaacatgatcaaaccctgtctctactagaaatacaaaaattagctgggcgtctgtaatcccagctactcgggaggctgaggcagggagatttgcttggacctgggaggcagaggttgcagtgagctgagatcatgccacttcactccagcctaggtgacagagtgagattctgactcaaaaataataaaataaaataaaataaaataaaaatatagataatcggaaaattttagtgaattcagaggaagcagaataaatttaaagctgaaattatcgagaaggtctttctggaactgatagcatgtaaattggactatgcaccgtgcaggtgagatgtgaacgtgttgaaatggaagtgagagggagtccactgagaagcagcagcagcagcatcaggaaacaagacatggagctttgggtgacgccaataacacatgagcctggatgctgctgccactgagtgtgggatcaaattagagaaaattagagaaaaataatatatatttttatatatatataaattatacataatttactatgtaatatataatataaattatatattataatatatattatatatacaacatatcttttatatatattataatatacatattttatatgttatatattatgtaatatattatatattaatatattatatattaatatactgtagtatatactataatatactatatattatatattatatataacatatattatatatgttatatataatatattatatattatagtaatatatcatataatatataatacattatgtataacatatatttatgtattaaatataaatatatacaacatacataattatatataaaatataaatatataataaaataatatgtaatatatattatgtattgtatattatatataattacatatataatatataatatacaatacataatatatattatatataacacatatgttaaattgtatatatatatatatattttttagatggagtctcgctctgtcacccaggctgtagtgcagtggtatgagcttggctcactgcaacctctaactcccaggttcaagcaactttcctgtctcagcctcctgagtagctggcactacaggcacatgccaggacgcccggctaatttttttgtatttttagtagagatggggttttgccatgttagccaggctggtctcaaacccctgactcaggtgatcctcctgacctcaggtgatccaccggccttggcctcccaaagtgctgggattacaggtgtgagccaccgcgtccagccaataatcaataaatttaataagaaaagtaaaaaagcagtttggatcgatggcccaaggaagagacgtagtgtactgagtgcgaggaaaagcatgtctccagtatgtagttaaactgcaggataaatcagtcctgcctgggggagagaaaaagtagggcagaggatgggcaggccagtctccttcacccctgtgcctggagtgagtaaattcgtctcattttcctcatgtccaaatactcacatcatgagatattacaaagctgccaagacaacacacctcagattttctgaaatggtctaaatttcaaatattccactccactctgcccataagtgttctaatgtggaatttttggtctggcatacagaaacaacggcattcagacaacagattacaaacaatggagcgggtctgatttaaacagggagaaggacataaaaatgtagatatttgccttaaaacaaatattaacaagaacaggttttgattgttacattttgtaaattcatcgtggctgcaggaaagactcagtgatttatgcatttgaacagagagaggtatgatggcaaaaggacggtgattttgtccaggaggtaactggagattctcagaaagggtcctctgaccctgctgctgcagctgcgagtgcttcagcttgggctgcgaggtgcaagttcccctggagagagtgggatgccgagtcatggagccagcagcctaacctggcctgcacattaagtgatgaatcagagcgtgtgatgctgacacacggggctttgcttccgaatggtactttcttcccaaacgaaaggcaaattcctctacctccatttcactgcaatgttatcaatagcagactcttcctttgacttgagaaaaataggagaacaggggtttctaagttaacatttccctaaagaccctggctgggcttatgctgcctctttccagcaatgcgtcagggcactcccctggccggccccgtcctcgcaccctctgtgagcatggtctgcttcatcccacttgcaagatgtcaaaacgtcaccaggctgcagaggctcagaagagactggcttctgaactggacttttgattaaatcacgagagaagactgctgtgtagtcttttcaaactgtgtgttgtgattcaataagaagtctaacctaaatgggttaagacggtctaaatatttcatatggttttgcttattcactcaaaataattatatttttaggcagagagtggtttagagtcactggtgtgtgtgtgtaaatgtaatagacatccgtctatctatctatctatctatctatttatttatttatttatttttttttttttgcgacagagtcttgctctgttccccaggctggagtgcagtggtaccatctcagctcactgcaaccctccgcctcttgggttcaagtgaatctcctgccttagcctcccaagtagctgggattacaggagcctgccaccacgcctaatttttgtaatttgagtagagactgagtttcgccatgttggccaggctggtctcaaactcctgtcctcaagtgatctgcccacctcggcctcccaaagtgctgggattacaggcgtgagccaccttgcccggctcatctatgtatttcttacataggacaaaagcactaaggcacagcgttagggaaacacctcatgctgcctgtataaacccctgctctcagaaagttgtgtgctgcaagatgggcaagacggtgcactgtgctggaatactggtttctggctggttctctacttaacaagtaaggcagtgagtcatctgatcctcaccttcaggggaactgttcatcgctattgtctttaaaggcagatgtccgaagttgcccagcacccagtgtctagatctagtgagagggatttagaggagtctttccaaaggagacaggacggaagcagcgttgtgctggaggcggctgcactggctctagagccaactgtgtctttccttcccaagtctgtactcagtgaggagacactggtagcttgaagctggcccagatgggtgtatttacaccacagaaattggcagcaactgcaaagtgggctcttttgtttacctcggagatctgcttgctaaactttcaccaattgttggatgaaagctagttctgagtcaaaaagatgaatatgtcttgaccaaggagacagaagtcaaacttcgcgaaggcaaagaaaagagggtgggaccttcgtttctgagctgacagccgccatctacctccatgcagcctctgatgggaggaaaattgttgtttttagggtgaatgaacatcaaatattatttgttgggttgccaaccaatttagagtcagaaatacagggaaagacagaggacatgagctcatattttattcctaacaaaacctacaaaacacagtgctttggatttgtggtcaaaagggctgatgaatattttgcctcagaatgaaacagatatacccacttaagtatgaggaaagagataaagaaagtgtgcagggaggagcctgggaacacagagaactttctttttttctttttctttttttttttttaatggtcccttttattgtatgtatgcgcagtgctggcctggctttgcaatgcaagtcctcagttaagatatagtcaaataactatggctgcagtttcgtctgcaggatccacaattcagatacaaacagggagctggggtgggcaggagaaacaggagggaagcagagtgcagactgtccccagcactggcctcttcacacagggttggcccaggcagacacaccccatggaatgatgaggaaatgacaacatggtcccttcccacagtgagcctggggctgctaggaaactgcccttcagaacctttgtgcccaggttgtcttggagcccaacaactttttatttggattaattaaaaaataataagttaaaattaagcaacagctgggtcctgaggatgctgagccagcacgcccacagtttggggggaaaaaaatagccagaccttttttgagggggcaaggtgtgttggcttgttttcgaatttgtggggttttttttttttttttttttttttgagacagagtctggctctgttgcccaggctggagtgcagtggcacgatctcagctcactgcaacctccacctcctgggttcatgccattctcctgcctcagcctcccgagtagctgggaccacaggcgcctgccaccacgcccagctaattttttgtatttttagtagagacggggtttcactgtgtcagccaggacggtctcgatctcctgacctcatgatctgcctgcctcggcctcccaaagtactgagattacaggcgtaagccactgcacccgacctcaaatttgtttttaaaaacacattccctgtgaggtaagaccgcagggggtgggcctctgtgaaagcctgaacttgggatgtgccaagtcgcagattcagccaacaccatctctgtatcctcttgggaaacagggactggggatgggggtgtgggtcaagaagagcgtgtggccagcaagatggggttgtgcagaggccgagctgcagagacagaccttgagatgcagaggacaaaaggcaagggaatgggaggtctgatgtggggggagtcaggataggactgcagccgtggaggtcaaggtgtggatggctctgctgctgcattcttcccctcccaatttctgattgacattctaatttttaactcttacacggacttaaattttgtttaatgcttagctacatctccatctgcgaagtttggtccccaccttgaatatccaccacgtaaaataaagaaacaggagcctgggcggtattttcacctcgtctccctccacttcccagctttttttcaactataccattattgttacattttcaagatttgttacatttacgttttattctgttaacaaccatgattacatgccttgcctctgagtggatgctggaagtgaaatagacacactcgtgacactaactaactacgtttgctggctggagcctgaaggtacagtctcattcttgtgttcctaaacctgggtcaccccaggaggaattttctgaaattcagatcaaacgaataattattccttacactaactttgaaaaatctttttgctgtatgtctatggacaggtttctggtgtagacttttgcttttcctgagtgtcaaagctgcctttccttcttcttgttgacagaagcaacacagggattccccacgggagtgctcagctctcccagctcattcagtgtctcgttaactgactgctctaagttgactccttccttttcagatccgcttccaagctgtctttctggaattttcttactgaatcccctgccttcctttatcttgggttttatttatatatatatttttttaaagtacattttcggccgggtgtggtggctcacacctgtaatctcagcacttggagaggccgaggtgggcggatcacttgaggttaggcattcaagaccagcctggccaacatggtgaaaccctgtctctaccaaaaatatgaaaattagcctggcatggtggaaacggctgtaatcccagctacttgggaggctgaggcaggagaatcacttgaacccgagaggtggaggttgcagtaagccaagatcacaccactgcatctaaaaaaaaaaaaaaaaaaaaggacattttcaggtatttttttcctcctttgggaattctttttaaaatttaatttaattttaaaagagagacagggtctcactatgttgcccagactggtctgtaactctagtctttcagcagtcctctcacctggggcctcccaaaatgttgggactacaggtatgggccagtatgctcagcctgggaattcttttcattcattctgaattgcatgtgtcttccacattgttgagtttccttgtcctttactgcagtccatatcatataataatatcatggtatattttttgaaaagttgcatggaagataacaatttctggatgctccatgtctgaatgtgtcttaactcgtttacacatttgataagaactggaataggtacaggaatccatgttgaaagaaacttcttctcagaaccttgctgacatttgcccagcttccaccatcagcatcagagggctgacagcaagctctgtgcctggcacaggacatggcttctcattgctgtagcttaagggacctctctggccaaggagaagccactcgactctgggactccatctagctttctcttggttagatgatttccagtagcttcttttgctattaattttgtgagtatttttacaaccttctagggatcagggtgagttatacccaagtgtattagtcagggttctcaagagggacaaatctaatagaacatacatatatatatatatatgtatatatgagtttatttagtagtattgactcacaagatcacaagataaggagcaaggaagccagtcctagtcacaaaacctcaaaagtagggaagtgacagtctagccttcagtctgtggtttaaggtccaaaagccccgaagctgaagaacttggagtctgatgttcgatgccagaaagtttccagcacgggagaaagatgaaggccggaagactcagccagtctagtccatccacgctcttctgcctgcttttattctggctacactggcagctgattagatggtgcccacccagattgagggtgggtctgcctctcccagtccactgactcaaatgtttatctcctttgggaacaccctcacagacacaccaggaatgatactttgcatccttcagtccaatcaagttgacactcaatgttaaccatcacaccagatattcctctgagatgtgaaattttcagtactattcctatggctttgttcttttctctgcccttatggataaaggatacacttctgtatttcattttggagaacattatttcatgctggttctagatgaatttcactggtttacaagaaacttcactgttctttgaataaaaataaggcaaaatcgtcaagggttttgagactatttggaaaaaaaaagctcgaaaagaatgggatgcacaaactagttattgttgaggcaatcagcatctcaactcctattacaccttaaaaattatttccgcaacataaccacacttgcaaatctcttcatttttacacatatatacacatattctatattagcactgaattttgctaacagctcacatttgccaagttattctaacttgtcttatttatgttcaagttttcatctttcccctactgcttgaaataaaactttgtgtcattgatttatttttgtgaatgtgcactggggacgtaagagaggaaaatagcaggagaagtgtaaacaatggcatgaaagtgacgtaagacgtgagccaggatggtctgtagagttcggactgtatttgctgagatcgaaaggaccaaacagcgctctcagcaaaggtgcaaacttaagaaggctgcaattattagaacataaagaatttccggcgaggcgcaggggcttatgcctatcgtcccagcactttgggaggccaaggcgggtggatcacctgaagtcaggagttcaaaaccagcctggccaacatggtgaaaccctgtctctactaaatacacaaaaattagccgggtgtgggggcgggtgcctgtaatcccagctactcaggaggctgaggcaagagaatggcttgaacccaagaggcaaaggttgccgtgagtcaagatcaagccactgcactccagcctgggtgacaaagcaagactccatctcaaactaacaacaacgacaacaacaacaacaacaacaaagaacataaggaattttccaggaaagtgaaactcaaaacttgacatttgtgaaataaatgtgaacagcagtattcaatcaatttagctcggaaccgtcaatgacctggggagcacgtgagagtcagtggggcagatttccggtacatggacgatacctagagaggtcctagtctgaaagaatcttccggatggaaacagggcatcttgtttatacaagcccaggtctctcacagcaaattcaactgtatgttccttctcctctcctgccagattgccagttactttgaggggaggaatatcttctaaattttctgaacctcctggaatttgacatatcgactgtattctggatatttaatgaattctgtttgatgacacaggtagagtaaaatggtcttaaatcattttgacagaggtaaaaaacattttattccacactttacttattctttttctgcctgaagtgattacaagaaaaaaaaacgaatagtttaatttaaaatccagattggtatgtaattatcacaaaatcagtgaagttcttttcaatgaaaaaaaaaaacaccagttctataatttggacagacaaaatttagcaataacaaaattaaaggtacaacccttaatctattaattatttaaaaatgcatctcgaactatttttctttttatttatcccttgtatcaatagacatttaattggcaaacaagaacatggaaaaatataaactgtaactcactgtaataaactctaaatcaatacaaagagtctaaaatgtgttttgacgtccaaatgtagctacagccactgtgtcctgtgttctataacacagagaaataatacaaaatgattaaaaaaataaaataaattgaagagaggcctgtaatgtaaggggcgctgtgtcactctcaggcagcaacgtgagccagtgagtcaatgcacgaggctctcctgtttgttggtacttcctgttctttctttataaaatacatggagaactaaatccgcaggatgctcacacaaatgattcatagagaaagcttaaaagaatctcacgttgttaatgagcatcacaataggctctgctcatgagaaggcattttgtttccgcagaaatgttttttcttactctgtcctgattttgatttctgtttaaattcagtaaacacattaccaaaatttaaagaaggtgacttgttttccccaactctcagttcaccaaaggtatttcatctatttgttctgaaaatgcagctgctctctagatgtatgtgtgccctgataagaaatgttttgtgtaacaataaaaatcatttcttttgattaaaaaaaaagaatctccagtcgtttacactggaaaacgagagagagcgcttgcatactttcttcacatatattaatggtgggaagaaaatggatgtagagtaatagggcctgaggaactcatagaaggaaccggacatgtatgaaaagatgatgactgccaggtggcactgacgcagcctccagcccctctatcttaggctttcgggacatgtgctctcttgcttccgctggacagtgtctcaatactttcctccctaaaagcaggttttaccctggtcagaggtgctcttgaggcccaaagaagagatttccacaaatagtctataagagcatgtacatactataactgcttgataagtgaatgaatggatgactaaatggagtcaatgctttcatgacctaacgttgtggttatgggtgtcactattctcttggcaatagtgcaatagtgaaatagtaaaatagtctagatgtcattaagaaccttcatggaaaacatgccggtgggggaaggaaaacaacattcatgattcatgggaggagataaaatagcaacatgaaggggaatttggaagatgctgacgctagccctcatgggtgattttgaggggttcaagtcttcagtggaggaagtaactggaactagaattagaagtggggcctgaagatgtgactgaattgtggcaatctcatgataaatcttgaacagtttacttcttatggatgaacaaagaaagttgtttcttgagatggcgtctacttctagggaagatgccgtgaacattgttggaatgacaacagaggattttttgtttgtttgtttgttttttgatacagagtttccctctattgcccagggtggagtgcagtggcacaatctcgactcaccacaacctccacctcctgggttcaagcgattctcctgcctcagcctctcgagtagctgggattacaggcacctgctaccacacccggctaatttttgtatttttagtagagacggggtttcactgtgttggccaggctggtctcaaactcccaacctcaggtgacccacccagctcagcctcccaaagtgctgggattacaggcatgagccactgcgcccggctgaaagaatctgaatattacttgtagttagttgataaagcagtggctttgacagggtttgagaggaatgactccaattttgaaggaagttctaccatagatagaatgctatcaaacagcatcatggtatagagaactcttctttcacacatgaaaggaagactcaattgatgtggcacatttcattgttgtcttattttaacaagtttccacagctgcccaaacaatttggcagtcaacaccctgcctgatcagacagcagccatcaacatcaaggcaaaaccctctaccagcaaaaagattatgacttgctgaaggctcagatgattgttagcatgttttagcaataaagtatttttaaattgaagtatgtactttcttaaagaaataatggtaataacacttaatagactacaacatagttagttttagaagcactgggacaccaaaataactgtggacttgctttactgtgatgtttgcttcgtgagggtggtctgtaactgaaactgcattttctccaaggtatacccatatttaaatagaaaatggactttcttttactaaggagaatggtattttcatttgtctcatttttggagggaaactctagagaagaagccaagacatgcccactgtccctctcccatcctatggaggctgcccagtgccaaagaggaagtggtcactctggtcactcatatacacacagctggcacaattgtcacagtcgctcccctttgtgacaggctggtggaatgacttacagttcagcccaccaaatataatacagatgaatttagtcattcagcctcatgaggtcacacttttactgttttcaacaaagcttaaacccccttcccacattctgtagaaaaaaaagtgatgacttccggggttgttttctaggccatttctatcagaactcctgcaactcgccagatatttcaactcttcggaaagccaccttgtgtccattttatgtcccccaaccctggataatgtctctgttttccatgtacctaaaaacattgcaaaaaaatctgctattcaacatatcttggtgttattgtcactggaggaaaatggaaggagaaaagcaaacagagagtatggaaataaatacccgtcagtatagaaatgtagtatatcataaaaatggcacttcaaaccagtgggaagcaatgggtcattccgtaatacagtactggaacaggttaataaaaaattacaaagtttaatttagatctccattgtattccttaaaaacaaagtaaatcccaataaaataaaaattcaagtgcgaaaaatcaaagaaagcatcaaaagtataagaaacgatgggccaggcatggtagctcatgcctgtaatcccagcactttgggaggccgaggcggacagatcacctgaggtcaggagttcgtgaccagcctggtcaacatggtgaaacaccgtctctactaaaaatacaaaaattacccgggtgtgatggcgggcacctgtaatcccaactacttgggaggctgaggcaggagaattgcttgaacccaggaggcagcagttgcagtgagtggagatcacaccactgcactccagcctggacgacagaggagaatctgtcctaaaaaaaaaaaaaaaaagttggatgatgaaaaattttctaagattgcactggtgatatcttccttgagcggacgttaaaaccagaagccataaagtagtaggtgcaaacctctgactaccaataaaatgtttaaactatttctatggcaacgtaacaaaagcagaaataatcttcttgtagtctgctctactggtggtcaccagtaaaccattcttggcaaaaggcatgcccctgtacccccccaccctcgtgaatctgagctgggcctgtgactggccttcaccaagagaatgtgacggacgcttcagaacttggcctcaggagtgctggtaggtcctgcatttgcactcctggacacccctgaactaagaagtacagctgcaagaagaacacagcacgtggagaggtggtatggaggggccacgtggagatagagagccctggaggctacatggagaagagcacagaacccagctgacccaagaactgaggccccaggactacagccccagtcaagccattccagttggctgccagccatcctcacctcctagctgagctccagacacctaagcagatgaggtctctgagacaccacatctccagcagaactcatacaggaagagcaccacactgtcctcatggggccctttccaaattcataaccctcagaattttaaaaagtaatatgttattttgttttaaagacatgggataggccgggtgcggtggctcatgcctataatcccagcagtttgggtggacgaggcgggtggatcacctgaagtcaggactttgagaccagcctggccaacatggtgaaaccccatctctactaaaaatacaaaaaattagcctggcatggtagcaggcacctgtaatcctcccagggaggctgaggcaggagaattgcccagaggcggaggctgcagtgagctgagatcacaccactgcactccagcctgggcaacacgagcaaaactccatctcaggaaaaaaaaaaaaaaaaaaaagacatgggataatgtataatgtggcaatagatagctggaacacccaatagtcaaactcaaaagaaaatcagcaaactgggaaaagactaagcaatacatatgccaagagactaacgtcttaaatatgaaaaaagagcttatgtgtaaataagaaaaaagtcaactcaatacaataggactcaaaacttactgcaaagaacaaaaacataagtggtcaaaaatcatttgaaatatgttcaagctcactcaatcttattgaaaaactgagtaatattcttttacttgcctattggattggaagatatttaaaagtttaacaatgaataaaattaaattaagtgaaataaaataaaataaaaagcaataaccagaatggaggtgatgtgaggctcatgaaccacttgttgagagcaatcattgtttacaaaaaacctactatgtctatttattcattgacccagcaatataatttctaacaatatatcttataaacatgatatactcaaggatacagcgatacatgaactgttatggactgaatgcttgtgtctcccccaaattcatatgttgaaaccattacctccaatgtcatggtatttgtaggtggagcgtctgggaggtaattagatctatatgaagtcatgaaagcagagaacccttatgggatttgtgtccttatgagaagaggagaaaccagagctcactctctgtcatgtaaggacagcaagaaggcagctgtcaataaaccacgaagagagccctcaccaggtttccaatcggctggagccttcgacttggacttcataccctccagaattgtgaaaaataaatttctattgttcaagccactcggtctatggtattttgttaaggcagccaaagcagactaaggctagaacaaagatgctcatgaagcatcatttgtaatatcttaaatgttggaaaattctacatgtctacccttaacaacctcattcaataatttgcaacacagctatacaacgtaacactgtaaagctttttatcagaataaggtagtattatatatactgatctctgaggatgtctagatattggtaaagtgaaaaaaagaataagctgtaaagtagaatttactgtaggattctatttgtgaccttttatgaaaaagatataggcacatgtatattacacacttgtaggcatgcatacttctatattatatttctaagtacacattgggagctattcatggtgattatctctgaggatagggagtattagaatggccaacttggtatgaatagggaataaagaagacttactttttatactacacccatctgcactgttttttttaacgtgaaacatgtaacttttattaaaaagaaaaaaaaattgtgaaatgcttcatagtcctttgtgtcaagagctctgccataacccaaagcacaaaacctaggaggtctgttgatcttaatctacactttggcctcatacatggatatagcgtgttggttggtaccatgcaaacactgtccctcctttctgggttggagaggaatcaggagtgtttggagaaaaagaaaagcacatcccctgaactggcaagcgatactcatgaccatcagcagccacaggctccattaacaagcaggagagggatgtttccctggtctcaccagcaataaatgtgtctatggggaagcaaagtttctaagaagtgcttaaggaactctaggcattcctagacagcccaggctctgaatttagatgggagaaaagtaggcagatatcactgaaaatcatgttgttttaaaatgttcttttttgcgttgggtgcggtggctcatgcctgtaatctcagcactttgggaggctgagacaggtggatcacctgaggtcaggagttcaagaccagcctggccaacatggtgaaaccccgtctctactaaaaatacaaaaaattagctgggcgtggtggtgtatgcctgtagtcccagctacttgggaggctgaggcaccagaattatttgaacccaggaggtggaggttgcagtgagccgaggttgtgccctgcactccagcctgggtgacagagtgagactctgtttaaaaataaaataaaataagatgttcttttcaagtttatcgattaattttcatgaacctgaaaggtgtttgtgaaagaacaccctattcttattattctatgtacaaagagaatcatattcactcttaaccctcacatcaagacacttactttgatacatttttaaaggcttgaaatccaaaatagagttttaattttcttatcaaaaaatttcaagcctttatatcaaggtggtaggattgttcatctcttttgtgtcaaccctgtaaatgtgagaactgtaattgatctctgctatgcgtgagtgacatggaagaccctgaatatgttgtagaaccagaacattttcattacctacatcatgctgtgtgtcaaacaggcatgccaatcagtttgtggatctaagcaggccattgcacatgcaaacgtgtatgataggtatgacagtttaacttagcattctcatttggaaaacattctggaatatgtgaataagtaactggaaaattcccaaatagacatagcattgcggttcagaaacatgaatatttaccattgacagagagcaagagagaaagcatgcacacaagagagggtccccatcaaactgaacaatgtataagcaagaatccacagtgcaaattggaaggatgatcatggctgcgaggctacagttatgactaaacaaccattgataaatttattctcgactatatcaaatgataaagaaaatagctatgaatttactgaaaaaaaagcattatccctaattaataagaaaaaagaaaaagaaaggaacatccagctcaaacacttgtccaccaaatagcacaacagatattgagaacactaatatttggttataaaggacaagaaattgttaagaagaaaagtaatttccactttggtatttctggccttatgaagacataagatacattgggaggattatggaaacataagtgattgagagaaaatctcatgagaaacttaagaagatgggactgtttatgaaataggaataccacccataattggacaaagacaataaaaaatttttctaattacagtatcattccataagtatacaatgtgtattatcagtaggtgaatatcataggccaaatgaaaagcaaacaagtaagtaaaaatattaagtagaaaaatattctcatgagtgattgatatgattacatttgaattttagaagatgtcattagtggagatgtgaacagaatcaggatttaggatgaagtctgggaaagctgttatgaggctactgcaatggtctgggctcttttggcatttcctctttaagctaaaattggccctttacttactatttattctcttttccctgatatttgctcttcttgtttttaaaaaatccttcaatttaattttaaattttatggctttcctcttcttctacccggttccgttccttactctgcattgcaaattacacagatagtataaacatagacgacgttagtctttaattttaatttttctttttctttttcttttttttgaggcggagtcgcgctctgtcacccaggctggaatgcagtggcgcgacctcggttcactgcaagctccgcctcccgggttcacgccattctcctcctgccccagcctcccgagtagctgggactacaggcgcccgccaccatgcccggctaaatgttttgtatttttagtagagagagggtttcaccgtgttaggcaggatggtcttgatctcctgacctcgtgatccgtctgcctccgcctcccaaagtgctgggattacaggcgtgagccaccgcatccagcctaatttttctttttctttttttgagatagagtctcactctgctgctcaggctggagtgcaatgacacgatctcggcttactgcaacctgcagctccagggctcaagtaattctcctgcctcagcctcccgagtagctgggactacaggtgtgtgccaccatgcctggctaatttttgtatttttagtagagacagggttttgccatattggccaggctggtctcaaactcctgacctcaggtgatccacctacctcgtcatcccaaagtgttgggattacaggcatgagccactgcacccggccgattttttcatttttatttcaaatttctgccatatattttggattctctctttaaaaaaaaatctgtaacattttaaaagcaattttggcattaatatttgtggtagtaataaggttttacatgatggattaggatatgatgacaatacaattcttaaggttaacacagccaggagaattatatggccaagtgaatagatctttagacctctggctttggaagcttcttatgaaatcctaagagatttacagacaacaaatgtttacaacatttaggcacacaacagcataatactagacacaaatactaagcaatattcagagtccaaatacagccatactcattttgcttgtaaaaatttagtttttcaatttgcctcctgctgcacagaagtaatatagcaggtgattcatttccacgtttgaactgctgttaaccacaatgggtgaaggagagcgagatgcaggcttcgctgatcatgtcacccttggaagaaaggggaataaaattatagggcagaatgacctatcatatttccttgacaggtgctaattcactttgatctatccttcaccataatttcattggtggggaggacatacatatttataagtgtggaaacaggcgactgtttttctgtttgcaatttacaacaacaaagaattcatttcaattttcatattagaagtcccaaggtgacccgggagtagataccagtcccctgctgtgcgggatttctaacataataaggaataaagcacaacaacagtacattgtgacctgggctcatgggtaatcaattcacatatttaccatggaaacaacagtaccacgcagaacatcgtcattgcttcaatttgctgacgaaagccctctagaacccaggaagagtgtgcgtgaaagctggctgattaatctgacttacttatgctttgttaaagagttattgtcttaatcataattaacactaaatagttactcatggaaaagctgcaagagagattcagctctacctcttatgaggcttatggtctgtgattttcaaaccatgagtcatcgacaaatatatacaatgaaacagagattgagccaaatgggaggacaccagggttttgatttcagaagtcggatttagaatttcattttctatgcaaaatactgcatggtatacaaacacctctcaggttatataatcatggtgcattatctttgtacccacaaaatgcttaacgaactcagtggggtgagttctttttcttctaaggaaggaaaacaaaacttctatgcacgggaaaacaagccagtgcacggcatgactaacacaatgccatgtaattaggcaaaagctttgaatagacatttcacttaacgagatatacgactgggttaataagcacatggataagatgtttaatatgactagtaattagagaacgtctataatgaacaagttgacaaaatctagtgtcggtgaggaagtagagaaactagaaaccaacacccccgctccccaccaccaccttttgctggtgggaatgcaaaatattgcagccacttgaaaacattcgagcaatttctgaaactgttaagcacacgactgttagagccagcaattcctctcctaggtatccaactgaggagaaatgaaagtgcagatccacacgaagagttttacgccatgttcacagtgtaactcacaataacaacgcaaatgtccatctactggtgaatggataaacaaaaggtatcgtatccttgcaatggagttttgctcatcaagaagagtttcacgtacaataactttgagaaaaatctcaaaattacgctgagggaaataagactgacaaaagattacatagcatttgattccatttatctaacatttctagaaaaaaagacaaaactctataagcagacagttgatcagtgtttgcctagggctgaaggtgggagtgaggatggctcaaatatgcatcgaaaaactttttagggtttatttttctgaaactggattgtgataactggttgcccaattataaatgtgtattagaaatgatcgaactggacatatacctggaggatttgcatgatgtgtaaattataccccaataaagttattggaattcagtaagaacatagcttgctctagatggttaaaggtttcagttgttcctgttataggatcttaccattatgaactgtcatcttcccaaaccagtgaagtcttagcaagtgctggaaatacaaataggttcacaatttaaaggggcagctggagcctcagtactccatcagtaatatgtattaagacatgccacagagcaaatgctcacagtgaaaagtgctggggagactgtacaggggtctactacatgtgattaaagaactgtgtcagatggcatttcaacagctttgtaagtgatgacagggacacaggtaaagttgaaaaatcacattcctatcctccttaggacagatagtaagcatacgtttttaattactgtcatgagtcgcttaaccacatggatacattctgagaaataggtctttgtgtggacatcacagagcatacttacacaaacctagatggtatcacctgctacaaacctagactggatggtagagccttttgctgctgggttaaaaacctgtacagcatgttactggactgaatactgttggaaaccataacaccggctgggcgtgctggttcacgcctataatcccagcactttggggtgctaaggcaggcggatcacttaaggtcaggagtttgagactagcctggccaacatggtgaaaccctgtctctactcaaggtacaaaaattagctgggtgtggttgtgcaaacctgtaatcccacctacttgggaggctgaggcatgagacgtgcttgaacctaggaggtggaggttgcagtgagccaagattgtgccactgcactccagcctgggccacagagcaagactctaccagaaaaaataaaaaaggaaaccataaaacaatggtaagtagatgcacaatgtctatctaaacacatgtgaacatggaaaaggtacagtgaaaatacagtataaaagataaaaaacatggtacccctgggccgggcgcagtggctcatgccggtaatcccagcactttgggaggccgaagtggatcacgaagtcaagagattgagaccatcctggccaacatggtgaaaccccgtctcgtctctactaaaaatacaaaaattagctgggtgtggtggtgtgtgcctgtaatcccagctactccggaggctgaggcaggagaatcgcttgaacccaggaggcggaggttgcagtgagccaagatagcgccactgcactccagcctggcaacagagtgagactgtctaaaaaaaaaaaaaaagaaacgtacccctgaataggacacttactgtgaatggagcttacagtactccaagttgctctcctgattcagtgagtgagtgaatgtgaaggcctaggacattattgtataccactgtagacgttatgaacactgtacatctaggttacactaaatgtatacaacaaagttcctcaataataaactgaccttggcttactgtaactttctgactttatacacttcttaatttttaaaactctgacacttgtaataacacttagcttaaaccacaaacacattgtacagccatataaatatattttcttcctttatatctgtattctatatgctttttttctgtttctaaatttgtaaaactttttaaactttttgttgaaaactaagacactgacacacacattagcctaacagggtcaggatcatccatatcaccatcttccacccccatatattgtcccactggaaggtcttcaggggcaatgacatgcatggacctgtcatttcctataacaatgccttcttctggaaatcctcctgaagatcctgcctgagactgctttaccgttaacttatttataagtaggagtatactctaaaatagcaataaaaagtatacaatatacataaaccagtaacataattattcatgaccattatcaagtattatgtactgtacttcatatgtgctatacttttatatgactggcagcacagttttgtttacaccagcaccaccacaaacatgaataatgccttgagctactacattgcaacagctacagtgtcactaggcgataggaatttttcagctccactataattgtatgggaccaccatcctgtgtctgtcatggactgaagtgtcattgtcattatacaacaccttactgcactcaaatgacctcctgcttcacccgtaaaggaaaatcatcatcagtgtagcctgtagctataggatggtgaagttcactaacttgccagccagtcactgtgttgaaatttggtagaacgtcatcctctgagccactcctaaatcttagtgggaacacaagtagcacaggataggctgacaactgaagtgaaagcagatagaaggaacttttcaacctctcttgtagaacaacatttcaattaccagagaaagtggattctctgggatgctacaaggcagatgtcagcctcaattggttaaatctgagaaacattgactgaatttctcaaaaacaacagggaatcctgcatctaattccaattcatgtttaaaaagcccagaaaattaagttacatacaataaggcaagtaatacattattaccattttgttgccactcaggattcaaacaaaagagactccaataaaccccctgttgtcaaatgcagaagatgaaattggcagagtgtcaacttctacagaaggcctcacttctcttccttgttctagctatttcctgcttgtcttttaaaattcctattacgtcttatggttttgaaaaatattttcctgacccctcagtgtgtccccactttcagccaccttacttacagtctgattcagaggttccattgttttgccctggtatgcaaaatggatgtctatcatttctcacattgcatgcaaacaaatattagtttacttttttctctcatattagaaatctgttaagggaagggggaaatacatatgtgtgtgtatatatacttatatttgtacacgtgcacatacatataagtaaatttgcttaattacctaggtgctgaaccagaatttcataaattatttgtggggatataatataagtacatgaggtaattcctacatgaaatggagtaactaacataggtcagcattaagttgccattaaaaagttccaaagtatgcattactcatgtttggataccatgtaacctgtaatgagatctgaattctggaaatacaggcaatgattacaggagtctaagaataaagaagccagcataagcctaaaaaataaagagaaggttttggagaagttggagttttgtttttaattttcatacatcttggattttatagcaaactcaattaactaattaaaaattagactcaattaactcataaaaaatgcatgttcttatgctgtgatcatatttcacaattgcagtttaaacaaaaccatgactcactatgctgacgttatgtcctggtgctgccacctatggacaccaggtcacagctccctccaggctggcaggcatcttgcagcatggctggaggatcctcccatgtggcctccctgttcctgatctcagcagcttgtttcccacaccttcaagtgtacatttcctcaggtcactccatagcatacaatcctccactgagtgaatccccatcacacatataaagtagattctgcagttgggggccagtgccggggctcatgcctataatcccagcactttgggaggctaagtggggcagatcacctgaggtcaggagtttgagaccagcctggccaacacagtgaaaccctgtctctactaaaaatacaaaaattaactgggcatggtggcacacgcctgtagtcccagctaccagggaggctgaggtggaaaaattgcttgaacccgggaggtggaggctgcagtgagctctgatcacaccctgcctcaataaataaataaataaaataaagtagattcctcctcctcttctttttatttgcaaaatattgcaaactcataaaaagttattaaaattgtacaaaaaactgttcttcacctaggttaaccacttgttatcaattttgtgagatttcctctttctgtctctacttacatataatgaatataacatagttattactatatgtataactgtattgttattgttgctatgtagcgtctgagttcttagagagtaatttgcaaacatcacgatcctttaccccctaattgtttagtgcctcctaaggaggaggacactgttaggtaactgcagtacaatcacgaagttcagctggtgcagattctgaatggaacttgcgagacccttcagaacgtggcccacctggcttcctctttccctgtctgcctggtactctttgtactttgcctaggaaagaaacggccattccttgctatcctccattgctttgtacacacagcccctgcctttcaagcatttttcccattctctttcctcagctgagttcactattgtttctgtgtctggacttgaatccaggctctggcgcttcgtagttatgggacaatggggaagttacttaacctctctggggctcagattcctcgtctgtgaaatgggattagaaaaagaaactgtctcctgggatttattgtggggttaaagtcagatattttaggtcaagagctaaagaatacctaggaaaaagtaagcattcaaaatctacttactgcccctatcacactaccatcatcaccaatcacttctcgggcctcatctttaacctcacacactccaggaaggcctcactgatcctcaaatatgaatccaatggcccagactgtgtgcttaggtaccctgcattaaaatgacctactataatttactggaagtattttctatttgtttcctcctagtttgcgtttaatgtcttttccacagtgactaagtctgacttggtcaattttgaaaggctagtattcagcatagtgcctgacacacagcaagattttaataactactcactgaatctataaatgaatttcagtaattcagaattcagaatgaatttcagagtctaatggccgaaataattttcccaaactcggctgacaattgatttttcaggggaagtccagataggttaagagcagaaaaggtgactcattcttcaggggctcaacacccattccccactgcccagggaaagtgtttgcatgccatgtgaaacttcaagcaagctagtttttaagctgttaaaaaaaatgagggaattaattgttctgagcagtttctcaccatctccacagcattaaattcaacattcgatttgcttttcaaacacagttaacaggcaggaagatgagataatctatttcagtgaaaatgtaaactgtggaagtaccctgtgagtaaactaggggagagagtccctccacaaacaagaaccacggctgcccgtggggaggctgggaacatgcccagaattcacctggcatcactgttgaggtcaaatgttaagacttgctgggaaaaaaatattgttgttgttgttttttggtgaatccagaggaaggaaacatattaaaattctaatgaatgactaaagtgaaaatgctttacaggcttatgaatgaaaattttcccaaatttttccttatataaagattatgcatacaaatttaaataccacaaaatccaaatataaaacaatttatgatgggctaatataaaattacactttttcaatatgatagaattgcatctttgactttatagaaatgttgtttaaaaatgtctttagaggtcaggtgcggtggttcaggtgtgtaatcccagcactttgggaggcagaggcaggcggatcatgaggtcaggagatggagaccatcctggctaacagggtgaaatcccgtctctactaaaaatacaaaagattagccgggtgtggtggcgggcgcctgtgatcccagctactcaggaggctgaggtaagagaatcgcttgagcccgggaggtggaggttgcagcgagctgagatcgtgccactgcactccacgctgggcgatagagtgagactccatctcaaaagaaaaaaaaatgtctttagaaactcctatttatatacaaactgatatctaaaggaagatccattttatacttcattagtgtaactttcagttacatggagttgtaactaagtgcattaaagatacaattgaacttattcccagatgtcaagtgtccctgccaagatttaaatccaatcacaatatgaatgatgtttaggagattcaatggggataaaacaaacaaacaaacaacatggaagacatcctccttctttgctagttgatgatgaagaaaataagggcagctactatgctttactaggcacttaccacatgccagacactgtgctgaactctttatatgtctcgtctcctccccacgagactcatttaaggtttgtatttattattcccaatttaaaattaagaacattggagctgagagaggtcaaatagctttctctaaaccactcagctagtaaacggtgcagtagaagctgaagtaagttctgtaatctattttaggaacttttcaaaacgaactgttctgtttgaaagttacggagagtctacctctaagtaaatgggagtggtgaacacttagaatgacaaggaactgccacttcgttcttgacctgtagaaaggcagtcggtgagggagacatgctatgatctattcggtagtcctaaaagagactcatacttatatacctaaatacgcaggtcaagacctgggcgaatttccctattatatattcctgtagctgagtgatgattcctttgtagcgggagtcgcagattcagtttcatctgtctgttgtggttattagactgaggtcatctccctcacttgacttaccctccaagaaaacagggaacttatctggcttggcgcacactgtctcttcagccctggagcactttgtaaagatgaagtactgaataaatatttcagaatgaatgcataagggaaatgtgtgttcagagggctgcagcagttgagttcttaatacatcgaccctttcaacacattcctggggcctggtgacctctaccaaggctaccttcatgttcgtcttatccctgttgcagcaatttgcaaattgaggaatatataatctagtgagttttaggtctggttgcactctagttgcagtctaagaaacaggtgaaagagcatattttaaaatgaaaacataggagagttctttgaaactgaatctaagtccaacaagcctacgagagatataactgtctttctctataagacattcaaatgagctctgaagtggtacaacaagggcaagtagtggcaaaccctgggaatcttctagcagaggcaaataaattcagcctttagagaaaatccctctaaattttgcttctcctttttaaaagacaataagttacattttgataaacaaggctcagataaatgagaacatttaattctaaaggatacctgttctagaatgactggtgggcagaaaattacagttttagatacttcgtgtgtgtgggagaagatactatacactaaaatgaaaaaaaaatacacatacacatgggagttgttttctagtttgccaatgatagtttgttaaccagtattttccttccttagtaatctttttataagtgaatttgtgtattctccaaacccacttgcatgtacatgcttttactcatatattttgaagaggattgcaaagtgtctgaagaactacgaaggagcttaatcaaaaccgtgaatacatcactacgtcttacatacaggaaaattaggcctccatatttttaagctgaaaaaatgctgaagaataaataaggggtaaagaggaatacaaacactacattaacttacagggtaaaataacttacacttataactagaatagaagaaaatcaaaagtcatgttaacaaaaagcaaagatgataatagagtccactttaattatatttgaattagaaaatggctaagggaaatgttattagttttaaaacagaaaagacatttttacgactgaaatttaaaagaaacatattttaggaaatcaatctaaacaataatttcatctttaatggaaatgagagtagttagaattttttaagtggttactaaaaaattactttgcttgaacttgggaggcggaagttgcagtgagccaagaccctgccactgcactccagcctgggcaacaaagtgaaactctgtttaaaaaaaaaaaaaactttacaaaaataaacagtaccatagtaaatgtctcaatgaaattattttagagtgaagaactttagataaagttactgaagaagcataaaaaatattagaacaatctgtatatcattgttaaggaaaagagtgaacaaggataacatttatgtttgcttactgttgtagaccaaatatttgttccttccccaaattcatattaggaaatacacctactatgatggtacccctgggagacggggcctttggaaggtgattaggtcatgaggatacaaccttcatgattgggattagtgtctttatgaaagttgccttctgctatgtaaggacataaggagaaagtggtctgcaacccagaagagagctctcagcagagcctgaccttgctggcaccctgatcttggacttccagccttcaaaactgtcagaaataaatatctgttgtttataagccatttaattgtgatattttgttatggcagcctgaatggataatgacacttattattaatatttgggaagatagggaaaaataatttatgatggttaaaaatacagatttgtaggaggaaataaagcacagctttgaaagacaaatcatactcgatcaggtaaattccctttatgactcactgtgtagattagaagaggcaggagatttaatatttcttagcttcataaagtccttggttttattccacaggatttagtcataaataagtgaatatatatttcagccctacaagaagttaagtggttccgtatggactagggtgggaggtgagataagatagaaaatataacaatcatcagaatatataacatataacaagatactatttgccagacgccatagtatagtatcttacacattatttcctggaattacaacagctgacctagtgaggtaggtgtttttattttaactttcacctaggaataaactgagggtcagagtgtagttaagaaacttgatcaaggtcacataagtcccaagtggcagggctgaaatctgttgatttttcaaagcatctttctgcccctaagcctttggagttaacatggggactcatgagagcatttcttaaaaacttgtcttggatctaattggaataggctcaagcacctcaaaaagttaaacacacaattaccaaataatccattaagtccactcccatgtatataccccaaaaaagtacaaacgaggactcaaacccacacttgtatagatatattcacagcagcagtattcacgatacccagaaggtggaggtactccaaatgccaatcaacaggtgaatggataaacaaaatgtggcatatatataaatggaatattatttggccataaaaagtaataaaggatttctatatatgacaacctggatgaaccttataaacattatgctaaatgaaaaaaacacaaaatcacaagtattatataatacgattccttttatatgaaatgtccagaatagacacaactatagagatggaaaatagcttagtgattgccagagactgagagatagaaagtagcttagtgattgccagaggctgggaagacagggaaatggactaactgcttaatgtgtatggagtattattttggggtgatgaaaatattttgaaactagatagaagtggtgcttgcacagcatgggaaaggtacttaatgctactggattgttaattctaaaatgtttagttttatgtgaatttcacctcttttttttttttttttttttttttgagacggagtcttactctgttgcccaggctggagtgcagtggcatgatctcagcttactgcaacctctgcttaccaggttcaagtgattctcttgcctcagcctcccaagtagctgggtttacaggcacacgccaccacacctggctaattttttagtagaaacggggttttgccatgttggccaggctggtctcgaactgaccacaaatgatctacctgcctcaccctcccaaagtgctgtgacataggcatgagccaccatgcctggtctcacgtcaatttttttaaaaggctcaaaacacttcctaaaattatgaagcccaagaataatgtctgcaacccatgaatgcataaggcaaaggaaataatgggattccttgttttcataattgaataaacaaggaaggtgttccctttgccttgcacagactgcattttcagtaaaatggaaaattgttggcaatgccactgaatttacctgttggcaatgccactgaatttacctgaagccagcattctctcttggacagaaataaaacaatgagccatactggggttcagacagcctgggttccagtcccagctcaaggaagaactaggtgaactaaggagttcacaacctgacatcttggtgtctgtttatttatccatagatgtgagtgaaatcaggccagatggatgaatgattgctacattatcttctaacctaaaaaaatttataagttaatattttatgaaatgaaacaaattgtgatttcatcttgtatataatagatacaataataaatagtgtccagaaagcactgggagcaatacattaggagtgatgtatgatgtgcagacaaaaatgagaagattgttcttcaaacattgtctggggacgaaacaagtcatcatggatcacaggtttacacaatttagtaatctacttaaatgcaacagttctcagtagaatatagcatttcactcttcacctacatggctgagtacctcgttgtaatactaaatgttcttgcccattgtagaaactcatatgtattgctgaataatcctgacactgaatcattgtggtaggcagaataatggctcccaatgatgtctatgtccaaattcaaaaaccctgcaaataggaatatgttactttacatggcaaggggaaatcaaagttgtagataataatcagctgatcttcagatatgatgaggatcctgaatcacttaggtagtagcaatataatcacaggatccttaaaaggtagaaggggaaggcaggatagtcagtgtcagagtgacacaagaaagagtccaccggctactgttggccatgaggatgaaaggggccatgggcccaggaatggcagcacctccagaacctggaaagcacaaggaaatggactctccctgagagcttccagaaggaacgtaactctgccaacaccttgatttttaggacttctgacctacaaaacttgaagataatatacatgtgttatttttagccactacatttgtggtaattggttatagcagctgaaaaaatatatataataggttgtttttgaatgaacgaatgaatgaactcatggatgtgggaggtcaaagtagacacggcggctgggcgtggtggctcacgcctgtaatcccagcactttgggaggccgaggtgggtggatcatttgaggttaggagtttgaggccagcctagtcaacatggcgaaaccctgtctctactaaaaatacaaaaaaattagctgggcatggtggtatgtgtctgtagtcccagctacttgggaggctgaggcaagagaattgcttgaacctgggaggtagaggttgcagtgagcagagatcacaccactgcactccagcctccagtccagtagacatggcacccagcacccccagaggcattgtgtgaagttccaagaaggtactggaaggtgaatttgcatctatatctatcccttgatattgaacttcccagcctccaaaattgtaaaaagtagatttctttatcaattacccagtctgcggtattctgttatagtgacacaaaatgggctgaggcactgaccaacaaaaattgtcctgagaaagacaggggcacctattttaataatggcatgagaacaaacaccattctgaaagaaagcaaagggtttctctgagttttaaaagcacacaaaatatttaataatagattataagtattgatgatgaagactacttatggattatttgtactttcccctatggaaagcagaaagattttaactatggttatcaaaatatattatgataaaatgttggaggagaatttagcacaaaactgtgatttcaagagaataaaatgatttaatttcttaccgattaggagattgtagaggagaagaaaacaattcatccatcgaaggcaatgctatcatggagtttagcaggaacttaagtgaatgctttagtgaaaatcatcaaccatatgtgactactttaaaaagcctaaaaatgttttttaatgctaaagttcacagaaaataaacttctaatcctttaaatatgttagattaaaatatttttattataaaaaattcagaaatatttaaaaaaatctcagttaacataattaagattaatcttggcaatgtgaaaaaaacacagttgtcttttctctgatgtatcgtgttaattaaaaagcaaacatacatattgttttatgttgggttatgtttccgaaacagttcaaatatgcttcctcccacataatgtttaagatcataaaaaatataaatttttgttcattgaatatttatatttttatatcaactataattatgttttccagaatatcaccttaaaaatgctttccaagatctttaggcaagttaaaaccttgaagtaatattaaattaattgaaaatcatttgatactcagaaaatttcaaagtaagataaaaagaatactgaaacattaactactaagcataattttaagtttgtatacttttatttttatttttacatgctcgagggaagccaaatctttagcttatgttaatgaccattttcatttttgccactttgcaaagcgaaaaaaggatgtgtgtagctataaaaaaattatgttttatgtgtctctgacttctgctagtcagctagaatgcttatgtacaacacacaatctcaattatctgtcaagtatcttgctgaaatagcaattatagttatatagatggttacaactatactagcagaaagagtgagagaaaaagaaaaacatatttatgcttttttttttcaagaacaaagactggtttttgaataaagcagcagttctcaacatcttttctctccatccagtagattcttaaaaattactcaggaatctaaagatgttttgtttctgtagtttataatgtgggttataagtatcaatatttgatgttttaaatcactaaaaccagccgggtgtgatggctcacgcctgtaatcccgtcactttgggaggcggaggcaggcggatcacctgatgtcaggagttcgagaccagcctggctaacatggtgaaagcccatctctactaaaaataaaaaagttagctaggtgtggtgatgcacatctgtaatcccagctacttggaaggctgaggcaggagaattgcttgaacctgggaggcagaggcagcaataagctgagatcagccactgcactccagcctgggtgacagagcgagactccgtttcaaaacaaaaacaaaaacaaaactgagaaaataaaatatatatttattaatgtattgggaaataacaatgttgactccattagataataatgtaaataacattttcttaaagaaaatttgtatgagaaaaatgacaaccttgaacatttttacaaaaatatcctgaatgtttggcttaatagacaactgatgggttttcaagtctgcttctccatttaatctcttctggtcatatagcctctgaaaaactccgtagcttagtattgttatgaaaataactttggtgtcacagttcccctgcaaacatttcagggaaccccagaagtcttcagaccacactttgtcctaaagtgtctgtctgtcctacaatgtaaatgaagctcacagttcccctgcagacatttcagggaaccccagaagtcttcagaccacactttgtcctaaagtgtctgtctgtcctacaatgtaaatgaagctcacagttcccctgcagacatttcagggaaccccagaagtcttcagaccacactttgtcctaaagtttctgtctgtcctacaatgtaaatgaagctcacagttcccctgaaaacatttcagggaaccccagaagtctttggaccacactttgtcctaaagcgtctgtctgtcctacagtgcaaatgaagtacaccacttggagagtgaattggacttgtgttggtttataatgctgatatggttaggctttgtatccctgcccaaatctcaccttgaattgtaatccctgtaatccccataatccccaggtaacgagagagaccaggaagaggtaattgaatcacgggggcgcttcgccatgaagttctcatgataatgagccagttttcaggagatctgatggttttataagaggctcttcccctttccctcagcacttctctctcctgtcgctttgtgaagaagatgcctgcctcccttttgccttccatcatgattgtcattttcttgaggcatccccagacatgtggaactgtgagtcaattaaacctctttcttttatgaattacccagtcttaggtagtatttttatagcagtgtgagaatggattaatacaaatgcctacatatatctaaaaagaaactacaaagatacatcaacatcaaaattttagcaaaaattacttaacttcaatgggtttgcttcattggtttactgattaggccttgacccacaatatgaaaaaatgtccagtgaaagcaaattcctctgccttctgtctaatctgcctacagagcagagattctgtgtctcatcagaatagttttctgtgattttagatgactttattatgcccttgattatttaagggcaaaaaatgttgcctcacttaaggaagagctaagattctttacaattgtctttatcctctatgttttatgcttgtattttaaatatatgttgttactttgagagacaggttttttcccctcacttattcacgatcctgtattaatctagtaaaacaatctcctctgacaattattaattttaacttcccaacattgaaccccaaatttagataaaaaatagaagtttcaggatgtttttttctccctaaaactaactttgagatctcccaaatggccctggaaaatcaccaaagcttgttctttcaacttataaatagatgctagaaataattaggtctgtctaatgtgttattttaagagttgcacaggaagaattttcagatctgaagaaacactagcctcctctaggttaagtttgcaaaatcttattactataaacatttcagaaattgtatgctttatggaaagtctctggtgccctttctgcccaccatatgaggaaacttcaaaagttcacagaaaatgcatattatagaaaaactacgcatggattccaatttttgtgccaaaataaactcatactaatttgttacaatgtgtctgagtaggatccagtttgaggcactaaagaggataagatggtcaggtgtggttggttgctcacacctgtaatcccaacactttggaggccaaggagggtgaattgcttcagcccaggagtttgagatcagccttggcaacatggtgaaactccatctctactaaaaatacaaaaaattacccaggtgtggtggtatgtacctgtaatcccagctactagggaggctgaggtgggaggattgcttaagccggggaagttgaggctgcagtgagctgagatcatgctactgcactgcagcttgggcaacagagcaagaccttgtttccaaaaaaaaaaaaaaaaagaagaagaagaagaaggataagacgtgagtatgaaaagagtccctatcagagcaacatgaattctgctaaaatccaagcaacttacagtgaaacttaggtgaaaaaatagtgaaatcactgatgtttcttgaaaattttataacgacaatgccccaaagaaatgagcagtttacaaattgataactcctgtttagaagggatgagatgatgttgaagaggaagcctgcagcaatagaccatccacatcgattcacaggtgaaaaattcatcctgtttgtaccctaactgaagaggaacaatgactaacagcacaaacaatagccaatgccatagacttctcagttggtgtaatttacacaattctgagtgaaaaattaaagttgagcaagctttcctcttgaggggtaacaaaactcttgtgcctagattagtgacaaaagtggagctttcaatggaaattttaaacaaatgagatcaacatcctgaagtatttctttgaagaattataacaggagatgaaacacagctttaccagtacaatcctgaagacaaagcacaaccaaagcaatggctaccaaaaggtggaagtggtcgtcaggcaaaggcaaactgatgaagaacaaaggtcatggcaacattttttttttttttttttgagacagagtctcgctctgtcacccaggctggagtgcagtggtgtgatctcggctcattgcaccaccacctcctgggttcaagcgattcttctgcctcagtctcccaagcagctggggactacaggcgcatgccacaacacctggctacttttttgtatttttagtagagacagggtttcattgtgttagccaggatggtctccatctcctgacctcgtgatccacctgcctttgcctcccaaagtgctgggattacaggcgtgagtcaccatgcccggctggtaacagtttttgggaggctcaaggcatttttgcctgttgactttatggagggccaaataaagaaaacgtctgcttattatgagagtgttttgagaaagccaaagctttagcagaaacatgcccaggaaagctccaccagagactcctcctgcaccacgagaaagctctgataactcttctcattgaggaagggcaaatatgcaagtttcaatgagaaattattaggcatccactttacaatcctaatttggctccttctgacttatttttgtttcatatttttttttttttttgagacagagtcttgctctgtcacccaggctgaagtgcagtagcgtgatcttggctcactgaaacctccacctcccgggtgcaactgattatcctgcctcagcctcccaagtagctgggattatgggcgctcaccatcatgcccagctaatttttgtatttttagtagagacagggtttcaccatgctggccaggttggtcatgaactcctgacctcaagtaatctgcatgccttggcctcccaaagtgctgggattacaggcatgagccaccacacccagctgtcctaaatttaaaaagtgtgtaaagggtccccatttatcttcagtcaatactgtaaaaaagaatgtactgatgtggttaaatgccagcagcctcagttccttggggatggactaaacggctgctatcatcacttacaaaagtgtctggatcttgacagagattatgttgagaaataaagttacatttttcatcttttaattccattttttttccacaaacattttgaagtatgcttacatgttcttactatcaggagaaacactgatatcaactcatatacaacagaaaattttattctccaaactgaaagtattggtcgcagcagtaatttaacaacagcttttaagtctttatcatctatagtcacttgtttcactctgatgcttttctaaggctttgctttaaggtacagaccacagcttgtgtcttcaacaaaagacagtttcagagatttttggaaaagcgctctgaactactgacatttcaaacagttatctcctgggcatgggtttctgagctgagaatgcttagacaactttcagatatatcagtggactatgttacgatttctagaactctttttagtgaaatcagattattaatctaagatccagcaggagaagaattaattatttaggactgaatgagctgatgaggaaaactctgttttgtttgtttgtttgcatgatgttgttgtaatattccattttctagatatatgacaaagccttttgtctttcttcttaaactttctatcatgtacaagaatctagtagactccacttttctacaatcaaacgaaacatttctaaatgatccctgatttttactgacactccagatttcatacattcttcctaaatttcattacttttcatggcaatgtaatagtctgcacagaaatcagtaaaaatctgtcctactttttaccagaaaaataattggacaacctaggtcaatataaaataaattgggcaacctaggtcaatataaaataaattgggcaatctaggtcaatataaagcatcacatttgagaatggttcttatttcatcagatctgacattctgctcttaaggaacaactgttgattttgcatgggtccacagaacactctcagggaaactggcttaccaggctccagcgatacagatgggaagacaggtaaaatcctggcacattagaagcattaatacattttcaggacttcaagagagtttacccaaatttacatgttatacaggtataacctagtaaagacagccttgagcttagttttatagtcacagaataataaataagagcaattttaaaacacaatttgaaattccttataaaaacatttgtggttttagtagttacattgtatggttctagatggaagaagtaaagtcaaggaggcctatatagtaaattaacagtcctaccaccaccatataactaattaggcccaaacaaatgagtccaatattttttgtgattattaaattttgagattattataatcataaattgggatagaaagtaagaagaaattttgaaggacgttgaaacgaaagaaacaagatgagtgggtgtgttatgaaatgccaatcctgtcatctgatttatgggtatgtgccacttacagtgtttgagccactgtataactttaaaattaatgcaaattatttgtgtctgtagagacacaaatagattttgtctatgttttagaaatgtgagtgattctttcctcctcaacaaaaaccactttgcatttattgtcagatacgtttcagcatttgtgattgcctagagatgacttccctttgcaattcctttgaactggtttttaacatctgactagtttcctcaaaatttaaataaaatctttgatgtgttcatttatatttgcctgagagtcatgactttgttttaaaaaattatacttttaacaatttaaagaaatcaatattaggggattgttcttgattttgaaaaggaaaaactaagaatatcaaccaacttcaatccaggactgctcagaagctggatagaaaaaataatgaggccaggcacagtggctaatgcctgtaatcccagcattttgggaggctgaggcgggaggatcacctgaggccagtaattccagaccagcatggccaacatggtgaaaccctgtctctactaaaagtacaaaaaatggccggatgtggtggtgcatgcccataatctcagctactatggagactgaggcaggagaatcacttgagcctgggcggtggaggttgcagtgagctgagatcgttccactgcactccaggcctgggtgacagagagagactctgtctcaaaaaaaaaaaaaaaaaaaaaaaaataccgtcgtcgggcatggtggctcacacttgtaatcccagcactttgggaggccgaggcaggcagctcacttaaggtcgggagttcaagaccagcctggccaatatggtgaaaccccatctctaccaaaaatacaaaaattagtcgggtgtggtggtgggttcctgtaatcccagctactcgggaggctgaggcaggagaatcatttgaactcaggaggcggaggttgcaacgagatgagatcgtgtcattgcactccagcctgggtgacaggagcaaaacctcatctcagaaaaaaataaaagaaaaaaaggcagatgttaaaaacaatttcaaaagaaatgggaaattttaacatggtttatattttagataaaattactaagtaatttttttattttaaaaaattaataaacagttttcttaggggtaaaattggtactaaataatggagttattctctttttttttttgagacagagtttcgctcttgttgcccaggctggagtgcgatggcgccatctcggctcaccgcaacctctgtctcccgggttcaaacaattctctgccaccatctcccaagtagctgagattaagtcatgtgccaccatgcccggctaattttgcatttttagtagagacggggtttctccatgttggtcaggctggtctcaaactcctgacttcaggtgatccacccaccttggcatcccaaagtgctgggattataggcgtgagccaccacacctggccaatggagttattcttaggccatgcttgctgaagtattgaggtgtctagtatcacaaaatttgcaaatcatgttcaaaaaatatagcaaaaaaaaaaagaaaagaaaagaaaaagaaaaaagaaagtgtgtctttgtgtatgagcacaaaggaaaagaaagaggacagagccattgagaccacctgttaatggctggtgccagcaaggtggtgcctccatggctgctcaatgttgatataatgttgatgtctctcaacttctcttgaagttgaaaattttcaaaataaaaatggggcaaaataccagagagaaaatttgcatttatttaaaaaacactgagcattggttgagagttttagaaccagaggacataaaggttcttgataacatatgtatttttcattcctcagatccctagccagtctatactcctttgttccagacacactgataagagaataatccaacttagttcatgaccataagttaatgattatttcagatcctgaaaaagaagagccggaaagtgactgttcagaaatcagaatgtctatgtggcatgtggcaagggaagaaggtacattcaggctccctgcaggcgcacaatctacaatgcaggaccacccatttccagtctctgtgatgctgaccacagcctcttagagctggaactaatagcaaacctcacttggtgtttgtggtctcctaatgcattaggttctccccgcacacaccatgaaattcatcagtactaactgctttggacacagaatattattactgacaggacagaattgaaagaggccatactgatatggaagtgctgggaagggaatggcatggtcgctttaaccaatatggaaggtggggaagggaagtgctgggtagaggagggcatggtccctgcctagggctccactcttgggcctgtgcccagggacctaggtgtggacaattattttcattttcctgccccaatgttggcatttcccaagaccaccctggccttccacatccccatcctgtgcctataaaaaccctgagagcctagcaggcagacacaggcggctggacgttgagaggagcacatcagcagaggaacacaccgggggctggatgtctacaggaacacaccaacagccaccagcatgttggccactgactggcagaacgatgtggagtgtggctgaggcagttggaggagatcccaggctgctgagcagcccgactccaggtgaaaactatctctcttctggctcccccagctgctgagagctactcaataaaacctcactctcattctccaaggccacttgtgatccgattcttctggtacacaaaggccagaaccctgggatagagaaagtcctctgtctttgtgataaggcaggggtctaattgagctaacacaagctgtctacagatggctaaactaaaagagcaccctgtaacacatgcccactggggtttcaggagctgtaaacattcacccctagacactgctgtggggctccaacagccctgtctgtatgctcccctagagcagccgggcactaaagaagtgagccacgcccccatgacatgccctgggaggaggacaaggaaacttcctgtttcaatacctggttataaatattgctggagaccataataaagagatggatcatagaggaaagatcatgtgaaaaaagggtgagtgtacaattttagggtaaaatagaaatacgttattaatgaagcaggaggtgggtgttttaattttggtccaagttttcagttaaaactttttgcttataaaaataatatctcccaaaagcataagtgggttcttgcatgaacagagaagaaaacaaagatttacattcctataaattacagacaacctgaaatatggccctcgagctaccaaatttactaaagcacactggcagtcattaaaattgcagaacattttacttcagtggtacaaccacaggggcctctggggaaaggctgggcattttactcaccaaaacaactcattggaactaaaggcatttaaaattactccactcaggctgggcgcggtggctcactctcaatcccagcactttgggaggccgaggcaggtggatcgcctgagatcaggagtttgagatcagcctggccaacatggtgaaaccctgtctttactaaaaatacaaaaattagctgggcgtggtggtggatgcctgtaattccagctactcgggaggttgaggcaggagaatcgcttgaacccaggaggcggaggttgcagtgaactgagatcgcgccattgtattccagcttgggcgacagagcgagactccatctcaaaaaaataaataaataaaataaaataattccactcagcaagattttgttgttggatacttccttttgttccaattcaaatacagtgcatgacattggaattgcaaattgctcccattatacctacctgaaatgaaaaaactcaagagatttgaccaagaaatatgaacacctttacatcaacagagtaaatgggagaagactgttcatatcatttatttggaaacgttaaggttggaaccacaatctaacatttgacagaaaaaaattatatcagagatctgtaataaaaaatacagcatatacccctttaagagtaggcaaaaagagaaaatagctggagtatccaacaggagatattttgaggcaaaaaatttaaaatagacatttgcaaagatgatgattagggaagatggttttcttctaaagacacatgcagtgaagaaagaaatctttattcttatctgggttgcaaatggcactttttgcaaaagaactgctacttacttctagagtcagctaaaatgatatcaaacttttttaaagatgccttcttaaggcagaaagtgtcttaatttagttttaagatattttaggcttattaacctcaatagtgaacttgaagattttccattaaatccactgtccatcagcctattatagacatattacaattctcctcccaacatcttgccttctttatgaagttgacgcgaagctgaaaataattctgtcaaataagacaaaaaaaattaacaaaccacaaaattctatttcatgtcattcatcaaatgctatcaatacactctgtgccaagcactgggttagaagagaacaatgatattatttgtcatttattttaactttatctaattcattttttataaatgcacgagtaagtatcttttagacatgaaatgtaatatgtggatagtatgtatattttgaaggaatataacagtttaatgctattttcacaaatgattattttatgctttaaagaagtttttggtaagtgaatgtggaaatcctgaaataaagtcaaatgatatgatttgcattttcccagcagcctctaaggaagcagcctgagggatcagcctgaggaaataccctgagggatcagccttgaggaatcaggtgaggcatcagcctgaggaaataccctgagggatcagcctgagggatcagcctgaggaaataccctgagggatcaacctgaggaagcagcctgagggatcagcctaaggaaacaccctgagggatcagccttgaggaagcagcctgaggaatcagcctgaaggatcagcctgagggatcagcctgaggaagcagcctgaggaagcagcctgagggattggcctgaggatgcagcctgagggatcagccttgaggaagcagcctgaggaagcagcctgagggatcagccttgaggaagcagcctgaggaagcagcctgaggaaggagcctgaggaagcagcctgagggatcagcctgaggaatcagcctgagggaccagcctgagggatcagcctgagggatcagcctgagggaccagcctgagggatcagcctgaggaatcagcctgagggaccagcctgagggatcagcctgaggaatctggctgcagggaaaatagaagtcctatcattggactttatctcaccttctctcaccatgttctgtattgcccataatctgttttttgatataatttcaagatactgtccctgaaactctgcaatggggggcttaaggaatgtgatagcttgacaaaggtttggaggagggtttccaggataccctgtagtgctctttcaactccaggtcttaaacagggccacattccctgcaaggcccggcacagaccccatgctgaatacatagaagctgcttattgccttgttgccccatcaccatttttttttctgttctgcctccttcttggggccattgaaggttcctcagcattgggctccaaatcccttctctgtccttcccacccacttctgtgctaagtcccagaacctggtattgtcctttcccctagatgatgagtctctgagcctgcagactgtctggatcactttctgggggccaagcacagtgtctgctaagaaggcgatccctgagacttttattttattatctaaataaaaggtgaaagaatctgtccaaaatagttgctttaggaattgtactccttataaagcaaagaacacactgtcacagaattgattttatcatagtcatgaaatctatgttagaagaaaacagccctttttctcagccaggcagagactttgaagagttaacttttactgtatcacagtggcctacttaatgctatacaagaacacagaatacatgctgtatttacaaacttcaaaggaaactagctatttgcatttttatctgtaggagaggagagaaacatgtttcctttttgaccttttatcctcaagttatatatgaggaagattaaatttgtcagtattgtcagtgtaatctatttagggttttaaaccataacagtggaaaatatcaagattgactttaaagcctactgaatataacttttttaaaaaaaagctggatgagacgctgaaatggagagaaagccttagttatgggaggccggattggaagtttttcaaaataagcatcagaaataatgggccccctattgctcacatgcagacatcaatcttttgtttgtcctggcaaggtgagaaaaaaaattgggttaccatcaaagccaggtaatacggcccgctcatttgtaaatcacatggctttagtaagcaaagatgcttcctagatttaatgaatgtggtatcagaatgttttctttgaatgagtacagtggtcttctatccggttttcttccttccatatatctgtctctttgaatgacaccaagtggattaatcttcctaaagccccagttgggaaaattatcattctgccttctcccaagctttcaaccattcccactatatgccaaataagctcgttatgttgcattcaaagccttctaggacttaacagtaacctatctttctttttatctcaaatttctctcccaggtacaccaagttgcagctaaaccaaactgtggtttgttgcctgtttctggatctttgctcattcttcaccatcactgataatgttctctctaccccctacctttcaaaatcccacctgcacttcgagattcagttcagctcacagatccatcttgaagctagacatgacagtttccctcttttgcagtagcagagaaatatgtttgtactcacaatatgtgtcacaccctagattttaaagctcccgaaatggatgagccttcttttactatttttatatctcccactgtcctgccaaggacgaagaaatattttttatatttctatatattattcctactataaattccttagggtgatgagaacttccttagggtaaacacctagtttttggtattatacttatcccttacagtatttagaatttatttagtaaatgcttaataaatattttttaactaaatgagtagaaaccgtagaatgagtagaaaattttttcctaaaactacaagtaggaattttgtctatctcagagacagcagaatatgcttagtatttcaataaaggacagttttttagaataaatagcgtactttggaagcctgaaatagctggaaaagatgaagtttcttatttattatgcctctggatgtgtttttaatttatttccctagaagagctcttaggcaaagtgataacttggcttagaatctttaggagaaataaagatgaaaataaatacggttctttaccaaattgcatgcacatcacacacacacacacacacacacacacactctctctctctctctctctctctctctctctctctcaatacaaaagagacagcgctaaccctgtcttgaatccatagaatcctcaaatgcatgcatttcagagtattgatggtgacactgataaaacattcagaaaatgacttattctgaatctgctgaaggggtgtcctcacagtgaatgccttcctttccttctgagatccaccaaaaaacatactagtctgttcagagtgatcttagaattcagttatttttatggcttggaaaatctactcctggaaatctgttctttagaaatactggcaaggctgtaaagatacatgtacactgctgttaatcccaacatttggagaaggaaaaaaagtaagcgatctcaatgtctactaatagagcaaagctaaataaattacagtacaatggaatgtatactctgcagccgttgtgataaatcaagtatgtccataggggtccttggttaaaaggctgtccatgatgttttattaaatgtaaaaagcgcgttgcaaaagatggggaaatacccaaattgctgaacacttctgtagatctcatttttctaagagtaatattctatgtatctatgcacttatatttatagacaggcatacatatgtataaatttgagtacatatgttgatgtctgcaagtgcttatacatctgtttatgtgtagatgtatgtataaatgtttatacgtgttatatgtaaaatatataagctatatatatatgcatgtacatacctttatagatatttttacagccatagataaaaagatgtagaaagattcagaacaatttagaataattatctcttttattggcttaaaggagggaaaagtgaacttttattcacttaatagaaaaaaagaaaaaagtagcagaagttcaaaactgtggtgtttaatttgggggcctgttctgattcatgaatcagatttgaaatatacttgaagccttttcttaaaaatggtcattcttctgacttgatctgcagactttattgattccaaatggttcacaatgaggctgtgttctgtcatcttttacagcaattgttcctactttcatgtatctgcctgtgactacaggaggcagcggcttccccagaccactcacctccctccttcacacctgcctggcccgagtcccacagtgatacctgtcatggaactacatcttgtattcatgtgttaaacagagctctgtagttgattcgcaagaaagaaagttcctttcagtgaaacagagttgtagcataattgttgttttaaaacggtatttttcacatcaaaagatgatttaatgtagaattattttttaaatgagctgccttcatagatttaaaatatactttaacaaatatttgacttactctcacatacttgacattacctaatatgtaccttgtacaccttttttatggattagagtttgaaaccaaaccagaggcaccttctgttatgccatcctctgaaagcatatttcaggctgagaatatctattttgcattttcttattatgtatcttgagatgcaatttctttcttttcttcttcttcttcttttttttgagacagagtcttgctctgttgcccaggctggagtgcaatggtgtgatcttggctcactgcaacctccacctcccaggttcaagcgcttctcctgcctcagcctcccaagtagctgggattacaggcacgtgccatcatgcctgactaatttctgtattttttagtagagaggggatttcaccatgttggccaggctggtcttgaactcctgacctcaggtgatcctcccacctcagcctcccaaagtgctgggattacaggcatgagccaccgcgcccggttgagatgcaatttctataacagccctcaccaactattttaggtcttcctgctggactcatttgctcatttattcagcagatagttactgaatacctacctgcttcctgccactcacttttgttaagtgctggggatacagatgtgaatacagtgaacatagttcaagtctactgaggcaggcaacaaactttcatcctacagtctcctaaataaaggtagactagcacattgcattatgacacatgaaagaagagtaaagaaggaggtgagagttgtcacaggctgcaagaatcaggacaaggaactgttctctgtggaaaatcagataaacagagacctgagacctggacaggagtcagctgcatgaaaaaatgcagacaatttctctggccatgagacatgcgaaggccttgagatacagaaagatttggaacttgcttaggaatgggaataaggcccatgtgtttggagggcaagaggggacccagacacagagccgtgtcagtaagggcacatctgagtaaggctttcaagaagctggcatttcaacacagatccttctggcagtcagtgtgcatttaccaaatgggcctgccattatccgtacatgttctcatgtagtataaaaagtcgcaggaagctttttgggaacttgccccagaatttccacaaaagcagagctctctgatttctacggggaggcagagaggctggagggaagtggaccagtgagaagtggactgcagggctgcagggaagcctgatcaacacgtgggctccaggctgctggatgaacagagcctggggtggacttcagcggggtagttccatgcaggacatgatccacacaacgctatgaagtcctgttccctgcccagagccaccagaagtatcttcctaaagcataaactggtcactctgttctcctgacttaaaaactccaggctgggagtggtggctcacgccagtaatcccagcactttgggaggccgaggcgggtggatcacctgaggtcagagttcgagaccagcctggccaacatggtgaaaccccatctctactaaaaacacaaaaattagccgggcattgtggcaggcgcctgtagtcccagctactcgggaggctgtggcaggagaatcccttgaacccaggaggtggaggttgcggtgagccgagtttgcgccactgcactccagcctgggcaacagagcaagactctgtcttaaaaacaaacaaacaaacaaacactccaatgactccctgatgactaagtgatagagttataactccttgaaggacacaggaggccctctgcaagtggatcccccaaattctttgtctacttttacttccctgagatataactacagcttacttcctaccccatatgggccaagacagagcactctctgtgattcagcacatgggattcctcttccagggatgactaaccacctcctctgcatggtaacctactgctgataccacaagacagcctgctgcctctgtcctcctgattccacagcttttggagggcagcacacggcactggggagaacagcgggcatgcccctggctgtccaggtcagctcaatttaactggtggtcagtggcttacagatattggtaccagctatccctaacagctaaactctttgcaaagcatctcctcatggggcaaagtaaaaggaaggtgggagattgggaaacagttacaggtaactaaaacagcatgtgccaaggtcctgtgctgttttgctcaatgaactggagaaagaccagtgtctggaatgcagtgtgaagtaagaagaagccaacagtggcaggctctgattaaggttttaagaagtgcaactatcttttgcttttacaaaatattagtggaatggtgactgatggacatccccgtgaaatggcagcagacaacacagaaaacatgaatggacccaaccatatgttaaattggttctatctttggccgggtgtggtggcttatgcctgtaatcccagcactttgggaggccgaggtgggcagatctcctgaggtcaggagttcaagaccagcctggccaataagacgaaatcctgtctctacaaaaaatacaaaaattagccaggcgtggtggtaagcacctgtatcccagctacttgggaggctgaggcaggagactcacttgaacctgggaggcagatgtttaagtgaagccgagattgcgccactgcactccagcctgggcggcagagtgagactcagtctcaaaaaaagtggttctctctttgcaatagcaaagagaaagaaaacaaatggttacaaaaccaaaatacagtaggggacactgataaaattcaatttagcaaattcttcctggcctgtgaacttgctaagggtatggcgttgtagggactgtgaaagatgaatgggacctacagactggtttatcaggtatgagggaaacatttaaatatttacacaaaatgcaatggggtttcaatataaaagaaggttcagaaggcatcacagaacacgtgaaaattgtactgcgtcttcgagagttgtaaaagcctcaggcgaagggctagaagagggagtttcaggagaaggaagggcagcagagtgaagacactgaaacaagaatcggaatggctgccctattccaggggcattgagccatgtccctagagcaaaacgtgtctttttagaaagaaagaaaatcatcaataaattataatttttttttacatgtcaaagaggaaaggtacgggtgttaagtaatcagtctaaaaaaagttttggggcaatttcaatatttgttcataagaattcatgagtagggtttttacgttactattactttaagttgctgtaggcagaatttagcttgaaggaaatttaagatttcttgataattaaaatacgaaacagtatggcaagacaggctggggaactccaagtctgccttaattagatgctaaaaatagatgtttctaaaagtcctgtttcctttctaggccatccaacattctggagaagtgcttttaatctcagcaatgtgctaattgtttctaatggcctgtaaacaagctccctgaactattaaccttcttctctctttagccagagattcaggaaattagtctttgaaagaagagtctccagcaggttgcccaggagggtgtcccaaagtacagacactgtcactggtttggaggaaaatcaaggtcagatctgagcagcaagcttgtaatgtggaatagacaagctcaaaaccttaaaaagaaagatcactccactcctctctggtttagtttggttgtgttcctatctggaaggagaaatataaatgttaggctgggcacagtggctcacgcctgttatcccagcacttcgggaggccgaggcgggcagatcatttgaggtcaggagttggagaccagcctggccaatgtggtaaaaccccgcctctactaaaaatacaaaaagttaccttagctaggcatggtgacgggcccctgtaatcccagctgctcgggaggctgaggcaggagaattgcttgaacccagaaggcggagattacagtgagccaagatcgagccactgccagcctgggcaacagagcaagactccatcttaaaaaaaaaaaaaagaaaggaagaaggaaatgtaaatgttggcacctctccaatggcttccaaacacaaacacaagcccataatcccaggatttttaaaaaacattaaaacaatatccttcagttgacaagaatgttgaaaatttgattgtgctaagttaaaattgatgccatattgaaaatggcgttcaatttaatctcagaaaggcaatgcctacctgaaccctcggaaaggagctggggcattgagggtgccaccctctgttctgcttgtccttttcagaacatgacaaaattaacttaatttgtcatgaaagatgaatgatcacagagtagccaaaaaatgttgtgaaaaagatggtcagtgaagagaggctttatcaaacatatttcaaactttatttaaaattacaatagtcggccaggcgccgtggctcatgcctgtaatcccagcactttgggaagccaaggtgggcagatcatttgagctcaggagttcgagaccagcctggccaacatggcaaaaccccatctctaccaaaaatacaaaaaattagctggggatggtggcgcacatctgtggtttcagccagttgggaggctgaggcaggaggatcacctgcacccaggaggcagaggctgcagtgagctgagattgcatcattatactcaagactgggtgacagtgagactccatctcaaaaaataaatacatacataacataaataaaattacagtagtaaaactatgtgcctggcacagaatgagcaatggaacagaagtaaaagcctggaggggagaacccaagagagacagatatttatgtgtgatctcagcttataaaacctttccaattagtgaggtattagatgatttgctaaatggtattagaataatcaacataataaataataataaaagttggatctttttagcattcctcaattgaggtaatcaggaggatcaaagaatcacatgtataaaacaatgaaagggtaaaagtaggatgacgacgtgagtcaatcaagttaatagcccaagaggggccaagacatgcccacgtgagcagagaaaccaaaatccactgatcattgactacacacaaatgtaataattgatatggaaagacactctaaacagagtaaacatatggaaaagtgctagcattcctgacatctgaagaaatctcctgaatttatttatttatttatttagatggagtcttgctctgttgcccacgctggagtgcagtggtgtgatctcagctcactgcaacctccacctcccgggttcaagtgattttcctgcctcggcctgccaagtagctaggaccacaggtgtgtgccaccatgcccagctaattttttaattttaataaagacggggtttcaccatgatggccaggctgattttgaactcctgacctgggtgatccacctgcctcggcctcccaaaatgttgggattacaggcgtgagccactgtgcctggcccaaatttatttatttattttttaagacaaatatccaataggaaatttagggtggggggatggcaggtcaaaagaagtaattcacagaaggataaatacaaacagccaggtttaccgggaaatcacactcagtgtcaggggagcagctagccagcaaatggcccaacagctagcagcacaaccacgtccctgaacacctgccggatgccagccctgcaggtactgctgcaaagaggtgcccagataggataggtagaaacaagtgacacacacaagtcagagggcagcatgtgtgacagggtctcatcactacagcattctacacacacatgtacattccgaacacatcagcaggaagactgggcatcagagttacaagacaggtgtgagctagcacgacgcaccctgaatttcagatccatgaataagccctttcctacttataatcagtggtactgaggcagaatggggcgcacctaggaatacacactttagtacaaaacctgggcttgagaccctactgtaacttattgactatgtgacattgaattacattccaagcctcttcccacataagtcttggtgacttacgtgaggactgggacactaatagtatctacctcccaatgttattctgagcatttaaggaggccctgcatgtaaacacagttagcacgcactaagtttgggcaggaagagatttttcacagttgggtaaggcttccagcagatgcgacttggttgataggaatctcagccgtgtagctgaaacgtagcttctataatacatcgaagcgaagcacttagaggcatatggcttctgtgaatgtgctgcagcgctgagcagtatcttcttcatcagttccactaaagactggaaactcattataatcctggcaagactgaggtttagccaagaatgttctaataccacagaagctctgtatgccacatcactgatgccgccacagtgagacagaattcgaagtacagccagatgcttttagtaaggttctctttggcctgaccttttttccactccattcgccttgctttctgtgggaataattctctcaacttaaaattaccaaatagcattaaaaattctgcaatatttctgaaatcatattgacacataatggaggatttttcagaataaaattagatgactcttgtaattgttttattaaggaactgcaaacttgtttccattcttcctgaaattaagtattcatttccactgtaaggcaagaaaaaccagctaacattatacagtcaaagggtgacacctattaaacctgatcgaggtttttggaatttatttaaaatacagaactaaattacagtttgttggttctggaaaatgactttcagaattgctttatctctgtacaaccagactcagcctctccttcacagtgcaggcctcctaatcactgcctgtttaccatgaagcatgttttccagtattggctcagccagtttttcttccttcctttatcaaaatccaatggaaaagagccagccccatggctcaatgtgaaaggccaggagttcacatgcacaatcttaaatttggaactaaatgtatttctcttcagaccatgaaacaatggagaggaacaggagagtttggaatgtacatggtttaagcagtctcggaggaagtcatcgtcctgtctcacaaaatcattcctgggtcagccccacctcttcttccacctagagcaggctttcctgacctcagcatcattgaaagttgggcaagataaccctttgctgtggggctgactcgtgctttgtaagatgctcaacagcagccctggcatcaacacaccggatgccaggagcaccacccttcattggtgacaaataaaatgtctccagacattgccaaaggtccccattgggaaaaaactaccccggatgaaagccactaacttacagctatttaagggtattattatatctagattcttgcctcatgtcatattatcaaaaaagaaaacagagttacagagaatatttactaaattttacattatcataattatattcataaaaattacataattggccttaaaaacattattgttttcataggaaaaaaaatttcaattcaactcgccaaagaagggtttgtattaaaatttccttggaggccgggcacagtggctcacgcctgtgatccctgcactttgggagaccgaggtgggcggatcacctgaggtcaggagtttgagaccagcctgatgaatatggtgaaaccctgtctctactaaaaatacaaaattagccaggcatggtggcgaatgcctgtaatcccagctacttgggaggctgaggcaggagaatcgcttgaactggagaggtggaggttgcagtgagccaagatcacaccattgcactccagcctgggcaaaaagagctaaactctatctcaaaaaataaaaataaataaataaaatttccttggacagatgatatctgggatgtgaaagcatgcgtgccagtcacagtaaagattatatactctttcattatgcttcatagaaccatggctgtggtaagtttggagaacaaagtacagataagtcaagacctgttggttcaagtaaagacttacctacaatatccccctttcagttagcaagtcagggccaaaatcttggctaatatttactgtccatatgtgatcagcactgttcaagttttatctcttgtaattttcacaaccttttgaagaagttgagagactggggaacttgcccaggaaacaagacaactagaggtagaactgggttttgaacacaacattctttctccagggcctgtgctcttgattccagcctgttccatggaaaatgttcaccaaaggctaactcagcgggtgtccttgagcaccactgagccattcaagggcaaatcaatctatgctcagaaacaaatggaaatgaagactggaaaacaagaaaatcagatatggtgagaaactgggggaggagagaaaagtctgtgccttctgccagtctcagtgcaaaatcagtatggcataaaatagcacaaatggacaagaagcaagtgagagagtacagtgctctctcaggaaagcattccactgtatttatggaaaaataaactctctcaattaagccaaattttcaagataaaaggatagttccatccatctataatttagtaagggatacaacaataaatgttctgaaatttattctttaatttcctgaattaaaatctctctccatatggactaggagttgcaaaaacatatacatatatatgcaattatatatataattccagaaaaccagattagagttgaacagtgacacctatgtaaaaaccaatgtgtgtgatggagtcatcctatttcgtgcattttagcattttcctaggatactgttctatataaattctgtaatagagttatatataatataattactgtagctattagtgatttgaaaggccactttcttggaaaatttcaacttagtgttgtcaccggcattcctggtcattttctttgtgcatcctgtacacgtgtgcaggtgtactggactctgtggtcatgggaacctccgagtcttcagacacccgctggaagaccagccatcatcactcaagtctgcagccagctgcccaatacagaatggagtgagatggcaccttccttactgtcatacgtgtaaagtcttgcagtaggagaggatctgagagggagcagcaattccaggggaaactgttcattgataataacatctgaatgacatttgacagtttcctaagcactgtcacgtgaatgttgtttctgaactatcaccacaaccttgatactccttttaagtaggtaccatcaacatcatatgacagagaggtagctgagggtaagggtaaatgactagttcaagtttatatggcaagcaatcaactgcagatgcaaatccatgtctgtttttatttttttgttgttcttgttgttttttttttgtttgtttgtttgtttgtttttttgagccagagtctcactctgtcatcaggctgaagtgcagtggcacaatgttggctaactgcaacctccacctcctgcgttcaagcgatcctcctgcctcagcctccctagtagctgggattacaagtgtgcgccaccacgctcagctaatttctgtatttttagtagagacgaggtttcaccatgttggccaagatggtctcaatctcctgaccttgtgatccacccgcctcggcctcccaaaatgctgggattacaggcgtgagtcaccgcgcccagcccatgtcttctcttgattttgtttgctttctgttccaccatgccatgtttctgacagtatcgctagacaccactccagaccaccagcaaagaaagcagagggcttgcgctcagggggcaggtcctgaggagtctcctgaagtcctcccgtgcaggtcaaggctttcattaactacgcggatcaatttaaccatctctcttgtagaggagtactttaaaacctagtcaatgagtgctaatcacagaaatcatttcagattaatcttagaaataatcattaaataaatgtaataccctttaaaaaggggcataaaaacagattcaagttaagaaagtctagttgacaacaaaatgcaattccacatcccagaagcttactgaattgcattaagcttaggatgctaatattggatgtcatgtctctatatggttaaaatgcacaaagagataaagacgcttgcatttattttaaaaacttattataatacttgggtaatttatcagtgacgttgtttatttgtactgtggttaaatttttagcgcaataattgtatttcttaaaagacacgctaaattgttcctctcttcttatgcctgggaaaccatatgaagattcagtaggaaactaaattttgaagtttattccctaacttttctttaagatacattttgactatttgaatgttttatgttgttgctatttttaagggaatcatttatatcagatataatgagagaaatttaaagtaatttctacatcaaatcaatattatggtatttgtaaaaaataataataataattaaaactctgttttttctttgcagttgttttcattgtaatatgatacctgaattttatgtaagaatgtgagagtgggccaggtgcagtggctcacacctgtaatctcagcaatttgggaggccaagacaggtggatcacctgaggtcaggagtttcagaccagcctggccaacatggcaaaaccccatctctactaaaaatacaaaaaattagctgggcgtggtggtgggtatctgtaatcccagctacttgggaggctgaggcagaagaattgcttgcacccaggaggtggaggttgcagtgagctgagatcatgccattgacctctgaactgggcaacaagagtgaaactccatctcaaaaaaaaaaaaatgagagagaaaaaagaaaagaatgtgagagtggttagtttataatatagttaacatagttgaatctgactgttttttgctttcaaaacatgtattattccactaagtggtatcagttccctttgcattacagcagtcactggaataagttaaatattgttatttttgttatttcttgtccaaaaaatacacactgtacactttctcttctaatactgtcctaaacaacttttcgcaggattcactggttattctcctgcctgttgcccaagggctgtagaagatacagagagaagtaccacccagatcccgtttcaaataagtatttgctgctcagatgtgaggcgtgtggccagggatggcctctgctgtcagcatcggcacctgtccctggcagccgcaccgagaggctgagcgagctggggatctagcggttttccctttgcaggcctcggttccgacggataagataaactcacaccaacttctgcctcaatttctgcctctggagaagtccgcccataacagtctcctgccacagcctctgcagcagccacatataagaggttaaactctactaacatttccaaagcaatccttttagagaagtcttatctttcccaaatacttttctgtcaccaatgcccaatttcttccaaaactacttcttatacaattacgtgtccacactattcctcccattaatattaaaatatatttgcttgtagcaacatggtccctcctaactcaaaatatttcctctgaggtgatactcagggttagatactcccaaatgaataaatgcctcgtttctaaaaataactatttatgacatatatttcccgagaacaggattattaataatcataagtgatttagatttgtgtacagatctaaaattttcaaagtgtgttcacagaaattaacttatttgatcctaccaccacctcaggaattaaccaaatttaggaaattaaagtcacagtgattgatctgcccccagtcagacaatgaaatcggtggtgggttcaggagggaaagctgttcttatgacctccatcctggagtcatctgctttctgtgttacaacctgcacacctacagaccttctgcaaagtagaatgtgctccctgggggattggggtatatgatcctaaactccagggcttcagaatctgtaacttggatgttgccatttgaagctgaaatggaaagggagggctgtgctaacttggctccccgctttggtgccaccacactggaaaaaaaacatggttccaagtgcttactgcatggactcacttcatccttacaataactgcaagaacaagaagatgctcttattatctagaaggacagaggcaaaagatggcagagccaggttctgtacacacagtctggcttcaaaggcagggctctgaaccactgtgcttcatgtgtatcttgggaattggaaagacggctggagacaaacgcaaaagacatccaaatcttagcagtgagtaaagaatgaaaatgaaagggaaggcagaagcagaaacttctttagctgttggggataaatcacgcgataagaatttaagaattcaggggatgatttaagatcacctacatagtcacacatgtctataaataactcttggattaatggtctatgtatacttccatatttataagaataatgcaaatcagaagagccttcaccagacgaggccatttgaaagagatgggttttaagcaaactgggaaggtgatgtggagtgacgattagttactattagcaaaagggtcagtgctgcaatgatgtaggactgcagcttgctggggacagaaagtcaatctgtcttgctttgttagaacaagaaatgaaagtcagtctgtggatttaagaacagcaataccaactcctcacctacatggtagacagcttgcttttccaattgcagtttaggaacaaagggaaggagaattcactttgtcacagaattttcactaatgaatatagacaccaatgcaggaatatgtgttatatttgtgtgtaaccctaatcactattacctatgctacctctcctgaaccccagtggctgtggcactgtaaaatgggtataaataacattcaaaatgttaagataaacatacatgcaaaatatctaacaaatggtaagaacaacttgttagcaatagttggaccttctccagccttgtggaatatatactgatgtcacattatcctgacgtacacatgtgtctggactgagcgcacaagaaaacagtcctgtgcagtctggaacaccacaaagtcacttttgttccggctcagagaaggaatctaatgtggagacctgcaatgatagcaacaggtgttcaagtttgactttgtggtcacggtctggtcatttccagggtaatatgcaaggaggaggtacttcagcagaaacggaagctacgtgggatggcttggggttaggcaggtaatgtacgtatctagccggttgggtgtaaaagaaaagggagtgggaaaactggtgcatgctctgctcaaacacatagcaaatgattctatgtatttcttcaaagttctgtcttggccaagtattataaaagaatcttggggaaaacttagcctaaagaaataaagtttgggtccctgttctaccacgatacagtgaaaatgaacaagaggtgttcacaccttctgccttgcttgaactagcccggttccgtcacaccttcacctgctagagagtgtccccgtcgacggctttccctgccatcgacagaaatgcatcaggcttgatcagaaacgcaaggttttatctcagcttgaagcacctggaatagtttcttgagccacggatgaactcagtaaatatctgttgaatgaacagactaatctccttttaccttatctttgatggtagaagaggtattaaagatctcaaatgcctgcatgagactgcgttgcctgtgatactgatataatagaatgctggtatatctgtgtagcccagtgcctctcagtgttgtgaaaatccacatcgagatctagaaactcttgaaattccacttccggtgcacagaagatacagcacatgaggtcatgtttcctgtgatgcagaatgtgtcaaattcacaaggaacagaatgaacacaccacggcccttgctgcgataaatgaatttgcactccgggtgtctgaaactattgcttattttgtcacaaatagctctacaggctttgaaagctacaaaggacaactttgcaaatacttaattctaaatgtcatgagaaaatagagctacataaaggatgtttatagagggcaaggtagatcatattagtgctaatcactaaaaagtgtcccagcagtttaaaatttctatctgaagatatgaactggcacaaacattatttgcaatgaaaagtaacttcttcccctcacctagtttatagcaaattgctaattataaggataaaattgccattagaaataaatgcacaagtaatgcaatagttttctttaaaaaaaaaagttatttaaacactgtgggtatttctttcagatgaaaatggaccttaaacacaaagcttaactgttaacaaagttctagcaagggtctcttagatgcttcaggaatgtagcaccttttttttttttttttttgagacggagtctcgctctgtcatccaggctggcagtggcacaatctcggctcactgcaacctccacctcccaggttcaagtgattctcctaactcagcctcctgagtagctgggattacaggtgcacaccaccatgcctggctaatttttgtatttttagtagagacgggggtttgccatgtttgtcaggctggtcttgaactcctgacctcgtgatccacctgcttcggcctcccaaagtgctgggattacaggcatgagccacctcacccggccgctccatctttcttaatatccaccaacaggccaggcatggtggctcacacctgtaatcccagcaatttgggaggctgaggccggtggatcacctgaggtcaggagttcgagacaagactggccaacatggcgaaaccccgtctctactaaaaatataaacttagtgggcatggtggcatatgcctttaatcccagctactcaggaggctgaggcaggagaatcgcttgaacccaggaggcggaagttgcagtgagccaagattgagccattgcaccccagcctgggtgacaagagcgaaattccaaactctgtctcaaaacaaaaacaaacaaacaaacaaacaaaaaacacccaccaacagaaaatgaagtgcttaagatccagacagttacaacacgcaaggttgaccctaacggatacaaaattggtccaggatttgcaatattgccctgctcttcccagcgggggttgctgcgcacctgcggtgacagttaaatgaaaaggtaaggcataagaatttcatgcacaagcacctgtgacatctctaggaagctctgctgacgcagctgctcacatctgaagcccacaggttcaccacgggagaaatgaaggtcactggctgacattaaaactgaatggttcacatttcaaagtaccagtggggataaaatatttcttctatgctttcgtaagtaactgaccccagataatatggcagcataatctatatcctgtgacttggacttcaaaattggacatttccccttatttctaacacctccttaaaaatctccattgatttctgactaattcattgttttatctgagttaaataattaactcaattagtctattaaattcagaagggatttttaaaaggagattgtttcatgtgaaaatagtttgctttctgtttgttgcactgcatgaaacagattttcctttaagtcagcatttatttaaacctctttgatgcaaagtcttgtgctggccacggtagggaggaccagtcacactggcatgtcagtcaatttgggtcttgccctgcaagcagcctgcaattttgcagagcagcagacttggaggcagctctgtatttttctactcttactggtttttaaagacagacacacaggacaacagcgagttcaactttttcttttctctgaatctcactttactgctacattctccttttcacatgcaaatccaccttccggcctcaccagatagccttgcttttcgctgtacagagaaagccaggaccatgcaggttggagggtaaggtgtaatgaaagaatagcaatgcaagccatgtagactttggtttgtagattggtttaaccacttccttgtggtgtgatcagatgtaatttttttaatgtgatagattcaatttcttcatttataagatggaagccctaattattttaaatcaatgtagctaaaaaattacaggtcattaagcactgcatctgaatctcaaagggagcatggtgatcacctgttattgaaggctttatgcaaagattctttctggaagggtttatagcagctctccctcaagactggattagatgagggtgtgtcacacttttcagaaaagaatcactcctggcataaggagatagaatttactcctatggggcctggggcacagtgtgaagtagcctgcttcaagctagaagatatatctttgaagttttctctttcatcttaaaaagttgtaagattttccattcgactctagaacatacccttgtttattataatataaacatatttgggtctactgggagaaatatatagctctgtgtgcacaaacactggtgctacaacacataaaaatcttccaacaatttccatgacagaaagaaaaccacttactgtgaaaggctatgttaaagattccagtttaactttttgtacgtatacctgagtttctcaccatgctcctcagagtctgatgactggataaactatcagatcccatctgatccctaaattttaagaaaatcttaagttgatggaaagtagctattggtaatgtcaaaaatcagactgacaaagaacttacacagtaattctaagtcacaacagaatgccagctatagccagaattaatatgtgaattgacaaaagaagcttaagacataacaaatgcattcaaagggaattgtaactaagatctccattccctatctctctttgttcaatgaatgaatgaaagcataccaaaatccagtcaaattatctttaagtcattctcccccaggaacacctggagaaagtacaaatggactttgagataaatctttgctaatccccaggcccaagtaaatcttttaagtctgcaatccattgtggcattgcttcaataagccgaatgaattttattttaggacaaatttgaaggcaattatgaaaccatttatatcaaacaacaatgacatcaaaaacataagtctttattggaagggttgagggaaataacatggtagaacagatttttaaatttaatgcccaacagggacctgggttttcaaacatgtgtctcgaaggttaatttccgactaagcaaatcgggctatttttcggtctgcttcagctttggaaactaaggaataatgattaaaggtgagataacatacagagattcactagctgccttctatcgatgaaaagagtcaaactctgtaaaatatttaaagagatttattttgagccaaatatgagtgacaatggtccatgacacagccctcaggaggtcctgagaacatacccaaggtggctggggcacagcttggttttatacatgttaaggaggcatgagacatcaatcaaacacatttaagaaatacattagtttggtcgagaaaggtgggacaactcaaagctgggggcttccagcctataggtaaatttaaacacttccctggttgacatttggttgagtttgtctaaagacctgggagggatagaaagggaatgttcaggttaagacaaaagactgtggagaccaaggttcttctgaggtcttataatggctacccttagagacaatagaggacaaatgtctcctattcagatctttaaaaagtgctagatttttagttaatctctttaggattgggagggcctggaagaaaaatatctagctatgttatctagatagaaaaatatctagctagctataaacagatgcaaattttcccccacaaaggacagctttgtagggccatttcaagatacagcaaagaaacatgttttgggctaaaatattttgtttttcttccttgtctcataatgttatcccgaagtcagtttggaaagtagtcacaataaatagggttaaataaaacctatctgatgagaatatacgaattgtagggcatgactccccagactccttagatagaaatttgggtatgataaaaaaaatcagagtttagtcctcaatatcttgataaggatttttctattttgtatgttttcaatttttaccctttaaaaaatttagaaaactggcactgtaaagggagattgaaggagcagaaatatcaatttcgtttgggagacactgacagagggtgagccccaagacacacatgctggctagggaaagaattccggtatccctttggcttacctgtgccatttttatatgacttaggcacccaaaaaagtcctgaaccttctgttgtaacttctattggaaagactaaacaaggcagctattttgccttcaagtgctagacttactgtgcttaatccagttcttgctttttgttcagcttgttatgcttatattcataaacctcaaactatcaactgacaaccctgaagggtgaagagcaagtcactactgttggtaaggagaggagaacacaaggcttgatggccagaagggaacctgcagcttcacaaaaaacctcaggacattctggttcccagatagttcactttttcccttaagaaagagtaaaatattttgtttgtttgtttgtttgttttgagacggagtctcgctttgttgcccaggctagagtgcagtggcacgatcttggctcaccacaacctctgcctcctggattcaagcgattctcctgcctcagcctcccaagtaggtgggactacaggtgcacaccaccactcccagctaatttttgtatttttagtagagatggggtttcactatgttggccaggctggtctcgaactcctgacctcgtgatctgcccacctcagcctcccaaggtgctgggattacaggcgtgagccactgcgcccggcctaagaaagagtaaaatattttatgtcaaatgtaaactcaaaggacacaaatcatgtacctgaattaaactgtaaacctaaaatctggccatgagtcacacatgtctcttatacatcggcctacatgttacaacatatatgtgatttggtaggcgcatcattgcagacttcatctttgatttctgcatttgtcaacagacagaactaaatacaagtatttttgcaactgtctcaatcaatttataagctatgaagaagtcttattcctccctcctgcagtccttagaaccagtcagagccttggagatgacctacttaaaatcctggattttacacggaaaccaaaggccaaagaaattgtggtattctcttaaggtcaaaaagttagctttgtggcattagagcacttgaattattattaaaaaggtaaatgaaagagttatcagtctcttactatatagaagtatatttgtaaagcacaaaaacataaaattcttactttcattagtactgacaaccgaaatgagtgactgaggcagaaggctccgtcatcaaggtctattattccagcttgagagcatgcctgggaaaaacccaagtcacagctacctttgtggctgctttttccctaagaggttctcaggagatttagcatttatgcattttccttaaaagggggaggcaatgagacatacttgtgatgattatatacttgtgagcctttagatagtgcccagtaaacctacattttacataagataaggtgaacatttaaagaaaatcagaatagaggaaacagctgtctcagggagggtgaaggactgatttatcttatcttgcctttattctgtacctgggaagatataagccagtgatggacattatcagtgtggggccttttttttcttttgagacacagtttcactctgtcacccaggctggagtgcagtggtgtgatcacgcctcagtgcaacttccgcctcccgggttcaagcgattatcctgcctcagcctcccgagtagctgggattacaggcgcgcgccaccatgcctggctaattttttttttttttttttttttgtattattagtagagatgggatttccccatgttggccatggctgctctcaaactcctggcctcaagtgatctgcacacctcagcctcccaaagtgctgggattacaggcgtgactcaccatgcccagcctcagtgtagagtcttttcgaaggcctggtttctgtttagcccttagggaaggaagcctagaggtggttagtgagggtggggacatgacaggcctgtctgacctcccaccccatcatggctggaactcagcttccaaggtgtctccacggtccccttgacaaggagggattctgttcagtcagttggaggcttacaattttatttttatttctcagtataaggagtacgcagaaactatatttacagataaattaatactatcctccgattttcatctattatgtggttaattatgtctaatttgattaatgatgtatgattaatacatatatatacacataagtaaaacaattataagaataaaaaatagatttaaaacacccttttatttttaagtctgtaattatgaatttgatttatctccaggaaaatataatattttaaaataaagaccaaagcaacatatttaaacataaattcaaaagacagtaaactgtatatttataaaggacaccgtgatattatgaatagtgaatgagaaagcaattgctgaaaccagatctgttttgtagactttttgtatagctttcatatggagaaagtttcacattgttctctcacaataaaaatgcaaataagccagtgagaaattcttgtattcataaataacaaaataataaaaaatctcctttatcaaataggcaaagacaaaaattatgctgaaagagaggcaggagggagccctctcaaacatgggaagccagatcagaactagagcagtgtttctggaaaggaaggtgacaatatggatcaagaacctcaaaaatgtccattaccgtggacctgcaatcactgttatgaccgtattcttagagccaaggcatgcagtcaatgatgtctgtaaaataatatggttttcagtcttatttgttttttttttttttttttaactgtgagtaaatgctcaaaagtggggaaatggttaaatagaactgagacagccaaggtacccaagggggtacccggagaaagtgaccagcctgtgcactgggagaaagggatggagccttgggaagttcatgctgtttggggtggggaggagcctggcctctcctgatctgggtagtacctgggatttcagctggtgaggtgggaaaacctgcctggtttctgtttagcccttaggaaaggaaacctagaggtggttagtgagggcgttggcataacaggcctgtctgacctctcaccccatcatggctggaactcagcttccaaggtgtctccacggtccccctgaccaggagggagtctgttcagtcagttggaggcttaatattttacttttattttccagtatgataaggagttcacagaaactatatttacagataaattaatactatactctgattttcatctattattttaatccatattcattttgccttatagattttcatctatattcatcttgctttgctgagagtccctgttaccctttttcttttcctttttgcccaataaattccatttttctcacccttcaaagagtctgcgggcctaatttttcatggttgtgtgacaaggactctgtttttagctgaactaaggagaaagtcctacaacagcatatccccacataacggaattttaggtacctatttttaaaaaactgttttcatggcagagaaaatttattatgattttcattttttatttttttgagacagggtctcactttgtcacccaggctggagtgcagtggcacaaacagctcaatgcagccttgacctcccaggctcaagccgttctcctgcctcagcctcccaggtagctgggactacaggtgcatgccatcatgcctggctaatttttatattttttgtagggacagggtcttgccatgttgcccaggctggtcttgaactcctgagctcaagcaatctgcctgcctggcctcccaaagttctgggattacaggcatgagctgccacgtgcatgcctggcacagagaaaatttatcataatgtcctgctaaatggaaaaagcatgatacgaaactatatatatatatatatatatacatacacacacaatataattatacagcacacacacactgcaaataggcataatcaagatattgcaaaaaaattaaccagaaattttactaagcatgagggtaaaaataacttctaacactttttttttttcttgagacggagtttcactattgtcaccctggctggagcgcagtggtacaatcttggctcactgcaacctccacctcccggattcgagtgattcttttgcctcagcctcccgagtagctgggactacaggcatgtgccactacgcctggctaatttttctatttttagtagaaacagggtttcaccatgttggccaggctggtctcgaacttctgacctcaggtgatccacctgcctcggcctcccaaagtggtgggattacaggcgtgagccaccgtgtctggccacttctaatgctttttatagtttattgtgaattatttctaaatttaaaaagaaagcattatcaggaaaaaccccacaatgatcaccaaactgcacggagtgtccgtgcaggcgctcataatgtccttacacgtggatccctcgaagtcagaagaaagagttcttctctctttcttacatatggggcacttggctgccttacacgagaagggaccttattcaatcaagtggttggttatatacacacacccttaagatgcatctggatatagtcgcttctatttataaattctcccaaaggcaatcatatgaacaaaattaatgtgacaatattatttttccagcaattatcaccctgtgtatctgggaagtaagtggctcattctcttcgaaagatgttgccagttattaatacgaaagtgacagcataacagcaggaaacggggagggcaacgctcttagtaagataataccatcatcaccacatattttaatgtcatgtttaccaaccttaatggaaagtttaaaatactggctgatgagctgttttctgacttacagaagagtattttgaatttttcctttgaaaaactgaacagtgacttaaattacctgctgctatcagcgcagtcaagccctcgcttttagcacttttcaatccctttcccgaaacaccagaatccccatcttagctgttcttcttgcatgttgaaagcgttagccatacacagtcattcaccttgccaagagaggctgaagcgctatattttaaaggcaatgttgtggtgcttcctgccacagcagtgactaaacatgcagcaaagagaaaatcacgtctcatttttattccttcttggaaacaggtttgttcaacagatgctgttaaggtttttgggcttctattaatcaacattttaattttaatttattagagaatagaaatagcctgataggagtgtgaatatttgcttatcacgaaatcacagagtttaaagcaactttaaaagaccatctaatacagttccaaaagccagagagagacaacacttaaaatgattagggtatatgactatttttgcttaaaagtctgaaacaatagattctttgactttattcattaattcattttggcatttcattaaaaagttctttctgggctgggtgcggcagctcacgcctgtaatcccagcacttggtggggctaaggcgggcggatcacctgaggtcaggagttcgagaccagcctgaccaatatgaagaaacccccgtctctactaaaaatacaaaataagcctggtgtggtggcgcatgcctgtaatcccagctactcgggaggctgaggcaggagaatcccttgaacctgggaggcggaggttgcagtgagccgagatcccgccattgcactccagcctgagcaacaagagcgaaactccttctcaaaaaaaaaaaaaaaaaagagttcttcctgatatgagggctaagttctcactattgcaatttgagcttcttagccaacttcaaagaacatgtaacgaagctaatttcttttctctgtccattcggaaagtgtagagtaaggaattgtactctgaattgcctactctgcagagcaaacagactcagtttcttccactttgtccttggctcctacaccgcaattcgtattgagtcgttttccctttttttactaacaggccatctccacatttgcttgcttttcttgtgttcactgggattagaaataacaaggtcccaaactagctacttgctttcattttgagtgcatgaatgtgtgcgaagcctcagcataaatataggcaaatatggagaactgaaatgtatggaaaagacattttaaaaataaaatgtatgggctacatgttgtggtgttcataaattttttttccattcctggccgggtgcagtggctcacgcctgtaatcccagcactttgggaggctgaggtgggcagatcacctgaggtcaggagttcaagaccagcctggccaacatggggaaaccctgtctctactacaaatacaaaaaattagctgggtgtggtggcacatgcctaatgttaacattttaaatgttagcaccatattttaattttattttggaacttaatggatgagtttacattttatactcaaatatgtgagcttatattttaatatcaactaagattacatacactattttagatatgccatctcccatcttaggaccctatttacctacttaaactaagtcactggcattttaaattgtttcctcacattaaaatatacccaaattgggcagacgcatcaaaataaagcagacactccccaggaaagagagttcactgaggaaggctcgtgtggcagaacaatattgggaaagtaaggaggggggagtgatgctatttttagatccttacctcacgtccgtggagggaagtgacactatttttagatccttacctgacgtctgtgcacgtaatgcaagtgatgttccgactatttgttgcgatcaggtgcaaagctactgatgtttccttgtcagaggtggggtgtgctccacatttaaagaaaaattcctgaaagaaagataaatatgatcacacacatggatcccggctgctcatttttcctctaaatgtttccacagtaaacaatctctttggacaagagaagaaatctgttacgaggtgtgagatggaaataaatcagcatcaaacctttcccaggaacggatgaccttgtgccaaagtggtcaacaattctgttttagaagggccctgagtctctgctattcttttgctctttaagcgagggagctggagaaatacgctgtgaccttctttaagccatgcccctcgatgataataagtgagtctagaagaatcacacgatgtggaggtgggaggaagcctctcactaatgaggaaagggagacgtgaagccatgaaatgaggtgcccacgggtcaaacagtaagaggtgaagccaagaagtaacccaagctccccgcagggaaatccagtgctttttctccagtatcactacatggttagtcatttagcggagtcaggaattgagagagccctactgtaaatagccacacaagtacacatggactcctggtagacacagaagtgcagcagaggcccggcgcgttggctcgcgcctgtaatcccagcactttgggaggttgaggcgggcggatcacctggggtcaggagttcgagaccagcctggccaatgtggcgaaaccccatctctactaaaaatacaaaaattagccgggcatgacggcacatgactgtaatcctagctactcgagaggctgaggcaggaaatcgcttgagcccggctgaggcaggagaatcacttgaggttgcaatgagctgagatcaccccactaaattccagccgagagtttagcagagcatggctctcccagccccatctggagtctgccccttttctgcctggcatcaacaccccagcattcctgcgaagactctgccgcccaccctctgtgccaggcaactggaatgctccaatccagtatcttgctgcttcttagttcctttccccagccaggtcctgccacatactccctcattttagcttttcacataggtcacgttcttttgattgataatattctcccttctcaaccacgttttttcttcacttttttctgttctaacttctgtatttgttctcactctccttctgttcactcacacaccaaggcgtttggccagcaattgctttacttcttgtcccacagtctgcatgccttccatgatactaacatctgtgaagctaaattttttgctactgaaaaaaaaaatacatatattttactggatgacagaataacccctgcataccacacatactcctaattccacttgcgtttaactacctgaaatgtgggaaggattttcccttaaaacacttgatctggtattgacaaactttgatgtaaagtgccagatattacgcattaagtgcttttggttttgtagggtatatggtctttgtcacacttctcaacttggccttgtagctaaaaacagccataagcagtatgcaaatgaatgggtgtggctgtgtcctaacaaaaccttatttacaaaatatgtggcaagttggatttttccctgcaggccatgatgagacatttgtagaatgctttattcatatttgtattctaacagtgactgacattaggataggcatgacatatacttcttttttttttttttttttttttgagacggagtctctgccttccaggctggagtgcagtggcgcgatctcagctcactgcaaactctgcctcctgggctcacgccattctcctgcctcagcctcccgagtagctgggactacaggtgcccgccaccacgcctggccaatttttcgtattagtagagacggggtttcaccattttagtcaggatggtcctgatctcctgacctcgtgatctgcctgccttggcctcccaaagtgctgggattacaggtgtgagcctgtaatatgcccagcctgacatatacttcttaagtgaaaaacaatagattaatcaacgctatttaatcaatgttatttatcatttatttaataaatgctatatgttatccccttatacgtttgacagcaacatttgatttcttcttttcctgtttataatttactaacctcatcctcctctgacatgtgacaccatgagcaacagcccttggtctgaagctgtagtgtgcatcagaatcactcgggtgggagggggcacggacttgctaaaccagagatcgctgaacccaccctgggatttttgtgatttctgggatggcatcaagattcgcatttctaacaacttgccaggtgatgttgttcctaccgctcaggggcccacacttgggaaacctgagctccaccaatgtcagaggcaaagtgagtaaactctagttactctctcgcaagaccgctgctgtggcaggtcgcttaccgtgtctgaaaataatgctacatcttacgtaaaatatgtgactctcaaaaatctggagtgtgccattttactttttttttgagacagagtctcactctatcgcctaggctggaatgcattagtgcagtcttggctcactgcaacctccgcctcccaggttcaagtgattctccctccttggcttcccgagtagctgggattacaggcacccgccatcatgccaggctaatttttgtatttttgtagagatggggtttcaccgtgttggccaggctagtcttgaactcctgacctcaagtgatccacctgcctcggcctcccaaagtgctgggattacaggtgtgagccactgtgcctggctgagtgtgccattttgatgagagtatcccaaagccagggatttggaacccaggctattcttcactacaagtctcaccaatcccaggtggtataatttagttaactaaacctatcctatctggggcagtggaatatcagccggtcctcacacctgcagtcctcagcccatggaggcatgtgtgtggagtcttgctggagtggacaggatgtccagtgtgtgtgatgggcccaggctcaggcatgcctgtggagtcctgcccatgagtccaggaccttccccacagcagcatggaaatcatgctggctgatgtttttgtttggttatgttttgttttcctgaacataggatcccattccttttactcaatcttttgaaatgtgacaaatccttcaatggccagctcaagggtattgagaaagagatttaaaacaatgtctgaacaccaaaacgaaaagtctgaaggacatgactgacccttatgaaatacgctgagctagctacgactggtttttgcagacatgaaaaaaatcctctttcaaaacataaagtaattcctccaaaacagctgagttggcaggactattgaaaaagtatttcatatacagataaatagatagaaagcacttacgttttttcttagcttacagaaagctgcagtggacattcagctaacaaatcacaaattgttctaacaccagataaaattcagccagataaaagcctttttattgggggtaggtgtttatagataatggtttaagaaattacagatagttgaaaaattctagtaacacatatagtgttgataaaactaaaactcacattgccaaccctatattaaatatgtatgcctcaacagtaaatttcagtgctttctccaccaatttttatgaaagaatgtttttgttgtagtactagaataactggcaagaactgtgaagaatgtgggattttacccagcttgcaagttagcaagttagtttgctgcagtatcataaaagctgacagaagacaagagactcctggatcagagacaaaggactgcagaactcagagcacagggagaaagaagcatgagcatcatattacaccagttcccctccacacgtctctctcagggttgaagtagataggctaagtcagattctacaggtgcagtggttttgcatcacaaatgagaactctgaacttaggaaactcaaatcttctttaagtagttctaagcaagtcatcttttcatcctgaagggaaacattgtctttattatactgcataataagcaaatctgccttttgatctggagagaaacattatcttctctactttctgtttttttggtttttttttttttttttttttttaagacagagtcttttctgtcgcccaggctggagcgcagtggcacgatcttggctcattgcaagctccacctcccgggttcacgccattctcctgcctcagcctcccaagtagctgggaccacaaggcgcccgccaccacgcccggctacttttttgtatttttagtagagacggggtttcaccatgttagccaggatggtctcaatctcctgacctcgtgatctgcccaccttggcctcccaaagtgttgggattgtacaggtgtgagccaccacgcccggccctatcttctctactttcaaggtcatttgctctaaaacttccttgaaaagatgggtcagaacaagttggtgtctccctcagagatgagcggacaaatgacagacccatggagaattgcttctcaataataacaccttttcttgcaggctaatttgcagttattttattgtattttattttattgtattttattttattttattttattttatttttttgagatgggagttttgctctttttgcccaagttgtagtgcaatggtgcgatcttggctcactgcaacctctgcctcccaggttcaagtaattctcctgcctcagcctcccgaatagctgggattacaggcatgtgccaccatgcccaaccaattttttatatttttagtagagatggggtttcaccatgttaatcagctgatgtcaaactccagacctcaggtgatccaccggcctcggcctcccaaagtgctgggattacaggtgtgagccactgtgcccggccgatctggtcatttctgctcctgtacaatcagtgggctggattgttgaagtcttttctgacacttccaatctgtattcaaaaccagcagacaataaaggaacacacaatagaagtgagaagggcctttttcgaaaattccaccttgggtgtctgagatggcttgttcacacatgggtgtcatctcacagacagtggcatgattctttgggattaactgcctctgaattctgttttgtttctcttaattactcagtttaaaaaattaaaaaagtcaaagacaggaaagctttctagctggagtccaagaaggctggtcagaaggctggcaccactgcaccactgtgaggtcactggggcatagcagggcccaagccaagtggccaagaaacatctccagctgtgctgagcgacagtggttatgcctgaggcaaggctgctcaaggtggcattgtttgagttctagcgtgtgcaggggttggccggggaagttgcttctcggtcactagggaagcagagtattctgggggagcagccgggcagtgtcctcttcatcaggaagcccagctgtcaattctagtgtggctggaacagaatcctttacggcgggtaaactgagtctcagagcggcccaccccacctcttacaaatggtagttcacagataaatcagctacagaaagattcccccacctaaccaggagctataattcccaggggcttactcacatcatttgtataccaatagtcacttctgggaaaccttaattagcgaagagagctaaaatctataacagcaaatggccagttttttgtttttgtttttccaaatgatagcctaaatgattttatacttgaaaaaaataaggctttagaaaatgtgcttggctttatattgtgacactgttaaatgccataagcgttttcaactttatttatttttttgagacacggtctccccctgtaacccaggctggaatgcagtggcacgatcttggcttactgcaacctacgcctcccagtttcaagcaaatctcatgtctcagcctcctgaatagctgggatcataggtgtgtgccaccatgcctggctaattttttgtatttttagtagagatgaagttttaccatgttggccaggctggtctcgagttcctgacctcaagtgatccacccacctcagcctttcaaagtgctgggaaaacaggcaagagccactgcgcccggaccgttttccacttcattagtattaaatggaaaacccaacaaagttgtattcctcaagttcttagaaaggctactcatgcttttaccatttctctggacaaggctgtgatcccttccttccattcttctctttcatcataactcacttgccctctcctcctcactgtcgaagcctgaccctccaaatcacatcagacccatacaaatcaaagggggaccaggggagaagagcaggaagatgtcaactggactgtggtattcctggaagccactcctgctcacttatgtcccttcacccatgactcataagcagtgccactcacaaagaggaaaactagagcaagaagaatggaataaatagcccagcaaaatctgaaaattagattgacaccaagaatccaactgtataaacacatttacgatcagaagcgaattagccaaacccaaatacaatttgatagatttcaaattactataaaggtagatgacaactggcttgaaagccctgcttatcacagtcctaatatggtcaaatctgaaaaaatcattagcagtaagacctgacttagttacccatgatccttccaatagcttttattgaacatcctaaattttatgtttatagatattgtttaacaattatgttttccaaacgaaatattgtatctatcttcacaaagagttaaattccattcttgtctccaaatccttcttagttaatatttcccaaaagaaaaaaaaactatccttctcttgataaagtaatggggacacacactttccactaacaaggttgcaaagggtatagggtttgtacttaacacgtaactgcatagctatttgcatggctcagggtatagttaggaaaacagggcccacaccaggtagttcaactgacggaattgaatgagattagttatagaggagtggaagcacagaagaactaaacagagaaaggaagccacttgagattagcgtcattattgcacagctgccatctggggctagaggacaatgggagaaggtattggagtcaccacagctctgcagctgggctatctggttgggagtctgacaatgaatgggatgaagccactgccagagatgtcccctagagagagagggagaaatgcccctggcttctgccttctcttggccctcccatctccagaaacagccccaacttacagagcagagagggggaaaaggtggcttgggtctgaaagccaccagcagatgactgctgcaccaccacgaggtggaccctgtgtgagatcaaaattctccaagtgtcaccctttgttagtggtgacacattctaatcagcctccactaaaaacaaaaatacacattcagatattgttgtgaaatatgtattgaagatacagaaatactcacacaaatatacattgtatattgagattaaactcaactatactcgtcaaaagactatccatccaaattttccgatgatattaacaggatacagggctgtggttactgcttatgagatgaactcgtaataagtatcttacatctatatcagaaagattctcacagttaccaagttaagacagacagcctgtcacttcaaatcaatctaaatgcctctcacaaacctaaaatcctgtttgtagctaacagcaacagatattccccagttactctctcctcagaaactgtccaggctagaatagttcctcgttagtgagatacagattcttttctaagacacaactactagttttaagtcttcctatccatgcagaggtttcattattaatcttaataataaagttttaattttctttaagttaaaacatgtcagctgggtagggtggaacacacccattgtcccagctatttgggaggctgaggcaggaggatcgcttgagcccaggaatttgagaccagcaagggcaacatagcaagaccctgtctttaaaaacaaacagaaactccacaaaaacaaaccaaaaaatgccagataaagcataaccacaacattctctacctaatacataaaaaaagcctttaaaatagccatggcaaagcctgtttatcttgtgacttctttattgtgtcttagccttcatactgaagtgttcgacttactgggtattacataaacccagtaactgaatttatcagttctgatacaaagtaactatgcaaactggaggactatataataaatgtacactttgttaaattaacaatgccagttttacaattaagttacacctagtcaaacagatcagacctaaaaagttaatgagtctatcaccatgttcaattacaagtttgttttctctcaagatgtcaataaagcctctagatgatgtgcaaagtttatcaggagaaagaaaatcaatatactccacacaaagcaaaaccatgtcacaactttgctgagaaggaggctgtcagtttatggtacatgtcttcaagaagtctaacttaaaacaaaagttggctaatataacaacccacatccgccccttctctgcctgattgtaagttcttcagtgtgccttgaagtttattccaggtgtaatgccactcagccataatttgatgtttataactttaagagcaaaagggagattgttaaagaagatgttaaaagtgattcctgaaaagtaaaataaaaggtttgcccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattactattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctataatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcacggcacatgtatacatatgtaactaacctgcacaatgtgcacatgtaccctaaaacttagagtataataaaaaaaaaaaaaataaaataaaaggtttgcagtcattactgacccttataaaatgcgtgaaaactaggaaaactaatattctctttcccagctcaaggtacttgctccaataagctcagatggctgtacctccttttcccctccccagcccaggggtgaacaggcagctctggcctcagcggtcagagtaaaacaggctcatacatgtgaccacaatgagatacctgtctgagaaccaagccggtgctcagaaggaaaaagtgatgagagaaagacagtctccaagaaagagatcacttgtaccctggatccagctatgcctgatgtttccccagttacttattaatttttatttatttatttattttgagatggagtctcattctgttgcccagactggagtgcagaggcgtgaccttggctcaccgcaacctccgtcccgtgggttcaagcaattctcctgcctcagcctcccgagtagctgggattacaggcgtgtgctaccatgctgggttaatttttgtatttttagtagagatggggttttgccatgttggccaggatggtctcgaactcctgacctcaggtgatccacctgcctctcaaagtgctgggactacaggtgtgagccaccctaatccctggctgtgtttttcattctttaatttagcagtgcccataggcacttccaagactgatttccatattatctgtcagactgcaaaacaaggattttcctttattatctttattatcttggagaaagctttgaccttaggcgttgtcccctagataatctatcactggggaatttttcagagcaaatgcttccactatgtttgttgctatttctttacttgtgcatatgatcttgctgttagcatttcatgaagggtccctgactccaaacgctttagaactatgggacagttgtcaaagttccacgctgcacagcctccctgagagtgagcaggaggaccctgctggccagatgaagcagccctccctgacctctgactcattcctgggcaggaatggccatctcaggggaaactggatcgggattacacacaacacagcaaccatgtttttttctttccttaggttttggactagtggctctggtgtggtaccagcttcccctgcatttctctcccaattccaacaaacgtttggagattgtaacttgtctcacctcaacataatcgcagtgacttatgcgatgtcatctgctcagtttataaatcgagcatatctcttccctttcaattttgtagcctagcccgacaataaaagaacatttattattctagctgttctttctctcctttagaagctaaaggtttcacatgctctcataatatgtcagcttcaagaacataacggcacccaaaacatttgctagttgcatgtttaggccaagctttccagcttttgtgctcagataaataagatgttaaaatatctggttgttaacatggaatatttccttttgtaatctcccaccaccgagtgttcgactccatgatttgacctccaggagaggacatataaacgaacatgtgttagctggtaattatttacgagaaactgaggagacaggtcacaattttgaaaattccttatgactcaccatccctagatgagttactatattcctaacattttctagggagtctctagaagacagtattattttacatttatttctaaatgtgcaaaacacttattctaattaacaatggcaaacaatgtagacgagctatgtaatcatttcactgtctgggttaattatcttccaggccaagcacactggccgagcaaggccttgtagactttctaacctccttgcctcactgcctcccacctcacctgcccacctctcccttggcctgccatggagaccctttgaggaggggctggacttccccccttcactctggccccttgcttgtggtttgagctcagcaggatctgtcttcttcctctgctttgtccactcattttgcctttcaaagccctagatgtctttcggcctcagtgtatctatcttcaaccctggaggccttccttgatcctgtccctgttttagctagtcctcaattatgtccggtgcctaagctctccataagatacatccaccagtgtgtcatgtcagtttaccattgccatggcaacatccaggagttaccagccctttccatggcaatgacccaatgacccagaagttactactcttttcctagaaatctctgcataaactgccccttaatctgcatgtaattacaagtaggtataaacatgactgtagaactgccctgagctgctactctctgcctgcagggtagccctgctctgcagaagcagtcacagagctgtaacaccaccggagctataacactgctgcttcaataaagtggttttcctctactgtcagcttgttcttgaattctttcctaggtgaagctaaaaaccctcttgagctaatccccaatttaggtcttccctccccaacatcactattcttgggaattaagtaattcactctgttctctccctgctctttggttagtctgcagtgtcctttttttttttttttttaagactttgatattccatcttttgagttacaattgggacaactgagagaggggaagagctggagtggggtgagaactaggagggctcaacagctggaggtgtagttcacttagtttttgtactggaagggttcatcactggtttcattgagaagtcaggtgcgacgagagcttctgtcacctacatattcctcctaacatttactgctgctgttgaatccattgtgctgtttatttggaaaatcccccccactccctggaccaagtgagagcggaacagccagacctgagaaatgcagccacagcaacttcacagtgtccagtctaggcagggaaagtgcaagagaaacataccttttgatagcaatacttcacaaaatgataatataactggtttgttggctatgagcaaaaagaaatattgagcaataaaaaaacagcctagctttaaaacattttaaatgactttagacttggaatctaaacttttttcgttcaaaagtccttgtttctttagcaagtagaatttaaagcttctttttattcgtgtcttctttattgcaggcagcacaagccatcataaacattccactcaagataaactgggcaaaggcaagtgcttaacacaatttaatactttctcacattctatatatttactttatttcctcattaggaaaagaagaaaataaaatgtaatttgtaaatttacctataaaccatataccggaaaactaagatgaataaaactggaaaataaatgttacactgagttttttcttttaacatgccagtacaagtgataaccaatggaagaattaaaaactcaaccagccatcctacttatgtaaaatatatatcgatgggcgtagacatgtgtgctttatacatatgatcatccctcagtatccaggagggactggttccagaaaccccctgcagacagcaaaatctgcagatgctcaagtccctgatataacatggtgtagtatttgcatataacctaagcacatcctcctgtgtactctaaatcatctccagatcatgtagaatacctaatacaatgtaaatgctgagtatatagttgttacactgcattactttttaaatttgtttttaaatattgtgttattttttgtttttatttttgaatattttcagccgatgattgaacccaaaaatgcagaagctgtggatatcaagggctgatgttacatagattgactgaaaaatttcggagtccaattaatactgcatctaaaataagttaaataacatcaaaccttttgtgtcataaggacaccattaaagttatttatttgtttatctctcctctattttttgagaaatgtatgctgtgttggagaggcaaagaaggaggatggcaaatagtgcagcatcatccggttgctaagaggcatatgtaaaaacaaagaaacatcccacaaggcaagaagaggaactgttagagtgaacgatgctccctcttagcccaggcttatcattatagaacaattctcaggcgatggcatctatgggcacagtttgtgtgtgagggcaaaagactcctgtacagctcatgcccccaccaggagagaaaagttggtggccccggccttccatcactgttggggaaaagtcaggaagagtcagttcttccaaaggggaaaaaaaattttttttttaatctaaagaaaattcttcagggctgggcatggtggcttatgccagcactttgggaggccgaggcaggcggatcacctgagatcaggaatttgagaccagcctggccaacgtggtgaaaacccgtctctactaaaaatacaaaaaattagctgggtgtagtggggcgcgcatgtaatcacagccactaaggaggctgaggcaggagaatcgcttgagcccaggaggcaggggttgcatgaggcgagatcccgcactgcactccagcctgagcaacacggcgagactccgtctcaaaaaaacaaaataaaataaaataaaataaataaataaaaagaaaaattttcaggaaacataactaggacacaataaagtgtttcaatcaggtttaaacataacttgagaatataagaattttaaaatttaattaaaagctaaaaaagaagagtaaaaacagagaaaacctattaataaaatggaaatcatgagtgaaagctcagagccatgaacacgacagtgaggacatcaatatataaatcataaacacagagaagcggaacccaaaaaaaaattgcagaaaagatcttctgtgggttaaagctacccaatggataataccagtactacagagcattttcattgactgcctgattattataacatgtttggtaagttacttaatcaaatttatggtagctgtctttatcatgtttaatttagctgatttttaaaaaaatatttacaatgagctttatcttttttttatactttaagttttagggtacaagcgcacaacgtgcaggttagttacatatgtatacatgtgccatgttggtgtgctgcacccattaactcatcatttaacattaggtatagcattaggagacatacaatgagctttagtacaaacagcttctaagtttgatcaagtgatttggattcactatggacataatcacacacatctcttttaagctttagatagcatgaattaaattgatggatatgtgaagattatgatatcctgacactttgaaataaacacttactcctttcttactttcatagtgcctggaaatatatatatacaccatccagggcctggggatcaaacagccttacccgttacagctggtgcccatgcacatcagggggcctgaggacaggtctgccttcctgctgctgttcccaccagtgcgtggatataccatcaactgggagcctgggggtcaacctaccatacctgttgccactggcaactgtgtatgattgcagggcctgtcaacaggtctgccctgtccttgatgcctgtgcataccatctggggcttgaggataggtcagttacaccccccaccacctctgctggcacccaagcatgctatatggggacctggggaccaatgtgtcccagccgccacagcctgcacccacacacactattggggacctgaggacaggactgccccacctgatgctaccactgacagtgcctgcatgcttcatctggagacctggggattgatctgccccacatgctgctattaatggctatgagcaccttccagggccctgacgatgggcctgctcagcctgccggtgcccacatactttgactgtgggactggggaacgaccctccctgtctgctaccaccagggctcacacacaactcccagaggactgaggatgggcccactcagccggctgccatcaccactgctggccatctacccatatgcatcacctggaggcctgagcactggcttgcttaccctgccaccaccaccactggtgcctgcatatgctgactaggaaccagagatgtggcttgccactactattgccatgaatgatgccacacaccacccaggagcccaaggaccagcctgccctcccagcccactgccaccactgccagcacataagcagactatctggaggcccaaagtttggcatacccaaaccactggtgccaccactgtgcccgaagaccagcccacttggtgtccctgtccccacaaaagcttcactgcaacctctactaacaagtgctgcccgagccactgaagagatcacagacacaactgatgctgattacagctgaagaaatcattgagacattacactgctgtgcccagctagaatcaaagccaaggtgacctaccaaagcaacattataaatacatctgtagaaaaaagtagtctttttctaaaaaagccaatccataaaattggaagaagcaactgctacatcagaggcactgtaaaaagctcaatgagatatgatagaacacaaataaaagatacgaaatatcagaaaaacaattcatgatctgaatgagaaactaaacaaagagaaagatatttttaaaaatgtctaaacaaaaatcctggatctggagaattcaatgaatgaaataaaaatacaattgagggcttcaaaaaaagatgagatcagggagaggaaaaaagaattctgaacttgaaaagagatcatttgaaataacccagttaaaaaattttaaaaaattattaaaaaataaagtaagcctatgggatatatgggacaccacaaagcaaacaaatggaatttggggtgttccagatggtgaagtgatgatcaaagacatggaaagcctatttaacaaaataatatctgaaaacttctcaagtcttgcaagagacttagacatccagatacaaaaagctccaagaatcccaaataaattcgactcaaaaatgtctttttcaaggaacattagagtcagactgttaaaagttaaagacaaacagaattctaaaaacagtaagagaaaagtgtcatgtcatatataaagctatccccatcagacaaacagcagatttcacagcagaaaccttacaggcaagagagaataggatgatatagagtgctgaatgaaaaaacatgctaggaaagaatattctaccaacaaagctatctttcaaaaagaaaggagaaattaagtctttcccagacacaaacagaaggaattcatcaccactagacaagtcttatgagaaatgctcaaggaaattctacatctggaaggaaaaggacaatatgtaccatcacgaaaacacacaaaagtgcaaaactcaatggtagagcagacacacaaaggagaaatgaaggactcaaatgctactattacagaaaaccaccaaaccacaatgataaacaacaaaagggaaagaaggaacaaagcatatgcgaaacaaccagaaacaactaataaaatgatggaaataagtctttactcattaataataacttcaaatgtaaatggattaatttcccccataaaagataataaatggctaaatgaattttaaaaaatggcccaactggccaggcgtggtggctcatgcctgtaatctcagcactttgggaggccgaggcgggcgggtcacctgaggtcacgagtttgagaccagcctgcccaacacagtgaaagtccatctctactaaacatacaaaaaattagcctggagtggtggtgggtacctgtgatcccagctactcaggaggctgaggcaggagagttgcttgaacccaggaggtggagcttgcagtgagccaagagcacaccactgcactcagcctgggtgatgagagtgaaactccgtctcaaaaaacaaaacaaaacaaagcaacaacaaaaaaatggcccaactatatgatgcctacaagaaaaacacttcacctataaaaacacataaagatgacagtgaaaggatagaaaaagtcattccatacaaataaaaaccaaaagtggacaatagtagctatacttacatcagataaaacagattacaagtcaaaaaatctaaaaagagacaaagaaggctgggcacggtagctcacgcctgtaatcccagcacttgggaggccaaggagggcagaagtcttgaggtcaagagttcgagaccaacctggccaacatggtgaaaccccatctctactaaaaatacaaaaattagttgagtggggtggtggcgcacctgtaatcccagctactaggggggctgaggcatgagaactgcttgaacctgggaagcagaggtttaagtgaactgagatcgagccacagcactccagcctgggcaaaagagtgagattctgtctttaaaaaagagagagagagacaaagaagatcatcatataatgaaacatgtatcaattcagcaaaaggatgtaacaattctaaatatatgtgtacccaatagcagagcacccagatatattttttaaaaaattatagattgaaagggagagatagaccctgatacaacagttgggggcttcaatgcccctatttcagcactggatagatctatgagatagaaaataaagaaacactggatttaaattgcacttatgaccaaatggaattaacagacttctacagaacatattattaagctgcagaatacactttcttctcatcggcacatggaacactctctagaatagatcatatattaggacataaaagaagtctcaagaaatttgttaaaatcaaaatcatatcagatattaatatcttttcagacaacaacagaataaaactagaaatgatagcaagagaaactttgggaactgtacaaatacacggaaatttaacaacatgctcctgaatgaccattaggtcaaggaagaaactaagaagaaaaccaaaaaatttcttgagagaattaaaaatggaaatgtaatatattaaaacccgtgaaatacagcaaaagtactgctaagagaaaagtttatagcaataaacacctacatcaaaaaagtagaaagacttcaaattaacaacctaacaatgtaccttaaagaactagaaaagaaaggacaaaggaaacccaaagttagtagaaggaaagaaataataaagaccagagtggaactaaatgagatagagacaagaaaaatgtaaaaaggattacaacaataacaacttggtttttgaaaaagataaaaatcacaaactactagttagaataaccaagaaaaaagatagaagactcaaataaaaaaagcatacacgaataggagacattaccactagcaccacagaaatacaaagaatcattagagactattataaacaactacatgccaacaaattggaaaatctagaggaaatatataaaccttggacacatacaacctaccaagaatgaagtaggaagaaagaaaacctaagcagacccataatgagtagtgagattaaagcagtaattaaaagtcccccaacaaggaaaggtccaggacaagacggattaactgcagaattctatcaaatttatatagaaaagctaaaagcaattcttaaactatttcaaaaaggtgaagaggaagagattcttcctaatgcattctacgtggccagcattacattgataccaaaaccagataaggatacaagaacaaaagaaaggaataggccaagatcactgtcttagtcgatttgtcttgctatattggaacacctgagactggataatttataaagaacaggggtttatttgacttacggttctgcaagctgtaaaagaagcactgagccagcacctgcttctggtgaagggctcaggctgcttccaaccacagcagaaggcaaaggagaaacagcatgtgcagagatcatgtgacatgacagaaggcaagagagcaggtgaaggtgccaggctcttttttaaacaaccagctttcatgagaactaatacagccccttacctgagacagggcattaatctattcatgaggaactgctcccatgacccaaacacctcccactaggccctacctctaacattggtgatgaaatttcaacataagatttgggtggtcaaatatccaaactatagcaacccgttatgaacatcaatgcaaaaatcctcaacaaaatagcatatcatgatcaagtgagatttttctcagggatgtaagaatggttgaacataaacagatcaataaatgtgatacatcacatcaagataatgaaggacatatagaagcatggtgtgcagaaaaaaaaaaaagaaagtgaaggacaaaacccatataatcatctgaatagatgtagaaaaagctttcgacaaaattcaacattccttcatgataaaacatcaacaaactaggcatagaaggaacatacctaatggggaaaaggtgaacgtctatcctctaaaggactgaaacatgactaggatgcccactctcactactccaattcaacatagtactgaaagtactagccaagtcaatcaggtacaagaaagaaaagtcatccaaactggaaaaaagaaagtcaagttgtccctctttgcagacaacatgatcttatatacagaaaaacctagactccaccaaaaaactcttagaactaataaatacagtaaagttggaggacacaaaatcaacatgcaaaaatcaatagtgtttctctataccaataacaaactaattgaaaaaaaaataaagaaagcaatcccatttacaatagctaccaaaaaatctacttaggaataaatttaaccaaggaggtagaagacctttgcaaggaaaactacaaaacactgatgaaagaaattgaagatgacacaaaccaatggaaagacatgccctgctcattgaccgaattaatattgttaaaatgactgctcaatgcaatccctatcaaaataacaatatcattcttcatagaaatagaaaaaaaaaaaacagtcctaaaatatgtatggaaccacaaaagaccctgagtagccaaagcaatcctgggcaaaagaacaaagctggaggcatcacactacctgatttcaaaatattctgcaaagctatagtaaccaaaacagtagggtactggtataaaaacatacacatagagcaatggaacaaaatagtgaacccagaaatcaattagtgtatttacagccaaccatcttcaacaaaggtaacaatgacaaacattggagaaaggacactacaataaaaagtgctaggcaagatgtatacaagaagaatgaaactagacccttatctctcactatatgcaaaaatcaaggcagaatgacttaaacataaaaccccaaagtatagaactactagaagaaaacaaggaaaacattcaggacattggtctaggcaaagatttttatggccatgagctcaaaagcacaggcaataaaaagtacataaatgggactatattaagcaaaaatgcttctgtgcagcaaaggaaacaatcaacagaaacaacctgtagaatgggagaaaatatctccaaactattcattcaacaagggactaatacccagaatacacaaggaactcaaaaaactcaaaagcaaaaatacaaataaacccatcaaaaagtgagcaaaaggttagaatggacacttctcaaaagaagacatacaaatggccaacaggtatatgaaaaaaaattaaatattactaatcatcaaggaaatgcaagtccaaacagcaataagatatcatcttacctcagtatggctattatcaaaaagacacaaaataacaaatgttggtgagaatgtggagaaaaggcaactcttatacactgttgtaacctgtaaattagtacagccattctggaaaacagtatgcaggcatctccaaaaactaaaagcacaaggtggcttacgcctgtaatcccagcactttgggaggctgaggtgggaagactgcttgagtccaggagtttgagacaagtctgggcaacataccaagaccccattttcacaaaaaattaaaaaatccccaaaattagagctaccatatgatccaataatcccatgactaggtatttatccaaaggaaggaaatcagcatatcaaagggatacctgtacccccatgtttattgtagcacaataggtcaagatatggagtcaacctgtgtaaatccaacagataaatggataaagaaaacgtggtgtgtacacacacacacacacacatacacacgagtactaatcagccacaaaaagggtgaaatcctatgcttgcagaaacctggatgaactagaagtcattatgttaagcaaaataagccaggcactggacaaatacctttccaaagtcaaaggtgaacattaatcccattctggttactggacctttattgaactgacccaaataaaaggttcctatatgtttcttcaagccagcagtatctacatactttactttaaaccccgcttattttctttttggctgatttgccaaaatgtggttgactgatccatcaaaaataatactgtaatctctaatggtattccaaatttactgaaattaatttgcgtctttattttccccaatttttagctcctcttaatcaaatttacatgtaactggtataagtaatttcagctaattaaatgaagaatagcagactctctatttgttataaatttaatagttacgttaacatgtattgctatttcaatacttttatatttacatagataacaacactattcagcattagttagtatatgtgaagggaacagtataagtatgaaaaacagcctacccccaaaatatatttttagatacaggagaagtttatgattaagttgtacaattttctaggggaaaaacgttttattttttttttaaattaacatggagaaagcacctaaatcatcatgcttcaaaaggaaatcacgctgaaaacaacccaaccacttacatgtgccccttgacattggactcatatcagcgggtagctagctcacaactgaaatgacccataaatcttgcaaacctagtctacctctatacacataaaagagcaagcttcaattgcgttctcgaatgacaataagtatgtacaatgaaatacgtaataaactgagatctaggtggctagcacattcgacgcaacgtgctctattccatagacaattccattctacttcttggtgcattaaatgaagttattttccttatatacatagatctgtatactcattaaatatagtgacttctgcgaaaaaatttatttctaccctgcagtggaagcctaggaaaacattaattttatgttactgagaggtacaaactacaaccttctccttagaacaggaggtataaaaatcagcctcctggggttctgttgctaattcctctggacggctgggaacttgatctaagccattccacataactggacatcatttacaacttgtgggttttgtgcagtgtctctgtgccttcctacatggggactcaatcacataagcaagaaatttcttttccccagtcacctaactcagtaccagccagctagatggcatctctcaaggcactgtggtagaggcatggtggctgttactcatattacacttttccaatcagttgggtcaatctgtctactcagaacatactaagtgatatcaggcacctgctattctgtggtgactgtgaaatactcttcctcactctacatgtacaaatctagtttcttttcagaaaaccagcagttagtgatagaaacaccattcccaaaccaaaatacatgagggtaaactcaagttggacagagttatcaatattttttagctgcaaacattcctttcatcaccaacacctggtgctcaatgaatgtatcattacttggctggttatatataagcccatctgtgcaaaaatggccaaaagccctctcgtagttggctggacctgtgtcctaaaatacaggagccaggtaatgacgagctttgatgaccttcataaccatgggaaagacagctgacagaaatggtttatatggcaataatgtggaaataaagaaccacatatactgcaaaatatattaaaaaacataaaacatatattatatggttattatatagcccttttaaatacaatagtcatcttttctttatagggatttttgggaagtatgagatttcccatctaagatttagtgaggaagcagtaactatatcacttttggatagtctatgaatatgagaataatgagttgactattttcagcccatttatcagccttaactcctcaaacacacaaagtagatacactgtcataaatctttattcgtgctatgatggttgccaagaaacgcttcatttctcagtaaatcatagttggcatgaagtcatgtgttgctaaatattttataacctcctcttatgaacctggaaacaatctattaactacacatatgaaaacccccatatatttgcatgtaaataaatatttatttgttttgtccaatttccatctttatctgacaaagataaaatgagtgtaacctcagcaggcaattcacatgtggccagggctccatccagttatcctagttacagctttctactctggtagcaggtagctactgtttcattagctacagtttgtatatcaggcttagactgccattcctaaaaaacaacaacatttatttacactttcaataagaggaagtttcagcgaattgcctgggctccaggaaagtcttgagagaataaaagatagtgtaagagaaatccaatcccgttatacatacttgcagtgtaaatttgtcatcgggtcaatttccagtatatttcctaacccccaaaatgcctcaatataaatgggatcttcagggaaatcatactgtggaaataagtaatttatggtgtcagtttgtttccaaagatgagtagtgtgaactgagtatgtgtgtttaggtaattttcctcacaatcccataatcattttctagtcttttgagaatgaaaaacattctactttattttgtcctcttaacacacaaaaacatttgatagaaagataagtagattctcagtagatttaggaaagggtgaagaaggatttctaacaaccgcaacacagaattatacacagcttgcctccaccacaagcgattctcctataaacccctcttcacacctctcagaatcattgccacagtgagctatcaagtctcagcaataacaacgaacaaaatcagtgtcaactgcttagagaagaggcagtctggataaatgtaaaattgacaacctgcttggggtggggcggaggagatgtcactgcaattgatttcaggaagtgaactcctcttgtgcccatctggacactggactttactggtgactgttgctgtaacagcatcatgaaaaagagtgactgtccctacctcggaattgctccacaattcctgaaaaataaaaacgtgtcttgtagtgaaaaggtgaaagcacaagcagtgaatccccatctatgcatgagcaaatatttcatggcacgtccatttatgcaatggcattcattttgcattttctatgtgctaagcaatgtgcgaggtccaagagtcacacgaaataaagcacaatgcccgagccaagaaggtggcaagaggtgaggagtgattgcactatggtgattgttagctgcagtggtaggcacagataggaatgatgaaatggaactacttttgttaccaagactaatgcaccaaaacatgaatgtgggaaaacaggacactttggtcagctaatttccgcaaacaagctttagaggacttttttacttgatgcatatggatgccagattttagattccacagaccaaaataataatagcaataacaataataataaatgatgaactgagttactagcaacttgaaaaatactgataattatatttcaaagaaatactaatagtaacaagatgcttatattaatggtaaaattaactatgcgtgagttctttagaacaaaattttgttttaaagacttacatttaaagacttgttatatttttccatccatctactgaaggacatcttggctgcttccaagttttggcaattatgaataaagtcgctataaatatccatgtgcagtcttttgtgtggacataaacttttaattcatttgggtaaacagcaagcagttaaattgctggatcgtatggtaagactatgtttagttttgtaaaaaactgccagactgtcttccaaagtgatgagaccatattgcgttcccatcagtaatgaataagagtttttcttgattcccatactccccagcatttggtggtgtcagtgtcctggattttggccattgtaatagatgtgtactggtatctcattgtttgtttgtttttttaaattttaatttccctaacatggtaagacgttgagcatcttcttatatgcttacttgccatgtttatatcttccttgagaagtatctgttcaggtcttttgcccatttttaatcaggttgtctgtttttgtattgttgagtttttaaagttctttgtatattttggatggtagtttttcattagagatgtctatttaaattttttctcccagtctatggcttgtttcattctcttgacagctgcttttcaaagagctgaggttttgtattgtaataaaatccagcttatcaattatttctttcatggattatgcacttggtatcgtatctaaaaagttattactatacctaaggtcatctatgttttttccagtgttactttctcggagtcttatagttctgcactttaacagtgaggactatgaaagttttaattttgtaaggagtacaagatctgtttccagatttttttgtttttgcatgtttgcatccagttgttccaataccatttgctgaaagactacactttctccattgtatattctttgcttctttgttaaagatcatttgactatgtatgggtctacttttaggctgtctattgtgttccattgatcgatttgtctattcttttactattaccacactgttttgattactgtagttttgtatagttaagccttaaaattggatagtgtcagtcctctgactttatacttctatttcaatactgcaatggctagtctgggtcttttgcctcttcatataaacttttgaatcagtttgttgatattcacaagttaacatgctggactttttattgtgattgcattgactctagataaaattgggaagaattaacattctgacaatattgagtcctcctatccatgaacacgggctatttctccatttatttagttaatttctttcatcacagttttgtaattttcctcatacagatcttggacagttttgttagtttacctaaatatttcatttttagaggagctaataatatttttagaggagctaatatgttattgcgttcttaatccgaaattccacttgtacattgctggtacagagggaagcaattgacgtttgcacattaaacctgtatcctgcaaccttgctataattactaactagtttgggggatttttttggtcaattcttttgtattctccacatatataatgatgtcatctgctaccaatgatagttttatttcttccttcccaattttatatgttttgttccattttcttttgttcttgcattagttaggccttccagtaaaatgctgaaaaggagtggtaagaaatgacattcttgcattgttcttgatcttaatggcaaagagtctagcttctcaccattgagtatgatgcccactgtaggttttttgtagatattccttatcaagtttagaaagttcccctgtatctctagtttgcaaatagcttttttttttttttttttttaaatcatgaatgggtgtttgattttgtcgaatgctttttctgcatctactgatatggtcatttgatctttcttctttagcctgctgatatgatggattatattaattgattttcaaatgttgaacacccttgtagatctgtcatagatctcagttggctgcatgttataatttttcaatacattgatttgctcatattttattgaggaattttgcatctatacgcatgcaagatcttggtctgtagttttcttttcttgcaatatctttctctgttgtttgtagtagggtaatgctggcttcatagagggaattagaaagaatttctgcagtttcatccttctgaaagagattgtatagaactggtaaaatttcttccttaaatgttttgtggaattcactagtgaacctaactggagctggtgctttctctttggaaggttattaattcctgattcaatttttaagataggtaccattcttttcagactgtctatttcttctactgtgaattttactagctgtgcctttcagggaatttcagctacattatcagattgtaaatatagatttgttcataatattcctttataagcctttcattgttcatgagatctattgtgatgttcttttatttccaatgttagtaatttgtgtttcctttcttacttaacatggatagtcttattgattttttaatcttttcaaataaccatttttttttttgcttcattcatttttctctattgatttcgtattttcaatttcattgattttttgctctaaatttaatacttctcttccacctttggatttaatttgctcttctttttctacttttctaacatagaaactgagatgatttattttaggtctttttctcttctaatatattcattcaatgctgtagatttctcaaaacactgctttcactgtatccacacattttaataagttatattttcattttcatctgatttcaaatactcttgtgatttattatttgactcatgtgttactgagaagtttgtgtttaatttccacgtcttttgggattttccatctgtctttctgtcattatagtgtaattccactgtagtcgagagcaaatattctatgatttctattcttttaaatttgtaaaggtggctgttttatggcccagaatgttctgtgtcctggtgaatgtttcatgatagcttgagaagaatatgtattctgttgttgttggtggtggaagtggtctatagaggtcaattatatccagttgatcaatggctgcaatgagaaaatcccagaatcatacagaaaaaccttcccccaaattgggaggttgttgacaaaaaaaaaaaaaaaaaaaatttggacatgtccagtttggcgagtagatgggttataaggacttatatatgaggacctcctggatggcagcaggacagctttagagctccacaccacctcttgttcttaaactacttttaagcgaattttctgaatttttgtatattgtgtttaagtgctgagactatttttcttgctaggttctcagacactttctaggatgcttaggttctcaggaacacctgctacttggctgagccccatagccttggctcactgcctggtcttcaaggtttaggtggtagacatatacccttggctaatgggtgggagactcatcatgctacaatggtgctgctgagttcaactatgtccttactgattatttacatgctgaaactgtccatttctgaaagagggtattcgttcatttttattgcagtttactatatcactgtataaatataccataacttgtttatgcattgacctgttaaagatcaattggaacacctcataatatagcctaccatggtaaatatgcctggtgtacttgtaaagaatatgtattctgctgttttgcacaatattttataaaagtcaattaggtcctgttgattggtaatacagtttaaatcttccatatccttaatgattttctacctatgtgttctattattgaaagagatgtattggaatctgaaacttgaattatggatttgtctttttatcttgcaacttcaacgtattctcactgcagcaacttgtttctaggcctgaaacacttaaagccttggtctcgtcacacagataaattaggagttgatctgaaaaagctgggatttggtttggatctgtatccccacccaaatctcatattgaattgtaatccccagtgttggaggtggggcctggtgggaggtcaccggatcatgtggttgaatttatcatgaatgacttagcactatcccacttggtactgtcctagtgaatagaaagtgagtgagttctcacaagctctggttgtttaaaagtttgtagcaccagctgcttcacccgctcttgctcctgctcctgctgtgtgagacacctcactttccctttgtcttctgccatgattagaacttcttgaggccttccccaaagcagaagtcactatgcttcctgtacagcctgcagaaccatgagccaattaaacctcttttcttataaatccaattaactctcttttctatatttctttatagcagagcaagaatgcactaatacaggccaccatagacctctgaccagcagttcatatttggtgcttactgcttaattatttgcttgaagataatgagcatttattgttgcagtagcaattagcaaactcctcaacaccagcgtaggtaatataaacataatgatagcactgaaagttttctgaagatgtctgttgcaaaattgtagcttcagaaagaaactaatgaactcatagaactgggagcacttggaatccacatggaaactcatttaccacactgcagatggtatgtctcccctgtgatgagcaacagcttttgcaaactggctgttgatcaggttcacttcctaagtggctcctcaggctcacatatgattacgaatggaaagaaaatttcaaggaaatagtgttgatgttgggctcagtgggataaattgtatttaagaaaaatgttgaagataatgctctatttgaattggcattattttgcaaaatactaaacatatacatttttctttccataggaaaatattaattaattgtctgtagggacacaaaggaagacttgcctgtaaaggcacttaaattaaaatgaaatgaatctcagagtaatagcttttgaaatctgaagatatgcctgaaaaagaaagctaatataaaaatcgagctaacgtttaatattaaataagttagtacaattaagtaagaaaaagggaaatgacaacatatttcaagcatgtgcttcttccaggataaagtctcaaactttggggacttttagtttggtgtgcatttgactctttattggtaataaaagaaataaagtataggacaatatagaataccaggaaagttgttcacattgggaattttgtaagaaatatgtccaaaaataaaaacaaagactgttgactcataatatatgctacatggtaagacattttatcatatcactaaaaattaagtcgacctcttcactttgattaagcaggagaaatgctgtagtggaaaagattcaactcaactctcaatccacctctgactcttgcacatgcttgctctctctctctgtctctgcaggactattaaattggtagaaaaaaaaaaaggaatgaaactcttgagcccttatttgtgttcttgcttgagtgttgacagcccgaatctattgccctgccgagaatgcctcgggctagagagaaaaaagccttcattcatgataaaagctccttaggctcagtttacttttccaagttagctttaaagtagttgagatacagaactgcagggtctttgctaatatatcaaatctaaccttttttggggggaaaaaagttaactttagaaaaccggtgctagatgtcagggttggaagatgggaaggagaaaggttgtgtattatttctattatctaaatctatttaatcctataatctgagtccaacacttgtagaattttatagccatttgtgaatttaatataaaaggatagtgtatatatatatatatctactcacattttatgatgatggtgacattgctaaatttaaaaaagcatactaaaaattgctatcttatttgaacaatattaagtaaatctgcatttcttagaattactataaagtacacgagagctttgaaacatttaaaatgaagttatatatgtgtgtgattttattttgtctaatgacttgtttgttccatctttgtttcccatcactcagcactgttcctagcacccagcagttgcttggcgtttgttgattaaacgactgacaattcctgggactttaaaagagttccaattcaatttccattcaatttaaacactgaatggaaaaattctcacaccactaattgatgcttttgccccatattcttcccacagcaaaatgagtctttcaacaatgtcaaccagattccacattcaacattgtgcactcaatttaacattccacattgtaaaccagattccacattcaacactgtaaaccagatcatattcttcccctactgactatcctctagtgttccattccacttggaaaacacaatccagatttcttgccatggtctacaagaccaacgtgagttggcccagtctgcactccactcctgtctgccctcttcaaagcactgtcctcctttcagctcttcagataggccaagctctttctctgcttacgatgccttgcactagctgtctcattagccgagagagctctgccccctggtcctttgcacatctggctcaatcttgccatttggggctgagttcagcatcctaaagcagcctcccacccttctcttattgtttgcatgatgacatcccatactgatctccatcatggcacttattggtacctagtattaactaagaaatttatttctcttgacatactgcgcccaatgaaccccagaatataagctccataagtccagtggccccctcctttttacaactgtactctagaacttagaagagcgccagcacattgtatggcttcattatctatatatacagttaaaaaattatatatacaagtaaacaaatgaaccatgaataactgaatggataaatgaatgggaaatatactatcagccaatatccaaaaattatacatatttagaagaacgatggaaaatgagcatttaaaaaaacagttttaattttgcctgaaaaagcaaggttgctattagtcatttttcaatatttaatgaagggctgtgcatttaaagaaatgtcactgctctcaggatacagtgcagtgagtggtcatgttgaaataacacacagtaaaagatgtctcatagaaatttgactatatgacgttttaaaaaggccatggggttcattctttcatgctaagaatttagagaaatattcactaacaacaacaatgcaagtataatagcagacacatttcaggcaagaaatcaaaactgttgaaaaaacttcaccgtcccagagtataatgtgatagtatgacacatgtttcttgagctagggataggggaagttttgtgaatatacttctgaaaatgaaaaaccaagcttaatgggcaagagttttgcagggtctccaagtctaaactttaataggtaccacttaaaccgttgatggcagaatcatcaattaagttttatagcagagctgagtaagaaatcaatcaacaaaatattagtaatccatctgctcatcacaacaaattctggcagacaacattattaccttaatgatatgatattggaaggaaaaaaaataaggaaaacggcttagcatctcccaaaggcatgcaatatggttccaaatcaattcgaatttatagctatcctgagttctctataataacttcattccacaaacactaaattttgaacacctttttaaaaagccagaatcaatatacatccaaaacaaccaggtgctctatttacatgtcattccaatacagcagaatgaaaagctttcatattcaacccaagtttgaaaattatagctgtggatatattttcagatgtcgctaggggagcatttataagataccacacacttaagcaagatactaaaataataaatgaagttcaactgaaaaaactgcaaagggataagaggcataactggattacctaagaccaaaaaattgaattcctcctgagggtatccaggaaagctgagctgcaaagtttactatgaaaattcctgtaaactctcaggagactatagaagtcaagaaattagagaaagatgcacatatatgtgtatgaacatttggcaccagatagtgagacacggagacgtgtgcttggaggcagaatgcctgctatttgtctcttcagccccatttcccaccattctccacctgcttcgtgccccgggggccccaggacgctaccctacatgggctacatgagcttcttactgattttggtcaattggtagcagctacaaaagaaaatggagaaagaggtaattattcctcaggcctcactaagtactcaagccaaggctgagaagagaacagtgtatcgaaatgcatcatgttcagtgttgttacacaatcatttaccaccagatagaagctgcagcaggaacttgaacaaagtctggtggttaatgaaccccaggagaatctggaaaagctaagggtatcacacctcagttatcagtcttccttggatttaaaacaaaattctgtatggaacacttcccaatttaaaataaaaggaaatagaccatgagaatagaaaaatacatcctgagaacttattatatgagaaaaagacaccatggccccagtgaattagatcctggcattagaataggaatattatttatttagccttacaatatttgaaggggattttaacaggaaagataaaggaatatgactacagtagagaaaaatttaacagtctttgagaaccaaaggaatctggctggatacccttgtaagagttatgtgggttcaggagcaaaataaactatgtaaaaaggatcataaacaggtgaggtgtggccaagcgcagtggctcacgcctgtaatcccagcactttgggaggctgaggcgggcggatcacgaggtcaggagttcaagaccatcctggccaacacggtgaaaccccgtctttactaaaaatacaaaaattagccgggtgtggtggtgtgaccctgtaatcccagctacttgggaggctgaggcaggagaactgcttgaacccgggaggtggaggttgcagtgagctgagatcacgccactgcactctagcctgggtgacagagcaagactctgtcttggagaacaaagcaaagaaagaggtgagatactacattgtctagattcaaccttggaaggtaagtggaaattttgacataaaaattgggaaaaatggaaatcaaagcaatgaattcccagaacactgtacagaaattatcaaactgcataagctaatgaaacacctacatgacaatttcagcaaaatgaaaaaacaaacccacaaaccacaaccgtcagaatcactattcttcaataacttatggcaaaaaaggaggtaaaaagatgtcatttttccacaaagaagaaaagctgaagctcaaacacagactcggaggttttttgtaacctttgcacactaaatataaaaattgcccttcacaggcacacaggatgcatgcagtgaaataaaagtcctctcgcggctgggcatggtggctcatgcctgtaatcccagcactttgggaagctgaggcaggtagatcacttgaagtcaggagtgtgaaacgagcatggccaacatagcaaaaccccatctctactaaaaatacaaaaattagctgggcatggtggcaggcacctgtaatcccagctactctggaggctgaggcatgataatcatttgaacctcagaggtggaggttgcagtgagccaagatcccaccactgcactccagcctgggtgacagagcaagactctgcgtcaaaaaaaaataaagtcttctggttcataactaggtgtacttgtaaaagttgtttataacttcaacatctgcatgctaacttcacctacgcttggagttactatttaatgaaacaaacaacaatcttttagaggaagcaatggaacattttagaaatgggaacaatgtctcttgtttgcctttgctgcagatgtcacttcctctggctcgtgttagcacagggagacccctcgcagaatcaatcaatttgctttggaacaaatttctgatatatatattatatatacataatatatattttatatatttattatacataatatatattttatatatattatgtatgataaatatattttatatatttattatatatattttatatatttataatatataatatataaataatatacatttattatatgtaatatacatttataatatataatatataaataatatacatttattatatgtaatatacatttataatatgtaatatttatgatatataatgtatttataatatatattatataatgtatttataatatatattatataatatattatattatatattatataatatattatataatgtattatattatatattatataatatattatataatgtattatattatatataatataatatatattatataatatattatattatatataatatattatataatatattatataatatattatatataatatactatatattatataatatattatattatatatattatattatatataatacatattatataatatatattatataatatacaatatataatatattatataatatattatataatatattatataatatatattatataatgtataatatatacaatatattatataatacataatattaatatatataatatattataaaatatattatataatatattatatatactataatatattaaatatataatatataatataatatataatatataatatataattaatataaataatataaaatatataatatatatttataacataatatatttataatatatattataatatataattataatatatatttataatatatattataatatataatatatttataatatatattataatatataatatatttataatatataatatatttataatatataattataatatatattataatatatactatattatatataatatagtatattttataatatatactatattatatataatatagtatatatttataatatataatttataatatatataatatagtatatatttataatatatatttataaaatatgtaatatagtatatatttatgatatatttttataatatatataatatattatatattataatatatatttataatatatataatatattatatatttataatatatattataaatatataatatattatattttataatatatatgttatatatttataatatataatatatatattataatatataatatattataatatatataatatatatttattatatatatattatatatatatataaaactttccagactgactttaagattggtttgatatttttattttctattttactttgttttgcagtgctatgaataattgacagatgactaaaataaccatctttattgttacagcaaaaaccttgatagcggtgtttgttccatagtgcatatttaaaaggctgtatttcagagggtcactctgggctaatgacctttcttcagattaaatatatatttttaaattttacaaagttctgggtattctaaccataagaaataactgaaagtgcataaacctttacaaaatagcaactatcaaattattttacttctacatataaaattagttttattgactaggaaaattgtactataaatgctgtgagaactttggagaaataattgatggatagcagagatttaggtagatatatatttagatagctagctagctagaggatagatatagacaatactacactacactgtgctatgtcatattttaataatgacacgcaaaatgctttccatgcattgttaaatacagggtcttcaacaactctaccatgtgggtactttcctttgatcacgtcatcctgcggagatgagaaatcgtttaaccatgatgtcagccttagtctgatgccaaagcccatatttgatttctttgggaattataaattttaaaacaacttcagatatatagaacagttgcaaaaattgtacaaagaactcttacatattcttcatccagcctcctcaaatactggtatttttttcacgtttagtttatcttcttctctcaatctttctctatgtacattatatagagaaagtaagttaaaaaagaaagtaaactaaaacaagtaaatgcaaagtaaatatatgcatatatacatatttaactatatataatgtacattattatatatctttatgtatgtaattactttttctaaaccatttgaaagtaactttcagataggatgtccctttacccctaaacacttcacttgggatttcctgagaataaaaacattcatttacataaatttttacacaatacttttctcaaaatcagaaaatactgatagaatgctgttaccttattgagcaaatctgatccttacttgtaaattgaaccaattatatctgtaacacccaagccccccaaattgaaccgaggaccacctgctgcattgagttttcatgtactttcagtcccctctgatctggaacagtccctcaatctctctctcatagccttgacattttctgttgagtgtaggccagtttttgtgtagaatgttcctcaatctgggtttgtctgatgtttatattaggagacacatgctatcgtttgtcccaatatttcagctttgatcatttggttcaggtggttcctgccaggtttctccactgttaaggttcctgatttttatttttatgttgaataagtgttttctggggcgacaaggctatgcaaatattctgctgttaatcaaacctctacttaccagttttagtatccattgataatccctgcttgaatcaattattagtatgatggttgccaaactgcagtttttctaaatgaatcaatccttctacatgtggaattttacagagaggaagagacttctaacatttatttatgtatgtatttatttggttatatcatacagacccatggattcctattttttactgggttaacatctattggtcataatatcattatttattttgatactcaattcccctagagtagccaatgggagccctctgaagctaaatcccttgtcttttggatacgtcctcactgttacatgcatccttctttcttttctggtgtaagaaaaatgttccagcctcctattatacttttccggctccaaccccagaatcaaccatttctatgaggagccctagtatttttagtggagaaaatgttcagaaactgagtgccaggtgtattcattcctagtgggatgtcattgcttccagatattctcaaagacgaagctaggaaatgtgtgtgttatacacaaaaatatctttatgacaaccccaagtgcatagtgataactgtgattccaatcaagcatcacagtgtttattcgagactcttctttttcaatatctgtagcttccttctgtgacactgataaatctgactctggttatctcaatatttgttgtttatcaaatttagaatacacaggagttatagaaatgacaactcagaacaaaaacaaaactacttattaaattcatttttatattgagttctgactttatgctaaaagtatgtagtaaataattcagtgggtaaagttatttggaaatttccttttccctttcactgtgccatattatctatttgaaatactattaagttcatttgtttgcatttataattggttttagtttgttttattctgtgtccttgctgatttttttaaacataatacattaacaaggttccaaaggtcaaagctatacaaaaagattcagagaagggtcactgtcctaacctgggccctggctgggcactgctaccccctcgtacctcccattcagttcctactcaccccccatcgggaaatttatctcacttgtttctggtttattcttcccatttctttgataaaaatcagcagacatgcatactttcagtgtggggcctggttaaaaacccacgtgtgacatttcaggcggagcatgggcagttgagcaaagctgccctcccacatgggattcagagcacagccagagccctgcacagtcaaggtttcagagcccccggccagtcaggcttttttacgtactcacactgctacatacctaggtctctagctgaggccctgggcaaggccctcttcaggcgcctctgcagaggcctccttccaggaggaggggaaaccttgaagacatgcttcctcactgtgactcagtccactttgagctctcttcacctggccacagggtccataaaactgctggagccttttgttgggtcacgcatgtccgcacggatccacctgacccttgaccagtgcaccattccatggaggaaacaggaacggaagcgagctggtgcttcctccctataccactccctatacactgcagtgagtgatgaaaggtttaactcattaagggcttgttgctttaaatggctactctgacacctggctctctctcccagctgaggggagctccttactccactccactcagtccccttcactcctgcaaataagataacacaatacagatcacctttcgtattttttttttcactcagcaaggtagtccttaaattactccacctcagtgtgtagaggtctttctcatgcctttttcccagctgcatagtactctattgaatggttgtactctcccggtttaggcaacccctaggttgtttctggtatttttcaataacaattactttttgtataatatcatattgttgaaagacaacatgttcacgttgtagaaaacatgaaatttaaaacatattatcttgagtaaacttgcagcatgattttaagaacagcaacttttgcgattgatccttttgaaaattggaagccaaccgttcaaatttattgtcaagtgtttcctctagtgaagtggtggggaaggtttctttgactgtgagttctgaaatgttaggctaacaaatcgctaaactgtggcagtggagaaaaggaactcacacaagtacaccgctgagcttcattcttctgggagaaaaaaggcttctttgagattatatgattggtttcttttccctcaattgcagtaacaagtatatgggctaaggatgatgatcagaaactagagaaaaaaagagctatgtatcaaaggtaactgcaaagggaaaagtagtatggcaatcccagctttcaggcagaagcgcagaaccaactcaattcagggctgtaatattctcccgttcaaggtccagtttcagccacagcctaattttcaacaggaatggcatttgtaagctggagattgtcagctacgctcttgctgctgaatcctgttttcaatgcatccctcctcccttcctttctcccctgtcaccttccactgctcacccttctactctctgaaattgaagcaaattacaatgtactctatagcattccagctagaagaatgaaagagttattcagatataaagaacataatacaggaaagtccttcagtgagaaaatggtaagccgagaactttcaaatttcaagactgaaagtatgaatgcttatatgttacaatcaatatataaggctgaggtcagaaatcaaatgtaaatgacatattcatggaaagtatctactcgcagggtaggatattcttagagatggaaatcaatttgttgtaaattgactgaagttcatttacacgaaacagaacctttgtacaatagagcataaactgacaagataagtattcattctgagactctaaaatggaaaagaacagttcaaaactgccaagatgaaggtctccatctggcatttcaaatttgctgatattttatgaaagtcagttttatgttatagggcaattttctgccaaagaaataaaaggtgggactaattcttgtttaaaataataataaaaaaaaactgaatccatagcaaaggcgacacatctgttgttgttccaatttattttctgtaagccacattaattatacatatgaatcacatacatgaatttaattcaaattaataatagactcttgaaaatacaggccgattagaaaattactgagcattttttccatcactcactttccatacacaaaatgtaacttgccttggaacccctgcagactgccccttggacaaaatatcctctttgaaaggggataaaatgctcctcctgtctttcttcttgtcttgataggtggaaagtgcacaggactcctgaggtcctctgactgtcccttgccaactttcatctcccatcacgaggagggagaaggttcttatgatggacaacatttgattccttagttgggccatgtctattgctagcagggccaactagaagtagggtattagatccatgcaagttaccctggaacactctcctcgtggctgacccatccccactggtcactcaatagtaacaaccctgagatcacaatttatatatggtgagagcctgaaggttgtcttcggtctcaagcccaagcatgccatggagtcctacctcgcctttaccagggagatgtcatggagctttaggcacaggatcctggcgataaagcagccctcactgctcatctcacagtagtcccttctgcatctgatgctttcaggatcatgcagtaacaagaggggatgggcaggatggatgcctacccaacacgccaactccaccttccgaaacctcacacacgcggctctgaaattcacacacttccactcagtcaactgtgtgtgtgcaactcaaacatccgcctctctcccgggcctgctcaaatggccccttattaacaaagagtttgtcttaaatatctaagatcatagcatgtggattaattttttgtgttttacattttgtgaagctcatttcattattttgtgtggcttcatgaaaatgttgtaaatagctatttttagaacttccatagggagatatatcttatggagtcagctccctagggtggttaagagtctgtacttgggaatccatcagaactggtttgaaattcaggtctgggaatcgctagttatgtagcattaaatgtttgctaatctaggcctagtttacatgcatgtacatgttacaatgaggaaaatgacccttaccacatagaaactatgagggttaaatgggatccaatatgtgtatagaaggcatgtggcatggtgcctgacaatattaagtgccccataaatcatatccattatgttcatgtcataaatattgtagaaaaatctaattctgactaaatgatagaaaatcaccacattcaatgtaacactgaaaattttaaccattgtaactataactaaatatttcaagaatgtttgaaaaaccatggtttaacatttcatgcgatcattcttcacgacaaatatagtttttctcatcagaggctcaacagtatgggcttttgtatctaattaattcagatattttctccattacagtaaaagatccccttgggaaaatcacatccatcatcttctgaaacgttgcctgtcacagcaagggactatatataggcttcaaaatttcatacttaaccttttctgtcacttagcgtttctatttcttttttgatttctataagacaagctgcattcatcttaaaataaaccaataccaagcatgaaaaaagaaaccccgagagagcctctgttgttcctatgtgtcttgctgaggtagctggctgtctatgtgcaatgagcaccatgaccctgcgggaaagatctggaacagagatgaagaacacaggccataataacttttatttttatttttattttttttgagacggagtcttgctctgtcacccaggctggagtgcagtgacatgatctccgctcactgcaagctccacctcctgggttcacgccattctcctccctcagcctcccaagtagctgagactacaggcgcccatcgccatgcccggctaattttttgtgtttttagtagagatggggtttcatcgtgttagccaggatggtctcaatctcctgacctcgtgatccacctgcctcggcctcccaaagtgctgggattacaggcgtgagccaccgcgcccggcccataataacttttagacagacaaagtcaaagtcttgaggctcaatagctggtttaaaacaaatgcacatgtgctcatatcccattcttgggagatgtggttaaaataagaaaaactaatgatgagaggagccatttttgaattacttggagtctaaattatcaaatattttgcaagaaaagcatgtttttattattttcagtcttttatggtaatacgaattaagctctcataatcttgacagatgtgttttaggacctgctttaaaacagcaacaggaatgatttacaattagtatagaaaattgtaatgtgcgaactgatcatttcaaagtgatttctcagtgtgctcagctttttataataatctctaattgtatttatatacttaggatgcttttttgtcctcccaagagccaaaacctatcttgagtatagctctctaccattaaataaatcctacatgagtgggctctgcaataatgagattactatgtaatgactttatgttatctgaaactctaagttaaatataaaatctagagcactacacttagcaagtcacctgtttttatattattattttctcataatttagccttggtgcactagctgaatatcacatcattctttgcctattatatcactacattaaaatatcacaaattcttcttatgtaaagcatcacatgcttccttctagaactttggtgatcaaccatacttagatggtttactgactcatacaacatttcaggaagagctaccaaggtattttctttctactatcagaatgaaacactagggctaaaattctataatcaaatttacatttttatggagaaaaacatgaggtacacagagaccaacaaggttattcatgacttaagcattaagtgccaagtctctccctaaatatcttcctcattcacctttccattgggccctgcatgcctgtgtgttgaataagtaaataataagtgctatagctgttagagtgtcattagaatctccagaaccatgtaagacatgggctaaggagctgaaagaatactttgaggggcactgaagtgtttccaactctggcatgcctcggtgcaccctcaagctcagagatggattgaaaggcaccgttcaaaacaagtctcccagcagcctgctatctacagatcattgaaatgatatactgcaataacttcccctggaacgcttatggcttattgcgctgatgtgtaattaatctgctgagcagtgacaggacccagctgaagagtgcttctggagcttttaagatctggcatgccaaagaacacttggggagtccttggtccacgctttgttagcacaacagactacaacgagcctttaatctgtgattgcacatatgctagataactttatgtattaaaaatcatggctgggtatggtggtcacgcctgtaatcccagcactttgggaggccaaggtgggtggatcacctgaggtcaggagctcgagaccagcctggccaacatggtgaaaccctgtctctactaaaaatacaaaaattagcctggtgtggtggcgggcgcctgtaatcccagctactcaggaggctggggcaggagaattgcttgaaactggaaggcagagatttcagtgagccaagattgtgacattgcactccagcctgggcgacaagagcaaaactccgtctcaaaggaaaaaaaaaaaatatcacaaagtggttttgctcagccttggtctaatgtcagcagcacctgtaagtgcatgtgcatttgtaacctgtgctcaaagttgagaggatggagggacagcagactcttcctgcggagaacaactgtgtttttgtggcttggtcaggcttagagagctcattaggctccagccctgcaaatctgtgactgcagtgcacttctgacttgcagtaaacatggatagaatatagggagagcttggatggaactggaattgtcagtgacagaatgctgactaagtgaccaatgaatcaaaaaaaaaaaaaaaaaaaaaaaaaacagataaaaacaaagaaacatacaaatgatgtctgaaaagagcaaaatcctatttaaagatatgaatgtttttctagatattcttttgtacatgatactgaaaatattttcatttgaatatcaaaaagtggttgatgaagttggatgtagctgataggctaaacatacatatcttggttctttcacaatttcaaagcagttggtaagggacagatatatatgtaggtaaacaaaaaagttcaagcttatcagcatctactaactcgagaaaagcatttcaaaaaacatcttaaatgttgaaattggggagttaacagttaatatgtagtggaattcagaaattgatttttttctcacatataggactaataaagattctccccatatttctacattttaaaatttaggaatgccatgacaaacaagaatagctctctttgaattttctgttaaaatatgtaatgggcccggcgcggtggctcatgcctgtaatcccagcactttgggaagccaaggcgggcagactgtgaagtcaggacttcgagatcagcctggccaacatggtgaaacctcatctctacaaaaaatacaaaaattagccgggcatggtggtgcgcacctgtaatcccagctactcaggaggctgaggcaggagaattgcttgaatccgggaggtggaagttgcagtgagtcgagatcataccactgcactccagcctgggtgacagaacgagactctgtctcaaaaaaaaaacaaaaacatatatatatatatatatatatatatatatatatatatatatatataaaatatatgtgtatatatattatatatataatatatataatatataacatctatatacatcaaatatatatataatgtacttaattgataagaaaacagataattaaactatcatataaaaccacacttaaatgactaaaaatctgatgctttttaacaaaggctttcaaataattggtcagtacaaattcaaggtcatccaatccctttatgctttatgaagactagaatctgttcctctcatactttttgatgtcccggcattacagggaatatatatatatatatatatatattttttttttttttttccttaagctcttttttaaaataatcttttaatttcgtttccatgaacattttgaagtcccttcctccgtgactaaaatatccccacatgctcagataagaaacatattactcatccgaagtttctaggatattactgtgcgtacaaatcacctgatgatcctgctaatatgcagattttgattccctacttctgggatgggttgagatcctgcatttcttctttttaaattttaaatccaggtggtacatgtgcagttttgtacatgggtatatcgtgtgatgttggggtttgggctaccattgaatccatcacccaaatagtgaacatagtgcccaataggtagtttttcaacccttgcccccttctttccctccctactttagaattctccagtgtctattgtacccgtctttatgtccatgtgtacccatcgtttagttcccacttataagtgagaacatgcaattatttgattttttgtttctgcattaattcccctaggattatggcctgtaactgcatccacgtcgctgcaaaggacaggattttgatctttttttttggctgcatagtattctatggtgtatatgtaccacattttctttatccaatctaccattgatgggcatttaagttgatttcattactttgctattgtgaataatgttgcaataaacatatgagtttttgatagaatgatttcttttcctttgggtagttacctagcactgggattgcagggttgaatgggagttctatttttagttctctgagaaatctccataatgttttccatagaggttgtgctaatttacacgcccaccaacagtgtataagcactcccttttctctacatctgcgccaatatatgttattttttgacaatagccattctgactggtatgagctggtatctcatgtggttttcatttgcatttctctgatgattagatgttgaacatttttaaatatgtttgttggctgcctatatgtcttcttttgagaagtgtctgttcatgtcctttgtccccttttaaccggtctttattgttgttgttgttgatttaagtttcttatagattctagatattagtcttttatccaatgcatactttgcaaatattttctctcattctgtaagttgtcagtttactctgttgattgtttcttttgctgtgcagaagctctttagcttgtcaatttttgtttttgttgcatttgcttttgaggatttagtaataaattacttacctaggtcagtgtccagatgagtttttcctaggttttcttctaggattttaataaatcagtgccttacacataagtctttaatccatcttgagttaatttttgcatacggtgagaggaagcgttccagtttcacttatctgcatatgcctagccagtttcccagcaccaattattcaatagggtgtattttccccattgttgatttttatcaacttaccaaaggtcagttgcttgtaggtatgaggctttatttctgggttctctactctgctccattgatatatgtgtccatttttgtaccagtattgaaatgggaaaggttcccttgtccccctagcagggcatgcggtgggggtgtggcttgcttcttcagagccctgctgctccaacctctaggtgaacatacagacgggcaggctgtggggctcccaccccacagcagtgtctcggggtgactgtttacagctcctaaagccccagtgggcgtgtgttacagggtgttctcttagtttgcctacgggcaccttgtgttaatcaactcaattagagcgtctaccttgttacaaggacagagggctttctgtatccccagtttcttgccttggtgtaccagaagaatcagatcacacgttggcttggcgaatgggtgcaaagttttactgagtggaagtatctctcagctgatggggcagcaagaaggaagacggtttttccctggagtcgggctgcttcggggccagggctctcctccgaccgccccagccaaactccacgtggttctgctggtcgcctgccggtgtttgtcggtgtgctcttctcctagcctgctcctctcctcgccctctccacgactagcggcttgcatcttcttccgccgatgtgctcctctccatgtctggccgtctgtgtgtctgcctgctagggtatcgggtttttagagacccaggatgggggtgtggcggaccagggtggtcttagaaaatgcaacatttgggcccgaaagcaggactacctgtcttcacctaggtccatgggggtggagccgtagccagggaccacgccctcctttacccagcacttcccttccctccctatcatttagaaggaccatactcttccctttccagtactcctgtattagcatcatgctgttttggttactataaccttgtagtatagtttgaaatcatgtaatgtaatgcctctggctttgttctttttgcttaggatttctttggctatttggactcttttttggttccatatcaattttagaattgctttttctagttctgtgaaaaatggcattggtatattgataggaatgacattgaatctgtagattgttttgggcagtatggtcattttaatgatattgattcttccatccctgaacacaggatgttttccagtttgtttgtgtcaggtacgagtccctcccttcctccctccctcccccaaccctttttttttttttttttttttttgacagagtttcactctgttgcccaggctagagtgcaatagcacaatcttggttcactgcaacctctgcctcccaggttcaagcaattctcctgcttcagcccccaggtagctgggggtaattgcatgtgccaacatgcccagctaatttttgtatttttagtagagacagggttttgctatgttggtcaggctggtctcaaactcctgacttcaggtgatccaccggcctcggcctctcaaagtgctgggattataggcgtgagccacagcgcccagcccacttatttctattttaaatttttacatttaccacttttttgttaaaaattaaaacagagttttgtagttctccttaaagagatctttcatctccttgattaaatgtattcccaggaatattactttttgtgtgtaaggctcttgtaaagcgaattgttgtcactatagtgaacaatttttagactcaggaacttctaaaaccacatagatgcttcagttctgaactctagtgaccttggtgcagtcccaaacaaagatctaacttttacacctaagaatgaattttgagttcatcgaagacctgaagtatttgcaaaaacaaagagaaagcagtcttataaattagactaaactgtaagcatctcaaaaataagtccagtgtttcattcctttgttgtttatagtcagcacgtgcaccaaataagtctttttttatattatgaaacatttattacatatttttatatatgtatataacttctatacgtttctatgttgtgttcatgtccagattgtatttttttttttttttttttgagacggagtctcgctctgtcgcccagcctggagtgcagtggcgcaatctcggctcactgcaagctccacctcctgggtccacgccattctcctgcctcagcctcccgagtagctgggactacaggcacctgccaccacgcctggctaattttttgtatttttagtagagacggggtttcaccgtggtctcgatcttctgaccttgtgatccgaccgcctcggcctccgaaagtgctgggattacaggcgtgagccaccgcacccagtctgtatttttaaattatgtattatttataaataatttcagaagattagtatactctcatttgaccatcaaatctgcaaaggtacttttgttttcttccttcctgtgcagtacagaaagtgagccttttctaatccgtgtcatgtctctccctatatactgtccaattcattccatctttttagtgacttccttctattgactaccctttcttgcagtgtcaactttttaaggaaaccttgtcagtgaattctgtgatctcccagtggccatatccatggtgctttttttttttttttttttttttttgagacggagtcactctgttgcccaggctggagtacagtgccacgatctcagctcactgcaacctccgcctcccaggttcaagcgattcttctgcctcagcctcctgagtagctgggaccacaggcatgtccacacctggctaattttttttcatatttttagtagagatggggtttcaccatgttggccaggctggtgttgaactcctgacctcaagtgatccacccgcctcagcctcccaaagtgctgagattacagacatgaggcactgcccccgggccatggtgtgtttaatgtgcttttaaatacaggagcaatcaaggcttggtagatagggagatgagggccaaacaagcagttgcaaaccactattgcagtcaaggaaaggttaacaatcctttcttagcagaacagacatgggctcgcaggtcctgtcaaatgaaattacttgtcagcatagctacatgcagaatagttcaacagcctggaagccagaaatctgagcttcttcatttcttagttctttcagtgaattgctttgaaatatgttgacatctgtgtaactttgtggactatcacttccgcaactccgtgaagacagagaactcttatatgtattcgcgtattcatagacacatgacaaatggaaggcaagttggctttccctaaaatgcggaggcacacgtgtgatgccttctgctaacactgcaattatgtactcataatctctcattgtaaatagaggcagatgaagccactccagctctacgtcaactctcctggaaagaaccagaatgtaggtcctgtaacctactgagttttcattggcttcatgaacacgtatgtcctgcaatcttgtggacctgtaagctcttcatgcattaagacacattcactttcagccacctcaactttcctaaaagagatgcttttgctgtaaatattctaaagctatttcagtcaagatgttctgaagctatattacttagaaaaatgcttttagtagggaaagtggagctccctaaaggcatcttaatatgtacttatctgctttgcttttttttccccccacaaatggcattcatcaaaataagttaaatagtaatggcttgaaacgtaattgtgctgttgtacgttctccaactgtgtacattcaacaaaccttggaaaatttcagatcacatgaagagcaaattattggtatgttgttggcaatcaggattaagttgccagagtcatgttgcttaatagcttgcttttcataaaataatgatggtgagaagttaatatttattgagtctaccgtatgtgtaatggactgtacttcaggcattttctcatttaatcatgataacaaacctataaactagaaaccactttgaattcctagttaatagataatgaaactaaaaaagagagataagcaattttgcctgtggtcacgtggtatgctgcggtctagagctgggattcaaatctgggcttctaacttcagaaccctcacttatgacctctctacaaattctgctctccccaaaacccatgtcaatcgttagtgtttcaagactctaagcattattctttctatatcaagaaattgactgtatttttagtctccatacttcataggaattcatcttatgattcctatgtttttggatatcctcctctgtatgtttaaccatgatattaatcttgacatgtttcaatgttataatcacagaacaccctaagttgatgttttgcaccatcctcataaagtaaccatgtttgtggtccctctgggcatctatcctgtcagagaattgctctgatttccacttattttcagttcctgcgagtgcgacaaacctctgtatattcttgtgtagaaaaaccagtcctcaggcaaaagtagaataagtaagcaatacctttatcctgttacaaaactaaagaaatatcagcaatttcttcaagagcaagctcatgtcacttcatctgttaatccttcctgactatgccaggtgaagttaaccacgcccaaatttgtgtttccagatatgccatataacactgtaagtgattatactctgcaatgttttaatacatctgcctttctcataagacaataaatacttgctggggggtgggaaggggcatgcttatttctatattcacagatcttagcacagttgctgaggttgcctccgtgcttaatacatggttgtggaaagtagggagaaagtggagaggaggaagaaggggcagaaaaggagagagggagggaagaaggaaggtggggaaggaggaatagattaattacattaacttggagtgtggtttatattcatactagatgttttgatttttccataatttcccatattgccaggataaaaaaaaatcacataagaaatatactccgaatactgcctctgacccagattccaaagaacagaaagaaagatggtcagaaacactgagaactgtcatgtcattaggctttccaggagaattctgtacagcttcaactgtgctcttttagaaaagccaggtgttataaaaacttggttgtttattgacgtattttatctaaaacatggttttaaagtgtgtgcgtgtttttaacctgataggtagaagctagaacagctgccatttaaacattgccatcagttttctatcttctataatgtggaggcttaaattcccctttggaacaagtatgtcaatgttttcagtgaaccatctaaatggacattttagttaacacaaagtgaaagcaaagtctgtgctctgaaacggagaggtttggggcgaggcaggggaagacaagctgcaggtgcatctttgctggttctatctccattgatgacggagccctgggccggctgctgtgtgctcctgtggaggtgtgcgtggaaacttccgggcacggaaatctttctttaggaaataagcagtaggcaagagatggaagaagctgcttcctttgagagactctgaggagctacgggcacaagcattattgctttagggagctggctacaaaatggagcagtgaatggagggaaggacgctgtccaaagccacacagagcccagcatgtctgggcacccacaggcattggcttgggaatattgggagctactaacctggaagtggatattggtgttttcacatgggggacccgtagcaaagccaagagggtggcgtttgactggcttcagggtgacagcaaacagtggacatcgcccaggaggagagctcaggaatgaaacatggcacaagccatgtggaaaccaaagagaagagggtgctgtgaacgcacatttcctgagctctttggagagtcccataaattattactgtggtgatgtttagaatgataggatggaatgtaccagaaattcaggtggaacaaacatatgtcattggaagtttagcatcaaccattaaagtgactgtatttgtgcccaaatacaatcagaactcctgtggcaggccagttatttgccctgcccttactagtagctcccagttctccctgcacttcagaatcacccaaggagctctgcagaaacaaacccacccacctccacccccacacatgatacagagaaattcagtcactgggtctgacatttctattttttaaaaaagaaaactttccaggtaattctgtcttacagatacttttattaaaaattgggttaaagtttgcagaaatcaattggggatacgcaacatcaaatatttaccatgaaggacctttcttcaaggttgtattttatgtctctcaatcattagtaaggcaagttcctgaagttaagggatgtggctttcacatccttgtatttcccacaggaggtaatgtgtggggaaatgaaatgcgtacttgtgctgctgaaatggcctatttgctcatcccagtttcctcgatggcaccgtgcaccgcactctagttcatccatgccagcgctctttgctctgctgagcaaagttgttcatgaggtttggctccctctctgctgggattttgcctcatcctttattctcaaccttgaccctgtccaatttgttcccactaaacgccataactttgtatttgcttaattgtcctggattatcttgggcattatttttgttgttgttatcattggaaggtgttaacaactccttcctagtatacaccataatataaaaacacattaattatgacatctcagtaatttatgaaaatagcaaatgctagtcccatgctttgtgacaggatcttgctctgtcacccaggtgggagtgcagtggtattatcatagctcactgtaatctcagactcctgagctcaagccaaccttctgctttagcctcctgagtagctgttactacaggtacacgctatcacacccagctaattaaaacaaaaaatcgtagagatgggctctctctatgttgcctatgctgtgctaaaacacctggcttcaggcaatcttctcacctcagcctctgaaagtgctgagattacaggcgagaaccaccgtgcccagccgctgcacctttctgttccatgtttttctcagaaccccccaaatttcccagacagctggctgaaacttttaatacatccctacaactaataatgccactttcttcccactccttgacaaatgatgttgcctcccatgttactgcagctccccgttatctgcccatctccactgatgaaatcactgctgggaattagaggtactctgaatgtaaaacggccccagttactggaaagatctcagaaactgtcattagtcatggctgcctcatgctctcatctggctggtcttcttaatgtcactgtaacatgtcacagtgatttgcatctttgcacctttgcaggaagccccttcctttcctggaatcaagccttctttttacccttgtacagttacaagccttcctccaaccttcatggtttaaggcctttccagcacttgccaaaacccttccctgcacactccctgttctaagtgcaactttttctgctgtctcagaatttgggcagaggctctgagtctgagaatcattgttcctaggcagttacagagaatgaaatgagagacctgagaccctgggctcacaccctgaagacaagggagcaaggtgctttaagaggaccgcagagagagagctctaggtactggaatttgtggatgtacaggtgatggacaccctcctggagaattaacgaaacatctctatcaagagcagattcttcaagagtgcagtctatgaatactgttcctgatcattacctctcctcagctcactccagcccctccaccctaattctggaggagccacgaaaggagtaaatggggaaggaagaatgagagaacaaagaaattaaaaagaaactatagcgcatttcctcctctaagataagactgagtggtgagagaggaagaagttgacattacataagtaacactttgatgttggccaacttgacattttgataatggaaaataaacaatgcagctgagatgtccagctcggatgtcctccaaggcctgagaaggacaattctagagtgatctaggaatggtgagaaagcctttggcttctttctgcacacacctttccaagggcacctattttttttttttaatgataacaaatggtgacaagaatatatgttatcattcaaattagactgcatgtttgaaataattgcccagagtgtccatctgctgctgtgggtatggaaggtactcgatcattattggttgagccccatcctccacatccctctcaacatctaatccttttttttatctctcataggcaagagcagcatttatagtcaaagcttatttacaaatattatgatgcaaaagtaagattatattcaaaaggctgccaaaagagtcacttttctttttcttttctttttcttttttttttttttgagatagcatttcactcttgttgtccaggctgctgtacaatcatgcaatctcagctcactgtaacctccacctccaaggttcaagcgattcttcttgcctcctgagtagctgggattccaggcacgtgccaccatgcccaactaattttgtatttttagtagacacaaggtctcaccatgttggctaggctggtctcgaactcctgacctcaggtgatccaccccactcaacctcccaaagtgctgggattagagttgtgagccatggtgcccaactaagagtcacttttttgtggatcgttgcatgtcctgaggatatatgaagtcaggcaacagaaagaaataccatgtcaagataattcagaacccagttagctgaaagcttgttctactaactacatgtgaagtaatgttctagttatttcagctgtaattccaaattcaaaattgtttacaccctctggttgcctttgtactcatggataaaacataactgtgtcatcaatattatctggctcataacagcttgctactaatgctgcaaggttttcaaacagctttagccgacagcacaagcagcgcagagtttcttaagggttaatttaaatgtttatatttaagaagcatattcatctccccttacaatatccatcagccatcttgcataaatgtatttctgctgctgtcataccactctttggagaattttatttttaacaatgaaaataataatattttaaaaccaccaagcaaaaacaaggcaaatatgatcataagattacctagtcatatacttttctctaaaaaccatacctattttgttctgtagaaaaggaattctaaggcagagatgggagtgaaggagagaacattttaaaatcaggagacaacagaaaacatgtctgaatcttgaggcaaagtgggggccactttgcagcctaggccagtttgtctgtcaaccacctctagagaggacaaaataatttcatgtttactagctactatctgctggttatcttacgtatataacctcattccttctccttgaaaatactgcatgattatcgcttcatatcgatgaaaaaagcgaagctgagagaggttaaagtaaaatgccaaggttctgcagtatagctaacggtcactgctcttggctcctttttcagagaaagcatggctagaagatcttgaaagttacagaaagccccatgagacaatgactcatctctgatgtgtggcagaatgagaaaccacacttacagtggtatcctcatcactcttccattgaaatgaacccaatgctcccacatgcaatccaacgagagataaatatgacaaaacaaagaaagctgcatgtttgaagtgctttccaagatgtcttaccacactcctgattgggactgtaatatccaagaagcttgacccaatttctctgagatcctggctttcccctaacctgacactcttgttttattcttggtttagagaattcttgcccaatctttctgcctcttttattccagacactggctcctctctcagctgtctcacatgttatgaatgatctcgcctccatcacttttcacagctctttacaagtgctgaccatggatcatattcgagtgtatcagggtctaggacaatgtgtttacattacagaaatatgactggctttcacccttctgaaacatctctttttatggaagacattcattgataccttcagtcttaaaaacttgttggcatagaagaacaggaaactggaagaggagttttttacttttatacttttatttgctaaatgtgttaaacccttaaatgtgctacatatgtactataaggaatgcacaccattggtcaactatcataatttatgctctgtaattcacaatgcatactttatatatatgtgccttagttataactaatatgcttctttttttctttaaaaataatatagatcaatgatatttaatgtttaaaggaattttaaagatcatctagccccaaaatatcatttcgtaggggaatttggtcaatatctctttaaagaggtagaatggaaagccaggttcctgagttctaatcattcccagaggttctcttgtagttaaagcatgattttttaattaattagctttcatcttagaaatcgttttttatcataaagctaattttcagacatttggaaaactgtgtgagttatcaacagatgaaattatgctgttcactcatttaactgttcattgtgtgttttccttccatcttttctatcttgtttatttattaatctccagaatttagaattatgccttgaaaacaaatatttgtagaatgcatgaatcaatatgcaaagtataagaaaggtctctctttgaattctgacatagccctatgaaatattataacatggaagctgccctttgatgtaactggtcctaattaaatcaattcagataatgtagtataaacgatctttgggaatacagtatcataatgtttgaaagttatgaaaaataaaggggagcagcaaatatgcatttttaaaagctatacacaaaattggcctcgctcacagggtcattcaattgtgtgtgtgtgtgtgtgtacacatacatatatatatatatatatagagagagagagagagagagagagagagagagagtgtctactacatgtcaggtactatattagttactttatatatttagcacctcagagcttgctgaaaacaacccttatggaagatgctattattattccctatgttaaaagtgcagaaactgttttcaaggtcactcaaaaagtagtgctggtaaaacagctagaaactgggtgtttcttgctccaatgcctttaaggctatactgtgctgtcttcataaattgatccacaataggtagagacaagtagaaacaagcatatttcctgcagtttattcatttccttcctatctgtttttgcataaagtttcacttataaaaattacacaaaacttgaaaggtgaacaggagatattaggcttagaagaattccttatgatgaagaacactttggtactgattttgttaacacacttttccaagtagccttataaatcaaatagaaataataattttaaaaaccctaatgactcaacatacttcattccaattgaaacctactggatacatgtaattcagagaacagattcttctcagttaactttatccaagactctaactttttcagtcaggaaaaatatagcccatatggaatgttaaccttttatcacggaattatgatttcatagcttcaaattgctggtccatgaggaataacagccgagagcttacatatggaggtaacaaaatgttaatgtcttagtccttttgcattgctataaaggcatatccgaggctgggtaatttaaaagaaaagaggtttagttcgctcacggttctgaaggctgtacaagaagcatgtcaccagcacctgcttctcttaagagcctcaggaagcttccactcatgatggaaggtgaaggggagtctacatatagagaccacatggcaggaagagaaagacagacagagagaaagagaggaaaggggcccaggccagagagagatatatatatatatagagagaggctaggctctttttaacaatcagttcttgcaagaactcatcaagtgagaattcactcattaccttgaggaggcaccaagccattcacaaagggtctgtccccatgactcgaacatctcccaccaggccccacctccaacactggggattaaatttcaacaaaagacttaaaggggacaaatatccaaactgtatcaactaaagaattaattttgggggtgctaggttttctcagaaactaaaaaatgagatataacttgccattatatgatctgtgtttaaagtacattctctctcgtccatatttctccaggatgatatgcttaacttaggtgttaaaaataagtccatctgatttattttcaaacttcataaaaaattatagatcatgtagaaaaattaatctgtgtgactagtaaaagaaaatgtgacagcaatttggagaatttactatagcagatattaaatatgttacaatgtattaaatgttagagggatcaaaataatacagttttcagggcagaatgagcagaggaatggaatagaacagactcgagagataagaccctcaaggttaatataataaaaagatgagatttatttcaagtcaatggggaaacatgttttattcaataaatgatgcataaaaagtaatttgtagatttttggtgagaaataagtaacattagattcatagaaacccttcacactaaaataaaatctgtatgaatcaaatatttaaatgttttaaaaagtgaaactgtaactagaaaagattttcattaaatatctccaagtgtagagaagatcctcctaataatgataacaaagacataacgccataaagaaaacaatacggccgggcgcggtggctcacgcctgtaatcccagcactttgggaggccgaggcgggcggatcacgaggtcaggagatagagacgatcctggctaacacagtgaaaccccgtctctactaaatatacaaaaaattagccgggcgtggtggcgggcgcctgtagtcccagctactcgggaggctgcggcaggagaatggcgtgaacccgggaggcggagcttgcagtgagccgagatcacgccactgcactccagcctgggcaacagagcgagaccccgtctcaaaacaaaacaaaacaaaataaagaaagaaaacaataattacatcaaaattatagtttaaataattttgttttgagatagagtttcactcttgttgcccagggtggagtgcaacggcaggatctcggctcactgcaacctctgcctcccaggttcaagcgattctcctgcctcaccctcccgagtagctgggattacaggcacctgccaccacgctcggctaattttttgtatttttagtagagacagggtttcaccatgttggcctgacttctctggagcttctgacctccagtgatccccctgcctgggcctcccaaagtgctgggattacaggcgtgagccaccacgcctggccatctgaaataattttgaaacgccttaaaaagacctgaaaattaaattacttactggtaaacatattttcaacatgtatgacaagaaatggtttcatacaagaatatatgaaatggtcataagaaacaaactataagaaataatttcttatacttactgtaagaaacttttatctataccgtgcaattataataaaagaaaataaccataatagtaagcaataaataatgaaaatgtattcaagcttcctagtaattggagaaaggcaattttacatgagatgtcatgtttcacctaaataattggaaaaattaaaaagaataaaagcacccagtgttagaggatgcaaagtaaccatactgacatgtagtttgggggaaagtggaaattgatggaaactttccagggtaccttttggaactaaggactctaacacattacatgtaaaatattttgccctttgcaactctactcccaaaattatatttcaaaaatgtgactagacaaattactagagatgtgtctaaggaagatcactaatgtgctgtttttataatgaaatgtagagcagcctataaacttatcaatgcaagactcttcaacaaaataaatgggatgcatcaccaaatgtgctcatagagacctgtatctcttgatatggataatgagcacattatatgaagtaaaagatgcaagttataaaataatacgtgagacacaaaaacaggtgtatgtgtatgtgtccgtgtgttttcatgtgtacacacacacacacgcacatggaaaacagacttggaagaatatgcacccagtgttaatagtgattatctccaggcggtttgattcaagaggttttaccctctgctttttttttttttttggttttgagacggagtcttgctctgtcaccaggctggagtgcagtggcgtgatctcggctcactgcaacccctgcctcctgggttcaagcaattctcctgcctcagcctcctgagtagctgggactacaggcacacgccaccacacccagctagcttttgtatttttagtagagacagggtttcaccatgttggccaggatggtctcaatctcttgacctcgtgatccacccgcctcagcctcccaaagtgctgggattacaggcatgagccactacatccggccttaccctcctctttaggtgaaagtacgttggctaatttttttttcagccaacattatgtttttataatcagaaaatgcaacatttattatgaaaataattcaatgaaaatgaggtataatagttttaaattacacatctagtatgacatttaaaaatgtgtggtattctggtaataatcatactggcacacagttctgaaaaaaaaaatagaaaccaataataaaacttttcctaagccattatgaccatgttattttttcctccagatcaactggtatagattattatctatgtcataataatctgttatataaaatgcaaattaagtacatttttatttaagaaaattacaaatgttacagtttggtacaaagttattgtcagagccacttaatttgaatacatgttatttgtagaaacggcaattgactgtgtaggaattatggcaaattgattgtagtctttgtggaaaaggctggagaatgccaccttctgaaatcaaacctagtaaaagtcaacacattataacaactatggtcataataactacaatttattgatcccttacaatgacaggctctgaagtaagcactttataccctttatcagataatgcttaaaacagctgtgtataatagtcacctatacatctgtatcaaaatatggaagctcctagggttgcaaaggtttcatctggggccaccagcctgtaagtatcataacaaaagttcaaatcaagtttctctactgtctgagctattgtctactaggctacatactaagcttcgtctcttttagaggaaaactacagaaaaataaaccatcagataaaatcatttgtaaatatgtcactgatgttgacttgaaaaatatgtacttagaaacctaagagaccagggtataacctcaggtagacatgataggatcacatttgatagatatataacttcatttcaatgccttgggcatgaccaagttgtgcaattagtaaccagcaagaggtggagttgacttgaaagtccttgctggccgggcgcggtggttcacgcctgtaatcccaacactttgggaggctgaggcgggtggatcatgaggtcaggagatcgagaccatcctggctaacagtgtgaaaccccgtctctactaaaaaaatacaaaaaatgagccaggcgtggtggcggacgcctgtagtcccagcgactctggaggctgaggcaggagaatggcgtgaacccaggaggcgcagcttgcagtgagcagagatcgcgccactgcactccagcctgggcgacagagcgagactccatctcacaaaaaaaaaaaaaagtgcttgctactgtttgtctgacaccattcaatgcaaagatatactttaaatatagaaataattctagccctgcctgaatgaactctctttcaagatcacataactctacttcggatgctttgatcattgctatggtttggatatggttcattcggccccaccaagtcttctgttgaattagatccccattgttggaggtggggtctggtgggacgtgtttggatcctgagggcagctccctcatgaatggcttagtgccattctcaagggagtgaatgacttctcattgttggttctcctgagaactggttgttgaaaggagcctggcacctccttctctctctcttgtttcccctttccccatgggacctctgcccagaagactcctcttcaccttccaccatgagtggcagcggcctcaggccctcccccagaagcagatgccagcgccatgcttcttgtactgcctgcaggactgtgaactagataagcctcttttccttataaagtaagtactcaaccttaggtattcctttatagcaacacagactaaacaattatcattgtctgttgctaatttgagccccctttcaataaaactatgacgtacacacacatatgcacacaaacagacagacagacagatgtatatatcaaagtgtgtatagtcttctgtataacagcatgatcacagagaacactgtggaaggtatgcccgtcatctactgctattcaacaaaccaccccaaatgttagtggattaaatattttttagttcttaaaaattaattttactggtaaatttaaacaggattaaattaaagcagcatttggtgggcactgcttgcctctgctctgcttgacaacagctgaggaggtttaaaagctgggaggtggaattgtctgaaagctcacttgttctcaaacacgatggttgtcgatgcaaagactcaaactgctgggagctggtacacctgggttccttagccatctctctccatttccatgtgcctttccctctggtctctccagcacagaagcggtaggaaacctgggcatttacaatgttgtttgggggctgctagtgtacaggtcaacaaaagaggaagttagatgctactttgccttttatgatttagcttcagaagtaacagcataagttctactgttttctgttcttagaaacaagtcactaagtctgacctaggtctgtggggagggaaattagaaccacttttttttttttttttgaaatggagtttctttcttgttgtccaggctggagtgcaatggcacggtcttggctcactgccacctctgcctctcaggttcaagcgattcttgtgcctcagactcccaagtaactgggatatacaggcgcccaccaccatgcccggctatttttttttttttttttttgtatttttttgtagagacggggtttcaccatgttggccaggctggtcttgaactcctgacctcaggtgccacccacctcggcctctcaaagtgctgggattacaggggtgagccaccatgcctggcctagaaccacatttttgatgtatttatgaacctgcagacatatttttaaagaaccacgcaaggatgaatagcttggtaacattgagggaggtcaagttagtggggagctgcccaaggagaacagtagtgaggaagaaaaacaacaagaatcagacagggacagagtggagggcaggagggaaagtcatgcagctgagagggaagatatgaataccatggaacgttgggaagccgaggtgggtagatcacctgaggtcaggagttcaagaccagcctggccaacatggtgaaatcccatctctactaaaaatacaaaaattaacccagcatgatggtatgcgcctgtagtcccagctactcgggaggctgaggcaggagaatcacttgaacctaggaggcaggggttgcgaccagctgagatcgcaccactgccctccagcctaggtgacagagtgagactctgtctcaaaaaaataaaaaataaaaatgaataccatggaattggagctgttcccagagtataaaccaataaatgaacatcatggttcatagtctactgtgtattagatagctcatgagttcgtctctttaagaactgagttgctaaaatttagttcctgaacctgtaaacatttggactcatggcaattcttaccacttggtggccattctcttcaacatgtctttagccacaaagcactatttgatggagagagtaaagacattccatttcttcagctcctcttaaagctccaaatgcctccaggccccacccattcccccacctctctctctttctaaacagagattggttctcaccatttcaaagggtttaggttgttactgtggtttagtttagctttgctttgttttttgaggtccacctgtcgtatctgtgacagaatttgcaggaggtactccagttgtgatcactgggaagaaaatgcggtgaaatcagactaacccatagttctcagtatatcattgcatggcttctaaggaaccacaatttaaacagtgcatgataaccagtattaatggattatagcccctaaattgtaacaattgtgactttgtagactcctaagtatcttctggtttgggtaacctttctattatttgctttcttgggatctgtcagttacagtgtgcatttagtcccgtacgtgtggctgacatatcctatcctagagtggccacttgtttagaacagttctattgatcctgcatgttccctaggaggaaacacaaggccttgctgagaaggctctcaagcttcactcccatgcagtatagtttacatttctagttttgtgatttagttctcatggagccataggccataattactcagctgtaatgaacctcacaatgcatcaatgcattcttctccatttatatttgcttttatttgaatgaaataaattcattcaaataaaagcaaatataaatggagaatacattcacaagatgttcacaagaattataataacataaatgaaacaaacatttattttattgaaataaaagcaaacataaatggagaaaaatgcactgactatggttcatgactgaaccatagtccttatttatgagacacagtcttgctctgttacccaggctggagtgcagtggccaatctcagcccactgcaaactccacctccggggctaaagcaatcctcccacctcagcctcccaaatagctgagattacaggcatgtacccagctaattttttttttttatttttcatagagatggggtctcataatgttgcctaggctggtctcaaactcctgggctcaaacaatactactgccttggcctcccaaaatggtggggttataggcatggtccactgtgcctggctgaaccatagcccttttaagcattgaatgcatttaaaatattttcattgttctatcaataaaatatccacatttaaatgcaggccttataataattaatactactcactattaaataccaaattagaattgattctctaaagtgtcttcatatattgtacattgtgctaggtaatatgagttttaattgcttaatataaaattacttaatggcacttataattcttgtgaacatcagtataagttttaataaaatggtagaagcacatggagaaatggttctttgattgttaaaatagttcatttttataaggcaggtaagaaattagtaagttagataactacattagtccatttgcatgctgctgaaaaagacatacccaaaaacaggaagaaaaagaggcttcattggacttacagttccacatgactggggaggcctcataatcatggcgggaggtgaaaagcacttcttacatggcagtggcaagagaaaaatgaggaagaagcaaaagcagaaacccctgataaacccatcagatctcgtgagacttattcactgtcatgagaatagcatgggaaagaccagccaacatgattcaatgacctccttctgggtccctccagcaacacatgggaattttgggagacacaattcaagctgagatttgggtggggatatagccaaaccatatcaataaccctgaggaaaaaatcacaatgctgggatccagaaaaatatagatgtttttgaataaggtttttgaataagaaaaatctccatatatacacagttagataaacccaacagaacatccttcagttttgaaagccaaggaagcttcattgaatcctgtgtctgcataaatgatcagtgaaatttcaaaattcactgatgtgcagtcttgcttcacaaatggacaaatggagatgaacagaggccaatggccatggacatagaaggagaaggagttacagacagaatcccaaactctcaatccagtttctcaaactgtccagcatgtagttgctattgactcaattgtcctttggaaaggatgaagtctcagatagtctcaaagttcactttacatagtaacccattttgtctcccctctaatattttgaaaaggtaacggcaacagaaaagggtcctcagttttctaggaagattgacaagaaggaagcagcaggaagagaaaggcaggaaaatcttcatactggatcatccatttctagcgattatagataacagagttgctgataaagatagaatttcagtcaaccactaagcagattcccactgaggaacaccctggagaaacacgaacagtcaagacagaagaccaccagatggctgatcttaataacccaataaatacaagaaaagagtggcacttctacccagttctaaacgaacatctcatttgtatgttgtgttctgagttttagggaagacaaaaatgccaattctaatttacctttattcacactttgccagggattcaaggaaggcagaaaaaattgtacaaaataatcttttgtttttgttcccttcaagattctcttttactctttttgttccttatgccatcactccaccacaaccatactacagacttcgcaactgctgtctcagcctttgaaacacctaaacttcaacatgctgagattacgcctattacgctaatgaacttctacaggaacgaacaaacgaaaaggaagtaatgcaccacctcctgtttctcagccatcaccacctcccaggtgcttcccagagcagttccctgctgccacggggctcctgcaggagctcctccctgctaggcatgtcctcaacccctagtcatcaagtctagctcagcctctgcatttcagctcaacgtctaatttcccagcgtagattccaggcagccgccctgtttcatgtcctcttaacatcctctgcttttctatctcatcttccttcttgacaagttcaaagtcatgaggactggatagagctccatcaaagcagggaatgttgattttatacactggagctgagtgggcagtctggcacagagcaagtggccagtaggattacggaatgcatgaaccttaattttctattcctttattcctgtcatttcctgtacctcacaaaatgttcccaaccatgccaacatcaccacctgtgaaaatcccaccactcttcccttgggcctcacctccatgaagtcctctttgatcacctttgtgttttctgaactccataagcactttctatgcgtgtttcacatcactcatgatatactaacttgtgttatttcctctgccctattcacagagggaagtccttgcatggtccttcacatccaatcttattagcatttaggtcatggcataaaaatcatcgtttgcctacacgtctcactccatccccaatttttcccaaactatgaaagcagtgaattcaatactcgtttttctatcttagtgcttggcacagaagagatgcttggtaagctttttacttgctctgcggaatctgaattgcagccatttttgtgaagtcttctctactcggctagattcctacatcctgaaagtcagtctttgttttctgcatagtgactagcacaacaaatcaatgtgttataaaagttatctacatttctttcaatggaaagatgcaaattttaaaaacgatcttttgcttttccactcttgaaacataaacattttctctgtaccttgtaaataatacttgcgtaagatgatcaccactgaagttattttcccaaaccctgagtattaaggggaatgatgactgcctacttgaggaagctcagatgatccgaagatcccaaactatgttcctttctccaagaaacattagtggaagggagtgtttcaccacatgtgggtcaacagtacgtgacatcgtctcagttgtgatttgattctccatatgcttataatttccattctaaatctcaagtttggtaaactggctttaagggatttttgccacatatatcttaaaaactaaattttactgtggctcttgataactttttgagagctagcttgacctgagtaagacagatgatagctccttaatgaccgccatcaaggcatgatgaagtgcgggtccctgggagccatcaatcacctgctggaaggactaggagggctgtttcccggccgagaagcaggcctcaatctcttggcccattactctcacgtcttccttctattcttctcactccattaggctcctgtgtatctgcactgaggctatctcagagtgacctcccatctctaatccttgatatttccatttgggtctaatgtaccatctcgattgaaacatttgggaaagcttacagcggtatttaatctttctttgctctagttctcagaatctcatttataaatctatttgaaattatcttttttgtatctattactatcttttccagtagatcgatatgtactctctcctaatctaaaacctagtggtctagaagcacacctctttctgagtaattgtgataaagtgctttgttgtttctttgttttcagggcctttgtctaaacctgcaatgcaaccatcaacacagcctcggactgacacgtttggcttttgaatcattctatggaaaggcaaaaaacgaagtaagacttttgaagcctctggggtttataaaccggtataaaattcctcatatttgaatatgttgtagtaatatgcatgattttgttctactgcacataaagtgcgatacaaactatagaacagaagatcgcagatcatcaagtgtaaaaaacagctgacattcaccttgactaggagtttcctagaacagggaagcaagaagtatgtattttggaagctgcatattgctggaaagatggcgtcatagactaaaccaaggtcatgttctgtgatagcagtgtgaacactgttatttcacacgtgcagattctctgctacagccgcactggttctggcacctggttttcttcctctggagattattttttcatgtagcagtttacaaggaatctttaacactaccatgaagaagatggctgttaattcaattttccaccaggttataaaagagccctgatgaaaaagaagttatgtcatggttatctcacagaaaaaggagaattaaattaagcttagggttcataccatcattgacacttttttccatgggaaactaatgcgttttcatatacaaacgaaattttgattcaaatttgcaaaatttaagctaattctgtaataaaaatctatcttctaattttaaccttaacaattaaaaaaaaaaacaagaaattttttgttatcaagtattcaaaacttggtttagaaataagctgtccttgagtctgaatgctggattgggtttttgaaaaatgttctaagaaaactttctagtttgtcaccccaaattgcatgtcagacaacagagaacactttgtcacgcttagacaccattcaatcataatctgagtttgacttcaaagttttcacaattcaattttgtttagaattaagaaaacatgactgtggggaccaacgtaagggcaggcagagcatttctcttcagccaaacaccagggcagaaggaaaaggggagtgaatgagtccatttgtcctttacctctgttttcattttccactctctacatttaagtgtccagctgctctttgaccacagtgggacccctcaaagccacaaaggctggaattgcttaaatatatatttggagatgcttgtgctgatagttattgtacagtgcagacgagcatgggcaacacaagaatatggagcccacggctctcatgctgtgcaaatgaagaccgtcatttgtgactatctcagggacacttttcaatccaagagcatttcttaaaaacaaaagcaaaccaaccttttattgttattagacaccagaaaaaaaaaaacccaaaacatacagttcacacatgaaaccatcctgagaaattctgagtctcattttctgtgattctaatgaagtctaaaacaacaataaaaacagacaaaagaaatacagattccttggaggatagtaatttgatcaaactaaaacattattaagaaactttttggacataaaatacggaaatgacttctgacataaatcacaattgctcagtattaggagacttatttgctattaattttgtttcagtcaacatctctcaacaacatgaaatcagaggtgcagaccatgaatattaactttcattcaaactaacgttccagttggcatatactgagcctaagagggggaaagtgtgaaaaatagattgcatgttgagtaagatgaaaacactctatttattatactgagtttaatagttacattatttattatagttcaggggatagttttaagtatctaatttcatttgaaataaatcttggagttattgtaagaggtgttacgctacttgttctgataagaaaaaaaatgtttgatgtataagagttgaactccagtcaaaatcaaataatctaaaaaagaaaatgttattttacataacacttcaggtaaattctgcctctcaaaaatagatgatatataaaaaatattatagcttgtgtaataggaaatcaacacccctcaataagaatttctttaaaatgaccttggtcatttattactttaaagagatcacttaaattttctttcttttttatttgagtaaatacccccatcctaaaccctactgtgtgactgtcaggtgtgagggaacaggcaaggttcttgcagttggctaaggggcacctcattaccagaaaagcaccactgaaaccacaggtctcggaggggagcgttggatgacagtggacctcagtgttacgagttaggattcggaactcagaaataatgctcaggcactaggacttcagggttttccttagcctatgtgtgcccaagtaagagaaacacacatcccccagtacacatacaaacacaaattattgttttaagtttttaaggccagtgtgtccaatcttttggcttccctgggccacataggaagaagaataattgtcttgggccacacatataatacactagcaccaaaaatagctgatgaactaaaaaaaaaaaaaaaatctcataagagagtttacaaatttgtgttgggccacattcaaagctatcctgggctgcatacggtgccgtgggttgaacaagcttggtttaaggtatcataggtaaattataaaatgaagatcgacacagaataactaaagtcttatgccatatccaaagttgagttaatttcactaacggagaaaatcctaattgatttcatcccctttttaatctcaagcatatatcctttgagctgaccggaattctttttataaaaaggtaagaactaatagtatgctccctcctaaaataacagcgattagcataaagctgaattaggttcaggtttctctgtctaaaggagagttagggtcaagtttgtatttgtactcttaaaaaccaagggtaaactttactgctatttaaaactatctactaagattatctttaagggtataaatattaattaattaagaatatattaggaacactgctattttaagttctaagtacatggatattttgtctaagtgatagaaattcaaaattttaataaacttaaaatatataaaataaattatatatagggtccaaaatactgtcaaaaccttgactttagaaaatacaggagtcagagtttatatttagctgcattgtgaaaatgcaatccagaaaaatggttttaagagagagtgaaagagttgagctcacactgaacacttaacttgagctagctattgtcatggttagtgctcaaaccttcagtcccttcacttaacaggcatttagttggtgtttattaaatacagaagaaaaaatatagttggatatgatgcttccttttcctaccttgataagaatatctttgggtatttatgatccttaattccctgttcaaatacaaatttagctacactccaaatatctgctatgtggtaccctttcattgttgtttgttcccttatttccatttagatcttaacattgactcagtgatttgaatgtccacgtgtaacagatttttagagttatatttttgctattgatagttaaatttcttaatgtcctaaaacacgaccagttgttgatatcctccagttgccgagtgactctctcctgatgtcgtgggctcactggtggtacgaatcggacgcgtccttcctaagcttgtactgcaggagccctcaactccacagagagctgtgttactctctctcccaccatggtgttaaatttatccacatattttgttaattctgacaatgtttccttagtacattttgaatccgtgttactaagatcataccattttaaactgctttatcttcctgcgttactaaacctttctaatcctcaaaacctcaaaagtctccttttcctgggatgctgaacatatttttcctcaaaacctcgcatgtctccttttttagtaatgtttccaccctctcctgaaaatctattttatgtgcaattaaaatggtatcaacagcattcttgagttaatacttgcctggattattactttccattcttttactttcgatgtttttctgctcacatgttttaggtatgtcttttgtaacctgcataaagccagattctgttcctttaacccagtctaagagtcattgtctttcacatttcagttagtgcatttccatttcttttcatttctgttacatgaggttttacttgtgccatttttgtgtgcactacttaagttgtcccattttcctatatttcaccccctctctttttttttcatctctcaatttggcattttgtatttcagttctatcccttgaatggttatactagacaatgtaggttcacctctaactttgagggtttaatgttgacaatgactagactgaccaagtgactggtccaggaattgcttcccaggaggtcccaagcctgaggttccaataagggcggggaagataatgaccttggcacagggaccatgacctttgaggacatgactggctgtctctcctggagaaggggcttcctaccaggcccagaggagcgtggtccatgcggagcactgaagacctttgaactcgagccctcgctgggacttgaggccactcccacctccccccaatcaccgtggccacacagctggagttgatgagaagccagggtactgaacagcaaggactcgaatccagccaagacagggaggcccagctctgaacctataaacacatggtgttcggaaaggcctggagaagcagcagccattatttactgccagaaaattcacgaggcaagtcccatatgtgttaggagtgtgaggaaccacacacgtcctacaagtgctgcaatgacaagaaagcatccaaaattccccccatttggcaccaggatctcctatgcaaagaaaggtcttttcagtgcagggaagatgaggaaacctggagccaaagctgtcgcctccttcagaattccaaagtccacactgcagaagggatttgttggggaagccaggctgagaaagttcccactcactcagcacggagaattcacacccaggagaggccgtctatgcgagattcttcagccacgctcaggccttaagcatcccgaatgctcacactggagagatgcccggtgagtgtaatgtgtgaagaagcttcatttgtcacccggaacttcacaggctaacgggcctcatgagcaaagccagcgtgggggactttccgccgcaggtacaccctcgggagtgcacatcagagatggtcttagggctgctgtgcacgcgcctccgcatcctcgttcaggaacaatgtgttcctgcctgagaggcgagcaggagcgtggcctttgtgagaaaggcttcggtcatgatgcaaccccatgtccagagcacccatgccaagggccacagagttgtgaggccttcgggggcgatgatggactttctgaccttccctggaacccagggtgagttgtcacccccagggctgatgggaagaagccttccttcctctccatcctggtggggcagctgccgcccccacatgatcaaagaacgcagcctctagtgtcacccacactaccctggagcaaatccagactgtcctgtgcacagaactggcctaatctggacaaggggacccaaggggtgtcagctggaagcttctgggcaaggcttccttgtcccatggattttaaagtctctatgtgacagctgtgatggcttcaaacagcctatgagtccccttatttgtggactgtggtatccaaagtgggcagaagttgccctagaacaaatcccccaaagataccaggaatgactgtgttattagatgagatcgggcacgttcagggtggtatggccgtagacaggaatgactgtattatcaaactctatcctccatgttttttaagttctcttttattttttaaatctattatgttctggctgcatttaggataatttttttcaggtcaaatttcagatctaagttctattttctctttttacctatgtcttatctgctgttcagcccatttagtaaactttgtgtcaattattataatttatatataattctagaatttcaggtgtgtgtgtgcttgtttaatttgactggatatttccaatcgttttgttttgtttttttaatcttttattttttaaacatattaagcatccttatactctatccttgatgatttcaatttctatgttctttactgttttgaattctgctcactcttattcaccatggcttgtttccacatatatgttgtgatttttctgattgttaatttatgttccttgaaacactgagaaaattatttcaggactcctttgaaagtacagggctcctagaggatttgggctactctcagcccagtacccaggactacaactcatgactgactacattaaacaacattctagacccaggactttctgtgccgcacaggaagagtgaatattggccccaaactcaggtttgagttatagatataactctaacattatacacataatgttgtatatatgtataccatatacatacatagaatgttgaccctaaaaacttgtaagcataaacccatcggtttgtacttacaagtttataggggcaagattctatgtatgtatatatgtataacacatatgtatatatggaaacatagatgtatatataattatattattagatgcaattatatctacatattatgtatgctataatatatacatattacatttgtatacatgtaaacgtatgtaattacacttaagaattctgccctatgaaatacgcactctaatttcatcctggtaggaaactggcaagactgtgtgatacctcaaaaatctgtgagtgacatacaagtcattatctttcttcaggatttggatgaataaaaatctgttcgtagtccctagccctaggctggtggagagtgactgtttattgttgcccactgccatcctggtatccttccgatcagccagcagattggcaagagaaagctcctctcatgattctcgctcaaacgctgtacctgttgctgttgacagactctgttcctgagagaaggtattaactgccagctggctctgacagtttgggaactaaggctgacatttgtgctggcagcataacagtatttacaactcaggaaatgtatacagttagattacgacggagccagcgagttttgaggttaaaaaaatacaacaatatacatgtgaagcatgaccataataacaaaattaacttaaaaataaattcagagcttaggggttctttcaggaaatatctgcggtctatgaaacatatggcatatatgtgcaaagagagaaaggattacaaagaacagaggatggtaattcaattacatcgccggccacccatactatattttgtaatagtccactatgtcagaaaattactaaagaaaggtagaagtagataaagcagaaaaaaaaatcaattttgaatgatggggaatataaatataaaatatcactggagcaggagagaaggtgaatctcatgcttctgtaatttttcttttggaggctctgcactggctctccttttctcacctctccttttccttctatggatataactttgcaatgagtttaaattggcacatttccacacggtccccccaaatgattaagtcactaggaaagtgaccctgaaaggcaggggcacaggttggaattttggtgaatgtaattaacctatttaaatatcataacacttttggcaaacattattagatggaagaacagtcagttgacattttgtctctaatttcctggcaaacagtgaagatgtcatcattttcttgcaataagaggaatgaatgtgaccaggtacttactgcactagtcccagggcagtgtggggattggcattcaccactcatccggtttggaattaaaacatcatcccagcaagatggaccctttgggaaaaaacaacaatatatgcttatatgagttataatagaaatgtactccttaagacatgtttccacttatgttataaaataatagtgaaattagtgtgtagtccaatgattttcaaagtgtggtctgcagactctgggggtccccgtgaccctttcaagggatgtgctaggtcaaaactatgttcatcaacatacaaagacgatatttgacattttgctccaaacctgttcgttttccacttatagcctccccctacggctgaggttaaatgcaccttactagaaaggccatccctgactttgctccacttctgtgtctgccctttcaggcttcctttgcttcataataattattactaccatccccacccaaccccaccatgcagtggcccagcacagagcaagggctgtctgtccctagtcaccacagctacacaaaagccaacttggtctgctctgttccctgaggcatcccagcacctagaggagggcctggcatcgagggggtgcgcagcaagcttccctaggcatcaaagaaataaaaattcaataaaagcaacacttcttttaaattagagaagatcatttaaaatgaaatatcagtgtcaattattgcattcctcttggaaagcaaaccagtaaaaagcatcacaagcattcaactggttcataactttttgactaaattttaagaaatcgggctgtgcacggtggctcattcctataatcccagcactttgggaggttgaagggggcggatcacctgaggtcaggagttcaagaccagtctgactaacatggcgaaaccctgtctgtactaaaaatacaaaaattagctgggtgtggtggcacgcgcctgtaatcacaactactcaggaggccaaggtaggagaatcgcttgaatgcaggaggcagaggtggcagtgagccgagattgtgccactgcactccagtctgggtgacatagcaagactccatctcaaaaaacaaacaaataaagaaacaaaaaatcaaaagcaaaaggcagataggggagagggcacaggggatcaggagcagcaaatttccagatcctcaaatcttctaaacagaaagttcagaccatctacttggaaacaaaaatcaaaatagaatgtttaacttgcagcaataccttcaatttcaacctaaaattctgtgcctgacctaattatcaattaaatgggagaatgggaaaaagtggcttggggagatgcaagttggaaagttggcttgtatgtctgtgagggctcagggttcaggaaatgatcagatgcctgaggaaagccccaggtggcagcctggacctcctcaccgtgggtggagcagtgaggtggccacgggaggggcggagtaagaggtgggttgtctccccagctgtgacacagaaaggaggaggagggagggtggcatcaagggctggaggggattgacagagcttccaggagacgtggtatgaggccactgcccagtgcaaggcagaaggttaggactcaggggcagaggctgtggtgattttactaccgacgacgtttggacccagctagtgtttaagttgtaggagctaaatcggtcatcacaaggcccatctctgcttcaggaaccagtgtagagccgccctggcactttgtagcagatgctgaggaaaatgccgtgggaggtgggcaggggttcacagccacccctgccagtctgcaggagtgctccctccctccctcctttaccattacatgtgtgcacacacacatgcatgccacacactcacatatacatgcacataccacacacactcaggcatgcacgcacacaggcatgcacgcacacagcatgccacacaccacacatgcataaacacaccacatacatacacgtgcacacacatcccacacacctcacacaccccacacacatatacccacatgcatgcacgcacaccaagacacaccacacacgcacgcacaccaaaacacaccacacatgcataaacacaccacatatgtacatgtgcacatgtatccctcacaccccacacgcctaacacaccccacacacatacatccaaacacatacatgcacaccaagacacaccacacatgcataaacacaccacgcacacacgcacacacacacaataccacacagcacacaggcatacacatactacatacactcacacactcatgcatgcacacacgcactattctagagaaaagtcggggacgcagagcagttctccaggcctgagccgtacctgaaagagactgagccttttgacggaggctctttaccccagacttcaaaaggagctgcatctgggatccaccgatcattaatccaaaggccaccgcttaatatggaggtaaatttgcagaagagttctagcaggactgaagctgcgatggtttgaaaagcctgctttcaagcttggcccttggctggcatctgggaatgtgaattttggaagcgtccacatcattcccttactgctacgggtggtgtgcagagcctgaactgtctgcacaaaccatggctatgcacaacatcttctcaccctcggcaaggctggaattttgataagccccaggcagaggtgtctgcatgaccagttcccactaaaatcgctgggcactgactctccattgagcttcctggcagacaacacttcacacgcgttgtcacaactgagtgcctctcgagtgaccactgggggaggactcagagccttgcctgcggtttcctctaaactcctccccctgggccttttcccctcgcttcatatccttttgttgtagtgaatcttagctatgtgtgtgacaggacagcaagtcctgcaggctctcctggtgaatcactgaatctggaggggggaggtggtcttgggggcccaggacatgacgacataggattggtgatcaaggcaatgttctcccaggcacataggagggtcggggctcatcattaatatcacaccagtcacaaagaacaagccgtttcattttctttgcacatcccactgtgttcacgataatggaagcacttatgtgattttcaactttagagtaacactgttaaaactgaacagaggatgttaattatgattatgtaaccaaatatatatgttattcagcttggacaatataaaagcaaaaacagaaatgtgaggacttggaaggcagaagtgaggctggagagaaaacagaaaagtgctgatgaattccctgacctgccaagctgtttttattagaaggttgtctgcacctttgatttttaaacatgagcatatattcactcgataaaagttacaaatgtatagaaataaaagagaggaaaagaaatgatacctacgaccttgatcacgttcatcagcctcatttttctggcttaaagtgagaaattcagtggagataaatgtggctagaatgcagtctgctacaatgaatacactttttaacgtgaggacctttcttactcctatacaaaaactttgaactatagttgctttagccatgcaacttctggaacactgtgtacgacgattaggcaatttaggttttatattttctaaaatatgacaggagcaaagttaaacgtgctttgtaatggcatagattcactgggacatttgtttctattttctggatagtcataacattcatactaatagtgtgagtagtgtggataaattagcatgtctattttattatattgaattcccatattcaacagaggattttaattatgattattaaatatatatgtaatgtacaaattacatggcaaattgcaaatcctttgaggggaacccagagggcacatcttgcccctttgtttgttttaatgtctgtttctctgtaggttgtgatttgttctacctttacggacactacaaatcagatttctctcttttttagacaattaggaaaactttagagtcaaatttgtggaccagctcttgcaattttacataaatcataatacacacttcgtttaccaaaattacccttggcttcatattactttcctttgatccctttcctcatctaatttaatttttcctggttttcatctgcatgtatccctgcaaggttgtcacatcattctgaaacgagtcaggggataattaggtaattgtcgggccttgtgatgtaacctgactgacagctctaacaggagccgtgctccctgggatggtaggtcatctcgcctccagggacaaggtgatctctggccagatgcctgtgccaagctctggctctcatactgtggctggtggcaattcccagtgaaccacactgtgcttgaggcaccgaaaagtccctgcgtttaaaagaaatccatttcgctgtggttaaccattaactaaatgggacaacattgcttctcttctctggaagttttttctgactgactcatgacacatgcaatggtcaataacacacctacgtggcaacagccaagaaggagcactaataggccgggcatggtggctcatgcctggaatcccagcactttgggtggctgaggaggatggatcacctaaggtcaggagttcaagaccaccctggccaacatggtgaaaccttgtctttaataaaacacaaaaattagctgggcatggtggcgggtgcctgtaatctcagctacttgggaggctgagggaggagaatcgcttgagccagggaggcagagattgcagtgggccgagatcacaccactgcactccagcctgggcgacagagtgagactctgcctcaacaagaaaaaaaaaaaaaaaaaaaagaagtagcaccaataattaaatgcaggaattagggcccagttatattttgcttcacagagtaagacttcttacctcaaagtctagaattcagtgagacttttctgtgcatatcacagatgtttattttttcatatttaaatttttactgccctaatagcaactaaaatatttatggaacaattcccgtaattgccacatcaggtactatgttatctgacaaattcgtgttctacagagacattatagaaaactcattcacacattcttcttgatttcaaaccataacacaatggtgtaagtagtaaaactgaatggaattcttttgaatctgggactttaacacagtaaaatagatgttagtttatgcagctgctcacactaatagtgtgaatgctatggctatcctgaaagcagaaacaactgtccaagtgaatttatacccttacaaagcagatttaactgtgctcctgtcaaattttggaaaacataaaactttaattgcctaatcattgaacacagtgttttaagagttgcatggccaaaacaattatagttaatagtttttaaatagtagcaagaaaggtcttcagattaaaaaggactgcaaaaatgcatggcagtagaagggagctatggatgataatacgtcaattagagaagcaaaaccactatttcatccctcaaatctaccgaattagagaaagatatctgaataaaatgtcacatagtctaataggaaaaatttggctggtttttagagaacgttctctttttttttgcctagtaatgacgataaccaagaaaaatatataaattattttagcaacactagcagggtgaggaaaccatgggctgctggccaaatcccaccttatacagactctgtgctaagaaatgttttcatgtttgttaatagttgaaaagcacaaaaagaagaatgtttcgtgacacatgaaaactatgagaaatttaaaattcattgtccataaagttttattggcatatagccacataaagcatggttgcttgtatgctacaatgagctgttgcaacacagacctcatgaaccacacagcctatcacgtttactgtcgggccctttatagaaaaaacttgccaacccctgatctacagcaaattaaattttccaaactcatactgaaaagtactcttttatttttaatattgtggcagcactttggctaacatataatcgcatatgtttgtatgagtaggtatgtcctgggtctcaagtgagaaattacaatgaaaaccttagtgctgttgacctgagaattccgagaagacggtgatagagaagcagcaattgaatcctgggattcatcaaattgtttgcatcagtaagtggaaaatgacaactagagatggcatttgaggactggtcctgactaatgttactgtctatagaaaagcgtgaagcaaatattacctaaacacgtctatatgatgcatgtaaatcagaaatacagaaaaatgaccccacagagggaaagcattgataaaatctgtaacatgtgggttttaaaatttattttcaaaagttctagaactcataatctgaaagccattttggctatgtctttcaatgcccagaaaagtggaaaattgaagtatgtaactgactatttcatatccaaatattattcagacacagtccagactgacaaaacaaaataactatttttcttgagttatctaaataaatgctataatctgctcatcatatgtgagtatatgcattgatgcttaaaataaattgctaattctattttccaaaatgttaatagaaaaccatggcatttacagtttttgaaaaatgttatttaatagtaattttacttaaactatacttaccctattatctcatcttgtcatcgaatatgaaggatttcaaatattctcttgaataatccacaaacatttaagccacataattaagtgtcagggactaaaataattttgtaaatcatactaaggacataatacaacaacagcaaaactatcttgaaaaagctgtacccagaagcttgagtcctcccttgatgtttttctatctgtgtctgcaacaaaatgatacaaagaaggagctttgaagttcacaaacctgttgtatttcatttctaccaatgactagctatatgttcccgagctagttgcatggacccattccaaacttagtactcttcatctgaaaagtaaggaattaaatacctacttcacagagtgtgcatgaagattaaatgaaacaacacaaatacaaacaacactgtgcaaaggcaacacaacaaacgcctttacacagttgctggcacatagagagttaaaaaaatggcaactgttacaagtattatttcttatttctcaaaatagaactgcctgaagagggttatttttggtttagtaaaaactgagcagtaagaagccctttccaagggacctggacccacggcccagtgggtttctgaatttatcctttttctcaatttccctattatccagccctccccaggatcatgtcactttctacagcatgctgtttataactcttctaaagcatgtatcgccctctgtcatatagtagacactgacactgttctgagcatccatcttccttcatttgatttaaagatcctacactgtcacaaagccaagcacagtgccgtggttagagcagcagcataataaatgcaatcattaaatagtaaccaggaaaaagaacgaaaaaaattcgttaaaccaaaatattcatccacttaccaagtatttattgttgctcttaaaccctgagactgcagttataaaaaagggagaataatcgcttttcttgtagactttctatagtagctacaaaaaaatggtattacaaatgaaccaatcacatccattaaaatgagtaagatttttgaaaatgcccatgtaaaagacaggcaagttggaagacaactggaatatacacactgttggtgcaaatggaaaatagtatagtcactgctgaaatctactaggcattctttttttaaagtaaacataaaagtaacatatgactcagttattctactcttaggtagtcatgtgagataaatgaaaatatatccacacagaatgttgcaggcaagtgctcctaacaattttattcatagcaaatgtaaactggagggcacccacatatctatgaaatatttcatctgactggatagacaagatgtagtatgactattcagtggatgaccactcaagaataagcagtgtcctgttacctataaatgcaacaacattaacaattctcaaaatcagcctgagtgaaagaagccaaacatggaatatgtggcatgattccatgtatatgaaatgcagaggtcgcttggggctgggagcacagagtgggaacaagccacataaacacataagggttattttgggggttatgggctgaactgcatcccctcaaaatttatgtttaagtactaacccccagttcctcagaatgtgaatgcatttggagataggtcttgacagaggaaattaagttaaaatgaggtcattagggtgagtcccaatccaatatgactgatgtccttaaaagcagacgaaaggccatgtgaaaatatggggagaaggtggccatctgcaagccaaggacaggggccttggaaaacaccaagcctgctgacacacgttgatctcgacttctagctgccagaaatgtgagaaaatacatttctattgtttacgctttccagtctggggtattttgtcatggcagtcctagcagacaaatatagagggtatggaaatgttctttatcatgactgtgctggtggctttacgttgttatgtacttgtcagaactcctcaaattgtacccttcaaatagagaaagtctatttacacaaattattctcaataaagtgggtaaggaaaacaatgaactgagcaattgacaaggaaactcaataagagacagaggctctctgtagcaaatgttgcttgaaaaactgaatataaatatctcactcaatacagaaagcaaatgggaacttctttataaccttggaacaggtagaacttccttcttgtaaggacacagaaggctctaatcccacataaaggaatgtataaattgaatttcaatgaacattagagctcatcaaaaacactaaaatatgactatgcaagccacagacttgggaaaatattagtaatacatataattgtaaaataagtaatctcagagcttataaagagctaatataaaggacacattaataatacagacataaacacaccagttaaatataagcaaaaaccttgaacaggctattcacaaaacaagacgtataagtggccaataattatataaaacgatggtcaacatcattaataacagggaaaatacaagttaaaatcacaagatacaatttcacttgatttcacattttagccactatgataatactaaatgtcggtgaggataaagattaacaaacgctctcatatatcattggtggaaatataaaacaaccactttgaaaacggttttggaatttctttctttttttttttgatacagagtttcactcggtcgctcaggctggagtgcagtggtgcgatctccgctcactgcaaactctgcctcccaggttcaagtgatactcctgcttcagccttccaagtagctaggattacaggcatttgccaccacacccggctaatttttgaatttttagtagagacagagtctcaccatgttggccaggctggtctgcaactcctgacctcaaaagatccgcctgccttggcctcccgtagttccgggattacaggcaagagccgcagcgcgcagccctggaatttcttattacgttaaacatatagttaaactatgactcagcactttcactccaaggtgttggtccaagaaaaatgaaaatacacacacacacacagagcaacatagactcgtacaagcatctaacatcacagccttactcatgttaacccaaacctggaaacaagcaaatgtcctttgacagtgactagaataaaccatggggtctcacatagtggcagactcagaaatgaaaagagagctactgagtcacacaaccacatggatgagtctcgaaacaaaacaccatatttaccaaaaggagctggccatagaaaagtatgtattatatgattccatttatatgaaatccagcaaaaagaaagattaatctatggtgataaaaatcagaagaggttatctttggaatggggaggtactgactagaaaaagagataagggaactttctggaaatgttctacattttggttggggtagtagttacatgagtgtatgtaactgtcgaagcttttagaattgacacagtgcattttgtagagtgtaaattgttctataatttaaaataatagactgaatctcctatcccatccttcagtgatttcctcttagcttttggaaacaatagtctgtgatttctgttataagataatccaagtcactgccaatcaacacaaaagactaaccagtcctagggctttgaactggttactaaccttcatcatcaggctacaaaactcttaaagtcaaggactgtgtcctacatatatctatgtgctttgctgtgaatagataaatgttttacctaaacatagtgaatacacaagaataattaagtcagactttaattttctcatctgtaaaataatgaaaactgaaaaatctgtattttcaaagttacattttcttttaagcagggtactttcattacatgaaattgtctatagtaaccaaatacataaaacaaataaagctgacccaatgtggttgaagaagaaggacgagtccccagaattctcattaatggcctcttttctctttgtcccatgtgatgcccttaagggccctccccacagaaaacaatttgaaatcctaaaagtctcttacaataatacaccatgggtatgctcagagaaaagtccacagtggtaaagaatctggcagaatatggttgaatcaaattgtattagggttcttcagaggggcagaactaataggatctatgtgtatatgaaagggagtttattagggagaattggctcacatgatcacaagatgaagtccaaggataggccgtgtgcaggctgaggaagaaagaagccagtagtggcacagtccgagtccaaaagcctcaaaagtagggaagccaacagtgcaggcttcagtctgtggctgaagacctgagagcccctggcaaaccactggtgtaaatctaagagtccaaaggctgaagaacctggagtctgatgtccaagggcaggaggaatgaaaacatccagcatgaaagaaagatggaagccagaagactcagcaagccagtttatcccaatttctttggtttgctttgttctagccatgggggcagcagactggatggtgcctacccacattgaggatgggtcttcttcacccagtccactgactcgaatttcaatatcctctggcaacaccctcacagacatgccttgaaacaattcttttctttttcttttttttttttggtcaatttttaaaaaaattatatgttaagttctagggtacacgtgcacaacgtgcaggtttgttacatatgcatacaggtgacatgttggtttgcttcccccatcaactcgtcatttacatcaggtatttctcctaatgccatccctcccccagccctccaccccatggcaggccccagtatgtgatgttccctgccctgtgtccaagtcatctcattgttcaattcccacctatgagtgagaacacgcggtgtttgattttctgtccttgtgatattttgctgagaatgatggtttccagcttcgtccatgtctctgcaaaggacatgaacacatccttttttatgactgcatagaattccatggtgtatatgtgccacattttcttattccagtctatcattgatggacatttgggttggttccaagtctttgctattgtgaatagtgctgtaataaacatacgtgtgcatgtgtcttgatagtagcatgatttataatcctttgggtatatacccagtaatgggattgctgggtcaaatggtgtttctagttctagatccttgaggaatcgccacactgtcttccacaatggttgaactaatttacactcccactaacactgtaaaagtgttcctatttctccacatcctctccagcatctgttgtgcctggaaacaattctttaccagctatctaggcatccttcaatcgaatcaagtcaacacctaatactaaccatcacacaaatccttaaaaggccatcctttattttctctctctctcttttaaggaaacacatattagctgtggctaacatatatgttcattagaacacatatattatgctctttgctatggtctagatatgtcccctaaaattcatgtgttggaaactgagttcctaatgcaacagtgttaggaggggggcctaatggaaagcgtttaagtcacaagggctccacctgcatgaatggatcaatacccctaagaaaggagcttgcaggagtgggttctctttctactgctcttcgaccatgtgaggacacactgttcctccctactggagcacatagaattcaaggtgctatcttagaagcaaagagaccaggccttgacctgctggggccttgatccagaattgtgagaaatagatttctgttctttttaagttactcagacccaggaattctaatatagcagcacaaaaagaactaagacattcttaaaatacttaattgaatcactgatacagatcacatgacattatccaggtgaaacagacatttgtctttatgttgtggcagaagctttcagttgtctcctctcttcttttatggtaacagaatttctgatttatagctgagcatatgactccctggaaaaatgactctacctcccagcttcccttgcctgactggccatgtaagtgatgaccaacgggatataacagaggtgtcctgtggaaacttctacttgtccttttcttcatccatttttttttctctcctgtttgtaatatacatagtgcatcttgaaccacaagttcaaggttatacaacgtagagcaacaatatagaaagagtctgggttcctgtcatcatgaagtgccacagcagccttgaaccacctatctaaacttttacatgagagaaaaactgaactctcacattacataagtcactgttactttgaatttttaagatattcactgtcaaatccaatggtcattattattacaattaaattaactttgttttgatagaaaaatcaatggagcacacaaaacagtagcaatattctatgatctaagaaaccaacaagaattttcttttacatacatgaggatgttgacataggaagataaataagtcttttggaagacaaaagtaaaatattacttataatacatcagggaataagaccttatttatgagttcatgagtttttacaattacagaagttgaccataaaacccaaacttttaaaaaagcattgatcattttgatgaaaatctttaccaaatgtgttctatagtccatccttatttcagcagattacacgcgacatgcacatgatgacttagctttctaaaaagagcaatggtgtaacgaatatatgccacttgccagaagccatagttaataccatatgtacacctcatccctagtgacctataaacaaaacaaggtgggcagtgccacagccttttttacagatggagagactgaggcttggagatgctgagatatgtccaaggctacaagtttacaaagtaacaaagtccatttatcataaaagtatttgttgttttgttcacttttcagacacagttttaaaaaatacatgtcaaataaataagcattttttatttactgttttaccatgaactacagtgaaatccttgctaactgtatctctttccttcagaggccgatgtcggacagatgtcaccgtcatgtcaggatggtggacattttcctatctggtgggtaggaaatcagtaactacatttactaattatgaaaacaccaccaagttaagattttgttacaagaaatgtgtacggacatacatttttagaatatatgtcaatatctttatactcctttggcctctttgctgataacctgcttttcatttagttatttcctgagttttgtaggtgtttttcttttaaagtctttattatcgacaggtttttccaggtacattacttcatttatctcagaaatcatatgagacattatacttggcatttcttttctattgctgtgtaacaaataaccacaattttgttgcttaaaacaacatgcttttatgatctcacagtttctgtggggcaggcctggtgtgacttctgctcagagtcccatgaggcccagtcaagatgtcggctgggctgctctcttccctggagactccattacagcaaaactagcttctaagctctctcaggctgttggcagaattaacttccttgcagctgtcattacaagggcctcggctttctgctgcctgttggctggaggcctcctgccgttccttgccatgtgagcttcctcaccttggcagttcacttcatcaagtcaacaaggagagggtctgctccagtctccactgaatccatcataagtaatatcgtcaggggaagtcttagataacataattggcacggtcagggaaatcaaatcacttttgctgtattttcttggttagagaaagcaatttcacatgagcatgtacaggaggtggtgggaggtcactgggccgggggggtgggggtcatcttcatgtctgtccatgccccgtttaacaaattaggagaaggagctttcataaaattaaagtttcagaaatggtaactcaatatataacattagttgtcaagtactcaggctatttttcaaaaatataaacacatgtttcagtttaggtacgtgaatatttgaacacttccttggagtcctccttttaaaatttcaaataagtcattttatagcttgggagatgatatggtttggctgtgtccccacccaaatctcaacttgaattgtatctcccagaattcccacgtgttgtgggaggcacctagaaggaggtaatagaatcatgggggctggtctctctcgtgctattctcatgatagtgaataagtctcatgaaatctgatgggtgtatcaggggtttccacttttgcttcttcctcattttctcttgccaccaccatgtaagaagtgcctttcacctcacgccatgattctgaggcctccccagtcatgtggaactgtaagtccaattaaacctctttttgttcccagactcaggtatgtctttatcagcagtgtgaaaattgactaatacaggagatattaagaaataaataccagatgtaaccagaaactgagtttctgtttattctggcatgttaaactttacaagattagaatatgttacacaaacagaaacatgtcttgctttaatgagtgtatatattcctttctaacttgaatttattccctatgatttcttagagcaagaacgtattatagaagcagttaactaaaaggctcactacggttaattctgcagaaagaaatagaagtttacagaagttaattctgcagaaagaaatagaaaggattaattgttcctaagtaagccaagttatctctacaaattgtttaaaacaaatattagaaggaaaacaataattaagagaagatcttaagaagacacctaatctagttcttattaatatttttcatttctgattttgatattatatgaataatgaaaaatccctcatttgaaaaaactttatatggtatacaggacgcaagagaggcaaaaatgatttttgtaaattccagccagtctccaagagactatgatcataataaaagcaatggcaatggcatcaccttgcattagtataaaacaggtttgtctacaaatcgctttcacatgtcccaagccaaccttgatttccagtgaaaatctgttaatgctgtgttctatagagctctgagccacacatggattacttggtcatgtgttgataatttgttcatgtgtaactgcagaactgtttcccaacaaaaccctggccccaagcccaagtattcactgggttctcacatgtaactacttgggtatatcttgatgattacatcatgcattttcataagagtatccattttatctaacgatttgttaatcatcaaaacaaggatcttccctcattttgtaatagaacaactgaagtccatgcttttcttggaaaatatagtcatattttagtaaaagtgtgatcacaaggctgggcagagttagctgggtaagtttgactctgctctatgtggggtcagctcggatggttcagtgggactgaatggtttcttttcaacgtggctcttttgcatggccgagtggatgctgaatataagctgaggtcagtgggctggtgttcttagttcttcttaacaagggggtgccctagagcagtggcccccaatctttttagttgtctgtcattgtcaacatgcacaggtttgacggaagacagtttttccagggacccagtgggatggtttcaggataaaactgttccacctcacatcatcaagcattagattctcataaggagcgtgcaacctagatcccccacatgcacagttcacaatagagttcttgctcctaggagaatctcatgctgccactgatttgacaggaggtggagctcgggctgtaatgctcgctcgcctactgcttatctcctgctgagtggcctggttcctaacaggccacccctgctggcccagggcttgggcaccgctgccctagggcacagtaggtgctttctaaaggtgactaccctaagagagaggaagtagaaacttccagtttcttaaggcctgagcctggaaatgggcagagtgtcatttctaacatgttctattagtgaagcagtcacagagctcagatgtgctaaaagaggttggtatttaaagaaaataattctaacagcacatcgtgtcacgttttcatctggcatttcactggacggtattcgacatttgcagtttaatattttgtgcccttgagcactgccacccttaggaaggtgtttggtgctgtccatgccctcatctgtgaaatgggggcagagacagcaccaaacaccttcctagtagatcagctcttcttagcctcatctcttgtcactctattcccagcattttccccactttctgacaatgtggcccattttgattttcctttattgttattcaaagtaccttagtaatatatgctttattaaaggcctttagataatttaaatatcatgaaacagtaatgtatctcatggaatatagtttacagacacctaaacaatacaacagcactaattcttctggttctccaaaagttccaataggatccctcttaaatttccatcaggtcatgggcatgggcagacagtatctgtgaacttatcagtggattccaattattttactgaatttaattttttttttttttttgagatggagtctcgagctgtagcccaggctggagtgcagtactgcgatcctggcaaactgcaacctctgcctgccgggttcaagtgattcttgtgccacagcctccgagtagctgggattacaggcacatggcaccacacccactaatttttgtattttttcagtagagatggggttttaccatgttggccagcctggtctcgaactcctgacttcaagtgatccacctatgtcggcctcccaaagtactaggattacaggcttgagccaccgcacccaacctattttacttaattactctagtttctcaaagacactcttcatttctcctagtgtttggaatcactaccaaacactatcataaagttctgaaaaagcattcattgttgctaattttaagtcattgattttttaattcctttaacaaataatgagcatctaaaaagtgacacacattttgccagattgtggggatggaatactgaaagagacttttgcacgtcaggaggataaaagtgattacacaggctgggcgcggtggctcacgcctgtaatcccagttgcttgggaggctgaggtaggggaatcacctgaaccagggaggcagaggttgcagtgacccaagatcacgccactgcactccagcccgggtgacagagcgagactccgtccaaaaaaaaatattaaacaggcaattaatactgagactctttgagggtatattggagggatgagagacctcgacttctgagagagctgggttttaagctgagagcagaggaatgagtagcagcagtaggttttgcgggaagaagtagtattctgagcatggagaacagaagaaaattccacaagccctgagcctgattcttggaatatcgatcccaaacaagatgatttctcagatactgacaattaatccataaataatccatttttattcgtgcaatttcctaaatatctccatccataccactagtcttgataacacaattcaattgtaatatacatgtaactgtaatgtacacaagttcctgatttcaaagcaatgaggatgtcaagatgataaacagtggttttgtgctttggtatcagaatgactgggtttcgaatctaatggccactaccagccaagtcaggatgggggtgtttctgaacatcaattttatgatatgtaatgtggaaataacaattgcacgtaacaaacaggactgatagttaaatgagataaagtagttagcaaaataccacacgcatagtgaatattcgataaacgttagtgggtactgctgaataaccacagtagaacaatatcatcatggaaagaactcagtagagaaagactcagaagatctaagttcaggatgcaatttcacttgagtatcacctcatcgatttaacatcctcatgcttcactatcttatctgtaaagtgtgggtacaggccaaaagagctcagggtcaaataagataacaaatgagctaattaatgtgaaaaccattgaagctacagcaaacaggtcacacagatagtagtaaatgaatgaatggagcaaggggtagtcttgaaaccgtctgataggagagagaattgtactcacgcttactcactttataacaaccccaaacctgggaccactttcaagtaaaagtgaacttaaaacacaatgctgcagctgctgttggcctcagcgttaaccagagcaagtgtctattcctgtatttattactcagtactgccaagttaactcaatggctgcctaaacagaacatctcagctggtcttgaaaattttcccaagtactacctctatagctttgggtttttttgttgttgttttttgtgtgtctgttttctgagacagggtctcgctctgtcacccaggcttgagtgcagtggcacgatatggctcactgcagccaaaacctcctgggctcaagcgatcctcccacctcagccccctaagtagctgggactccagacgtgcatcaccacacccggttaatttttatactttttgtagagacaaggtttcgccatgttggccagactggtgtggaactcccgggctcaagcaacctgcctgccttggcctcccaaagtgctgggattacaggcttgatgccctgccctcagccctctacagcttttaaaacataatttggcagataattcacttccaatacaaaaacgtgtttggtatcataaaaagcaagcatttcataatctaatactcaataccataatttacccactctgagaaaattatcacaagaaaaaagtcacatggagaaatgcaaatcaaaatcacaatgagataccatctcacaccagttagaatggcaatcattaaaaagtcaggaaacaacaggtgctggagaggatgtggagaaataggaacacttttacactgttggtgggattgtaaactagttcaaccattgtggaagtcagtgtggcgattcctcaaggatctagaactggaaataccatttgacccagccatcccattactgggtatatacccaaaggactataaatcatgctgctataaagacacatgcacacgtatgtttattgccgcattattcacaatagcaaagacttggaaccaacccaaatgtccaacaatgatagactggatgaagaaaatgtggcacatatacaccatggaatactatgcagccataaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgttgtgtggtggggggagggggagggatagcattgggagatatacctaatgctagatgacgagttagtgggtgcagcacaccagcatggcacatgtatacgtatgtaactaacctgcacaatgtgcacatgtaccctaaaacttaaagtatatatataaaaaaaagtcacatttcttaagaataattctcattagtgtaagtgaagtgactcgtcctccacgaaaatgcagctccgctgggttttgacacagtcaatcaccatcattacttaccgagtccctccatgcagggtgtacctatgttaaaccaatgaaatgccaacaacgcgtttcccccttcacaacttccagtcaccaaactattcctgaaccacaagatgccttcagttatattactatgtgttgacagctttgctgtaggtacatcacagggatagcagaattgaaacagcagtgattttttttgttgttccgtttcatagaatttaaacaatggagacaataaagccttacagatctggtgattcacatgaacgcactcttaacggatttaatttaggagaaccatatgattatcttcgtctgttcaagcttcctttactaaaaatagtctggctgttgcatggaggaaagtttgctgtagctcagattagaggcagtttcaggcagcaaaatatgtttctagctgttgagatggtagcactcatttcaattcatggcatgtaaatctatttgaataatatttatcatcatataaagattcatagttacctcagctggctttatgatcttgataattatgactggaactcaactatgcttattaaataagaagtttattagatttctagtgaatgctcagataccatcatcatcatagaaatattattatttagttctcaaaattaagctttatgaataacacatcacattttggtgtgtagtatagtactctaactccccacataaaacttaacttgatcgcctgcatttatttttaagaaagggaaaggtacaaatcacatcggattatggttaaaattataaaaagtccacattgtatttaattttctattgcttctatataatgtactgcccgtgaatatgtatcatcaatctgggctgactatcttgaccactggtcaacaactatcttgaccactccaacaacgttttggagtggtggaggtgagaaaggcatgtatcactgaagtaagaagctggctagataaggacttagcaaggactataaggaaaagtgcttttcaagggtcctaaagggcaacagaacttaggccccccagtgaaacattaaacacgtatgtaacgagcaggcttccaatcatctgagagctaatgatgctaccatgtatttataaggtacatttatccccatcttttcactgaaccgtacacattgtgggcaggggttcctattcttgccccttactgtcctggggtttgtagacatgaaaaaagaaaggcttgcttttttttttttttttttttttaagacagagtctcactctgtcacccaggctggagaacagtggcatgacctcggcttactgcaaccttcatctcctggcttcaagtgattctcctgcctcaacctccctagtagctgggattataggcatgtgcccccacacccagctaatttttgtatttttagtagagatggggtttcaccatgttggccagactggtctcgaactcctgacctcaagtgatcccccagcattggcctcccaaagtgctgggattacaggttgcaagccacctggcccagccaaggaaggccttcttaatccaaaaaaaaccaaataagatttggccaaaagaagagtcactttgtccttggacaagtatgttggcaaagacatacatattttttaatttgttttaacatggtctggtttaatacacattgtatagatgttctagtctataaatttccctctgagccttttcacttcaagatattccgatgcctctttcttgtttcctctcttctatctttcccccgattgtgttataatcaaagtccaatcacctctaaaaatcattcaggcctgtttctttatgatctaatcagagagaagaggaagtcttaattttaggtgaaaactaactaaatttgtagtcatctgggcattcttagcactgatttaaaccagctacagtttattctgaaacgttttaagtttctcacaggtttccgcaagaatttccccaaattattattttatcatttatcctccttttagatcgatgtttttgacttaataaaccaacttttcttaaaatttgctcttgcaatgtacatggatttcatcaaatgaagtggaaaagattgttgctgaagaacaaataagctcttgattataaatcattgactttcttaactttttgacataataatattttcaggggaacaattttcttcccccacatgcctgtcattgctcagagaactgcaactcccatcttcttcactcactcatccacaacgccgtccacacactctctgcatgatgagtgtgtcacttcagtcagagggaagagagtgggcaggctgttgggactgcaaacccgtgctcagattccccagactaccttcaccaggaacgtggcagacatggaggctggtgacccaacatccatttccctcttggttcaaaagatggaaggatacagttcattgaaaattgttcaaatgcacaaataattaccactgtattactgttacctacagcattcaatatagtaacatgttgtccatgtttacagcctcagagcaataggctgacctattctcttgctctgaaagcctaggtgtctggtaggctacagcatctagctgtgtctaaacacatgctatgatgttcgcacaatgacaaaatcacctaacaacacattgttagaacctatcccaccacagttcagcaatgcatgactgcacttctactgccccatgcacgtttgccactttatggctgtttattttgttgatggagaaaaattagtgcaagtaaaatagagggacctggaggaggtctcttataaattgcttgtgattattagctgagtattctttcaaaatagcccatcccaccactcccactactaattttatctattccatgaatgattaatttttaacaaaaatgaaaaatccaggatggtttaggtaaggaaaaaattaagagttttctttaaaatgtttattttttattcatggctgggcgctgtggctcaggtctgtaatcccagaactttgagaggccgaggcgggtggatcacctgagatcagaagttcaagaccagcctggccaatgtggtgaaaccctgtctctactaaaaatacaaaaattagtcagtcatggtgacatttgcctgtaatcccagctaactcagtagggtgaggcaggataatcacttgaactcaggaggcggaggttgcagtgagccaagatcacaccactgcacagcagcctgggcaacagagagagactctctctctaaaaaaaaaaaaaaaaaaaaaattattttttattcacaatactagcatacacctacatttcaactgattatagcatatgggataagttgaaatttgatattccataaacctttgggtcttttatgttaacagctcaaactggcttcattaaaaaaatgtatggtatcagccaacagatcatgggttctcagcatctgaagaaattcaacgttctctcatttttcacggttttaacttctcatgactttagtgcatggatacacttgttcagttgtatcccatggcttctaacatctgactatgcttcttgagatcagtctgaaagctgaggcatgttcatacttgatcttgaaacatgccatattaatacatttattcatagaagtattagtaattgtgatattattcaggaatcaaaaaacaaagggaaacacagagcttgcttgttatcccaaattatgctctggtttaaggaaatctttccccgaaatcatgttacttaattttagctaatttagatgacatttaccattctcttacctaaggccaagaaaacagttatattttaattagaacttagtgtcaaacatttttaagtttgataaaaaagccacttttctgggcaattttgcagggcctcattttgattccctgttacctcaaaatgactaagcaaaggagagctgtattgggtatttatcaagaaaactataaataatgtattgggaataaatgcgtgtgccacaaaccataaacttgtaaaggctttctgttctcctggtgtgaataagatagggacatcacaactcggagccattaaatgaaaagaatagggttactaagcaagattattaatacttaataattaatacttaataattaataaatactttaaaaaagattaggtaagatttaatttaatagatcagaccctcctttacagtctgtcttcacacaaaatcacaaagtcttacgtgactcaaatttcttttgaagtcatcagaggttgccattctggaactcataagcggtgacagctgatagcctcacagtcatgaaggaggtagaaaagttaacatgaaattcccaaagctcagcactcgagccttttcagaagctggatggaaatcgctgttcacagctccacagcccctgacagcatcattctatgagaacaaggtcaagtggaaggtgtagcggaacacgaatttgtagtctgagatctcaaggaaatgaagcaatctatttggaaaagcaaggacgatagttgggaaccattagcaacactacagacagaataggcagatactccgttgcccaactcaaaagggaattcatattctccaaatcctgacctctagctagctgttgttcttgtaatttgtaaatcggtgtcctcttttctatacccaaagccagcatcttattttgatacatcatactcccttttggatgactgcagtaacttgtcaactaattttgtgctgtccttctcagttctctcaaatgtattcacatacctgccggaggaatatttccaaagaaaaacaaaaccctgcccatcccctgtttaaacccctctcatggttcccccttatttcaggacagtttatgctccctggtccctaacacagctcagggagtcttttctcatctgcccacttccctccttccccacctctctccacccaccttattgtcaccctctacatagaaatccacaggcacacctataaggaaacatagagttatgcgtgattttgaatcttcctggaaactttctctgcttagaaaatttttttactttctagggtctttcaatcagaaggtctcaggaatgtttaatgagagtaatgcatttacagttagtataatgctgcatttaggttatgtttattggaaaaatgaattctcaactttctcaaatattcctcacctgctctgtgctattgcctactacaagcacatatatcttaaggtccaggttgacacattttgctttcctgctggacattttctggtgactgcatttccctaggattcttccccagcaactgagactgatggaaacaagtttctcagtttcaaatgaagattcagaataatgactatcatcctgtgtgtttattagaacccggtgaatcgagatgatttctaaagagagagtgcaatagaaaaatacagaatttagaagaaaagtacctaagttcaagattcattatttatatatgaaattgtacccttgggcaagtaatttcaattctacaatgctcaggtttgtctaggtgtaaaataagaaatagtatcagctctcgatatcctgtaagattttggtgaggataaaacaaacaaaacacatgaaaagttcttttccgccctaaaacactgtaatgttagttacaggcataagttggagatactgtgggttcagttacagatcactgcaataaagcagatatcacaataaagcaagtcacacaaagctgaggtttctcagtgcacacaaaaagtatgcttgcactatactgtagtttgttaagtatgcaatagtcttatgtctaaaacgagaatggacatgtcttaattaaaaaatacttcattgctaaaaaatgttaactctcatctgaaccttcaagtcataaccttttttgctagtggcaggtcttgcgtcgatgctgatggctgcagactgttcagggtgatggctgctgaaagctggggtggatgtggcaatgtcttaaaataagacaacaatgaagtttgccgcactgatggactcttcatttcataaaagatttctctgtagcatgtcattctgtctgacagcagcagaaccttcaaaactggagtcagtcctctcaaaccctgtggctgcttgatcatctaagtttatttcatgtctgaaatcctgtgttatcatttcaacaatgttcacagcactttcatcaggagtaggtttcatcttaagaaaccactttgttcttccataagaagcaactcctcatccgttcatattttattatgagattgcagaaattgagtcatgtcttcagcctccacttctaattctactgttcttgctattttcacctcatcttcagttacctgctccactgaagtcttgaatcccttaaagtcatccatgagggttagaatcgacttcttccaactcctattaatcttcatattttgacctccactcatgaatcatgaagttcttaatggcatctagaatggtgaatcgtttccagaaagttttcagtttactttccccagatccatcagagaaatgtaatgatctttagtgatctatgagagctatagcatcatgaaatttttttaaaatagtaagtcttgaaagtcaaaattactcattgatccatggactgcagaatttaggtgttgttttagcaggcatgaagactacattcacttccctatacatttccaccagagttcctgggtgaccaggtgcactggcattgagaagtaatattgtgaaaggaatgttttttcccgagcagtgggtctcaacagtgaccttaaaatatccagtaaaccgtgctgtaaacaggtgtgctgtcatctaggctttgttgttccatttatagagcacaggcacagtaaacttagcataatcttaagggacctaggattttcaaaatggtaaatgagtattgtcttcaacttaaagtcacccactgcattacccctaacaagagagtcagcctgttctttgaagcattaaagccaggtattgacttctctctagctaagaaagtcctagatagcatcttgttccaatagacggctgtgtcatctacactgaaaatctgtagtttactgtggccaccttcatcattgaccgtagctaggtcttctacataacttgaggcagcttctccatcagcactcaccctgaacttgaactgtgatggagatggcttctttccttaaacctcatgaatctacctctgccagctgaacaacttttcttgtgcagcttcctcacctctctcagccttcatagaattgaagagggtacaggtctttgatctggtttggctgtgtccccacccaaatctcatcttgaattgtaactcctacaatttccaagtgttgtgggaggaacctggttgggggttgttgaatcatgggggtaggtctttcccatgatattctcttgaaagtgaatgagcctcaaagattggatggttttataaggggaactttccctgcacaagctctcttctcgtcgggcaccatgtgagatgtgccttcaccttctgccatgattatgaggcctccccagccacgtggaactgtaagtgcattcaacctctttcttttttaaattgcctagtctcaggtatatctttatcagcaacgtgagaacagactaatacagccttcctctggattaggtttttggcttaaggaaatgtagctggtttcaacatctgtctggactactaaaatttccttcatatcagcaataaagctgtttttctttctaatcatttttgtctacactggagtagcacttttaatttccttcaaggaattttcctttgcattctccacttagctaaatgttttccacaagaggcctagcatttggtctatattggctttcaacatgccttcctcactgagctcaatcatctctagctttgatttaagtgagagacgtgccattcctcctttcacttgaacacttagagcccatcataggactaattggcccaattttcatgttatgttgtctgaggaaatagggaggcccaaggagagggagagagatgtggggatggttggtcactggagcagtcagaacacacacaatatttaccaatttcatttaccatctcatatgggtgtggttcatggtattctaaaactattataattgtaacactaaagatcactgatcataccctaaaattattagaataaatttcattcttttaaaaaaattattctgttttgtattgctcaggctggatgcagtggcgcgatgtcagctcactgcaacctctgcctcccaggttcaagggattctcctgcctcagcctcccaagtagcttggattacaggtgcctgccaacacgcccacccagttttgggacttttaatagagacggggtttttccatattggccaggctggtctcgaactcctgacctcaggtgatccacccgccatatacttttgaaagacaaagtctgaactattaactgaaaacaaagatccccaatcactctaacagattaataataatgcaaaggtttaaaacattgtgagaatttccaaaatgtgatactgagacatgaagtgggcacatactgttggaaaaatggtgctgctgatagacttgccgctcaataccgggtttccacaaaccttcaatttgtaaaaaatacaataccagagaagggcaatgaagtgacatgcaataaagtgaggtgcgcctgtactgttttcattttcatcaagccaaaccataagaatcttgcacaacatctgtattattagagtagcatgaataatgctttttattgtaattttgtttttacttccaaaaagagaaataatttttttttctgattatgaactaaacaggtcctcctgtctagtaatagaacatcaaatcatcaccatagagattcaacttctctttttaggaattaaaaatagtcacaatccacttatcaattacacagttaataacttgatgccagaaggattttgacaaaacacagtacccttcattctcttttaccttagaaatgatttacatttcaggttaaagaaattctgacactcaactaaaaatacctgcagacagatatctgtaacccatatatgaattgacagcattttaaaaatagaaaagttggtatttcttcatttttcaaagatttaatgttaagaaggaatggttactagaattaatatttttccagggacactaataatttgattataattgaaaattaaaaaataattttagaaagaattgaaatacacatagcattctcataaaaatagaaattataattataatgttgatttagtttttgacagaggtaaaaactattaaatgcattagatacatattattgaaaatatttgaaggggtaggtcatagtttctctttccaaacataaaatataatattaggttggtgcaaaagatttttaccattaaaagcaatagcaaaacctgcgattacttttgcaccaaaccaatgtgtactgtaaagccaaatcctgtaatctctttaaatttgacttaacatttgcgacctacatccactcatgcattgaaaaggcagctccgtggagtcaacatctgtacatgaagcccgtgaagacgctgcctccatgggaccagaacaagttaaagaattcaggttgctggtttctttcaataaagttgtgggaagtaagtttcactatatgtagaacattctgaggaattgtagttttggtatcatttagtattatttggatattaagaacaggacttataggagtcttcaaaaataatcataatacatttatgaatgtaatgaaataattgtgttatactgttgctatagctatgcagattatctgagagatacctgagttatttatgtttctacaaacataagttacactactgctatattcaatgaaagtatacattagtaaattttcctatactctgtgttactaagagtgtactgtagttacaggaactgtggcatctctatagtgtgtatttaaaaaatactcaagcaaacttcagttataaggcaattatgatccaagcaaagttcaattataaaataggtaatgataatatagaaggcacaattaggacaaaatattcctgtctctgtactgtcagatagcctggaattacaatcagtaacctgaacttcatttagtgtgaaggcagagtctccaaaatccaattcaaacaaaaaaggttaaagtgacatgttattccattatcactcattgctatattgatacagactagttgatcagtgtcctaccacaaacacacacacaaagagagagactcactcctcatgcagtgagacagtggaaatagggaaacagatgtcttaagaggaaaaacccaaatgggacatacgagataggctttttaaaaaaccctacataggcctgcacaaagaaatggatgtaattctagacaaatcccaccatgttgtataaatggaggtgaaagataaggaattacccctacccctaaaaacaactgagttgaaattaaaagtatgattatattatggattgtctaacttcacaagtattatcaacttactaatttatattaatgaatagctttcaatctagatatgatttcaaataagcaatacatatttgactattcagttattgaaatgattttcatgcatctactgtgtgttaaactttgtattaaatgttagaaatcaaacacgagtgagattcaggactatattctattattctataatttaatggaggacataaagagcagatatttgacaaagaaatgcataacatactaagggagttcatttaatggcaagaccaattataattttgtttccaacttggtatgaactatgcttaccaactgtgagagaggggagttaagatactattcatgtattctcaaattagtcaattccaagaatttgttgagtgttactcttttcaaatcaggtgggtggttggctcaatcagcgctggcaggttacattcccatcttactgttctcaccaccacccactgcagtgaaaaacacttttatgacagaaatttacctgttttaaaagtacttttgttctcagaactgagagattttattgttaaataaaagtgacaggggaagcaacataaagtatcaaagatggttctgatcaagtcatgtaacagtgcctatgagaaagatttgccattctactctatccatcctattagtccccctaatatttccttcttaaggctttgaaatctccccatagaactccttatgttacttcgagaattttaatagtcatacggcaaataagcagagagcagctcacaattaatgtactaatgcccttttcttttaataaaaattatactctttcattatcctattaacaaatgattctttagggagcatttctttaatgttcacagtgctggcaccctagttggcactcaactatcttaaatttttaatgaattcagaattagtctgggcatctctcaaaacttagagtctctgagtgcatgagtggactctttatgttatcagatttattgttttgaaagcaaagaagactaggaatataagcaaaagaggaaacaagcaggtagtttgagagtgtagaaaactccatggcacacaagcacattgtaaggtaacacctttttcaccaatggagagaaaagagaggaagagatggaggagcaaaacgactcgctgttaccatactagcagtgtcagcactacaaaatacaacatttaaaaatgtgttaagatgtttttctgtatttatcaacagataaacccacagccagcccaaatcaggtactggagattaaaactaaatccctggacaaagattagcatctcaaggagaggctgtacaacattagagaaaaatgtggttgagcaggttgaaaaggacaccttcacagacacatctgggagaatgctagcagctcttcaaatacttctccttagtagcatttatctccatcttaactacatcactgatgcattaattataggacatttttctctctggttagaatgtaagttccttgagagaacagaccttttttgtctgaattccagtgactagtctactgccatgcaggctcacagttcgtatttgtggaatgaaattgctgaagaattaattatacatgaaggaaattcaagcgtaaattgagccattaatacaaatatgaaaatacaaggaaatatgaactttagaaagcaaataatatgccacagaggttcccaattgcatacttcactggactcacttcatttagggacctcattttctaaggtcccccagctgtccagtgctcaggtcatcactgacatgggctcagaaaatacagatacatccccaaggcagagccagtgtttgttttatttttgttttaatgtaagcaccacttacctttttcacctatgggtagactctctcattccatgatattagaaaatgtttcaaatgaaaatgcccctggttgtaatataatgactaaaattacattaagatatcaatataaagagtatcaaaaactttcctaaaaatcagttttaataaaagagttgagaacatgagaatgcccttaaggaaagggtagtagaaagaaaaatcaaatatacatttgaagttcatcaaaatagatttggagttggcacagattagaattttattatttttttaaaaattgggccagaaacgagcacctactttacgctaggcactgtgcttccctatgaaaggaagcatggtttctgcttcaagtgggtgagtggagggcctacaggtgcttagagaataatttctttttttttttttttttttttctgagacggagtctcgctccgtcaccaggctggagtgcagtggcgcgatctcggctcactgcaagctccgcttcccaggttcaagcaattctcctgcctcagcctcctgagtagctgggattacaggcacacgccaccacgcccagctaatttttctatttttagtagagacggggtttcaccatgttggtcaggctggtctcgatctcgtgacctcgtgatccacccgcctcagcctcccaaagtgctgggattacaggcatgagtcactgcgcccggccaataatttctaaacaatagtaatgcaaatagagtatgcacagcgtggacattccagcttcctaaacgcaggagcactaacgctcctctggcttgagagagagtcatcagaatgcaaagatagaaagagatagacaaattaggggatgcaagggatgcaatccagtacaggctccaatttctaaccctgtcccacatcaatgaggacctttagagagggcacaatattatccacagtctcataattcaacagggaattgggcaaagaaacaaaaatagtgactatggactaaattgattctgaacccatattatgattcagtaagataaatgtccctgaaagtttctgaagattcttagggcaccctgatgaccaaaggggtgagagctagggtcatcacgtgacctcattatccttattatctctcagcagttaccgagttaatggggagctagaaaaaattgtttttctcaatcactggaaaacagtaaatgaataacagatagctagttttaaaatttactggatattttgtcaattttctaagctacttgttatatctttctaatccttaagataattgcatttattagaaaaaattaaattggcttagtaaaattttagtcaaaattttgtgtatttgtttaggaaatgaacaaagagattacaatctggatcctgatagttcactggtaaaagataagattataccaacaaatagataacttacacgaaacgggtaaattccaagaaagacacaacctaccagaactcactgaagacgacatatcaaatctgaatagacccataacaagtaaagacattgcgttactaattttaaaactgccaagaagaaaagtccaggtccaggggataccttggtaagttcaaccaaatatttgattcgttttcaacagggtaacaagatgattcaatggggaaaaataatcccctcaataaacggcatatgcaaaagaatgaagctgagttcctacatcacattacatataaaaattaagtcaaaatggataagaggcctaatgcaagggatacaactataacagtctcagaagaaaatttaggagtaaacctttgtgaccttgggtttggaaaaggtacttagatctggcaccaaaaacatgagcgaacaaagacaacatatacacactgaactacaacttttgttcttcaaagaacatcatcactacagtaaaatgacaacccaccaaaaggaaggaaataaatgcaaatcacatatgtcataaaaaacctctgtccagaatatataaagaacatttacaacttaacaaggagaagacaaataacccaattaaaaaatgggcaaagaatctgaatagacatttttccaaggaagttatacaaatggcccaataaactcttgaaaagaagatcagcatcattagtcgttagggaaatataaatcaaaattatgagatgtcccttcacacctacaaatattgctaaaatttaaaacaaacaagaaaagaataacgggtgctgtcaagaacataggtaaattgtaaatctcattcattattggcagaaagggaaattggtacagccacttttaaagagtggcataccttaaaatagtgttaccatatctccagcaacttcccttctaggtatatatccaaaagaaaagaaaatgtatgtccatataaaaactcgtacatgatcagtaacagcagcatttttctaatagcaaggaagtagaaacaacccagatgcccatcaattgatgaatacataaacaaaatgcagtatattcatacaatggaatattatttggcaataaaaaggaatgaggtaccacaagtcgcaaatatggatgaacttttaaacgtcataagcgaaagcaggcagtcacagaagaccacgtattacatgtttccatttaaataaatctcccaattaggcaaattcatagagacaaagtcaatttgtggtagccaggtactcggggaagagggaagtgagcaggggcatggggtgtgactgctactgtgtacaggctttccttttgggaattatggcagtgttctaaaatttgatggtgttgatgattacacaactctatgaatacactactaaactgtacacgtaaagatggtcaatttaatgttaggaaaattaagtcaatcaactgttatttttttgaaaggcagataaggtggtatcttagattccataagccagcctaaaagtgctgaggaaccacgcagtatttgtgtgtgtgtgtgtgtctgtgtacaggtgtgtgtgtgtgtatcagatcattataaggaaggatgtatgtctagagaagtcgtgttaggcttcacatacttttaatacattgttaccctaatgttataaaaacttatagtggatttatattttagacacaagtaacatatagttggccagttgaagtttatttctggaaaacttctgtttacattttattttaaaatagttatccctcaatcagcatgccctacattttcctagtggcagaaagtagtgaccagaataaaaaagcaattaaattaggcaataacattactgaagaggtcactggttctgcttacatttcacttgttttgcctatatatattatccattgaactaaatacagagaagccacattttctcttaatattctcttatggtctagtgattttctttcttttttacatatggaaaattacaaaagctctagctacacaacgacatcaaatatacaagtgtctaattgcaatacaccgggatattttgactaaagagccgtgataactttgcaatgatgtaggacgatgtttcagacaaaatatgaagccaaaaaaggcagaatataatctgaactgacatttcctatctagaatgacagaaatgtaaatgtgtttttctctagtgctgaaggtttggaaaatgctagaccctaagatttaccatggaatttgatgattcatagtgaacatgaagagacagacgccacagtctgagttctatttggtaattcgtggccacaaaagtgcacccctcattgctttccagctatttacacttgccagtataatacaagattcttaattagcaaccatgtggcttcactttaaatagccttgctagctcccttgggacctcttgaaatatcattcatattagtagaaataccatcccattttgttacagatttatttatttctcttgctatcctttttttttttttctgttaaggcatattactgttacatgattataagcattttttaaagttatgggcagggccatgatctaactatactttgtagttacatgacatctaaaaatgtgctatctgattaaaggatgcattttagtaataaagatgatagctatttacatccgataactgcctacaaaaagacagaaatgagctgaaaaatggaagaagatggaataaatacagtttactaatagagcttatacttctcccatttggtttaaagaggcttttaaacacttaagctgagatttactatgaaaatcagacttacaaacatcaccatcaacacagaattattaaaatgtagaaagtgtggatatgtctaggattgcgatcccattatgcagggacctacgacctactagaaatgctttgcaattcttactgaactattttttcatgtaaatgaacatcacaaggacaggtgaactctctgcaggcaccgatcgtctggttttctaaaagtatacagggcagacagggtattcaccttgattggaaacagagaatccaggtatatttgaatcttctgcctccaccatattgtgtagcactatgttttgtttaattttatcagtagaaagaaaaaggccagacaaatgccgtgactcaatcctgtaatcccagcatgttgggaggctgaggtgggcggaccacttgggcccaggaattcaaaactagcttgggcaacaaagtgagagccgattctacaaaaattacaaatattagccgggcatggtggcacatgcctgtagttcaagctagttgggaggctgaggtgggaggatccattgagcccaggaggtcaaggctgtagtaagctgtgattgggccactgcactccagcctgggcaacagaaagagattctgtctcaaagaaaagaaaaaggtcatacaagtttaccactaataggccaggtgcagtggctcactcctgtaatccagcactttgggaggcagaggcgggcagatcacctgaggtcaggagtttgagaccagattgccaacatggcgaaaccccggctctactaaaaataccaaaaattagcctggcatgttggcgagcgcctatagtcccagctactcgggaggctgaggcaggagaatcactgaacctgggaggcggaagttgcagtgagctgatattgcgtcattgcgctccagcgtgggtgacagagtgagtctaatgaaaaaataaaaaataaaaaaatgaaaaaaaagtttaccactaacagttgaagcaataaattttgttttgacgaagtaacatttatagtcggtgattattataaaaaattttgttttaaatcattcacaattgagttcccatcctattgtaagtctactgctaatctattaattgcatgcattattatgttggtcttatgatactacctagtaaataaatatacatatgtgggtcatactccataagtctgaaatacacagtttaaggggctaataaggtatatgtaactaagaaatacactagtatcatcattatctgctgttttatgttttaataacttctatttctgatatttcaaagtgatataaacgagcaagttctatacaaagctacctcatagattctaaaatcactggcctttcaaacatgtttatgggttctttttaaaaaataaacattcggatgctgacgaagtagaaaattagtcttctggagacatattatgatggagccttaagatggatgaaaagtataaactgcatcatccagggctggatttcctgtgcacactgcagaaacgtccttgatgttactgatgtctgcctcacgcttagctctcagagccgaagctccatcaggacagattggaactgccacccagaggcatttcacaatttgaaccaaaaggttttcaggcttgcgttctagctaattctgtcgcttctaattccagccagacttaaactcttatctttggatgccaggcctacagatagggctatcacagtagccccaattcccagaaaatacgcaactccatgacccaggtgagattaaatccttccagatagcctaaataaatggtctataacttgttcctgtcactcccactaatgcctttgtactgtgaaacagactaggaaaggtgtaaatatcttcaaattattagctgcacttcctcttccttgcctctaccaggaactctagcatcacgctcctcatggggcaaaggaaacccagaggcggcagttcctgcactttcttctcctgtagttattaaccaatttgcagatctccgtgtattactggtaatagaggcacactcatatcttttctctttaacaccttgccagtaaaattctcccgcactaacctgtctgcccctctctctctaagaaagatacagacccaattatacaatttagcccattactttggttcaaacagatttcacctcaaaacagatgtacttgaatgtaaaaggaccttcttgtcagtgcgtggggtagctgtgctctcctgtaccccctaaacatttatgtgaagtagtcacatctgaagaacacacacatatataatgggaagtatctcttaagcagcaccgcaggcatttgctttaaaccccccgtaactcataacggcttgactgtgcatccatgcttctcagcagctaggggttccctgaaagcagggacaaagccgtggtcttccttgtttcctctgcacctcacctcgtgctgagcacatgcagactcagaatagatgttcactgaataaaagaaaggatggacacatgaatacattaaatgaacctcaaacgttatctactatgctctgtgcagaatcagtcagaagacaaggtgtctcgggaatgcaaaacgggacaaagaaaacccagctcaagcaagataagcactgggcagtggttccatttgtctgagcgaggcagcacgtcgagatgagacgaaaacacagacactgactgagtaggtagagcaaggggtggaaatcaagaaccaacaagcagcccagtgcccatctgtgagctggggctgcaggaagaaaagttggaaaggtggctgggtgtggtggttcatgcctataagtccaacacgttgggagcctgaggtgggaggactgcatgagcccaggagttcaagacaagcctgggcaacaaagcgagagcccatctctactaaaaaagtgagccgggtgtggtggcacgcatctgtggtctcagcgacatgggaggctgaggcaggaggattgcttgggcccaggaggttggggctgcaggcagctgtgtttgtgccactgcactccagcctgggtgacagaggaagaccctgtcttaggaaataaacaaataaagtaattaattaattaattaatttaatttaatttggaaaggcaaggctatgttgggagggccctgacatagtgagaggaagtatcattatttgaaggactttgaatgtttctcatgtgactggaaagactattcatattcttaccacagcaagatctgaatttgtgaattgtcaagctctctcggtaacattgtttcattttccattattagttttaagtcactttaaaacaaattgtggtaaaattcaactcctgtcccacgacttagtttgcccacatttaaaactattcctgaaataaactatgtaaatttaggagggaaattttaatctgttaaatgtatttagacatttcctattcagagaaacattatgaagccttctattttgtgtatagtctagatttttaactatgaatatgtgtgtgtattcatgcaaatagtattgatggagatgtatagatagatagatgataggtagatagatgccagatgggtacatggacagtcacacagatggagagatggtaggtggacagactgacactatgaagaaaaacaaagaaggctgaagatggctggggtgaagccatctttctactgggtcttcaggggaaggcttttcgacaaggtggctttagaattactacaagtgaattctatccatacaggaattttgacttttctggagttagagatgatcaaatatattttgaaagaaataaggtcctggtcacaaatatgccactacagagataggttagtcctcacgaggcctacacctccccgactctaaaaatgaacaagatgagcagattgtggaactctgggtttcattcttattgccctttgaggggaaggtgcttagaggtaaatgttggcttggagctgactagaatgaactggttagctttgaatttggtatgcagcacaccatatatgttgagaggttatttaaatgtttttatagtttacatggagagattaattattttatttttatgtaaaaattgctgagatttcagcagttacgatcgctgacctattaatttaagtaataatgtaatgaattttatatttttacatctgcagaataactcacaatcctgtgcaatgtttctgatacctgcctaaatatctgtatttactcattttgcatttcttttcaaaggctctcatgatttcaggaggtatactgatgcaaacttaatatccagaaagaattctggtgcaggaatggtttggtatcaagaacgtgggctccagaggtggacaggtgtgtgtctccaggctaccttgtatcctgcatagctttgagatcttggacaatttatttctctcagagggccacagtttcctcatctgtaaaataaggacagcgatactaagttcagagtgtcatcgagaggataaagttaaagaagatcctggacacacacccacagtgcctaacagcattccatctgcagaagaggtcttggttatttgatgggattgagtgcacagagtgaaaaatgtgtccatacagggaacgtacttactcctttggagcacttatttcatatgtggatcagacaagttagcaagatggtaggtatgctgccaactataacgacagagatatctacacatgtgtagattgtaagattggtgcttctggagcattaataacagatcagaacccgaggatttgttttaccacagattaggatgcaccccaaacaccttctagaatgtccaggctgcttctcactctgttccctaaactctaagaattagctataaattagctattaatcctccattcacatccaattttgtgtagttttaaaagtacaagcatataaaaatagataagccaacctgttccattagccctttaatcaatattttagagaagatgaaaatttgactcacattgtatgtttcacttacaaagcactcctatttcaaggactaaccgtactatagctggtgatatggtttggctgtgcctctacccaaatctcatcctgaattgtagctcccataattcccacatgttgtgggaggcacctggcagaagataactgaatcatgggggtggtttatcccacactgttcccctggtagtgaataagtctcacacgatctgatggttgtataaggggtttcccctttcgcttggttctcattctcttttgcctgccgccatgtaagatgtgcctttgcctttcaccttctgccatgattgggaggcctcccagccatgcagaactatgagtccatttaacctcttttttttttataaattgcccagtcttgggtatgtctttatcagagtgtgagaatggactcatacagctggaatttttttttttttttttttttttttttttttgagatggagtctcgttttgctctgtcacccaggctggagtgcactggcaggatcttggctcagtgcaacctctgcctcccgggttcaagccattctcctgcctcagcctccctcagcctcctgagtagctgggattacaggcacatgccaccaggcccagctaattatttgtgtttttagtagagacagagtttcaccatgttggtcaggctggtcttgaactcctgacctcgtgatctgcccgccttggcctcccacagtgctgggactacaggcgtgagccactgtacctggccaaaaattattatttaacatgaaaagagcacgtatagtatgattttttttaggaaaaaagttaaaactgtctgtcaaaatatagctaatgtgtaccatttagataaatgcaatttaagagaatattatgctggaacacatattatgtgtcttgtgttcaagcacatcacatacatcatccacatgagctgtcccaaagtctgtaagagcagagtcacacactcatttgacaaatggatgaccgaaggcttagaaagttgaggtaattttcccaaatacatacacagcaagtggtggagacaggattcaaatgtgagtcaatgcaacttggagaatttccgtaatggtggttaaggaaataaattttgcctgctgaatagttgtaatgttcattccttcacctctaggctaaccatttcacttctctgcctaaaatctccagtggttccaccttgcatggttgtttccacgtgtgattgactaggcatacttactagtaaaaaatgtgagcacacagcccccaaagcatcttgtttattcacaaattttatatgcattactctactaagagattaagtacaccataaaatacacactgcttagaatttaagaacagatccaaatgagagaattacaatgttgacacgtggttatttgtttttcactattgagtaggaaaccaacgaaaagcttccaatggtactctaatgctggtgaaattttttaattaccgatgacttcaccaaagtttgtcttcaagttttaggtgatttcttggtaagagcgttgaccatggtctcagcctcacactgttagcagtcagcatcacattgcacaacactccctgaggacaaggctcatggttaatagtggtggatatgaattcttatttcaaatagtgcttaactcttgtcagatctgataaaaccatctttttcttttctttttttgcttgttaatgtggctggtgaagtgccttagtatagtcttcaatactatttcattttgtaagagttgctttagtttaaacgaggatcatgtcaactgcaaaacactattatgtgctacaggagacaaatcaatgctggcacacaggaatgtccgcttttcccaaatgttacctgtgaccatcagaaatattcaggcaactgggagtgggcataccatgagcaaagtgaggggtttttcctatttgctttgattaaaaattaatataaatgaaagtcctagtattttattcctgcacactgatggtatgtttcgcatccgttgggatgcatcaactgattttggagcccaggaaaagtctaagctatttggacactaagctgctacttaggactcccagaaaccccatgcctatgctcgcagctacatctctcaatatcttcatcaacatttatttgtagtttactgtgcttacgtacaacctttcaggtcatggctgcactcaagctgagttccctacctagaaaatccttccttcctatattttactcttaatctaaaatttctacattattcctacttatcctgtaaaagtcagattcggagtgattggaagacatttcttccatgtacttgtgagaattaagggttaacttgtccagtactcattcctcagtacgttggcttgaaaaggacttagccttgcaggctcaggaaagagaatggtgtttccctatcaggaactctaaagcagcaagtgaagaggggtggatggatgtggaatgagatgtggacttgtcactctgccaccaggacgaatatacaaaatctggagtccgttacacttgacattttcacacacagaagccatgcatttttcaaggtactatagcttttaataaaagctctttgtgctttgaagagggtgttggataacagtacatatacatacttgttttaaaaaaagaagaaaattaattgaggccagcatacatttttccatgccatttccaactttaacaccgttgaaattcctttaaattcagcttgaggttcccatggaatcacctctggccacgggccgtcaggtacaatcttgggattaagagctctctgtgaagacctggtgaccttgaccattcagggcatttcagattattctaaggcatatttttaaaagtagggttttttcctacatgactagttttgttaaacttgtaatttctttttaacataaatttcatactgaaacaagttaaactgttttttactgaaagtcagcttttgacagaagcgtacccctccctggagaaacagttcttcagaacctatgaatatgtaacaccaatgacttctagcacttttaattttacaaattcccttctaacggctttaattgtaattcctggcataaaagaggcaacaggataatactttgttgaaatgtttaattgaagtataatacatgtatgtcttttatgaaacaacctcaaacttagcattgcaagcacagtacaaataactatttttaaatcaacaaaaatgatatctatttattgtatataatgttgttttgaaatatgtatgtgttgtggaacagctaaattgagacaatatgtgcattacctcatatacttattttttgtggtgacaacaccgaatatctagtcattagtgattttcaagaatgtaatacattgttattaactacagtcaccatattgtgcaatactgtgcaatacatcactttttcctcctgactcactgaaagtttgcttcctgtgaccaacacctccccgcccacacacagccccaacttccagcccctggcaaccagcattttaccctctacttctcagatttcagtgtttttagattccacgtatacgtgaaaccgtgcaatatttgtttttctgtgcctggctcattttatgtaacatcatgtccttcaggttcatccatgttgtcacagatgacagggtattgttcttttaaaaggtcctatggtatcttattgtgtttataaatataacacattttctttattcattcatcagtcaatggacacttaggtaggtccctacctgggctattgtgaatagtgcggcaaaggacatgggagtgcagacatcccttgacatgctggtttgtttcctttggatacgtacccagaagtgagaccactgggtcatatgacagttctatttttaacttttgagctgttttccataatggctgtaccaatttacattcccaccaacagtgtacaaggctttccttttctccacgtccttgccagcgcttatcacttattatctcttgtctttcttgtcttttttttttttttaagatagatgtcgctttgtcacccaggctggagtgcaatctcatctcactgcaacctctccctcctgagttcaagcgattctcctgcctgagcctcctgagtagctggcattacaggcacccaccaccacacctagataacttttgtatttttagtacagagagggttttgccattttggccaggctgctctcaaactcctgacctcagatgatctgtccccttcagcctcccaaagtgctgggattacaggcatgagccaccgtgcccggccatctcttgtctttttgataacagccatcctaacaggtatgaggtaatatctcattgtggttttaatgataattttttccctgataatttatgatgtggagtattttttcatatacctgttggccatttgtatgacttcttttgagaaaagtttattctgtttctttaccccatttttaaattgggttacttattttctaactattgagtttttgagttccttatctattttgaatattaacctcttatcaaatgtatggttggcaaatattttctgccatttcataggttgtctcttcactctgctgattgttgcgtggctgatacagaagttctttagtttgatgcattcccacctattttcccttttgttgcttgtgcttttggagtcatatccaaaaaataactggccatatcaataccacgcagcttttcctctgtgttttcttctgtgagctttacagattcagttcttacatttacagctttaatccactttgggttgatttttgtatatgaggtcagataagggtctcatttccttcttctgcttgtggatatccagttgttccaacaccacttatggaagagacagtactttccccgttatgtattcttggcgtctttgtcaaaaaccaattgactgggccaggcgcggtggctcacgcctgtaatcccagcactttgggaggccgagtcgggcggaacacgaggtcaggagatcgagaccatcctggctaacgtggagaaaccctgtctctactaaaaaaaaaatacaaaaattagccgggcgtggtggcgggcgcctgcagtcccagctacttgggaggctgaggcaggagaatggcgtaaacccgggaggtggagcttgcagtgagccgagatcgtgccactgcactccagcctaggcaacagagcgagactccgtctctaaaaaaaaaaaccaattgactgtatatgtgtggatttatatctgagatctagagatactataactctctatatctctagagatactctaactatgtggtatatattttaaggcaggtagtgtgatgcctccagctttatttacataactacttttgggagtaagttgctgccatgatgctccatcatccctgaaaactttactgtgtatttcctaaaaacaagacattcttctacacaattggtccattcaccaaaatcaggaactcacattgatacactattagcatttaatccacaggcctgatgtaagttgtctcaattatgttctttcttaccatgtttttcatttttctaattttctcttttttaattttaagttccagggtccatgtacaggacgtgcaggtttgttacataggtaaacgtgtgccacggtggtttgctgccccatcaacccatcccctaggtattaaacccagcttgcatttgttattattcccaatactctccgtccccccacccatcccccagtaggccccagtgtgtgttgttcccctccctgtgtccctgtgttctcactgttcagctcccacttataagtgagaaggtgcggtgtctggttttctgttcctgcattagttatgcaccagctaagactatgccttgcatttaggtgccatgtctcttttggtcctggctacatttgcatataggaaaacaataacaattaatggcaatcatcaatactttcctctatctagttaggttaatctagacatggtgtataaaaacaattacattattaatcttaaaagataagtaaagcgctcatgaaaacggggaaactgatacataaatattttcttcgactgctcatgctgcattctggagacgaccttcactattttttgcacaaatatttgaaaaacatacgcaggtattttatctaaaagatccatgccttcttaaagcatgaaagttggaaaagtggttgtgggtccaccaaactacaaagcccaatttctagaagaaatagagggcatggcacactgctgatgaagaacacacagggcagaaatacataacttgcccgggcgcggtggctcacgcctgtaatcccagcactttgggaggccgaggcaggcggatcacgaggtcaggagatcgagaccatcctggctaacacggtgaaaccccgtctctactgaaaatacaaaaaattagccaggcgtggtggcgggcacctgtaatcccagctacttgggaggctgaggcaggagaatggcgtgaacccgggaggcagagcttgcagtgagcagagatcgcgccactgcactccagcctgggcgaaagagcgagactctgtctcaaaaaaaaaaaaaaaaagaaaaaaagaaatacataacttgaatgaaaatgtgtattagctaaaataaaatggttttaaaaaaaacaggatcagagggttttataagtgagttccactaaactctcaagtaacattccaattccttcatgtttaaaaaaaagaaaaagaaaaaaagctgttcagttttgtttaaattaatttctaaataaaacaggagcaataaaagaaaatgaggatgaaattccatttcacttgtaagtatacatatgaaacagaatccaaataatatcccatcatcaagatttatctcaagaatgtgaggatggtttatcatctgaaaaatccccatcaatgtaatttaaaataggaagaaactgaaaggtaaagcacttattatctcttataatacggacgcaatgacttaataatagtccataactttactattaaagcaaacagaaaagaacaacagagtaaaccaggaatggaacagaagtctctaacttgataagggcaatatatcaaacattgcaaaaatatttaaatttctgggagaactcttagctacattttaacttctgaaaaaaaaaaaatagaggatgatatcagcaaacaaaacaaactccagagatgagaaattgaaactagcactcagaggaacgccagggcagtgggccttctgagcccagaaaggcccggattcacaatgaagggacctagcctcagacggcagatgagagtggcagtgtttagcactgtcccttaggagatgctcagtaaaatgcctctgccagctgcctcctcttcctcacctgtatgtagctgtgaaatcctgggcactgttctcgaaagagcataagatgctccgagagggtcggccttatacgatttaagctgggccaagagggcaagtggagtctcaggggatggcagcctgtgctgtggaggtgagggccacagagcaaagcccctccatgaagggctcaaagcaaaggagaggccttctgcagtgcggccattaagatcatggtctgggaagccaggctgcctgggtttcaatctcagctctaccacttactgcatgactcagtttgtttgtcttgtgccctgcactcctcatctccatgaagagctaatggcagcacctacttcaaggttggttggaaggggtgaatgagttaatccaggtaaaacatgagaacagtctctgttcttcctcaagggaagcctcctgacgcctgaacacacacattccactggtgtatttccagcacaagattctggtgtgcatatgcctccaaaatgcaatagggaatctatgtaaccttccaatactaattaacatattgtttggccacacatattaataaacaagcaggaatcatctgattttggaggtaagtaaataacatgaaaaagaaatgccaagatgcacaaagacaacaactaatcatattaataggactgtttaatggaaggtacatgaaagaagaagaaatcaaagaaccggtgcttctcagactctgacgtgcaagtggattaccaggagatttgttattaataaataaataagaatgaaatgcagcctgcatcagcaggccaggcgtggactctgggattcagcatttctcaacaagcccaccgtgtaacaccaattgttgctggtccacgttccacacttttaggggtggggatcaaaaagataaagtcaagaaatgtttcaggagtaggaggaaaacgacaaaaatatacaaagaaagagatatttttaaagtaaatgcaaaattaagaagtaaaataattctaataggcatccttaaagaagatggcagaaatcagagaggggagaatataattttaaaaataaggatattttcctgggcaataaggataaaaggactagttctccatgctggctacatgctctgattttgggtggcatcaaagaataccaattgtttggccataatctatggaggcatagcttacgtatctgtggtttttaaaatcatagtgaagtgagaagcactcatcacgcattagagtaaaacagcccaaagggtatgcagcgaaaagaagacagaacccaccttgacatattttatggctctaaacggggatagaaaatctgagaggttttacaagaaatataacacctgaaacctacatatgaaacaaatgcccgaattgaattcaccttctcaatagtagtgccaagttttagaagagcagtgccttcaaattgggagagaaatgctataaacacagccaaaccacatcaaaataaagaatggaactaacaaataatgccttcaaggagaaaggagattatatgacaacaaattctacaaatataaataaaatattcattttttaaagatggagtctcactcttattacccagcctagagtgcaatggcgcgatttcggctcactgcaacctccacttcctgggttcgagcaattctcctgcctcagcctccgaagtagctgggactacaggcgtgtgccaccacctggctaatttttgtatttttagtagagatggggtttcaccaccttggccaggcgggtctcaaactcctgacctcacgtgatccacctgccttggtctcccaaagtgctgggattacaggcatgagccactgcacccggcccagatattcttaactataacataaaggcatatgtttcttccaccaataagaaaaataaaaatcaatttctctgagaacaatagagcagtaaaagaaaggcataaatctgaaccaaatatgaaacaaactaaaatatgataagatttttagtaactgatatctcctataaactctgaggtttggaacattattaatgattagtacaggctgagaaacattcaaatatcatttctttctcatggatccaatcgtcatacatacttgcccggccacataatacaatcttataaaccttgtcaatgtaactgtattactacatctgacagaatttaggaggagacaaaaaagtggtgaaaaatgtggatagaaaatgattggttgataagttccatcaaagtttgttgaatacatcagagttaaagtatgtcgttcaaagtaacaatgcacttgatgattacagctcccgtaagtacgggaagaggatggatagattaacaatgggaacaggctgggagaagagatgtggggcaaagaatgccaaattattaggttttcaaggtggggggtgaatgtgcatattttaatgttgataaatcaatagctccgcgatgatgataatccccaaaagaactaagtggagaaacacgtacaagtggctaactctggggaacagaactgaggacatgagagagtgaattccttttttttttttttcattttatgaagaaagcaggaaagcatgtattacatccataattaaagatattttaaatggtaatacaaccaagcagttgaaataacctaaacatttcaacttcattaatatctatttttaaaagcattttgaatcatctgtttctcttagatacttcttcattttacttaggaggagagcagcattctatcgtcatttcttctgggactttgcacaaatcagaagatttgcacaaggcaatactgtggcagcacagaacaactttaacaagttcacggaaaggaaaaccattcacattcgaaatagagctccatgcctctaaccaataccttcccctggcatatgtctgaccttgtcctggggactgaactagagtcatttcctgtgttactcaggacacaagtgtcacgatgttgtatgcactccagtcttgactgactagcccagaagggcaaaaaggcaatgtgaggggcttagtcttgctgcccagccctcactgttcactttccagaattcttatggtaggaaaatttctcagttcaaaagcttcaggttacctgtgcatttgctctttcaatacacatgaggagctcggtgtcactcaacctatccgtattccccatgctccaagagtctcactcagaggtgagcgtagggttagaagaaaaaaatgggaacagttatcatttaaacagtttctcacaacccccatcaggtacaactcttgagtgagtaccaagattccttgcttaaaaataaaaggttgaaggccgggctcaatggttcaggcctataatcccagcactttgggaggccaaagggggcgcatcacttgaggtcaggagttcgagaccagcctggccaacatggcgaaaccctgtctctactaaaaatacaaaaattagccgggcatggcggcaggcgcctgtaatcccagctactcaggaggctgaggcaggagtatcgcatgaacgcaggaggtggaggttgcagtgagccgagatcgcacctctgtactccagcctgggcgacagagcgagactctgtctcaaaataaataaatgaataaaaagttgtaccaagtagtggctaatttataaagcaaataactaatcttttaaatgagagagaacagaagagtttctcattttggagattaaagcatggcccagtcagcaactttataacactgaccaggagaggtacatgcctttgttaaccctggctgttgttactgttatatcactagggtgtctcctcaacaacactgttcctttttctcttttcctgttgctgtgaactaggcatcaggcatagttgtgtatgaagttatcaggaaaatcacaaagatgtgtctaccagggcaggcaaaccccagatcctaaggtttctgtccagcttttccataaacttttcctatttcttactcccaagtttgtcaaaaaacaccagtctttgactttttctctaaatgaaaaccccatagaatctaagttccaagcccaaaatttatttgcaaaagaaaggaggaaggaatgaaggaagaaggaaggaaatacatattatgtctatttaatatacactatgcacttctttaatatattacttattacatatggatgcatttttatctgttcattcaagaaaggatatgtcaaatgcctttgcttgggaacacctacgttcagtttgctccaaacatgtacctggttttcaaacgtcccacactcctgcttcacagggaaagatttgccattatgcttagtggtgggaatctatgcaaatggttccacatgccaatgccaagccaaaagagaaagacaagcctttgttccagaagacacagccctttacagccctttgaatccattcctctgggagcttccccatgggaggactgcttctttctgtgacccagcctcactaaatgcactaggaatcagcgcacttcactaaatattacatctagatcatgtgtgtatttactataattatgcatatttcatctgaactaattttcagaaaccctttccttagcaaatcgcacattttacgaaatgtcagtgtttcctaccaaccaccatgaaaacaacaacaaaagctgaaacatagcaggaactcaaatcgcagagtatttcaaatagataattagactgaattctaaagttctctaactaccatatatgtaatattaaaaaggtcattaaattgttggtgtgacagggttagttaaacataggcctagcagccagtaaagatgctgagtgcagtgacaaagaacggtgaacggaggacctgtttgtgaaggatgaggattttcctgcattcaccgttgagaagtcagtcttcataggatggtgctgagtaggactagatagatttaatcaccatcacaggaacaaactcactaattatagtagcagtgacacaggacaggtgagacccacaactggggcttagctgaggagggttcttgactttgcccaggaaggaactgaggggtaagtcagtggtgttaaaaagcaatgtttactgaagtggcggtgtacagcagcagcagcgctgccccgtaggcagtgtgccagggcagcagctcagaggcagcattgcatccatatttatacccacttttaatttcatggggtggattatgaagaaatttctagaaaagggtcaccaagttgttgtcgtgaaaaggggcagtaactcccaagtgttgccatggcaatgggaaactgacacagcaccctggtgggtgtgtcatatggaaagctgcttccagcccagccctattttagctagtcctcaatttggtccagtgcctgagccccacctccagagttgacttccaccttctacatcagtaagacaaagaaagtcgcaaagttggaagaatatacagagagagataaaagctgtattcaggaagtagatcctttataaaatccactagaaaatacaactgacttagtaatagccaatgacaaaacactgcatgtgcagaaattcaggactttatacaagtaataatgagtgaggacgcaaggcagccctggccaggacgatgaggggcagagatgatacagggaccagctatggctcttcggaccctgaccaaggaaggaaagctacagatgagtaaacagagttgactccatgagctcagcagaaatagggtgtttgtttatgtgtttgcagttttcaccagttcttagtgagaagttaggagttacagtgtgcactcctctgctatttatagtctgatatattaatacaggagctgtcttggccaagctcttcctctctacagatgctgtcccttaaacactttccaacatccaatgagcacttatacaaagattgctttttatttcatttaccgccttctcagctgtttatgagtcaaactgtttcctggtactgttgctgtaggtgtatattggacattactcaggatctgaagcatatacaatatccccaagcttaaattagtcattgtttcacttgtcaaattcaattaacatcatatgccaattgcataccatgaatcatttagtaaacactgtctagaaatattaacataaatcctgtgttttacttaacactatgttgaattctgttcataagtttgttgtttgcaacagtttaagttttagtcaatttcaaaattcttttgaatgtactatgtgtgtgtactatgggataaaagaaataaattaatatattgatgtttacggtaatgtgggttctcactatgggaaaaggtagatatgaatactgaaaggggaaaggcaatagataattctatggtattcctgaagttatatgaatgaactcattaatgcacacagacacacatacacatattctaccatatagtaaaatggtctagaagcaaaaacattggtagcaacgtttatgtctaaatgtaacagccagatcctagggtttggtaaatagaagatgaacctggaacttctgtgccaaaaagcaaggactcaaagaccaatgtggacatatcaaaactatgtaggagctgatttaaaggggttcatttttctcaaactgttctttaaagaagaatgctaaatggcaaatgtaaacaaacaatataattataaatctttctggttttttggaaaccacaaatgcaattatttatttgggcagaaatagaaatgaatccttaaaaagaccgttgaagaatagcatcttgacatggtctgaaagcagtatcccacatcttgtctactaattgcataagaaaaaggcaaccttgaaacaggggcgatgtccttttgagtatgaaactcacaagggagagactttatcagatcagatgctagtggggatcacaaacgccaccagatgagctggcgttctgtgttgctgatgggatgtaatgtaaagtacacaccctctaggaaacggtcttgccacacatgcttcacctgaacataccatgaggaaaacggcaggacaaatccagattctgagacatcccaaaaaaggactggcctgacgtctttaagtatgtcagagttgagacagacaaaaagtggcaggaagttgtggctgacatgaccagaccgccaaatgcaacgtgtgggcttcacctcaaccgggagaagaaaaacagatgtccacagaagacgttcggagatggatgggaagatgtgcacaagggctgcccatgaaataatatcactgagtcaacgtacaggcatggtgatggaacaggatgactttgcatttaagagatgcacgctggctggacacagtagatcacgcctttaatcccagcactttgggaggccaaggtgggcagatcacgaggtcaggagatcgagaccatcccggctaacacagtgaaaccccgtctctactaaaaatacaaaaaattacccgagtgttgtggcatgcatctgtagtcccagctactcgggaggctgaggcaggagaatggtgtgaacctgggaggcagagcttgcagtgagccgagactgcaccactgtgctccagcctgggcaacagagtgagactctgtctaaaaaaaaagagatgcacactacaactttcaaacaaatccaccaacacacacgcacacacggacgtgcacactcacatacatacacacatgtatcatgttttgtgtgagtgcggggtgtgtgtagcatgggtatttgtgtgtgagaaggaaggcaagtgggtcaaaagataaagaaatggtgcatagagtaaatcactgcggtactgtactagtctttcaagttttctacagtctcacaattaaaaaaaaaaaggtggagaaaaattttcctggagagagaaactaaacaaccagaagtttctgatgattgaattaaatcgtttttcagtatgccaagcctctgagcagctggattttccacactttagtttgttgccctggggcctcccagtcttgcttccataactcaacagaattctaccaccaattgttgaatccaaagtttcgttccaaagtctctgaaagcagaaactgtgttccagatacagagaatcaaaatgcgctactgaagtcatccagaatatcagtagccaagacatgatcagagagacctatgaatctaagccagttttctgatttttaagccaaattgtttatctccattcaacactctcaatacttgtatctacaaacatattggactaatgcagagagcacatttccacactggaacagttgaatagggatgtgaaaactcgaatatctttgcaaccttcaaacaacacttgacattaaaaatccatttacaaatccagctttatgctaaatattgtggtaacattcttaaagaccagacctcttcatgtggaaaatgatgtcccagtctaaagttttttgaaaggatttgctatgaaactgataataattttataggtattcatgtctatacaattactaggactttttttacacagaatacctaagtttctcctaccttattgaagattcttattaaaataccacatattaaaaaagataaagtaacacaaaaagtcacaaaagaattgaagtttacttttttgctttatttggcccaacacagtgtcttctagaagtccttgtcatcacaaaaatataaagcttcctttggatatgcactccccaacctgaattgtaagcactttgaagacagtaattaggtcttccatcacactttagataatgtcctaggccgggcgcagtggctcatgtgtataatcccagcactttgggagtctaagacaggaggatcacttgagctaagacaggaggatcacttgagccccggagttcaagatcagcttcagaaacatagtgagacccccatctttacaaaattaaaaaaaaaaaagctgagtatcgtggtttacacctgtggtgccagctactcgggaggctgaggtagggaggtcaaggcggcagtgagccatggtcgcgccactgcactccaccctgcacaacagagcaagagcctgtctcaaagaaaagaaaacacaccatgacgtcctgcatatatctgcctctcagagaactgattcaccgatttcatcgtttaaaaccaatgcaatactttcattttcatgaaaatggaagcaggctttcatgaaaacagtcttcaagttcatgttacacaaatcctacagaaattgtggacaaatgatctgacatcctcctataaaaggatgagaagaagctgtgcctcatgtaactgatcatttctatgtattaagccatatgaaatatcatgtctttgctgagcagaggctacaattagaaaagacccgatctaaaagaatgctcaaaggtcatcaagcatgattacattctgctgcacactgtaaaatgcatccaagtgtaaaggattattcaacaaattatgaatgattcattcatggcagatttttcattagaaggtaatgtctcctttcccataaagtcaacattatgatccaggatgccatttattagaacttatgctattaaacaagatatgaaaagagaatcttcttaagtgtctcacatcagttaaattaccctccacctgttggaaataagcactgtggtcaatgaagggagagggatatgtagtacatgtgttacaggatttgcaagagttatgcttatgtatatgtatacatgtacacaattttcattactgatctttcacttatgtctgaaagtcaaatacttactccttttgcttaaaattttggactctaaattatcccaggatcggtagttaccccaggacagcgtagtagttattaaaaagtcaattagatcccatttgtcaattttggcttttgttgccattgtttttggtgttttagacatgaagtccttgccctgcctatgtcctgaatagtaatgcctaggttttcttctagggtttttatggttttaggtctaacgtttaagtctttaatccatcttgaattgatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagcgtgatgcctccagctttgttcttttggctcaggattgacttggcgatgcgggctcttttttggttccatatgaactttaaagtattgttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctcgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgaatattttcacaacctactcgtctgaaaaagggctaatatccagaatctacaatgaactcaaacaaatttacaagaaaaaaacaaacaaccctatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaacggcaatcattaaaaagtcaagaaacaacaggtgctggagaggatgtggagaaataggaacacttttacactgttggtgggattgtaaactagttcaaccattgtggaagtcagtgtggcgattcctcagggatctagaactagaaataccatttgacccaggcatcccattactgggtatatacccaaaggactataaatcatgctgctataaagacacatgcacacgtatgtttattgcggcattattcacaatagcaaaaacttggaaccaacccaaatgtccaacaatgatagactggattaaggaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattcttactcataggtgggaattgaataatgagaacacatggacacaggaaggggaacatcacactctggggactgttgtggggtggggggaggcgggagggatagcactgggaaatatacctaatgctagatgacgagttagtgggtgcagcgcaccagcaaggcacatgtatacatatgtaactaacctgcacattgtgcacatgtaccctaaaacttaaagtataataataataaataaatacattaaaataaataaataaataaaaatttgacatgtttccaaagaaaaaaaaaaaaagtcaaatgagattttaaaatatttcccaagtgttatctgagagatcactttgagagaaggaaagcaagcggtgtttgtcatgagcttcgtccaaatcagaggccttgagtgttcggaggatcatctaaacccatgaaaaaaatcagctggcaggagcccatatgggtcaagatggcttctggagatagataaaagcggatgtctgaagtagactccctacttcccagctgtaactggcagtagagtaatcttgctaggaccaaatatcctttggtactgcatacatcaatagcactagctaaaaagattgatctgagttatccatttattttagagtttaaaatacactctccacagcatcttttttccactgggaatccagagatgttttacttcccgtctctataaaaagccgcctcacaatttacagggccactgcccactcttcatactttaaaagatatagataggaattcagaagaataagaatccctccttatttgcagatcaaatttacccttcagcaaacttcatgggctgacacattacccttgagcagggggtatagatatacaatcattaagaataatcaccaaatatttcaatttacttgatttaacaagcttttaaaatccattgcaagggggtaaaatttgattaataaactgcaggccacataaggatcttgtacaaggtgacttatttaactgactccacagaaaagtcaacaagcaatccattgatcacaacatgcaaacaattcctacttgagtgtcccactggcttagcggcagatttgggtctcaattgctgatcaatttctgcattatgattctggcatgaaacagctctctaggaaagggacgacatcataaagatgtgtataagagaaagaagatggctgagccctggcctcacggactttttgtcacgcccttttcaatcagctagaatccaatctgataatcatttactgtgtcttaagggacgagagcacgtgtgtacattagatcctgtatacgtttacgctgcacatttagattgagtgtgtactgtgtgcctgtcactaccataagtcactatgggttcagagataaaacaaatagctctatgtaaggtgctcacagtctagacaggcagagaataggaaatatagaacagcaatacactgaaataagtgaaattgcagagatatgcacaggcgtgaaagtcatttagagggtggagaacataggggagttttgagttgactgatggagctgaaatatgggcaaatgttggaaaggaatactttgcaccagactgcaaagatcaaataataacaaattcagggatgtgtgttttagtctgcttatattgcagagggactgaaggatttttaactgaatgacagcatccattccaaacttcatcagacaacaggatagaaggcagagtttcagctcagtgaagtatgttttatcaaactgtccaggatggtttctgagtaacacataaaaatgtaaatcactgtgggaaagcagctgtaattcacgatgacataaaaaccactttaaatcataaacacaaagcagggaaagaaaaagcttcttaaagtgggaagggagagaaagtggggcttaaaatagataatgaagaatgattttaaatcttgttatgctggcacgtaaatggttttgcatcagacaattctagagaaaggtatgtgattccaagtgggagtcatgttcaggatgagatacccaagcagtctgacatatgcttgcagtctactaggcgtaggctttcgccgaagggcctaagcctaggggaggcttaatcacagatcccacgctgtggccctttccctgcatcctggccatgtgaactatagtaaaagtgaaattgtatgagactgcgagaaagacctatgcatttccaagccaagtctccctcagcaggtggggaaaattggggggaaggtacagaccatgtccctgtaaaggctgctcagtaactcctatgctctgaccagctcttgagatggtgtcagaacctgttgatttccttctccactgcagcttgattcatccacactaatgcagttctgcacgaacaacagcctcaagatggaatcccaacacaggttccaggctccatcctttctggagtcaggtttgaggacaagccttttacctctatgcacagagagaaacatctgagtgaatgcaactgatggaaatcaaatatttaaaagtaaacatttttgggccgatgtggtggctcatgcctataatcccagcactttgggaggctgagatgggtggattgcctgaggtcaggagttcaggaccagcctggccaacgtggggaaaccttgtctctactaaaaatacaaaattagccaggcatgatggcacacacctgtaatcccagctaattgggaggctgaggcaggagaattgcttgaacctgggagacagagcttgcagtgagccaagatcacgctgttgcactccagtctgggcgacaagagtgaaacattttcattaacatttcaaattttaaaaatgagtatgattgggccgggcgcagtggctcacgcctgtaatgccagcactttgggaggccgaggcgggtggatcatgaggtcaggagatcaagaccatcctggctaacatggtgaaaccctgtctccactaaaaaaaattagccaggcgtggtggccagcgccagttgtcccagctacttgggaggctgagacaggagaatggttgtgaagccgggaggtggagcttgcagtgagccgagaacgcgccactgcactccagcctgggctacagagcgagactccatctcaaaaaaaaaaagagtatgatcacattaaaaagaagtaaacatttcagcttagagcatactacatttttaaaattaaatgcttcccctagttttcaatattatacatgaatgtatttgcttcatttttacaaacacatggcaggtatacatgaagctgtggctgctcagtcaatgccaagcaaaaggcctgaagtcctaaccttgaaatgcccaatgatgagttaataaagtcagcaacattaacatgtgctcttttacagccaaataaccaaccacaaccaaaagagtatttaatatttgctttcatttataaggtaaccagtgcattacaaaaaagttaaaaagcctacgattctctgaataacttggaactcctataagcaacacttgacaaattagcaacatgggcgtggaggtgtcctggcctttgaacacgaagatgatgatgtcttccttgtcatgctgccagtctagagcacacatagacttgcgtttctaattatgataataactcatctggccacatccacagatcatcccattgcatttgtgaccaacagcacacacgttcaaaatagctggttgaaatgaggtatgcctattggttatggaataagcacagggaagtgaactaatcagatagatattatagtagtaagtgagggtgaatttctacttcagaatagataccttcaaagatttcctttaacaagttcttgtggatcctggtagacccaaagaaaaagcacactttttcttcttagaaaggaagtgaagataccttattagttatgagaaaatatgacagactttgttccaaagcactgcaggaagtgctcggtaatcctgcaattggcacaaagtctacagggctttaaatcaaggggcctcgggatgatcagggaaaggactgtgaataagctgccaacctgtgttttgccttgaaggctgggcagggctgtcaggtactcagacattttctctcacctccaaactcttccacactctgctctggatgctatagacacaactgtgccaactacttttcccaaaatgttttgccagctggatttggtgagctgtcaacaggaggcaggaattcacaatgcaggagaagaggcaagggaacttccttattcctgtctgcttgcggtttgtgtcagcaaaatcacatgagctcaagttccccagcagtggcgcgctgtcccagaagcagctgttttttcccctcctctggcttcttttgccacttccaagaacagtttatcttgcccctctaaggagccagtggcaagcgggtctttaggtaagaagccttgaaggaagggagaagggctgctttctctgggaggggagaatcagagagatttggaaattcaaaatcagctttgtctgaatctatttagatgactccagtctcagggtccaatatcttgccaatcactctgactttcacacacaaggctgtttgaaggttcttgaacttaattgtaattctgtaacattttggatgttattttctgcaactcagccctatgactaagaggggagaaagttatcattatctttttagttcttcaggccaaaatagaagttctctgttttgttgttgttgttcttgttgttatttcaggtagggtcttgctctgtcatccagactggagctcagtggcgagactgtggctcactgcagcctcaacttctcaggctccagtgatcctcccacatcgacgagtaactgggaccacaagcacacccagctaatttttatatttttttgcagagacaaggtttcaccctgttgctaaggctggtatggaactcctgggctcaagcaattctcctgcttcatcctcccaaagcattgggattataggcgtgagccactgtgcttggcccatttattttttataaaaagtatcccgagtttatgatttcctatcactagacttctagccatttaaccccatagtccttgtcatcatcatttctatcatcacaggtaggtattgcaaggactttcacctaataggacaaccatgagctggagtaagggaaacatacatttctgctcaggattatcagctctgaactgcaaccaattcatggtaactaaaactccatgttggtcaccaaagtggaggcttttggtggtaaggtgataaatggatgaggcccacgtctattttacggagattgcagaaggttcagaaatgcatcacttggttatttttctagttcctgaatatgtaattagaacagacatttgcagcaactggcagaattcctgcatgtctctctgccccctggtgtgagcgatattaaaccagagccaggaggcttctaaaatatgaccttcctaccagaggatgttaatattgctgggggaagggcaacgattaatatctctgtcaaagatttgaaaaaggcaagtctcatctacttactccatactcatttaactcacctgtttggcccatgcacaaagcagttggacttagagaataattgtgaattaccataaatttacttagcttgtgattgcaattgcagctgctcttccagatatgatattttcactggaacaaataaacacagctcctggcatctggcagtttacaccttttgatcaggcaaattaattcatagcaactttcaaggatcaccaaaagccatttgcttttgcttggtcgggtccacatagcacctgcacttttctctgggtgatgtcaactctcctgctctttgtcctgactacatttgcagaaatgttgatcatgcttacctcaaactaactatactgacaacatgtaccacacagaccagatgaacagaaaatagcaaataccttaaatgtctgaataagatgtatgccaacccgtggaaaataaagcccatgaaaatgtaggcaccatcattttagtgaagttcttgggggttgaatgcttccgagcatgtgaggatataccctccaagttaaaaggtgagtttctggaaattgcaatgtgcttaccactaaaaaagaaggacagtacttgatgggcctccttgggcttatatgtcacttgtactgctttcacccatttatcaagaaatgtgtaaggctaccagttttgattggagtcttgggcaagagaggactgctgcagattcagatggcagtgcaagctgctttgccttatgacaagggccttatgatccaacagatacaattatatgtcaatgtctatgacaaacagaggttctgttgtggttagctgctgggtcctgatacagactaaacacctcattctatgaacataaagaaaccatgtggggtggccatgatgaaggggatgagagctggcctgctgcatctctgctggctcagctcatacctgtggactcctaggagagagaattttgaccaaatcacataggaatgaaaaacctcaggccttatttacagatgagcagtacaatatactgtcactaaaacactggttgatgcagcatgtggttatttacttggtcaagattgagacagaagtataggaaacagtgattatttggtgatcattaggggtctggttggaaggtaaggggcttggaaagaatgggattagaaggctgaaaacaaattgttcttactgaatcctcaaaactgagtctccagtgtgaagatatctgcactccatagaaatgctctctcaagggggttcactgcagaggaggctgtcagtaatcgggccaacaagacgacatgccctgtgaatgtcatggagcctctttcctcagcctctcctatttaccagatgaatcctgtggcaaagacagagctatgcttgggcagcatacaacctcctctcgccaaggctgatctgctaccaacactcctgtgtgctcatctcctgcagcagtgagtgctcagcatggaacagggcacagttctcccagaaggggcctcttaggagtgggttgattactttggacccttacattatgcaggaggcagcaaacggtcctcgctggaaaaggcatttattttgggtatggattcatcattcctgtctgccttgtttctagaaaaatcattgtccacaggtttatagaatatcctagtcacgatatggcactcacacacatgcttcagaacaatgaactcattttgctgcaaaggaagtatggcaatgggatcatgtctgttgatttttctcatattatcaagtctcccagaagcagctgggctgatggactgctgactgacctagaaaagccttagtggtggtgtcagtaggtgacaacatttggatagcctggggctcaatctgttctatctatctatctatctatctatctatctatctatctatctctgatatatatttgaattcttatatatgcgctgacccagcaaccaatatatggtgctgcttctctcactgccagaaaacacacctgcagaatcaactggatgatgtgggagtggctgctttcactactatatctaataacccattcacagaatgtttcattcgtgtcttctcagctctgggctctgctggtttaaatgtcttcgtacccaagagggcaaggtttccaccaggagaaacaaaaatagttaaaaaaaaaaaaaaaagttgagactggtacttgcccattttgagttccttaaacactgaagtaacaagaaaaaacgggggatactatgttgcctgggatgctggtcacaatttctagggaaaaactgaattgctactacacagtagtgagggagagaaatggatctcatttacaggggaattcctgtggcagctcatggtatttccatgtccaaaagtacaagttaatgaaaactatggcaaccaataaagattaaactgttgggtatttagagctttcaggaatgaagatttgggtcacattatacaatgggaaaaaaaggcaacctccaaacagattatggctgaaggaaaaggtaatagaagaggaactgtagaaaagagatgttataaacaaatataaacttatcagttatatgaatacagtgtaaatataggtatgtatatggtaactaatatttcatttcttctttaccgccactagttacttatatgtttgtaattttgtggttaactttatcatttaagttattctttaggttataagattctgttgcaagtaagaagaaactacaagagaaattaacatcttttagacaaggatagtatgatggttggaaattgtgtcttccattgctcaggagaggccaagagagtgtttgaacgaatagttattttttattaggtatacccatggagtatttactgttatgaaaaggaagtttgagtatgtgcaaagcagtatatgttctgaaaagatatggtcagtgtggacccaaagggttggtcaatatgaattacttaactattgtttctaacatcaaaaccctccatttgtattctattctctaatgttttgacattaaattactcaaaactcttaacagctagtttcttgttagactataccgagaggaggcactagagggagactggaaaacaagaggaagggagaaggggcttttcttcttcctgttgagttgattgccctgtaagtatcactctggcagcagcacacaacccgagcaacaattgcttctcccagaagcagcacttagtccaagcaccagctgttgtttccagcctctagttagttttaagcaaggagaactagcctcatcatgccattttgatgatccaaacccagctccgagaaaagtcccatctgtgagctttcagattctgacaaacctactctcttccacttcctttcaccaacaccagggctggtgggagcttcttactgttagcatgtctcaattcccttaatatttcatttttgcttttcagttttctaactctgtgtaatgaattctctacttaaaatttcctctgcaaaaaaccagtgggatctgtctttccctcgctgggaaagggacagagcagggttttaatcagtgaggttgggagttcactacactacattaagtacaaagttgtaaagagcctaagccagggatgaataacagcagacattaagcaagaaaagcccattgagctggaatctgatttgaaatgcaattgaaaagggagaaaatcaaagataaccgcaggctctgtggctgggtgaatggagtatgaacgttgaggttgtgggtgtggctgggagacattgaatttgaggtgtctggggagcataaagatgaacattttcacaagcaagtgagaactgtctaacatccaagaaaatgccacgggattaaaaataaagacttgaggagaatctgcagataagtctatttcactctgagggagtataagacagctggataggagagttttgagaaggaaaaggcagacgccaagaagtaaccttcgggaccatccatgtttcgggtgctgaggagcatggcaagtcagccagaacaattaatcagggttagtcatggaagaatgactaagaaggaatgaaatccctcagtcaagtgtcaaagaagtcagggaagtcttagaaagtgggagcctggagaggaagtcagggtcagtggtgccaaatgcttgcataggaagctctgccggcatcaagtacgattattatagaaagtgaggaattctctcaaatgccaccttccaacctgccagctgtcctgtgggaatgtgacacgtagtcctcagttctgatttaataagaatgacactaacagttagcaaacatagaaacgggaaaaacgctgccaacatcgtgtagcacatccctaaatacagcccatagggactgtctccacatgcttcagaatccagccccggagctccacgaataactgcatgtgagtccacgggcggcaccacacctcagagggagaaacacagccccccttacattctcaaggaggcgctgcttttgatcttttattttcctttgagttcttcactggcgcagaactttgttctatttgattgcaacatgtaaatattatcatcatgtcttcctttattagggacaatatttttttccctacaaaagacttgagctgaaagacataaaacactgtttcagtttcaggaattctagggaggattagaagaaagggttagaacacgattacccctgtggaaatctagggaaaagatcccatacctattttcttgtctttacccacccaactactcacaacccgtcacttatacacaaacaaatagtcactgtgcaacacatcttctatttctggtaacgtaccatggccaaagtcataaaagggtcaattattgaacctggtagagctggtggcaattttcaaacagaggcacaactcacatttaaagatgatacatggcaggtactcaataagtatttgttgaatgaaggtgtaaatggctgtttgatggctaagacatgtcttgtctaggtttgtgactccgttacagttggagggtgaattgctgtatttaaaacgggtagagaactgtcagagatattacctgctacgaagatcgtcagatctattagatatggatgatgtttcattgccagaaacagcttcacctaaaaattagcagccacagaagcagggcttctgtagattatgatgtctaacagatcaactccatatatgatacatggttgcaaatttgagcaacataataatatttttgggtgcctattaactgttttaacactgtgaaaaagcacagtgggagataaaggaagaaacaatggctgtgctatatgcatgcttatcactgcagaaacaaagaccgagacacagagttctcattctcattcccaatgggaagcagcactaaacacagagttctgcatgtggacgtgctatcagggcttagccagtggtacctggtcatttctgaactcatgaaatagatgatgcattaatatactgaaatttgtttttctaaagccctcaaggattgttacttatcctttaaccgtggctgcctaaaactggcttaattggtttcgattgatttaacaacccttcttcacttagtttatcgttatttaggaaaaggtcaaattatgtggtcattgttgccatggttcattttggaatagcaaagtcacacattttcacaagttttctcattgacaaattaaataaatgtccatttttagcaaggtttctcattgtgaggagcccctcctctcctctaggctccaaaccacatttaatcctcctgcagaccagctaccaaatgtttatttctcctgagcttttgcagctactcttggtccaccttgagttaaaattagaatttctctggatctatcaagaaatatctctcttctatgccccagtgtctgttcaaccaacagtctcctcttttactctaattcattttcctgtttgtttgtttgtttgtttgtttgcttttccctaggaagtatgagcattcccttgtttaatattttcctcatgttacattttacactttcccatgttctctcactgaactgcactttgcatttattcagttaaatgtagattgcttccagtacatactgtgacataacatgtttaataactgaaatccagaacagatattatctgcaccaatgtagtgtcacattcaattacaagctcccagttcttttcctttttacattattgatttctaaaccaataaaatggatacttattcaaagccagaaggatttcaagaaatatattgaaataactgtcagataatcttggtgaactttgtaacaaaatcaattatacaatgttcgtaccaagttgcaaaggcaaggcacgctgccgctgtgactacctgcctaatgcactcaatgccaaatgacttttctcccagacacaacatgaaaagcctgttactcaaaaggtgctagtctaccaactcaacttttgctttccaaatataatgcttttcattgctgtctagcaaaaaggagctaaagagtgagaaagatgagttaaaaatgcaaaccaaaggaaacttaaagacccaaaggttcaaaaatcagtaggcatactaaaataacattatttctcttctttgctatgtttctctagaagtagtgaaataagtgagtaccttataccataatttcacatcccaggaatcaatggccaagtatagccatagaaagagttgcggtgaaaaaactgaggaatcaaatgagaaaagaaacattgtaataaaatgtgcatcgttgagtcatagggaaaatctgccttcaaaacttttcctagaaattataaaaactgcccattactttgaataacacattgtaattttaaaatacttcactacataaaaaggcaaattaaaagaatcctttgattgttccatccctatggagccttatgaatcccataatccttgagaggtatctttactggcatacttataaatacacaattaaaatatacaatgaaaatccagtaggtattcatcccttcacttgcgggactccagctatggcagtatgagagctctgtactcctcacctcttcacactatttcttctgcatgatacaactcttctacttcagccctacttctcttgttaagaatgtttactcaactgagaggtcacatcctcagtgagacttcttattgccaaaaaactccactgggctcccttatgcttatttcctccagaactttctgctttccttccctcagctttactgcagtaactactgaatgtcttcagtgctagagtgtgggcctcctgagggcaagagccatgtctcttctgttcacaacagcattgccagtaccttactcaatgcctatcacataacagaaaatatgtagatgtcaaattagtaaatgaaagtgtgaagtggatggtaaaaagtcatcatagtaaatcactaaaggggttcctttacctgttttgcatatatttgtgtttttaaggggtcatacagcctgaagatacactatatatatttgactacagataatgcatcaaagcattggatttttatggtagaagaacaacatctagatcatagtatgtggcaaaaagtgagagagatgggaaagaggccaaacgtagacagcatctgtaagccatagcaccagccgactgtacaatctcacaccttactataggagagaaagcaagtccacattatcttttcagtagtgcatttatactacaagtatcctgataagaaaagttgtcttgggccctgttattttctgaatgtatgtatacctcccaaaatttatatatggaaacctaatccccaatgtgatagcattaagggtgggggcctttgggaagtgattaggtcacaagggcagagccctcatggatgggattagggcccttataaaagaggccccagagagctgcctcgcctcttccaccataagaggttgcataaagaaggtgcccatctatgagaaactcctcagaagacacctaatctgctggacaccttgatcttgaagttccagcctccagaactttgagaaagaattgctgctgtttctaagccacccaatttgtgacattcttttattagcagtctgaggtgactaacaagccctaattcacttaaatggtaaatgaatgctttaaaatgtacactcaaccaacattttgagaatcatctaaaggataacatcatatagggactgatcaaagggttttatgatcctaatgaatgtgaaaccacaggctacaaaaattctcaagagcaaaaattcctgatcagattttatcagaatttactgggtagctttatattaagtacttcatcatcattaatataccttaggtttcttaaatgagctttaattttatttacaatagataacattttgttggcatctacaaattctgggaaatattagagaaagtaacatgaatacagctttaattaaataaagattcaaatataaataagtgtttgcaactggtataaaatgtcatctttgtggaagcattttatcagcttaacattttgctgctactaacatagatgaggcagaactaatatggccagaagcaaggagaaacatgcatggaataagtgctgtaaatttttttctagagctatatattccttagtcagcatgcaaggaaaatggtaaacaaacaaggatgctaaataagaaaaacttggaacgttcctcaatgtaccaaacagagtgtgaatatgccacttcattagagggtggagcattctaattttataaaataaagttaaatatactaatttcattttcaaatatttaacactttactataaaatacttttcctgatgtgaggactgattcacagaactgcataaggttatttataatgttttataaatattatttgaaatgatatataatggcctacttcttaaattatagagtaaatatatacagtaagtccaaaactatttttacaacatctgagaaacaaattttcccctgtagagtgtttacactgaggaaaaaacagctagattatagaagttaaaaatatacgaaaataggaaataatatgtactaattaaagtaagaaaaaaatgagccttacagtctcagaggctttagaattgaggagtagagaatgaagcttgcttctcaattagctttggaaaaataataaagaacaaaacagctctccaacacaaggctccatcttattgtacagaccctaccaaacgaagaatgatctttctggcccccaaatacaggaatctaccactctgcagcctgtcctcacttctcttctgccccactgccccacaaacacctttcgaatgcccacaaatgcctctcacctcagaaatccttttttgtcttgatactgcttcttaaatagaaatatcttgttttagtcaaacccattcatttcatctatcacacaacagaaggtttctatttttagaggtcaaaaatctcagtgataacccaataaaatcaaacctcttcacgggtaacaactgtatacacacacacacacacggacacgtaattttgcatgcatttcaaggtttacagagcaggtccaggtctgatgttaaatcaatgtgcatcagaatggctcgaatgccagtaaaatatggccagggtccattttgattggctgtagtgtgcattcacattgggaggtgcccaggaacaaccagttgataaatatttagaatagcactctctctggggacatggatcccaacctagatagtagcagtaggaaatcaatgcactgctacatctatggtgactatccatcatacaggaagctatgtatgatacatactgaatgcaatttatattttgcagccaggaagagtctcacttctaggtttaccactcacttgctgtgtgatacaaggacatttatttcttcctaaacttaaattttcttatctgtaaaatggagataaataatatttttgtcacaggattagataaagaataatatgaaaagtatctagtgtctggtaaaaaatggatcctcaccaaatagatgatataatgacaaggacaacaatgctgaaatgtttatcatttagataatcttaacagctcaaccctcccttttgctctacgatgcccgagttcaaaatacttttcttaaaatttatatttcattcacaatcatttctatttcaaaatccttcctttccctgaaaatcacagcttcatggcattcattaatgatgaggcaattcccaccaccatgacagccttggtcatgaactacttgcagattcagcttaataatgactgactgagaatgcatcagatgctaggcattatatacacagaaattttaggagatcacatgatgacaccctctaaacaggagcctgaggaacagcagcttcaagtgagaaacttttcacagggcaaataacatctaaaataccaaccagaatacacagtaatgcaataatggccaaatgaattttagttgtataatgttctctcttttcacattgttttcatagcacacatttccaggtttctataaaaatcagccaatgatgaaaagcaacatttgttatcttagtttatattagtaactcgatttcccctaggactgctatagatgtggaaggggtttgggactgaattaatgaagctatttggataacagctgaaataagatccaggaatgaaataatgtatctataaatctttttctgtgtctttagattctgcaatcccttgagctactttcttggtacctggaggagaaaatgattattttaattttaaaaagccagtaggtgtaaatatatgctgagccttagaaacaagccttaaatttttccaaagatacttcatatatttcagatacaaaaatgtaagattttttgcactgccaatcttctaataaagacttaaagaaaagagaacatttaaaaatgtttattcatcatccatttcttcagcaaatgtaaaggtagagtctacaatctataggatcctatatggggtggggttggcaagtgcttcagtcatggtctgtgccttcaaggacatcacgggctgggcatggagtgtggacttgcacaccaacaccgccgacgtgtggtgatggttaactgatcacttacagataacatgccatgacagctcataggataaagcattacatagagctgggttttgttaccgaagaatgaggtttgagttgacccctgaagatgggaaggagtggacacagagaggagaaagaacatcatatgcagtgggaacaaacatttctgaaggtaacaaattctgctgagaagtgactgatgtgaaactttgggaagtagtcgtgaaaaggcagattggtgttggattgcagattcatactctgggtcatgacggctgggctctatttaagaaaccctcattgtttttacagtgcctgacatatgctacctgctgaataaaaatgtgaggaatgaaatggccagagcttcacctcgaccacggacaggccataccagaggcagcaaggcacacaatagaatactctgcattcagagtctcctcctaataattagcatgaccttgggtatatgcagtatcttgtctgagaaggaatatttcaatctacacgatggacataataactatcttatctaacggggtgtttgtgaggttcaaatgcaatcatcactgttgaaatgtactggaataataacgacgttgtaactagcacagaagagaccagtatgacatctattaattattccaataagaggtggtgaccacctgaagtggaaatggggaggcagggtctggtgtcaggggtaaaggacagttcaaagttgaaggcaacagggccaggactccagggcatctctatctctgaaatctactctgataagtgctgtggacaaaaatcaagcagagcggtgggatggcgggttataagagggtgggcagagaaaccatcttagaggagacggcttagagctgagatttaaaggaatgaacgccttccaggcagaaagaacagaatgtacaaaggtcctgatgcaggagctcagtaacgatactgagtgaacagtctagaagctcatttggccacagcaccgtggccattgtcggggcagcagaacatgtgcttggagagatggccacaatcacatcaggacagtcccatgggcacagtggacttagggttttactgtgaatgtgatgggcaggcagatggtttgtgtctgaaaaatgttagaaggatcactctggctgctgtgtgagaatcagctgagaacattctagacattgaagactgataggaataggactgggcaggaggctgctgcctggaggcaccatgagggatgatggtgtttgaacaagagaatagaagtgagggatctgtgaagtgatcggattcaaggtctagctggaggtagcgtcagcaacgctgctgatggattagatgggggcctgtataagaaagacaggagtcagataggacttgaagatatttgtccttagcaactgagagagcagtggtgctgtgctctggggtaatggtctcttcagggaagggcaggtttggcaggaagtatttagagttctatttgggacatgtaatatttgagatgctagttccccatcctactatccaatgggtagctgaatatacaaggatggagaaagggagagaaatagggctggaaatatcaattttgtagtcatccatgtataatatcacagaaagccatgggcacgaatgacaataatttaaaaggtataataatagagaagagttttaaaatgagatatgggtgctcagttcttgggttgctgggaagatgaggaagagtcgtcagggcagccaaagagaagtggcccatgtggccggtgtgcattcggcggactctgatgtcccagaagtcatgaaagaaaatgaccatgtcatttggggatgtgaggattcttggagtcgttttgaagagtggtaggaggaaatgacaggctagagtgggaggtgagcatggagagatgctgagcctagatattttttgaggcatttttagtagaaaaagaaagagagaatttgggtagtagatggtaagtgtgaagaaatatggaaggttatttacgaaataatgtaacttgggagatgctacaacaagattctgtctgatacgaatgaattacccagtatacgtcctcttattaaatatttacaaaactctatatggtaggtgttatcactattttagggatgagaaaatggatttgcaagggagacacatggtccaagacagcatgggaactggtggagctgagaaggaattccagctcaactgaacactacagtggaagcttgagtacatatacaatgtcaccaccagagtacatttacaatgtcaataaaatcattttttaactcacatctgggaagcaagatagcaccagactttgggttaaaggaaaaatctccaaatctcttattagttgaaaaaccttgctttcctttgttttgtttgtttatttggttgtttgcttgttttataagttactgatggaagagaacatcaaatattcgccagatacatgtgcagaacatttcagagctagggaggtggccaggagaagtttcagaagggagagtgaagtgaatgggcccagacacttcaaggacatggaatttatttaactagaatgtctgagtaggaataaatgaaggcagaagaaagttgaaaaattttggatgatctagttaaaggctttgaagcaaagagtgaggatttggacctgcttctctttagagtgaaagctactctgagatcaaagccataggtgaaaagaaaggttgacagcagcatggagaattgattggaaaaaggttttgatggaggcagagagtgccaaaaagaaagagtggatgtcagctcattcttctggtaagtaattacaataatgaccctatgctagcactgttgaaaactaaagattagagtccattattacaatagagctatttttacacgagaaaaaatcccaaggtttaatcgaaactgttcatactgaaactatgacaagccaattgttcctagtacttttaataagaaatatacatgttataacaaaacctatcactacaactgggaataacacagagcatcccaccttactgatggcatatcagtagcatcaccttttacataaagaaattctgtctaattcacaaaatatactatttttagggaataataaaatattagttttgttgttgttgtttggcttttacagactgggtcttcccctgtctcccaggctggagtgcagtggcctgatcatagctcactgtagtctctaacccctaggctcaagagatcttcctgtctcagcctcccaaagtgctgagattacaggtttgagccaccaggactagctaaaacaccgcgattaaaggcacagaaaacatttttacttttattcccgattagttgtcctaactgaaattttaaaagaagtcattgaatatggaatctgagaaattagaacaacagtaaattagatcctagctcttcagtgggttggaaggtgcatacttcattcacctattaagctgacatttatttatacctacagactgactgaggcaacagaaagagaaaaagtgctttttgataatacactgaggctcaaaattttaaatcagagttgaaatcatcacttcacaaagtctgctggagtgctgaggccatctgtctccttgccctgactcttgtctccacgtcagtgacagtgtgtgtagctgactgtggatctgcagatgagagggtctttgcaatgggctggtcagagaaggtagaaggtgaaaggtgaaaggtgaaaggctgaaggaatgggggaggggaggggccattttcagtctccttttctgacattactgatcatttctgatcacaaaagtaagggactccttgggattgcaaaccactttatttaaagaacaaaataaaagtcatattaggatgaactaagtaatatatttacattctacaaaagcgctcaaaatacagtctttattcaaaagcccaagtcagatggattttctcactgaagccttgctgagtccctcaactggagttcaccctcagccctgagtcccccagaatacattgtacatatattttaggaaagaaacatgttctactttctaaatttctgttaaaacataatgtatttatgtatatataaatatatataaataaatatatttttataaattgtagataatctacagaatttctataatatagaaattgtataggtataattttatatatattgtgtgttcatatatacatgcatatctcacacaggaacaggaaaaggaacatccaggaaaaacttcttcccctttagtaggattcacttaaggagaactcaacgatttgatgcatttcagctgtttgaatataacttagctactcagtaatacatatgcaagtattttaattctttttgaatcagcccaagtaagccttaggttctgaattctgccttgtgtaaatgtcacctcatttatttactaggtgcaaataatacactgctaagcgatatgtgttggcttccaagccatcagttatgggtttaaatttggaatctagaatttaccaggtatgtaatttggagtaagttaatttaatttcctaggcataagttgcctcatttcttaaaatggggtctatgcctccttggattgttgagaaaatgacatgggatgatatttggcaagtgttcattaaatggtagcctttgttttcagcatcatcactgtgatcagctgaattgctgattttcactttaactacaggaaacttgagtggaaaagtctgagtcatttatgtactcattacttcagcggatcaattccaagtaacaaagctagggcctctgcttattgtttattgtcagttgcctgaaagggaaatgtagaggaggccacttcatgtaacaacacagataactccaaaataaaggaattttatttatttatccacatttattaaaatatttactttgtaagtataaaaatatttaaaaataattaaatataattttatttatgaagtgggcagatgtataaagaggaatgtgtgaaaatgtatagaaaaaggatttatcttataagtacctcatttttaatgagactctaaaagaaacactcaatctattctaagaaaaatatagtaacatgactatcaaagaatcatttattaaaagccttcagcttcaagtgggttactttttaaaataaatgattttatttccaattaatttggaggtctggctgggaatataaaagaatattattgtgttgcacaggcttagaaatcaaacaagtctggactgaaatcatgacttgctatttaccagctactcaaactttcttggggtcagtgtccttatttataaaatggaggcaatattagtatatatttaagcaaatgtctgtagagattacaggaagcaggtgaggtacctaaaactacctgagacacctagttcttcactttaagggttatctgctttgctaatttctctcacactataagcagctagaaaaatagagaaacaactgttttctgactgtctcagtctgttttgtgctgctataacagaactcctgacactgggtaaattaggaacagaaatgtattggctcacagctctggggactgggaggtccagtatcaaggtgctggcatctggcaaggtctttgtgttgtgtcatgacatagtgaaatgcatcacatggcagaatggcaagagagagcaaagggggctgaacttgccctttcataatgggtccactcctgagataacaaacttactctaggacatgaatccactcatgagggcagagccccgatggcttatcgcctcttaaaggtcccatctcttcacactgttacaatggcaattaaatttcaacatgagttttggaagggacaaacattcaaaccatagtggatatatagaagttatatatataaaatacatatgattggactgaggtaatgcgggactgtgatcccgacgtgaaggaaacctacaaagatttggccttgttagctatagcagaggaagggagacaccaaacaaagcctagaagtctcggtgaactggggaaccacaaatcgaagtttagggaggttaaggaaactagaattttcaggacacaatacctaaaagaagtgacttgcacagagagagttctggaaatttgcggatagactaccttgaatctctggctgaatattatttttccgtacatgcatggggttaacaattctcaaagctcacacggaggtgggatattttgcattcccaccagacagagtggagagaccttatggtacttgaggcatctggtagagttgccagaagactactgtcatcatggtggggctaaattacccatagcattatggctcttctggatgccccagcaaagcataaaagcaagtctcaaaaggaattgatgtcgactagctcaactgttgcctgcataaagacaaactttttttaaacagaatgctacaaaatccaccacctaatgtacaatgtctggaatctagtaaatcactatgaatcgtgcaaagaaacataaaaataggaaccacaaccaggagaaaaatcaatcaattaaaaaagatccagaaatgacagagataatgaaattcatagtcaagaatatttagctactattacaaacatgctccatatgtccaaggaagtagagggaaagaggatcatgatgaggagaaaagtgagtgttgaaagtctcaaatgtaatatatggagagaaaaaaataccatattttcaataaagatacactagagagattaacaattgattagataatgcagaagggaaaaaggcagtgaatgtgaagaaatagcaagagaacccattcataactcatctcaccaagaaaatagggccagagtatcagtgacctatgaagcaataccaagtggtccaacacaggagaaattggtgctgcccatccaagcaaggaaataacaaggggagataaagcaaagcttgagaatttttagaagttggaaggtaactaagagaaagcaagagtgggggctaagaatgatggaagacatgatcgatgccttcagtccttccttgatacccagagatgggccattacctccttaaaaagaagtttaaagtaatgaaactcaatttgacacaatactgaaaaatggagttgtattcatgcatatattgtacattttgctgtcactattttaggggatggtggcagaaaccaaaggaggctcttaatgcctttggcatcaacaatggtgtttccttggcatctacactaacacgccttaattaacctatcaccatcttaagtccttgtagattaaaattgggtgaaaatttttagaataagtatctacaaaaatataaagccttcccttgaagagcggacaactgtggaaatatacaaagaatggaaaaatccactaacaagtgacgtgacacagaaagacgaatacaggcacagggaagagacaatttgaacagaggcttatgaggacgtcgggtgtgggaagggcccactgcagggtaaagagaatcagcatggcagtatgatggaaacacacccatagcactctccacagcatcacagtcatctccatgtatgggccatggtggtcagtttgcctaaaactagcactgggaatgacagcttgttctcagcttagctgtggactcacactgagagattaggtttcataaagcagaaacgtacatcagcctcagaggacatgagtaaaaagtataaaaacagacccgcacctatacataggaataaaatgaagtatctgtaggtaccagttgatctgaaatggcccactccaacgaacagaaggtgcctgcctgcaagcctactttgagttgttttaaacattatgaacctgacagagcgagactccatctcaaaaaaaaaaaaaaattatgaacctgccaggatactgaataaatgctacttagtacaaatgtccaaatataggaaagtccattatatttttggaaacttaatgtcaccaatgacttcatttattaaaaaggcactctgcatgtgagataaagttgggtatttgaatgattttaagtcactaaatagttctgtgaaaacagttcagcagaattagctattagaataaaagcattgtccttgataatatgattctgaacattcaattggggattgcattatgattcagttttcgcactctaaaatccaacttcccttttagtttcctgtttaaaattataatttctaagactaagagccacaattgcccttctagccttttgcttttcatgataatttagaaaaaaaagaaattgagaaacatatggcaggtaatcatttgcaaacacacgactctttcaatgcctgccatgttcaacttcattttatagcatctatcttggcaatataaattgtgtttggctgcagaggtatgcagtgcagtacaatgaagaaaagcaatcgtgacaactgaaaaataaacaacaaatgtgtgtttgtgagggagagaatgtgtgtgtgtatatgtgtgtgtggtttagacggcaccagctctctgcttttccggctttcttccaaaggggaatggtgttattttcgttggtttccttgttcccttttacagcaaagcaatgccactggaggaaagacaattgccacatctcagagggttgccaaatgacctcaaaccagttcaaaaggagcgccctcaccagttccacaaatgaaagcaatttaatgcaggtggattgggtcaggaatatttactattataaaggccatgttttttgaaacaagagcctacattatattaatttttaaaagtggtagcacaggaagactgtaagattatttatgatggccgggtgcagtggctcacgcctgtaatcccagctctttgggaggccgaggcgggcagatcacaacatcaggagatcgagaccatcctggctaacacggtgaaaccccgtctctactaaaaaacacacaaaaagtagccaggcgttgtggcgggcgcttatagtcccagctacttcggaggctgaggcaggagaatggcgtgaacccgggaggcggagcttgcagtgagccgagatcgcgccactgcactccagcctgggcgacagagtgagaccctgtcaccaaaataaataaataaataaataaaaataaaaataaaaaagattatttatgatatagtgactattcagaatgaaacatgctagcatactcacgtttttgtaaactttgactttcatgcaacttccccaaaattctctcaaaagtaagttttctgggtttttaataaaaattatcaaaagtatctaagattcaaaactttgaaagtatataactaagccttcaaaatcaaatcaaatttacctaatgctttatttttcaatgggttttgataaaccaagttaaatatatttggaatacttcaactgtgcaatctacagtttaatgtattcagagacattctagctcaaataagtgcagtcacttgtcttactgttcaattaacattcaaattaaccatttaaatttcaacatattttgctttattgattatgtattttaagacaacataaaaatgaaagaaaacatgcttgatttggaggcaatacatgcaaattacccatggcagtcaatattggtaatagagaaacttaaaaagcatccagttgatttcaaataaatgtagaatactgctatatagtatactttgcataagtggtatatactgttgggaagtagggggagcaaaagaagcttatgtacatggagttaacacacacgaagagcaggtataaagaaatagctgcccattgtcccatttgatggaagtagcctttttccctagagaagaagcattaaaggagagtcagtctaaccaggattatttgtgtgttatctgttctgaaaatagcgcactcaggcaagatgatcaccaaaacctttccataaatatagtctgcaatgcaccattgtaagctgtcccgtttactattttgactcatattaaatgccaagagtatgtaaacacatgatcacttatattaatatccatgcataagctgcttaaaagattttagttcacaaaactcagatacgaaactgcaataagtctgaaaagcagtaaggcaggagagaaggagagtagccaattaagaaatggatagaaaaaaaatgaaaatgcatagtgagaaggggtattatactggctaaatgtacaaccccaggtcatggggttacctgcaccagagaattccagatgctagccctggctcatgcagcacagatggcagcccagtggtgaagagcctgcatccggcagtcagacttcctggctccacatcctgtctctgccaggtacttgatgtatggctttggtcaagtaagttaaactctctctgcctcagtttcctcatttgaataatggagatgagcatcgttcctccattataggcttgttatggagactaaagcagttaatgatcataaaggtcttagaactgtggtgggaacatagtaagcgctatgtgtctcctagccgaatgaccatcctgaccccctggattttttatttatgcaataaagataacaacacagacctcaaaaggcacttataatcaaattatttgagttaatatttgtacagcattgcccacagtgaccaaaatagagtaaacaaacagtaaacagtaacagaatcagtattgctttagtgaagaaacagctaagatttaataaacacctaccatgctgagcactttacattattaattcattttatccgctaacaaccatgtttgaggtagattttatcatcatctctactacaaagatgggaaattggaaacaggtaaataataatgataaatactactagtctgaggaaagctactagaattgaataaaaaattacttataaaccaaggcaatcaacctaattaattagcctttggactttttctcagttaattcccaattttgtgactgaattggtcaagatgatttgcagtgttggcacgtaatacatggccaattgttctaggagatgttctttatttatttatacatgtgagaattactgaacaccttggcagaggccactagctagttgtcttggtgatacatatttttctccttcttccttgttgagtaatgagatatttaaggtggtaaaatggccacccacaacactagatttccaagtctcccttgcagctagaagtatcattgactaatttctggctaatgaaatgttggcagaaggttaaaattattccttaaatgcaaagaatgaagctggctggtacgagtctttatcagcaattctcctttcttcttcttgcttgcactatggacttgatggctgatgtgccatagaatgtcttggaccaagaggtgaccttgggaaaatagccatgcactataagggcaatgaggcagagatcctggttctcagtggtgatacatggcggctttagactacctatgaccagacttctactacagagaaaaatgtacacttctgtcagctttaaaatcactggaatttttggactttgttcctagcaggtgaatacaattcatgctgatatgagcagccatatgaactgaacatcaagggcaaacaagatacatttgaagaaaataagaatgcaaataattaaatgcaataaagcattgcacatattaggtaataaatagcacagggtataatgagattgcccaggagaaaagtgtttattctgtctgcatgggtttcttagaggtgatgaagcttgaattgagtcttgaaaaatgagaaggcatttgattcaagaagacaggagtgaagcgacgggctgcagccattccaggcacagagaactcatggggaaaaagtcacagagagatatgagtaattagatatttctgaatcaaactgttattagtcattagggtcaaaaatatataatttcatacagaacggatggcatatttgattgaataagacattataaaaattatctggctcatttaaagaaatctacatattcttctccatgtaatatgcttaaaagtggttgacacttaagaaggcaaagaaaggggctggtgatgcggcttgctatcacaggctctctctcaaaatgtaggtgctcactaccccagcttgaccctgttaccgcgcacacttggttgaggttaacaaagcgcacttggagagaactttaaaggcaacctttagaaaagcacaaatctccaataaattaatattctcccatcatgataaaaacacataaaatatgcaagatggattttaatattcatgactcacatctttcaaaagattggtgagatatcaaatgtgatacgataacaaaaaagcactttgtagaggtgctcaaagtactttcagcattaatgaattcttataatacccttgtaagaaagaatggaggcagagattattcaccataacttacagatgagatcgaggtggaaggatgctgtcagaagatcagctggtgtaggtttatggtgctccgagccttcctgggagctggcttccctacaatgtctgcagtaggtgcacacgaactgtaggacctatggtcacaggcccacccccaggtcaacctttggttgtagcttcaccactgcagagggggcataatgacagcttacatagttgatttcaggaacttttggtagttctaattgactgctgagaattgcaccaatttttagcttggcatgagcaaaaagcaaacagcttgcttgggttgctaaccctgactgtaaagcttcggcacagtggaaagtctcacactgacaggccttggtgagagaaccacatttgctccttatctagtaacatttaaggctacggtggagtgaaacgacgaggatgaacgtaaaaggcctagtacattaagggatgaggagcatagcaccaactcatcatttttagttcccagaacttaatcaaggattcaggctttcacacagaactcccattggtcatttctttttaatcactaattataagagagatcacagattaaatttccaaagaggaaaaatccctgatgacttcctgtagtcaaggtattcacttcaacgcaatttattacggaaattgaactcttctgatgatgatgggtaaaaataaccttcaatttcccttttaggtgtgtagacatacaagcaatccccacttttctcagctttgaattttgttgctctcagggtttagctgtttaataaagacctggatgtcaacagttcgtaccagtgttcaaacagataaagacaatacattcagaataaggatatgtagaataaaacacagggatttccccaaatggtgatttgggtggtctggggaaattgttcttttcctgtaagtaaggaccatctcattattttgtgctaagcataatgtcaggcccactgtgcctgggaatatttacacattggggggaattattgttgctagtggagagtcttgcctgcaagttgtccaggttcttggtattttgaacaaagaattagacaaatgcacagcaaagcaaggaacaaatgaagcaaagaaagcagagatttattgaaagcaaaagtacactccacagtgtgggagtgggtgaagcagcagctcaagggccccagataacagaatctttttgggtccaaatacccccagaggtttcccattggccacttggtggacatctcatgtaaatacagtgttggcccgcaatcagcatccaggtcagcttggctgcagaaagcaaccaatcaggctgaagtgaagttacaaaggtcatactcctaaacaaacatctgatgggcggcgaaaagcaaccaatcagaggctaaagttacaaagttgcacttctatgcaaatgaagacttggcctgtaatcagtctgactggttgcagacagcaccaatcagaggctgaagtgaagatacaaagtgacactactatgcaaacgtactttcaatttcccatctgccacacagaaaaggttggggtttgcaaagggagtagcctatggtccttttgttactcaggtgtggaatgttggggtttttgtttcaatttagttctaggaagtcagtgtgaaacggccttaggatccctgcctccagaccctattctcccaactgattatctctttttctatatagcacccacgtagccatccagcaaacatatgctaaagatagtagactagagatggacagtctggcccatgacgatgtcattgaacaatttagttatccaactccaaagcctctctacctctgaactcagtttataatcttttgcatttttgggggtaatatccaggtttgttcaagtgtgctgtaaattttatgttaacaaaacctaccttccctttggaaatcatgtaagaaaactaaaaataaatgtttagtaaatatatatatatatcgatagatagatagatatactaaacatatatatatacgtatgtatatatacacattatatatatataaattttttttttctgagaccgtcttgctcagtcacgcaagcaggaatgcagttgcaccatctcagctcactgcaagttccacctcccaggttcaagtgattctcccatctcagcctcccaagtagctgggactacaggcatgcaccatcatgcctggctaatttttgtgtttttagtagatacgaggtttcaccatgttggccaggttggtctcgaactcctgacctcaggtgatccgcccaccttggcctcccaaagtgctggggttacaggtgtgccaccacacctggcctacattctttttattcctcctgggctcaagtgattctcttgactcagcctcccgagtagctgagattacaggcatgggccaccacttctggctaatttctgtatttttagtagagacagggtttcacagtattggtcaggctggtttcaaactcctgacctcaggtgatccaccggcctcggcctcccaaagtgctgggattacaggcctgagctaccgtgcccggcctttttttattttgtctaaaaagatgcagggctgggtccggtagctcaggcctgtaatcccagcactttgggaggctgaggtgggaggatcacttgaggccaggagttcaagacaaggctggccaatatggtgaaacctcatctctactaaaaacacaaaaattacccactggcgtggtggcatatgcctgtagtcccaactactagggaggctaaggtgggagaatcatttgaacctgggaggtggaggctgcagtgagccaagattgtgccactgtattcaaccctgggtgacagaggaagactctgtctcagaaaaaaaaaaaaaaaaaaaaaaaagatacaggatcataccacgtctatgttggctacttccaatctctttctttagttgattttgtattgatgttgcaacctcaagggaacaaacacaggacattctcatgacatctgacacaggaaagggattagcaatgaatgtgacaatgtgaatatcatcttaaagcagatccagcctagtgagttcttctcagcattctggacaccctactaaatatgatttcatgataccttacagatttatattttttctttataaaatagaaagtaaactttttaagactgaatggacttttcattttaaggtgcagttagtatataaaggtaagggaagggtacttccaaacacaattttaaagtcatactcttaaaaacgatattagcaataaccaaagagatcatttgtgaacatctcgtatacagctatgataaattgacactcacagaggcattacagggttataattttaaccacaaaacattcaatcaaggtaattatattctacttgtccacagaaataacttatcaataaagaagtaatgtagacagtcatgaacagcataaaagagaattccaaggagacaaaaattacgcaatatttctatgcgaaaaaattacccagagatgtcctcagccccaagtcgacaaccagcatggaggaccctataatgacctgtctcagtcagctacatcagggcaccatagttctggtaacatcactgcttaacataatccagttgactagccttgtagattctgtgcctataaaacaaccattggataacaattgagctatccaaaaaaatttatctataagtagagaatgtgctgatgagtaaacattagtatcttctccctttgttagttttggttcttattctactttaaccaaccagtattccaccttttaaacagagttatctgatgagtttgaccctcgtgattcagctctgcaaaggctgatgacttctgaattcaccagcgtttgggtttccacgcctaagagcttgaaaaaaaaagactttagaacatggggaccattctgtcaccagtgagaaaactaaactatcaagattaagtcatggagattttgaggtccctgtcacagcagcataacttgtagcctaattcacatatactacctcattcaatccttaaaaggtcctatgcaggtagcacaaaaacaaaaaaatagtaaagtccaaggtgatataagccagattgaaacaaacaaacaaacaaacaaacagtgaccacatatttaaaatgtggaaaaaagcctaaaataaaggaataacatctaagcaaaggcctgaaagaaaaccataatatgaaatatatttttagtcttccctgcaaagagccaaagagctttgggcagtagaattctgagatgggccagcagtcaggaaattaggaagttctcagatacaagacaaaaagttcaaggatgggtagaaattgaaagggaaagaaaagttataataaagcctccttttatactttctgacaagacaaaaattgacattcttttttagacaattgcaggttcaagtgtgtttacaagtatggttgctcatatgtgtggccagggtgggggtacttacgggacaaacagattcttctcattcattcatacttaagatatggatttcttggcacaaatagggtagtgagaagtgaaatattactacaaccctgtgtctgcgtctgaccatttctgcggctgtcaccatctcccagtaggacaattcattgttactttgcaccttcaaggtcgtattagagaagaggcaatagccaggaaggctagctaggccttaaaatattgatttattttatttataaaataaaatataagactttactttcttttttcttcataatttttttaagacagggtctcactctgtcacccaggctggagtgcagtggcacaatctctgctcattgcaatctctgcctccctggttcaagtgattctcatgcctcgccctccctagtagctgggactacaggtgtgcactaccacacccagttaagttttgcatttttagtagagacagattgcactgtgttcgccaggctggtctcaaattcctgacctcaaatgatccgcctcttccagcctcccaaagtgcagggattataggcacgaaccaccatgcccagccaagactgtacatttttcaaagtaaaatcaagtcaagatggaaaccaggaaggttgccatcctgtactgttaagagcaaaatgaaggtcttgaggccaaaaagtgagtgcagacactctaagactccaaagtctccagggtctggtagtttcactatcaggggccagaaatgcagaaataacccgatccttgggctaggaatgcgcaactgtctagtgccatggtgagggactgcagccgtcagtgtcactaacgtggaagggcgaaggcagtcaagagacggaaagagggtcttcaggaaatgatactgatgaagcaagaacagggggccaggattctagaggtgcagcaggatccaagtttcctgataaataaacccccatgaatgaatgttttgtcttggaaagcactgtatggtataaagactctacattcctgcattttgtcacaggcctctaaatccccaacctagagcacctggacagatctcacttcttcacatgcagattcctgaattcagtaaaaaagccaataggaatttaatgacctcatttcgtagtaatattcccaataccaaacacatccactaccatcgccgtgtctttttaagaaaataaatatgtgagtaaatacagaaacagatggatattttaaaaatacctgacggacaacaacagtgaaaaggatcggtcacagcaataacttaagtgtgggctaatctgtaatggacatatgtatcctaagaagacagtggcaaaatgtttctgatgtgaatttaaagtgtctgagtttgggggccttctctgtttctgctcctgatttatatgctgtctccagagcatgagggtacaaatgatttcttgagggcagaatcttcctctgctcccgcacacaaggctttgttaccgcagggctgctctagagcacagagcccctggcaggattcgtctcaggtgaaaagaacatcaaagctgttactttgaaaaagacgcactccagaaaacgcagcacagtatggattttgcaacagatctcacaccggggaaaaataaatccagctcaattatatttgggtcctgcctttacaaaggctcattaacctctaaatcattcaaaagatgtaaaggaagagcaaaacgaactacagctttccctgccagcttttttcaaggtgaaatattcttggtgtttgggtacctggaaaggaagaaatgtttaaggaactctggttctctgatattgacacagacaggaaattggatgtatttatctattttaaggaaactgtccagtgttatttattctcccccaccaccccacatcctatgaggtgagtcaagcaattattgaacctcaattcatggtcgttgaatactatgaaaaaatgctcaaatgtcacctgagactgtgggctatataatacaattgagtttctaataaaagtaaaagagaaattggcaaagcataggaaagccactagtgaagatctatatgaggcaataaagacagcagggacgatcctaaattaagaagagaaaaaagggaagaaaatcagaggccgtccacaatactgaagaatgtaagaactgaagatgattcagcagatgacctgaaatttcctctgtcttgaattttcaagaaacagaatgtgctctccacactcgtaagtgggtcagagggtgttcccactgcatggatgggcaagctggctggccgagagtttgtctcaaggtttggctccatcagacaaacaggtgcaccagcatttccctccaccattcccaagggcaccttcttagaaaatgaaatttcatgctcagtcaaactttagaaacatatgatttaaacatatgccagtctctttctacatatttgcagcttcgcaattcttcacctcccagtccctttcttaaaatagcttgtggttgaagctaaaatgtttagttgaatagtcatcttttcctcttcttatctagcctatagaaatctctcatgaggaaactgagcagccacaagaaaactgagttagtgacgatttataatgtgatattttgatgcctgagactattttcagaattacaagaaaattttccttttccaaacacacagtcttccagaaaaaaatctaccatggaccataaccaatgaacactggctgattcacgtcttgccagtcccactttaagaaaaagaaagagagacagggtatgtgaaaaagttataaagataaaaatatcttcggaggacataaggtaataatcaatttttttattcacatagggtaagaaatcttttctataaggtgaaaagtgtaagagacataaactgcccagagttacaggataattaatttacactgattattttactaaaacacaaacatagaaagtgcttgtgaaaaacattatttagcaaaaaaaatcaaataattataatgctttatgtacccttaaattagcagcaatccattacaaacaacagattttatattaagggtcccacatgagcttctaataacaaaggtcactttttactaagacataacttgtggctgctcaacagtagaattggaaagaaaggctcttctctgattttaccttcccaaactgatgcatgccaatgaaataaaacgttatcctgccaaatgcaagcaaccctgggggagcttttcattgattaagtaaggtcttattgtgattggctcacatcgtttcctagtatttcacaatgtgtgtctcccaaattttccaaatccttcctaattttcatccaaagtcacctcaagcttctagaaccagtggaactactgttctccatgacacccttcctgaatagcctacctcaagctcaccaggcccactcagccacatcataacttccatctaactggcccgctatcatttctctataggtaagccctatctcctcaatcaaggtcattgaaattaagtgaaaatgattgaaatgaccaaggcatcaggaacagtagtttacagttcttccacatgcatactgcaggaacacaatataaatttcatgataacaagtgatcctcttgggaggaaggaagacttggtatctgccaggaatatgagtggtatcagccccagaagaataacaaggtgacggtgaggacacacaagaccaatttcccaatattgtcaaggagagtgtggtctacaaatgaatagaaagcagcattttaaaaatgatatagactcaactaggaaatatcagattgtatctcatagaaagagtaaattgtttgctgaaatctttgtttcagctacatatatgtgtgtgctggatcatgatgtgaaatctatttcttactctgggacaaggtcagagaggtttaaaatgcactgctttaatttgtctcaaaatgtgttccacaaaaaagcagttccaccaatgtgacctgcagaaaagggctccaaagtcgatgatgttcaaaaatagtagattaaaccaaattaaacagatattttaaatgcctgaattaccagggcttttaaaacgttaatatgatcacaagtgttcaaggctagaaaatagtattgatgcaggatattttcttgaccccttcacaggacctgtgacagagctgtcccgtttactcagcccaccatgctaaacccctcacaggagggagcgtgcaagtgagtgcaggaacaagcctgctccttcggcaccagcaggaacaaactccaattactcacttgggcctgctgtggcgcaccccttgcgggaaggaacgtgtagggaagtgagtgcaagaaatggtcagctgctttagccccagcaggagcaaatcatgtgtaggccctgtggcagcatccaggtggggctgactgtgacccaaaggcctcagagggcatgttacaatgctctcttaggtctgctgtcagcagacaacagtgtgttatcagttcagcgggccctttgcctcatggagtgcagtggcttccctctgccagtgagggcaaaggggcattataacagccttttggggtacccgcacttgttgggtcctgaattcttgtctggtacactggaagaataaggttacctagacaaatggaaggatgattaatgcggacaattttattgagtgatgaaagaggccctcagcagagggggagctggaaaggggatgggaggggaaggtcactgtcccccgaagtcaggttgtctctcttcctttctcctccgaggccaggttgcctctctatgacattcagcagtggctcagaagccaattcacctctccccaatgtccagccatttcccctctctaccagctgagcctggggtctttataggcacaggatgggggtgaggcgagccataagtagtttggaaagggcagcattcaattggtaaaaagacattattcagaaagaagtactcgggagagagcgggtaagcaggggtagaagctctcactttgggccatgggttcaggctttttggcttaaaggtggggctttgccagggacctgccttgtctgccaagagtttctctgcctcctgtctccatcagcataaagctcattctaactatatggccatgaaacctagggcaggtcgaggaactagcctctctcccaccacactctgaaaaacagtggtcaaagccagtgctgctgaagacacccgcatcgcctctgcatttcctgtctgatttcccctctgacatatgaccgccctgcacagcaaagcccattctagattacaggggagtgctcagtaagcaagaaaaacactgagaacatctgggagaaaaaaataataagaaaatgcctgaaaatttggtttcatgttataaggaatggaaaattcatttcaattcagtccccaaatctaatataggtttctcaggggaccatttgtgaagtagatgtgttacaataaaaaatgttagtagatcaagaaaatactgaatggcctacactctagtgacactagtacaaaaggagaaaaaaaaaaaaaaggaaaagaaatgagatgaagtgtgtttaaatggcacttgcccaggtctggttattatcctcagcatctgttagttctgctgaactgcatttgccttggtactagtcactaccattaaatttagacagtctaaaataattgttatatgaaatacaaggtagataatttgttatttaagcatcagaaagtaaaagagcatcaggtagtaaaaataatcaaaacaattcataatattttctttatgaactcatgtactctttcttaataggaagccatgatttttattttttatatgaatgaaaacttgatacacatatattttctttctttgatagatattctctctcaccagtataaaaggaaatagcttaattgaaaaatcaggttaccaaaatgaaggacattaattcaactctggatttcaggtgatgcaaaaaaaaaaacaaaaaaattcaaaaaaagcacaaaaaggactctgaagataatttatgtacttttcagcaaaacacccacaacatgacttctagactctatggtaaatcaaagatggaaaaaaaataaaacctaaaaaaaaaaacaacaaaatgacttactcagctgtttccattgaaaaattacttcccattaggagatgaacaaaatgcagcatttggttaatccctggcagtggcttaccattctcttaatactttcttctgcatctacacagttcttagtcagcacatatctgatattttgccatattgctattttaattacaaaaagctaatcaagtgaaaactaatttaaataatcaagtaagtcaagggcaaattaatcctgattcgtctaatacaagtttattacatcaaaatccctatctactctcatcagagaatttgggattgtagttgaattttctttttaagcagcactatgagactaccaggaatacagacagaactactactgaatttcaacatcagagacagcaagcagaatatcatagatacagacagaactaacactgaatttcagcgtcagagacagcaagcataatatcatagttttataaaagtgatctcagaacattcatagtaaagtccatcaagcggaaaagaacagaacagaatggtctcaaagaattaaaatgttgactattaatctcaatgcccagaaaaacttgccttcatccaattctaaggagccacttttgaagtccatcataaaagccacattctgtaaatcttgacactggctcagtgctcagaaactttcagttaagaaaaaaaaaaaaaagagtcaagggaaacacaaatttggctaaagaaggaactaaaaccaaaacgtgataagtgattataaaaccattttcaataagatgcatagaataaggtacaatgtctaaagaatgcaaaaggatggaggagcccagggcaacttgcttctttaaaaccatttgatttcttccaaacagacaaaattcagggaaggaatagtggaaatgaggaaaatgagtcataaatatatgccttcacccacatctcatgtttccttggttagactaaaatattttaatatttacatccctatgtactgtatatatatttttgctatgccatcataatcaaaacaactaacacagcaatattggataccaatgacagtcaaaggccactgaataggccactgaataatggaattgtatccaatcgtccaaaagtaacattacttgatgtgttagtcagggttccctgaagggacagaactaataggattgatgtatatatgaaggggagcttatcaggagaactgactcacacgatcacaaggtgaaatcccacaataggccatctgcaagctgaggagcaaggaagtcagtctgactcctaaaacctcaaaagtagggaagctgacagtgcagccttcagtctgtagctgaaggcccaagagcccctggcaaatcacagatgtaagagtccaaaagttgaagaacttggagtctgatgttcaagggcaggaagcatccagcacgggagaaagatggaggccggaagactcagccagcctgctctttcattttctgctgctgctttattatggccacattggcagctgattagattgtgcccacccagattgagggtgagtctacctctcctagtccactgacttaaaagttaatctcttttggcaaccccctcacagacacacccaggaacaatactttgcatccttcaatccagttaagtcgacactcaatattaaccatcacccttgattagcagacaatgttctccccctttgcacacaggtggaacagagatggacatcacccatttggggtttgtaaagactccagaccatgtggccctatctgggagcctgatttgtctaagcatccccttgacgttaggcactcaggtcatctcaagcatttccccattgcaaatcacattttatgaatacctgtatacatcaatctttccatttctagttatttcttcatggaagaagtggaataaagaactgagttaacaggaatatttttaatcctcttgatacattttaatctggttaattaaaaaaaaactactggcaagccacattttgccagtattttgtttttcctaatctcggattaccttcctactctttttagtctattctcttctcctctgcctcttccccaccacacccctgtaccctgtgctccagctccaagaacccttcctgcacagaaaagacaggatggcactttgcccttccatgctagctcctggctttgtttcattttcacatgtagtgccttcatgcccttctcctcttgctctctaactctcctgattacccccaccgagaatggctcacttcctcatcaaggttactaagtgttctgttcatgcctcatttgtagcaagcacaatttacattttctagaaatataaatttgccaaaaagctgctccagctgaaagatggtctctaaaagtactgacaaaaatgcaactggtactgcaagaccagagcttagaaaatgcttctgcacataaaaggcactctaaaggaaatgcaattaatacaggggaaattcaaaagacatcttaaatggcctcaattatactctttcaggataatttataatctgctaatgataaaatgcagatggcggactatattaatttcaaaatgctctaccgcagttttactagatatttctgggactataatgcaaaaccaacccaagacacattcagaaagacttctcattccctccaactacagccaagttgaattccttactcttgttaggcatgcatactgtggatctcaggttttaatgttctctgtattttatcaacagcttgtcttccataataataatactttcagtcctctggtctcaacattttgttgcaactttgttgaaacttcttaatttaatatctgaattcatattaaagccttctatgtttctttgagattatttttttgctgggagtctgctgttttcagccacctatcagaaggtaactcatgaaatagagtataattgtcagggtgcgataagtttttggcatattttctatgtaactgataggaaatataatacaaggctgttaaataatgaaaattttaaaaaggaataccattaggaaggttttctgtttgggtgatggatgtgatctatcatatagttctaaataataaattcagttttctgtctcaacggttgttctcttctttctcctcaggaaatgttacacgctgagcctctgtctcccagaacagtgctcctgaatattgaaaacatgctgcccagatctttctttcttctttgacaaaggctacttatcttgtagagtgtaaaagaccaaagctttttgtttgtttgtttgcgtttttttttttttttttcttttggtttgtttttgagatggaatcccactctgtcgcccaggctggagagcagcggcacaaacttggctcactgcaatctccgcctcccgggtttaagcaattctcctgcctcatcctccagagtagctgggactacacttgtgcaccagcacgcctggctaattttttatttttagtagagacggggtttcaccatgttggccagtctggtcttgaactcctggcctgaaatgatccgcccgccttggccttccaaagggctgggattacaggtgtaagccaccgcgtccagctgcttgttcctcttctgccttcttcctattcctttctttcctcctcccgccttcatccaacacggtttgtggtccatgttacttgggactattataggcttcaaacgagtctcgtatgagcagtctctagtccatattccacccctgtagctagtgcgcccatgttaaagctctatagtgttcacattactcccctgttcatgaatgctcattagccttccactaactaccatattaaatcccatctccaccttggcattcagggccatccacataacgctaaccctaagcctagtcagagcccatttacttgtgtttgtacctcctattgtcctcccacactcacccttagagcccctctggaccaggctctgtgtcaaaaacaccaggtgatttgcttacctttaggcctttgccttgcctatctctatctattaaattctgccgatcttcttatcgtaaatactgttttctattgactaattatctatgagaatcacacagatactcatacgtgagcattgcttttctaggatgcaacagaacttaatgtttcttatagacctggccatatttttcttttttagtaagcttttctatatattagcaacacacacttggcaatttaattttaaaaataacatttgcaatacaatcaaaatctgatctacttagggacaagacctatagactgaaaactagaaagcactgctgagagaaattttcagaaagtcctaaataaaatggtaagcatgtcttttacaagtatctgaaaattcaatattgttcagatctccccaaacagatctatagttttaatgtaatttaaatgaacatctcaaaaggcagatttctttgtagaaattgacaagaaagttctaaatttcataagggaataaaaaggacctaaactagccaatataactttgaaaaagaaaacaaagttggagaacttctgctacttttctttgagttttattataagttacagtcatcaagaaagtgtggtattagcatcaggacagaggaagagatcaatggaacaggacaaacagtgcagaaacagacaaatactaatctgctaatttttggcaaaatgtaagtgtaattcagtggagaatggacaatattttcaacaagtggctctggatcaattaaattgatctgatctatggcttgtaccttgtaacatttttcatagtcctaaatatgaaggtctagaaggaaaccaagaagatttttgtgaccttgaactaggcaaatatttcttgaatgtaacaccaaaagaatgatccacaaaagaaacattgtataaattggactttatcaaaatttaaaacttctgctctttgaaagacatgtttagggaatgcaaagacaagcatgcacagactaagagaacatatttgaaaattataaatctgatgaagaacttgcatctagactctataaatacttttcaaaactcaataataagaaattaagctacccaataaaaaacaggcaaaagattcaagcagactaaattttaacaaataaaatatatggatggcaaataacaacaatcactgatggtcaatagtattagtcattcagaaaatgcttattaaaattctagcaaagcaaattatagtgacataaaaccaagctgtgtttgcctacaaatgatgggactagaggagtgaaaggaagggatggctgaatggcagtcggagactttcctggttctggacatgttcattatgatagcagtgatagtttcacaggtatttacagatatcaaaatatataaaagcatatacacttatagcactgtgtcaaactatacctcagtaaagctataaaaataatcatgctagcaatgatctccatttttcaagttagtaaaataattttcagaaaaggaaacgtctgcatgtgtgagagagaaaaaaagaccacattagcctaaaaacaaacaaacaaacaaaaaccctgcctaaatcagatggctgtcctgggactcaaggaactgtgctttaagaggggactttctcctgtagtcccagctactcgggaggctgaggcaggagaatggcgtgaacccgggaggtggagcttgcagtgagcctagatcgcgccactgtactccagcctgggcaacacagagagactccgtctcaaaaaaaaaaaaaaaaaaaaaaaaaaagaaaaagaggggactttctatcaggcagagataataaaaagcactagtcaaaggaagaggcaccttatgcagaaatcactgtcataatccttcctgtctataggcaaggatggctctggaccaccaccaccccctgcattctaatttgagagtagatacactactccaacccttagggtctttcttgggttctaagaacactggatgagaaaatctagctaggatcaggcacatctatagcaaagctcacaggtttatccacaaaggccagccatgggctgaccacgtgagcattctagggatgcgatccccagaaatctaggtcacagacaatcctctggaaggtacaaagaggacactggagcaggagatgtggtgtccagcccagtaccccctaggaaggccatgtatgtcactaaaggatgctcacttaatacaggcagaatctcatcttctcagaggtatagcagccctcccttatctgcggttttactttccacagtttcagttacctgcagtaaattgcggactgaaaatataaaatgaaaaatttacagaaataagcaatacataagtttggaagtgtgcagcactctgagtagcatgatgaaatctcacgccaccttgctctgtcctgcctatgatgggaatcatctttgtccggcgtatccaccctgtttctgcagcctgccattgttcattgacattgtctgctcctgacattgaaacttgaacatgctcacggctggatgatccagaatcacctgacgcagataatcctccttctgacctaacactacgtcacaatgcctgggccgttcaccttgctcaatccaatcaggtaggcattttatcaacgcaacataacaagaagtgcaggtatggtaaaataagatactttgctagagagaccacattaacataacttttattatccaacatattgttataattattctattttatgattattgttgttaatctcttaccgtgcctaattcataaattaagctttgtcataggtatgcatgtataggaaaaaacagtacagtttgtgctctgtatccacagattcaaccaaaagaaacaaaatgataaaaaagtaataaaacaattgaaaactacaagttgaagaaccaacacagtataaaaactatttgcattttatttatttattcattttgagacagagtctcactctgtcgcccaagctggagtgcagtggtgcaatgttagctcacagcaacctccacctcccaggttcaagcaattctccctgcctcagcctcctgactagctgggattacaggcacatgccaccatacctggctaatttcaccgcacctgaccttacatagcatttaaattgtattaggtaatccagagatgatgtaaaatatacggaaggatatgcgtaggttatgtaaaaatactgtaccaatttacatcaggaacttgagcatcagcagattttggtatcggtgaggagtcctggaaccagccacccgacagacactgaggcacgactgtttgtattgggtttggtactgcccaaagtttcaggcatccactggggatcttggaacctatctcccattgacaagagggaactactgtaaccaagaaactttgattaacaagagaaaactgtatggaaaaattcactaattaaatgataaacataatttacaatataataccttcataagacttttctaactcatatgcaaatagtaaaaatacacaaaacaagcaagaatgcaaaaaattttccctaaatcttaccaatttgcattaaagaaaaatttctggccgggtgcggtggctcatgcctgtaatcccagcactttgggaggccgaggcaggcggatcacaaggtaaggagttcgagaccagcctggccaatatggtgaaaccccatctctactaaaaatacaaaaatcagtggggcgtgatggtgggcacctgtagtcccagctactcgggaggctgaggcagaagaatcacttgaacccgggaggcagaggttgcagtgagccgagatcgtgccactgtactccagcctgggcgacagagcgagattctgtctcaaaaaaataaataaataaaaagaaaaatttctcataggactacagttcccctgggatattactattcatttataatctatcattttgcaagctgaataccttcttaacaatttcttaaagtgctatgaatgcctagacttctaagacagtgatgccagtgtctctaacttcctgtatatgccacgctagtttctgtatagaataggttatcaattttacgtctgtgttaaggacaggaatcacaggacatctcacttattaaacggcatctatggaattatgccaaacacatttatctataaagaatgctggtcctcactatttttcattaatcaaatgcaatgtgtaaccagttacaaagcctgtagtattaatagaagcttctaatctgtatagcatgctgctttcttttagctgaaataacatttaaaattcataaatattggaggtaaaaagaagaaaaaagattataatgtgtgctctggcttgtagcccgaggagaacagaaacaggggaaaaacaggtaatgctttccagcgatgagtgatgaaaaagaagcacaacaattccagtgactgtatgagaacagccagaaatcattcttctaaaaaatagttttaagcagaacaatgatctagaaaaggatcacaacacattgcaccgccctgagcagtcccataaagcagtgtgatgcctctataaagcaaagttccgtccaacagggctgtcagaggggaacatgagtgaaagggagggagcgccttgcacatttatatccatgctgcaatgatccccacatctctcatggtgcccagcgcacgtctcctcctgcacccacaaccaggaattaggctccacgttcacctgctctgcagctacaggccttatcctctaattaaaccaaccccactgctctagaagaatagccctgctcggtgactcactaacatttaagaatacacacatgtgaaactaagatgaaaatgagggcggagatgatttatgtgaaaggacatttaaagatgaataggttttgtgaggttgaggaagcctgcccctctagagacagaggaggcatttgctcaagtgtggaataccagctgttgaaatgttaagtcaaatgaagtagaaatgtaatgttatttaacaatggccgaaaaggaactcgctaattagtatttagcaaaaaaaggttttgagtggtcaacctgtgtatttgtttatttgtttgcttttgtttggagacggtcttgctctgtcctctggagggcagtggcactatctcggctctgcaacccccatctccatctcctgcctcagcctcctgagtagctgggactacaggtctgcgctaccatgcccggctaatttttttgtattttagtagtgacggtgtgtttcaccatgttgcccaggttggtctcgaactgccgacctcaggcaaacctcccaccttggcctcccaaagtgctaagattacaggtgtgagccaccatgcctggcctaatctgtggactttttgtgtgtagagtgtgactgttacaaatgggaatgccctaatctatatgttactgtggaattttcctatataacaaaagaaacttctaagaactgctaccatttggaatccagtaattgtatttatattgaaatatttattataatgaagtatagcagaaaggctagtgagttacagaacaatatcagaagcctatgtgccatctaaaattttcttttattttttaaattaaaatgatctcaccaagcttaatcatctctaaatctaaaattttctaccaagtttactaggacactagaggcctatttctccagaaaaaatggtaatactaatttttacatatattagaaactaaacattttccaggaatgtacaattactctggaaattccaaatctttatgtcaaaaaacctagaaaatctgccaaatgtaccatgtctaaacctaagtgggtattgctactaatggtatctttactctgtctttatatagaaacaggcttatttggaatttagggctcagaaatagacctacacatacatgacatggtcatttgattttcaacaaatgtatcatagtcatccaaataaaaaagtaacaactgcatatccatatagatatccatacctcacactatcataaaatttacatatgttggatcctaaacctaaatgtgaatgccaaaactatggagcttctggaaaaaaaaataggagaatatttcatgagttgggattaggcaaaggtttctttgacaggttagagaccacaatatcattaaaaagtaataaacttagaaattaaaacatctgttcataaaaaatatgaagaaaatgaattaccaaactccagactataagaaaatagttccaaaacatacacctgataaagtactgatatgtaataaatagatcaaagcttccagaacaatatatacatttcctaatgaacctaatttgaaagtgaacaaaatacaagaagagacatcacgaaaagaaaaatatgaatcactaaccagcacgtaagaaagcacataacattgtcagtgagtctgaatggaatgccagtgcacaggcaccagaatgaaagcctgacagcatccgaggcggcggagccaccgtaatgctcatgaagagtcagaggtttgaccttttgctatcaatgttgttataaatgttaatgcacaactatctgtcagcccagcaattccactgcaggacatttactcaagagaagtgaggccgagtgtggtggctcatgcctgtaatctcagcactttgggaggccgaggcaggcggatccccttaggtcaggggttcaagaccagcctggccaacatggtgaaaccccttctctactaaaatacaaaaattagccgggtgtggtggtgggcacctgtagtctcagctactcaggaggctgaaacaggagaactgcttgaacccaggtggcaagggttgcagtgagccagggtcatgccactgcactccagcctgggcaacagagcgagactctatctcaaaaaaaaaaaaaaaaaaaaaaaagagaaataaaagcatctgtttaaaagtggtttacacaacaaatgtttaccttgttgtataaatgctctattcaagagagtcaaaacctggagacggcccaggtgtccctctacagtagacaaaaatacttctcagccataaaaggcatgaacggttgctccacacaacagcatggaaaaatcgccaacatattttgctgaatggaagaagccttacaccagagtagagaccacatgactctttatatgaccctttagaaggcagaaattgtggtggaaaaaaaatcagaagtgtttctgcccctgctgggtggagggcttggaactgaccaggaaggagcatgacatcattctctggggggtgataatgctctgcagcctgacaggggctgaggctgtaccactatatctttgccacaactcataacattccaccggatataaaatctatctgaaaaactgaactatgaacatgtattgaacttgtttgtcatggtgttcatgttgaagtatttcgaggtgaagtatactcatgtctccaactcactttaaaactcattttaaaattcttcaaaaatgagacgaattggtaagtggatggagaaggatagatagatatttagccaacaaaggaaatagagtaaaaagttaattgcagagctctatcaaaaagcaatccttacccaacagcatgaagagattagtagacagatgctctagcttcccattctctggaagcacaattctatgagacattctccatagctcctcagatgcccaatgagactgtgccctaattgtcccctgcactataaactcaactacccactctttgtcagctttgctttattttccatctgactttcccaactcctcaatgtacttcccaagattactcccaaatgaaccacctgcacctaaaacagagtctttggttctgcttttacaggaacccaacaaagatgataatatagggaatagcatgcatatgtccaactgtgtcagaaatgaggagccaagctgatgagtggatctacagtgatgttctaggaaatttaaaatgtagaattccattttcgcattgtcaaatgcaaggtgtacaattttgagaattttaaataattgaatatataaaatgaaggctctgaaatatctgttgcgatagaggtaagagatctgacagcttgtatgttggcatcacaaaactattgtcagttgttacataaatggatggtaaagctggaatgcctggattggagtctcggccctgacgtgtgcttgttaatccctcctgcctgggtttccttgatctcttaagcaaaatgttgaaagagcagctggatcatggtaaatgctattgaagtgtgctattgtttttattattgcctggcaaacactaaggaagtctatccaaggaattgtaacagaaggaaaatgagggatctgactattatagagaaaagtaattaatttccacgaaacagtcagtaacttggctaaagcgagctttggattatttgtcaattctgaaataacagggatttttttttttttttcaaaacaagtaaatttaggacaaataagatgacgtacttcacaaagtaatgaaaaatgtatgggagccattgttcctcagggatgggaaaaatttgaccagtgtttgtgcaaatttggggaaaaaaagtcatggactagcactaaaggaatgagatctacctagactttgaggtttgtaaagggtcttaatgaggcaaacaccaactgtgttctttcttgattctgttcattacctcatttaattttcaatggtcttgccgtgaatatttgcatgagatatagaatatttttaaagcaagaatattaataacagtttttcattttaggctcattaaataaaaacgtcattttttcactaattcacatgacatttattgagatgtattaaaaaataaaagaaagactttgaagacaaaattgctcaaaggttaggggcaatctgctcttcttggagtaaaattcaagggccattataagaagtataagtcaaattatagtaccaatcaaagaataaaatatttttgatggaactgatataaaaaagttgcgtatccttgtaagacgaatttctttctctccctatctctgagtagctgcataaaccactaagtttttctagaagcaagtgataatgctttatcataggtacaggcttaaagaatgattaggtacacttaaagttgggtactcctatcaaaatccaagacagtgcattgcttctttcctttccaaattttttttttcagtcttgtggcccctaactagtaattaagagaactaaattaaagttcatactggctacttgaaatcttacttttaatattctttgcattatgcatggaacttgtctatggttttaaaatccaaggggaattatgacatttgtaaggcaaacccaggctttcatccatcattctaatctgttttacaaaaaaaaaaaaaaaaaaaaaaaaaatcaaagcagcatttgggggacaaaatgagtgacagaaaaatggcaaaaatgtgtcaacaatagtgagatttcagagatccaggagactagctactaacctcagcatctcccgagatactccattatcgctatttatgttattacagatgatataaatcttacgtacaatcattgtacactgaaaagtagcagaaggaacagaggtttgtgaccagaatctatgacgcagggaaaattaaaaatgcatgaaccattccatataggagggaattgaaaattatatgcaaaagagtatatgtacacccacagacatgctatataaaaatgaacaaaatttaaaagcttattgttacccattgttctgatacgtatttctgttttcttggaaggttctttgctggccggccagattcctaaattttatatcctgctgcactagtgagatatgtaagaggattccaaacactcaagtgtccaaactgagctgtgctgaagacttcaggctctccttcccgtaagatgagaggtcatcaggaagatgatgctctgtgataacaggattgaggcagaaaagctatttgtcacattcccttgtttggattttggttttggactagaaagaacactggcttcaaagtcagaaatcaagaaccaaagcccagttctaacgtgttttattagctgagggacttcaggtaaatcatttagcatttctttccttcagtttcttcagatatttaatgaaagaattagaccaattgatttcaaggttctcattttgtttcaagattctacagttataaatcataaataaatcaccagtaagtttgcgtttgtcaaacaattcaagttactaccactttacaagggcacatattaattttcttaaaaatttatcacatgttatgtaaaaaaataagacttctgaaatacttagacaaaccataaatgtgcaaatattctatttcactacctcatagacaagttttagctgattagcatgccctgatgaaaatacacacgatatgcaggtgtaggagttggatgaatatttttaattgtgtatctcctctgtaggccaaaactgttcatctactaatacattagccttaaggcatgtgccacttttagtgactcagttgttaaaactgcgttacagctgcatttgctcccaaaaaatattaaagtcctgtaagatttctattaatgaatccttttgatcttctattttacatcaggtaaaaggtttcaggagcttctccattgttacaacatctccttgtatctaggaggatatgggggaaaatagcaataaaataggtggggatgacattctgatactagagagcagttaaacgtgatgggggaagaaagcgacgatccaacagaatatcctcgagtaggaaaatgattttatcgcatgactgcctacctcattacaaagtgaaattcaccactatacattttcgtgtgagctttcatctgctgtacaggagagtggctccctgggtttcctataacagctgttcccatgaatctaccagatattttgtttccacttttacctttcttactctctgtctccatacccttctgagggatgagggtctgttgcctaactctttcattagttatttatttatatctgctctgggaaagaagattgtggaaaatgtgagagcaattcacacatcaacgttttaagatcccgtgtacaaatgggattgctccggaaaagcttcttcccacaggcactaattaaaaagcaggaagttcacttgagcagcatttttcttccgtttattttcctttgtaatagacatgctactttttactttaatttgaacattatccctctctgtccaaaaaaatacaaaaacaaaaaccaaacaaaatacagtaaaggaaggcagagtataacattaacaatttagaaaagatattattttcccctaataaattctactgcattcttggaaagcattaaaagtataacaggtcacacatccttgaaatattagatgaaggaatttgtgaagacagactattggaacctctgagaaattagctgggcctctacttccgtggtcattctgaagcatttttagatgctggtcacgattaatgctggaaacaacgttagtgacagttcttctgtgcttatcacatgcctttagttcaggaccgaaagaaggaaggaaggaccacaaatggtacacgaatgggctgcacagggtggtttaaaaggtaagaaaccaaagtgattgcttgtgtctcatttaagttaaatttaccacaaagttcatattcaataaatttaataagaaaggtaaataaaaacaatcacagtaagaattacatatgaaaataactatccattcattctattaacaaactaataaattattgaacatacactatgagtgattctgtcctagatactggagattttcatgatatactaagtatgtttcctgcaagagttgaggatgtcagaaccactgggatactgcggttgaatagacaccattgcctcttggtggtctgaggctggtaaatacacaggcaggaactacgcattgcaacagaaatacctccaaaggtccttatgaggatggtgcacacagaaaaaaacgtagggtcatggagaaactggaaggaggaggatagaagaaataggtgaaacaggctaagatttatccaccccaagttgggagatggtattccagtgggaaaaatttcactgctaaaactaaactagactagcaattctgtaagatgtaagagtgtgagtgatgagctgagggacagcctgagtggttgaaacgctgcttttctgatgatttggctgatggagtggccctaagcaagtttcttcaccgctccgtttcagattcctcctctgtcaaaccgggaaaatactcgtatctacagtaagagttgaaggattcaatgaaggatttaatatatgcaatgctgagaaaggtctgtggtgttcagtaaaaaatcagggtcttttagtttctttcgtagggctgcacacgcctgacacaggggatgtgaaacacagacctctcatcctacaagtcccagctgcacctgaccccagcagcctaactgcccctggcccatgactctaccccagcccattatcttcttcataatcacaatttataacttggctattgctacattacatggtgcatttgcctatgtgtatacttgcttattttgcatttattttcctcatatatgagccctaggaggatacggacttgcctgtatttggggactggaacatataaggtgttcaatgagttttgttaaatcattactgatgatgctgatgatagcctgccactacatagctcttcctttgtgctactcttctaagcattttaaatacactaatattcttaattctcacagcaactccaagaggcctgcctcattaagtgggtcctgttactgttttatagctgaggatattgaagtgcacaggataaaaaagaaaaccacctaaggacacagagtaagtgatagaactgagtgctgagctagcagtaggctctcaaaacatattcttagccattaagctgcctggttctaagtaactaaatgacagatcggagcggggtgctgcctggggccctggctagccagtaggcagaaatggaccccaagctacccagggatgggagatggggcagatattaagagaaatgaggcacatcctgtactagacaattttcctagaagcccagtggctgagctgtttcatctgcagccaagagtgatgttccattgtttcgcatgcactctgtgagccgcctgctgcctgttgcctgagccttactccttcatccagcagagccaggccggcccacaccccacactcttaccacagatggactgggtttgaatcatggctgttaaatgcccttcaacactagtcaagtgattactttctttatttcttcacctgcaaaatggggattataaggtacctacctcataggtttgtggtgagaactaaatgagttaatacagagaccaatgcctgggacaaatgtagctcctctaattaacaatttgaattccctggtcccttggtttagtccctgtttgtcatgtactttacaaaagtgacaggttcctattcttggaaatgaatctgtctatactcagaatcagaaaaaccaaaggaacaaaataaaaatggaggcataccagccaatgggtgcctcggtggtatctccatgaaatctaacccatcagaggcagataagcacagagtccaaggccttcctctccagaagaaagaggaagaaggggggcgtgtgggagtgtagagtgcaaccccctgaggggctgaacccacagaaacagcctaggggtgagataaggggtcctggcccctgaagacaccctggggaattgaatggcttggggatggggaaggagaaactggggggcagaggtgaatacctccccatttctcaatgcctggcacctgccattctgctgttcctttctttccaagatcaaaacaggacattggccatcctcctgggttgtgcttccaaggctctctttgatcactctcagccctccagcttccagctgaaactgacctctagtggcctgtacactggtcttactacagtcattgcccccagattcagaactcccgtctcatgtcctgattgctgtgcagtcagcatctccacggaccagcactctagattatagcaccgagtacaagatggaaaaccaaggaatttcaccaccagttagtgttagacaattcattgttctttagtggcttgagatttaaagtggcaactccataaaaactgacgaagccttccttggtgttgacctttgacacttgtgagcagccacatgtggagtgcgtcctggacattttcaggtatctattttgatgcagcttttttttttttttttaaattaaacagactttctcactaaattgctttgtcatggcctcagggagaatctggcctacaacactgtttactatttcaagtcatgtgtgaatttgatgccctcatttcctcttcttcatgcttgtcttacaccaatcaataaaggaaggaactgggtcatagtctcctggggatgactcccagagttcaaattctggctctgcctagctgtgtctttggaccagttagtttcttcatctctataatggaattgcaatattactttatagggttattgtgaggaataaataagataatgggtataaagtgcttggctggagcaaatgttcattgggtgtcagctattctcatcgtcacgatcagtctatgagatggagtccactgtacttggtacttggaaataagacgtgtttatagatctgtgctgacatgtcagttttcaagagccaccatatatcctgctctatgcgtaatctttgtaatttagagtaaatgttaaggaagagagggcaggaaggaataaaatgtaatgagcaatcattggacaaataaattgcatccactttttaagtgcattttgtatacagtttaaaggtagaattcctgaagttatacgattttaaaatacacttgagaaaggtgatgggctgtccaaagcaatgattttcttctaagaaatacttacacatatagaaaatttgtatctttatatttgctgatgtgaggctgctctacactttgttcccttccatcagcacgcaggaaataaataaaatttgcccacacgctaaataaaagtcagctgaatcccaagtccttgccgtcccctcaaccacacaaactcatgcacccataaatatcttctttttggttctgagtgcacacagaaccaaaggaatttgtattgaaacgtttgatttcacttaacctgcatatttctatttctatatatcttaactctgaagttaaaatacaattcttccaatgatatgaaacacagtattttaaaggtatcacacatcttgggttgttagcaagaatttatataatcatttatccaaatcactatctattttggcttcacaccagacttctaatcaattctatatccttgttcaaggcatgtttcttatttttcaccactagtcaggtattcattcccttgtgctttgttcttgttcatttaacacacaactagtcccattcataggaaacacatcctaatccaattggtgttttacaaattgaatcttcccaacagaaagtcattgtgtccctcctagttcagaaatactaactgcatgcacttgaagttaaatcaaaggataattactggtctaatattttggatcatcttaaatatagaaccatattgtgctacagctggagaaattctgagagtttttagataacttggaaattacacagcctaccgaggtgtctttccccaccctgtgaggctctactaaagagacaagggggacttcacagaaagtttaattcaaacttaattacacttgagcctgaaagttgattaatcggttacatttgcaagcagcagaaaccaactctggctgtcttatacatcttgtacaccttgttgtcttatacaccttggtaggatgttagcctccaagtctccctccaggcaagctgtcccagaggtcatagagcaggaagacttggaccaaattaaaatgcttgaatcacgtaactttttaaaacatagtttgagaaacaaaagggaacagaaaagaaaagtgagccaggggagaaggtgatttttgtttattgccttttatatctattatattcccagcaccacctacaacactggtccggtacatagcaggtactttatgaagatgtcctgaatagctataggatataagtatgcaacccttttgtaattattataagacaatgtcttggaaatcatagctaaaaacaaatcaaacgaaagaaacttagtctcatattctattgtcaaaaattcttccatgatggtatatgcaatagaagctgtactggtggatttctcccatgtacaggttagcacacaggtaacatatgacctacagagctgcagaggatctgtctgcttagtgctgaaggccaccacttgatatagaaagtagaagtggggtgtcagggtggtagggccactggtccacgggacatactgctggaatagcaagacttggacccctgcttctgtttatcctaaggaagtgactggtgctcctctgatgatgcaatgcaaatgtcctgcagtctaagggctgttgtctgacatccagtctcagtaaatatctgtgctgccccatctccatgaattctccatataaaggctatttgagaagccaggctgtgagtgctctccaccatgtagccttcactgacagaaaatctgctcaatgttttaattttaaaggtagattatggattcttttataattagttgtagaaaagatcctctggcaatatggtagttagaacacatctttgccacccttcgctctcaattaaatattcaactcttacctgctaagcagggggagcttggggcacatgactaagccttaaagtcctataaaagtatcagcagaggggcctattaagatttggagaggggtggaattagatgaataatctaataaagaataaacatccctgaagagccaagaaaattatgtagaatttaagttggttgaggctaggctagtgttttaagttggttgaggctaatttaatttaagttggttgaggctaggctagtgaaagaactgtgcagtcactagactcaaataagtataaagagccacaccgtctcgtggataataccaaataatagaggacccataagtaaatctaggactatatggtacttcattttggccaggtgatatattgatatgttgggagaaaggattatttaataaatggtaatgtcacagaaggccatctattcaaagaaatgaatttgggccccttcatcacaccacatatgaaaggaaatttcaggccaattaaaagttttaaatgtagtaaactaaaaaaatagcagatacatctgacatctagaggctcggagaccttgataatcgacaggtgactacatgaaaatatttgtatatgatgataccataaataaaaaacagcagacagtggaaactgatagactagaacaatatacatgcgactcccacagtagagaaaaggttactatctgccataaatacggcttacactgtgatttgaaaaccctacctaatgtatgggagcagagagaaatgctcaataaacagatgaaacaaaatttaagttacaagaatattttgttttggctaatcagactctgaacacaatgaaattccttttttttttttttgggaaaaggagtcctttcataaaatgaaagcaaaagtgtgaattattacagcctgaaattaaggaaataagtataaggacatatattttactcacacacaaaaaaataaataaatgcatataaatatgtatacccctattcactggattgctgtatatagtcacacacacacatgcacaggcactcacaccaaaatctagaaatatcagtaacaaatcaataggcaaatgtttaaatcaaagccattgcagcagagcatagaatattatgcagtcataaaaaatttttaaaaatagaactataaaaattacctttgagagaatggctataaatgattaagagaaacaaattcagaagaaaaaagaaaaaacttatttctatgtgtgagtgtgaatgcatgccagagatatcagaaaggattttcactaaaatggttagcaatgcttgtatcagcggtttctacctcaccttttttatattggttaagtgttatataatgagagtgcattgcattatttgtcacataaaatttaatttgaaagctatttcattgctaaaaggcactggtataactataacttatttttctcatttaaaaatattctatcaaaataacatagtgcttccaccaggtgtgtgtcaaaaaaagaaaaacaacaattactaatgcctatcatttaaaaggactttgatataattaagcgaaaaaaaaaataaaagcaaagcacgttctctttgtgccttccaactacaccaagaatacaacaaagacggcagaagtttgtctgtacatttaataaagaaaacaaattaaagagagtgctttgcactgggacatttgaatccagtggcagctgccagattaaaaaaataaataaagagccatagatcaagctgcagctgcgtgcctccaactcactccgcagcacaggcccaaagccattgtcagtgcccccggatgtgtgggtgtccttcatttctctttgaatgtggccaggcctcttgaaggagaacactaggtggcatgcctaccaagctctgaaacaccattaaccaccaggaaaaaatgcgattaggattctatttggagatcatattttcccctgtaggctaaggaggcattctctaacactgacaggctctgagtctctttagccagaaaatcaaaaagtttctgtgaagccactaggtaggacttttagaaatagagtcgctacatcctctaggctcctgggaaagaacctgtagctgaattatttttgtgggtcatccgtaaaatgttaattgtggattgtcaaacccttactgcagagaggactttcacagaaacagttctatttctgataaatcaattttagcagaagagtctcttttgacatgcttaattcaatgagcaaattgtaatgggcctatcccttaagacactggtgtttgtgtgtttgggagtgttcgctcagcaatcttggccctgatgctgggggaatttgaacctgacaggcccagaggatggggccagcccctttccctggcctatggctccggtgctccagacacacacacctgagctacctcccttaaaggttggaggtcaattaaatccctcaagtacctactaccaagctatttgtttaaagactattttggccatttttttgatcagtaggatattgtcacgtgctgccaaagtgctgcaggtggacatgtttgtgtgttctgaaggacttacatcatcctgcaatggtcagctttatgacacaaagaatgagtgataactcagtcttctcagttttgtgtcgtttgtggttttgtttgtgtttatttctttccctatctggggtaaaagcctcagtccctgattcagcagctttctatctaggtgtctgatttactgaattgcatcatctcttcctcatcagtgttttcgcttgtttgcttgtttgttttgagtcaagggctctccgtctgtcactgaggctgagtgcaagtggtgcgatcacagctcgcagcagcctcaaactcctggcctcgagcgatcctcccacctttgcctcttgggtagcagggactacaggtgtgtgccaccacacctgatgcctggctaatttttaaaatttttttcgtagagacggagtctcactatttcccaggctggtctcaaacttctggcttcaagcaacgctcctgcctcggcctctcgaagtgctgggattacaggtatcagccactgtgcctggcctcccttcagtcgtaattgcattttgaaaactgggcctgcagctctgtggataccacacatgttctatttgagcctatatttctctgctggccgaatttcttaggaacctgtgccaattgtttttcatctttgatcatcagcccgaaccatgctgtgtccacctgaggggacggtccagcatctctgtgccatggcagatggactgccggggctccacctggttttggaacctgcagtttgcaccatggctctcctgactgcagagccaccggcagctgctgtgtttcctcatttcctctaaccccagtctgtggggccttccccttcagcctgctgcagaacccatccctctggtcagttgaaaaatgtgggtaactgagttggaggtggcatgaggggactttctggaaaaggtctaaaagtctgtctagaggagcgtatacatgtgtgtaggtaagaatggcatcaagttgcacactgaaggtttatgccccttactatatgtcaacaacaaccaagaaaagaatcacctgccaaagtcagtcaccacctacttagttccctagagttgccactggctcaattcatgagcttatgtatgtgccaaggggaaaggcttcctcctccactcaggttttgaacattgtaaacactaccaagcagcaaacagatagagcctgaacgtgtgaaacttaaatatctatttagtgtttgcctcctcttcccatttttttttcctttgacagaaaaattgtagtaaggggacagtgctttttgttatcttattactgtgtgtgtgtgtgtgtgtgtgtgtgtgtgtgtgtgtgtatgtgtgtagcaaagtctacatcctagaaatgtatgctgcatgccacagctgggggcctttgtgatacatgtgataggtgaaattcattgtaaaggcatatttgaggtgatttttccttattgtaattctctgtgaattgggagctgcactgaggaagtgacaaggatgaaatgatggttactatgatcagcctgttttccccaactaaacattttcacttggttgaaagctaccagagactacagtcaataataacttaatcgtacatttaaacttaaagagcgtaattgcattgtgtgtaactcaaagaaaaaatgcttgaggggatggatacctcattctgcatcctgtgcttatttcacattgcatgcctgaatcaaaacacatcatgtaccacagaaatatgaacacctcctatgtacccacaaaaattacaaatgaaaaaagaaagtcatcaggtctcgaatatactataaacatatgtgtttacagtctcttcaaacatataccaagaaccttatttaaatctcaccaaaaagaattgtcggctcacaggacaagcttaagagctgtccactgtgataatgtgacaatcccaaacgaatcttttctcctcctttttcatatttctcccttccccacattgactgaatgatatgttgtcggttccttttgttccaatcaggtagttttcaaaatttcatggcaggggaactgagttaaccaatatatacatagcctaattagctttcaagttggctttatggggcaaacaagcaagtgcgttatacaacagggaacagtgggctcccctccctcctgtatctcaatgactgggcacacaaatgcatccccatatattaactggacaacacaacagccccagctagaccagagatggtagacaccaaagaggacatcagggaacaggcaaaatccaaataacatgattctagtttaaactggattggcctcattctcaggtgaaaatgggtttacacaatgcatccctgcaacatttgtaagcttatttgttcctttacaccacgtttcattcagaaagaacgtgaaacagcccataacaatacaagcaagtgaagatatctgtggaggggagtgggctgaccgaggaacagaagggtaggaaatgttgacccagtcgggggtgacgttccagtcccaggtcagttcccgaagtttcatgtgcttgctagaggcaggacacctatttgtttctaagctttccagcaagcataggaaagggaagtgggattaattacataaatcacacaaaccatttgcatatttctttgctatttctggtactgaaaccaaagaatacaagtggatgcttggtgttaccaacatctgcacatgagctgaataaggatgatggtcatattggctctggaaccacttacagcttctacttcagatcatggatttccacacatagtaggtattaaatgctttttgaatttaacgggacaagggaaggtaatcagaaaatgaagaaagaaaaagagaaataaatgcataaagagggtcaggcttggacaaatattgatacagtgttgtacaagaaccatagaatccaacatggtacacctgagatacaaaataacaacagcaaccacaaagagaaacatggggagaatcagggaaagaaactaagaatcataagtaggaatcactaagtgggaatcaggtcctaagcaaattgctttatgtgcatttgattatttattccatcattgcttgtcagcttccaactatccctgcccaagagaaaagtgcacagacacactcagatttaggggtaggaaagaagttgagaataagaaaagaggttctgaaaggttaaggatcttgccaaaggtcacacatctaggaagaggaacttggttaccttatcaaaaacaggaaatccattctcagtttgataatgagtcagatattgtactgactcattatcccagaatacgtacaaacattctcagtgatctgagttcctggcgtattttcttttgtattgcaatctcacaaataatgtgtagagaaagaaaggaactgcatgcaaagtgtgttctttttacacacttactttgcatccaccagtttctaccctggacaaagacaggggttggagctgttatttgctgtattactgctgtactagtcccttcttgatggttccaaatacactacactctagtcattaaacacagatgttgcctggagatcaaacgctacacttaaaatcatgattcaatctgcgtttacatttagaatgggtgtaaacttgaggagaaatgctgtattcagagatattgaagacagacttataaaatataatagaattttatattacacgtagaagcgtctcagcctgaggacaagtggcactagctgtagttgccgtcaggctgaagcctgtctatggaactgggcggggtggatctaccgggagtctactgacatgggacagtgaagaaccacctgggaaaacatcactgtgtgtcaggagggtgtgcaggcacccaagcatcatgcaaatctaacacttcagtctgaaacatgggatggcaagttactaccactcagccagctcccatgggctcatcccaggatcctcgcaggagtacacgggaatttttctcttattaaaacatgtgtgggcatacctcattttattgcacttttactttattgtaatttgcagatattgccctttttacaaattgatgttctgtggcaagcctgcttagagcaagtctattggcaccatttttccaacagcatatgctcattttgtatctctttgtcacactgtcttaaatttaaccttcaactaaataactattgtattatttgaaacgttcaagtaaactaaagttttgtgaaaactgcttttcacctacttctaaaatgcattattattgggtcatttctgacacctttttttcttttttttggtgcttttctgccgatttgaagaaataatgataaaaaagaatttctataaatgtaaggatacttggttaatgtatatttgcatttcattgacaaaataacattttccataaccatgtggtctcaagcagataaattcctgtccagaagcacggtgctaccttcagcatttaaatgtcgggaggcccaatgtgttctcacattgagaaccacatgcattggaaggtggctgctattcagatagggaagatgtaagaggatggagaacaaatgaggtcctaaggagacatgtaaggcattgggagttcttctgctgcagaacccaggctgcagcccaaagggatctgagagacagctgctactgacagggaactcacacaggccacatggagctgtttccctgccatcatcatcttctggtgggtctccttgctgacccactctgaggataagaaggtgaaggagatgtccttgacagatggcagcctatgaagtaggtttctctgtgtaagaaagtcacctcccctcctgtcttggtatggggagggaaagactgtaagcctctctgtcttataaaaatcaaagatttgtggttccaaaattatatgccaaagtatacatcttggaaggaattcaatatggtgataaaactataagttgggaaactaacaaccttggtcctagtcccagatctgatctgtcactgctgactgcatgaccaaggcaaggcctgtctgatttctaagctttgggctcaatagccataaaactttactaacacttgaattgccgcagtatgccgcccctcgatccctaccatacaccccatttatgcaatagccaagtaacttttttccagctctttcttcctagttttagaaaaatacacttactagttctaaaaatccaaacaggtgcacctgactgccccagggagaatcccctgaactagtgctatctaagagaattttctgttgacaggaatgctctaaactacaatgaatgcagcagcctctagttgcaactgcccagtgagtccttgaaatgtggccactgtggctgataatctgactatttaattttctttaattttaattcatgaaaatttaaaaagtcatatgtgcctagtggctgacatattggacagtacagctctgtatcaacttttgctaattaatgtacatatccaggatcttgtactttatttgtccttttaatcaatcaaatccaatattcaataagcaaaaattactgattgcataataggaggcttcacaaaagggcagagtctagtgaagtaaaaaacatccactgtcctctctttctcttgattacttccaacatttacaaatttgggcttgccccgctgatatggtttggctgtgtccccacccaattattagttcccataatccccatgtttcacaggagggacctggtgggaggtaactgaatcatgtgggcgatttcacccatgctagtctcatgatagggattaagttctcatgagatctgatggttttataaggggcttctcccttcgtgcggttctcatttcttctctctcttgctgccctgtgtagaaggacatgttgcttccccttccaccatgatcgtaagtttcctgagacctccctagccatgcggaactgtgagtcagtcaaacctgttttctttattatgacccggtctccggtatttcttcatagcagcgtgagaacggactaatacatccagcctcctttgacttcccttttgctgatccccactgaagttaaagatgcacatttcacacgtgctttaaagattctgaaatctgcatgtttggagtaggccaggcaatattgagaagttttggtatataaacctttgagaaacttaaagtaaaccaattttctccactttttaacaatacgagtttctgtctcctaaatgaagcatttatttcaaaactcttatacacaaaactgtaatcttaaaataagggtgggggggtgctcctgactgccttggtcttctgttctgactaatcttaacaaagaaagcctcatctaataaagacaaaagtggcatcgttatgaaacttgtattgggctctgcttctgaacatatatactggcattttcctagatttgtgatattatttagtacatatttcacctaaactatgtattccacagcacattttccaatgttatggatattttttctaaactcatcttaattttccaagttcaatacaatgcatagccatttgaaaataaatgcccactaaatttcaagctgtacaaggtaaacttactttttccccccactaaatgataaacttgagtaatatatagaacctaacatttgtgccaattcactctcctgccaccccttcttcaaaatcataggtttccaaataaaggaaacaaaaacttacggctgaataccctgctccaaattaaacataaagtaatcaaagtcattattaaatgtttttcatgttgtcgaaggaaacaaaacaacaggaaggacaagagtttaggtcaagaggttccggtgttatctgcgtccttcattataagtgatttcaaaatctttttccctccaggaaaaactagtgagtaacagcttagtctaaatgacagcagctctgtggtacgaagggtccacatttcagctaattttcagctcttcttatcctgataccatgagatggaatttaatagatggctggaacatctataacatgacatttaccaaaggatgtgtcagcggcatccatggcctcaacaaagatggagccttcaaaacataaatcaaagaaaaatataagaacatcttagaagaaaaggatgacagtgatcctgcacatttaaaatattttaaatgccttagggactctacggagcaagtagtgttaaaaataatgatgtaccaactaaagatatttagctccctgttaagagaagaggctatgtagcagaaggagaaaatctttagattttttttttcaaaacatgtggtttgagagcccacctcacactgttcctttggtaattctcttattctctgtgaaccttgtatagttttcttgggtgtaaaatagtcacaggattcccaaccttacccaattcacatggttattaaatcaataaagacaatgtgtgtgaaaatactttttgagctgtaaaaggctctacatgaaaagcttatgtaatagaatattaaattggaggtttcaattaaagccagatacaagagatactataaaccaaaagaggtgctgattgcctatgtgaatttacaaatctaaacatcactgacataatttttttaacagactttttttttttttagcagttttaggctcaaagccaaatcaagcagaaagtacatccttttcttccaaacatgggctattttgaaacatctcatgaacatcatatttatagattggtttgttggagtgagtggagataatgtttgaaggtgagataatgtttgaaggtgatttctttgtggaagaaaagggcttctatggaaagactccactcagagagcttgatatggctcttctagagttaaggagaaacagtgatatgatttggatctgtgtccccacccaaatctcatgttcaattgtaatctccagtgttggaggtggggcatggtgggaggtggttggatcctgggagcagtttctcatgagtggcttagcgccatccctctggtgctgttcttgggatggtgagtgagctttcacaagatccgtttgtttaaaagtgcgtagcacctcctcctcactctggacaggtaaaacatctcacatctcctttgccttctgcggtgactggaagcttcctgaggtctctgtagaagcataagccactatgcttcctgtacaggctggagaaccatcagccaattaaactccttttctttgaaaattacccagtgtcaggtacttctttacagtaaggcaagaaaggactaatacagagagtgagttcaggtctgacccgagtcccacttgataatgttaaaggctagctactttgttggtatagttatattgggtttagtctgtgatcccagagtttgttaaaacaaaatatgtatgagaatgcccaatggaaaatgaaaaagagctgcactgaaaccactttagtttctacccaagatgtcctggaagaccaaggagactccaacagagaaaatcggggtggataacagtgaaaaaccagcagctgagaaagaagtgatcaccggaggaggaacatcagtatatgcttggaggtgaagcagacatttcctctggtgacctctaaacaacttgtacaggagccaatgagataaagtttgcttttcacacttcctacacttgacagcttaaacatatcccatgacagtgtcagctgagtgagaactttcctgtgccctcttgctaagctcctaaattgtgcttcaacactgaggtatcagaaacagaagagagcaaaatggcagtgcaggggagcaagttcaaggtggggaaggacggaggatgccccccaccccaatatacaccacccctccagcaagtgcccagcctaatgcaggcccagcaggagtacatggcaagctttttatttgtttagttggttgttttcaagagactggacactactatgtactgaaataaagctgtaattgaaacttaaagttatccatttggccctgggagaaaatctattaatataacatgacatttaccaaagaatgtgtcagcagcatccatggcctcaacaaaaatgctatctgccaggaggacatggaaactcctttagaggagacaaaagaatcctcagtaaaaggaaccaccaccagatacagcgtgatgggttgtgcagttgaagctacaaaaggtttgtcttggacattaatatggtttggctgtgtccccacccaaatctcatcttaaattgtaactcccacaattcccacgtcataagaggaacccagtgagaggtgcttgaactatgggggtgggtttttcctgcactgttctcatgatagtgaatgagtctcatgagatctgatcattttaaaaagaggagttccctgcaaactctctttttgcctgccaccatccatgtaagacatgacttgctccttcgtgcctctcaccttccaccagaagtgtgaggcctccccagccgtgtggaactgtaaatccaataaacctctttcttttgtaaattgctcagtctcgggtatgtctttatcagcagacatacagatataccgggagctgctttacaaaaatcaccagtaggcatgaaatttccagtggctcaacacgtcccactatgaccaaccctggtgataagctcagtgtctgacacagtggctgccacacctgctcgctctgaattgtcatttccaaccctgcctcttcattctccaacctgaacaccaacatcattccacaaagaaggccctgtgtacactctgccttttccttctctacagtcagtactggatcaatgtccacataggccctatccacaacccaacagcaatctcctggtcctacttaagagcacattcaccttctaatttcaggatcttctttcatagtcttgccatacctttcgtggctccaacgctgttctttgaaaagaaaacttctttgaggcaggagaatactctgtccctttttaatgcttgaatcgtaagtttaatacagaaggaaagccctaggaagtaaatcattgtagctgctttaaacatttgaagagcctacaggtggaacattccttagatttcgtttttttttttttttttaaataacaaaactagaagaatgggtggaaacatttaggtcagataactttctctcaagctctttaacaatgaaaacagttttgtgaaaagcaatgattattcctttactcaaagtgctctagcaaagtcagatgactacaaagcaagcatgtaagagtaattatcttctataggagggaattgagattagacgactgcaaagttgattcctattctaattatcttctataggagggaattgagattagacgactgcagagttgattcctactctaattaccttctataggagggaattgagattagacgactgcaaagttgattcctattctaattatcttctataggagggaattgagattagatgactgcaaagttgattcctattctaattatattctataggagggaattgagattagacaactgcaaagttgattcctattctaattatcttctataggagggaattgagattagacaactgcaaagttgattcctattctaagtatcttatatcggagggaattgagactagacaactgcaaagttgattcctattctaattatcttctataggagggaattgagattagatgactgcaaagttgattcctattctaagattatggataggccaaggtatacaatgactattatatcattcattatcatagtcattgtataccttggcctaccattaatttacttcatgaaacatcttaaacatcaaataataataatagtaataagaataaaaatatctactatgtggcaggcactatgctaagcaccaaagtatggtccctgccccaaggaaatgaatctaataagggagcccagaacagggggacccaaataatcaagacttaattttttggtcatactccatttatttcatgaactctgtttatgcaaagtttatatttttatgataacattgaacaatagacatattatgtcatattggtttatactgacctttacctaaagtactttaaataaaaatatcctattcagagacaaagacaaagagcatggttctcatttgtttgtagcacattatgggaggagtagagttcatttctccatgagatactactgctagctttaaattatggccatctctgagtgtacgcttattagcatggcattctaaattaatatgaaattctgtatgcacaactgaagattcataacacattaaaaaaaatagggtcattctgacactagacagaaatataattctttgaaactagccgtgggagaacccgtagttcaatcataccaacaaatgactgaagggttttaatcatactcagagattcaagtggaccatgcccagtgcatgccatagactctggcatcagtgagtatcgtgccctacaacaaacccacttggctaactagtcactttacaaatcatattctatgagcatttcccttttaattttcataatttcctttttcccagtacgcaatactcttccattttcttttcagcaagggaaaactccatgtttcacttctaatccagttctagaatcttaatccccactttagaaaacagagtccagtgaattttactcttttcagggaaagcctgcagagtaagtgtcaactctccctcaaccttataagaaaactaatgtgactcaatgtgagtgctttcagcaagaatctgagctcaagttccccagattaaactctcagtttggtttctttctcgccgggtgacccaagtaaagtcaattaacctctccgtttcccacccggctttactgatgcatttacgcaggtagctggatattcccagatggaagagcatgcacgcatacattcataatgcaaactcatatcacagtactggtctgtactggcttgcctcattctgaagcagtattttcagggagactcccctgccccgcacattttatcactgtaagataagatatttgtttcttataaagcatcaacaaaggatctactatgtaggaagaaaaggctactaaattctatttatgtttccccagtgagatttttgagccattcgcttcttaagcacataaattaacccactgccctacagatgtagtttttacttccacaagtcttgataaagctcctcagtgctcaaacggataatatgtcagtttcactctgcagagactcaggaaggtacatctatgtgtagaaacaggcactggagaaaagtagcatttcacacacaaaaacagtttcaaggctagccaagtctagtacaggcaaagtgatacaaatagggcatagaacagcagggtttccacgcaggaaagaaactgatgagttcaggaaagtgggctaaaacggtgatgcatttacaaatgtgatagtcgctgatcattgccaacccaacgtgcttctcaccctctgtccttgctcataggaatccgattttttttggagatggaatgggcccagactaggggataaaataggactggtctaagccaatcatggcaattctgtttccatgtggcaaacacttgcttttcaacatgcttcgttactatcactggccatatggcccagttataaatgatgagctgtaaggagaggcctattaggaggcttctaagaattatctttttccattttgtttatttttatgtatttatttatttttgagacggagcctcactctgtcacccaagctggagtgcaatagtgccatcttggctcactgaaacctctgcctcctgggttcaagtgattctcctgcctcagcctcctgagtagctgggattataggcacatgccaccacagccagctaatttttgtatttttagtagagacaggttttcaccatgttggtgaggctcgtctcgaactcctgacttcaagtgatccaccgacctcggcctcccaaagtgctgggattacaggtgtgagccaccgtgcccggccagaattatctgttttatatagaagagacaggcactgctgtgtccgttgttatcctgccttgcacacagaattgatgccttgatgctctgttctatgccatgaaggacagtggctagtaaagctagaaacagccccgtcagtgtgtgagtcaacaagaatgtcctgatgggtttatctgctgtgtgagtgcctgatccctgccaggagacagcatcacgaaccaataaacaaaccaaccaagtttttaaacatgatacatacatgtaactacaacgtaaaatgaaacaataagacatatgaaaaacgttctttagagaaccttattttttcttttatgctttgtaggtactttaggttgagttttctcaaacccttctatgtagtatcaagaaatatttctcttataaatattttaaaaatgtatcatcctgcacaatgaataagattgtagatcacttaaccaatttccaattatctaaattaatgactgcatgtcactactaactgacagactttgtaaaacttttaatatcttttacataaaaagtaagtaatactggcttggtgtacctcattgccataatgatatgcatatgtgaaattagaaaaagcactatacaaatatcataacaattaaatatttaggtaaagtctgagcttagctcatgatttatggtaagcattcaataaattatagggatttttttttttttttttttttttttttttagataaggtctcgctctgtcactcaggctggaatgtggtggcatgatcatggctcactgcacccttgactttccaggctcaatggatccacctgcctcggtctcccaagttgttgggcctacaggcacatgctaccacgcccagctaatttttttttttctattttttgtagaagcaggttctcactataatagtagtcactccttatagtatacatacaacaaaaccatgtactttggaagtaatgcaataagtaacatgttttaaaatatatacacatactttttcagagtaatatgcttttaacttcctgcccacaattttgagaatttcaaactagcagcatgggtcaagcgcatggctgggtatcaaaacaaaaacactgagacactctacacaacaaaatgcaaagcgacatctggtatgttcccatctctccagggtcctcatgatgctgagcttttgagcattctaaaggtacacttggggaacttgcgtctgcaagaccgacttctttttctgtctccctttttcttaaagagtagtgagtaaaatcattaccaaacaaacaaaaaacagttatcattacagagggatctctattaaagaagcaatgaaaggctagcactactgtgggctggatgaaaataaatagctggattgaaaagtcaatgaattaccaacattgacccacatttctctagactttaattaactgacatcatcccaatgaataacatatgataaataaaatcttaattctaaaatactaggcaaaggacaaaggctctcaacgtacgcatttctgtgatacagaagagtaacaacgaattggctaaaattgccggcagctcagctagataccattttacttatttcagatcaatgctgggtttctccctcttcgccaaagctgaatgtgcatcactctggcttttgcccaggtccccacatagactttgataaaatacttactcagtccaccttcggctatcactcctccctgaactcgtctatcccctccatcctcttcttctcttaactatgcctctgctccatgagaccctcagctaaacattggaggagtctttgagagccattcaaatgatctgatgttttcctaaaaattagtgtctttgaacaaatgaagcttttgtgacctatacatgtgtgtcctatggccatttgtaggagttggttctaggaaggctgctgaaaatccattcaccaaaggctgattcactggctggccaacttacctaatcgtttactcaaaagttctaaaatttgattatttatgaactgcacagtgtggtctttggtgtcctgagctcttcaggtcccctcctggcccctcagtgtacaactgcctggagctgttgcagaagggagcaggggcataaacaatgaacatccctaaaatgctcctaggaagagaagaggtgttcacctataacctgaaaagtcctggaaattcaatataaaatacagaagatcctaaaagctgattaaaagaaacatatttttggtaaaccaacaaacaaagaaaatgatttggaaaatgttttttaaatctggagtaacagaaaaacaactaaaatagagattagaaagaaatcggtataagccaagagttcccatatggaattttgaagtttaggttatatttataacaatagacgtacaagtatattaaagaagaaaacgttcttaagaagatgaattcacctgtatttcataactttcaacaaattgatcattcattaaaatctgctaagaaattattgaccattttgagaataatcaaatacagaatacaataaaaatacttgaataaattccaaaagaatgtttcaaaacaatattattccttatattagtaaatgtggtaaaaatcagcaaaatagtaagtgagaaaattcaatggtatccatatgaggtgtgtgttggtggaaaagaacatttacgggtttgaaacccaggcatgaattatcaaaatgagtctcaagaaaatggcagtagcagcatttacttacaattttaaattccttctactggctgatactgatgccctgaaatggtttcgatcaaccgtctttaaggagacccctttacatatatattgtatacagtatgcaaattctaaatgtaaactatcaagaataatacatgtataaaaaataaatcatcaaaattttaagttctttatggtaatccttttttatatgtttatttttatatgtttactatgttttttatatgtttatttttaccttaacctggctcttttggaagtattagctttggtaaaagggaaaaagaggaaaatattttaacctttctcacttctctatcgactggctctttgcgaggtgagtgtgcatcatttgtgtgtggatgagagcccgtgataaggaccaaggagaacacaagcaaagagagtgggcgtgaaaaggagatgaagtaagaagcgtccacaaggccaagagaaatctcgtggcagaacagatggtggcgtgaagggcgacagtgaacacgggggccaccctggctttggtagatgccagacatgcattgtgttctgcacactttccaccctggagcttatgaatccacacagaaaccagcttcgctgtagatttaacactgtaacgcgatgcaaaacagaatgcatggtggccggttccactctcactgtcgggacatccaaaacatgccctacaaatactgtcaataacataaaataatgcgtaatgcctcctccactgtgctttcaaagcactgaaacgcctgataaccaaatctacaataagcaaagaggggatatcacacacttaggcaaaaacaccccatgtgaaaactagaaagtaagcttaggtctattctaagacttgaatttcttacataaatgtgagagtaattttgataacaagagaggtaagaagactcctggccaacaattaatctgtaacaaatattaagcttaggaatgattttacatttagactgtatttcttaataaatttcctcacataaattgtgcctaatctataaactaattttaaacaaaatccatcatgccaggcactttacatcttactctatttattgcaccatttctcatcagaaaccttttagctttaatgctattccatggcagagtatctcattagagtggcaaagataaagttctttttgagataaagtaattacggtgattgtagcggggagggggtcacccaaagttcttggctacagtaatctcctggcttctgattcattttaagaccaataaactgagtacaaacaaaaagatgttaatggtggataactctggttacctagagtttgtcctggagggattagcaattcataaccttaatcagaactagagtcctggagaattttgctcccaggaaaatatttcaagaccagatgctgtatgtgctctcagctcacttctatgtcaattctatcttctaattattattaaagtcaatcaagtatttcactctataaaaagccttactatattttaagccaattttctgttccaaagactagtcagttacttcctatcccaggggctttgctttcttgaggaggcacaagtcagttgaaatatgggctatggccaagacaatgatagtagcaagggacaggactcctcagccatgatcagaaagagtactgttaggatttagtgagaagccttcaggggaaggaggaggcttggttttcaaatcatgccaagggacagacttaccattgccatggagtcaaattaaccttaccagcccagtcaaaataattaaaaattaatacagtctctgataaagtttgttgatataaattggtgctagggaaatatttcaaggaaacaatgacatgagttattttaaattattaatttcattggtcaggaacccaatcagaattaaatatgcacatataaaacaacctcccttgtgtgttcaactctgtctcatttctgcatggacctcagtggatgacttttgaagaagcagatgaaaagtgaatgcttgccaattagctattgttcaccgttttccagtaagcattcatatttctaaaggattatagtctagtccaaactctgatcaaggtcaccatgcaagaaagaggatattctgatatggagatgaagaaaatttgagtccgggttggttctcaacttacctatgaggtcaggtgaaaacttcagacatcagttccccatgcctaacatcaggacaaaattaactatccatttcctttacaatttgttagagtatcatattaaatgtgaaacatgattaaactggagcatcacatttgaaaagcaactcattattattacatgtaaattttaaatagcattcaggaaatgttagaattaagaacaaatcaccaataaaaactttagaagattaccatttagactcatgatatgagtggatctcgttgcaaactgatttttccaaatgagaaaaaatacaattatactttcaaaaataacccaggtggctaaccaggttccagttttcctccttaggtataaaaatcttgctgaagttcacataaaccacatgctgctcacctataactagtcagccacacaagatcctatattgtatttttgttcttgatcagagacaattatgtaagttatcgatccttataaagttctagaaaatgaaacctcagaattgcctattattcacacagcaatctttacacttggcaaagtttagcacctactccattattgcaaagcctaaatttgctggtgaatcagtagtgtgactggtcggctgatccacagaaatattatttgtaggtgttactgaatgtgtatttttgttattgaaaaattgaaacatctgatcttctcctatggactagctacactagatctagttactgtactaaaatatggattatataagttatctttgatttaattgtccctaaatccataagcatatttttttcaagagtatgtttcagttatattttaagtacaagggaagtagttagaaaatagaacactgattactagatttgtatagtgaggactatatcctagtaaaggccagggctatggaaaaatacaaagcagatttttcactcctggcttcgatatttatgaactgtgtaactttgggctcattacttaacctcatggagtctctttgtaaaaacactggatgagaattggagaaaaatagaaatacaagaatataaggataaggaaggaaatcagtacactgtagtgaagccatcataattgctatgcttcatttcattatatgatgccagacagaatttctaaagggtatgaattcatggagtcaacatagaaaatttcgaatacaaatgctatttattcagcattacttgattcgtgtctttctatggacaaggcactttgtgaggtgttaaacataaactagagacccaagctgaaagttatctgatcttataacaaggcttacaggctcttcgaacatagacaagtaaggacactttggtagaatgaagggcaggaagtgaatgatacctgcaatactggagttgacattttggcccctcaggtaggaaatgaagagaggagaggccaacagctctagaaaaacttcagagaagggtcaatgatatgcagagcagaaaacagtgcttggggaagaaacagcatgaatttaaatatcaaaggtggagcatctctgggaactgagaaaaatcccaggtggtcacatgactgggctttggagatagaggtggagccgagactacaaaacacagggattgaacatccctcccaggatgctgggcctggggagcagggtggcatgacatcatcacagagcctcagcctgagatggaaatgctcacagcctcttgatgcagagcagtagaggtaggggtggttttacttctctgaaatcagttagccaaagcctagattgatttcatacatgagtatatataaatatatatacatacatacataaaatagtaatattaatagaataacaataaagaattttacatttctaaatatttatgttctggctactgttctaagtactcttcgtaaatgagctaatctgcacaaaaggaaatagatactattgtaccattgaatagatattaccaagttggcataggtaagagcaaaggaagtcaggattctaatggggcagactggctctggctaactgatttcagagaagtaaaaccacccctacctctactgctctgcatcaagaggctgtgagcatttcttaggctcacaggtcatcacctctcagccaagccttactgttcctgaggattacgacatgtcaggctctggtaagtacctactattaatgtaccatttagtccccacaacactctattttggcttgttatgtttaggccaatgctacaggttggttttctttctgtttttctatttttttcccacacaaagcatattattaaatgagaaatcccatgtaaaattccagattgatgatttcttttgattaaaaagaaaacaatacagccatactgagtttccctctcacctcttgccagcaactggcagaagcgacttttcaacatgaattccacctcacccttccactactgtcctcaccgccccctactgcccacatctaacctaacttctcatcacctgagtgatcactgtggacatatgagtatgtgacatctatcgtaattatatctgtgtgttaaaaaaaaaaaaagctgaaaagctaaaggagttaaatgtttagattagacagtccaggttcaacctccaagtccacactcataagttcctcttttcttgggcaaatgccttaatctctttaagccttattatcctcacatctaaaatagggttactaataatgcttaactgagagtgttcttatgaaataattaaaccagataatgcctgaaaagaatttagcttggaattcaatattcatttttattgccatttttaccaagaataccaggaagttggtataaataggtcatatatgccacctaaagcaatcaggacttaggcacagattggggtagatgaggttgtgtcttgtgttgagaaagccagaggagaggagcaagtggaagcaacccctcttggggacattgggcctgcagcatgctgcccggcaggagagctgcccaagaactgtcccagaaagagccccgtgggcatcattcttgtgtggctttgactctataaatgaatttctctagacagctgaaatgttcatcaaagtgaaacactgaatcacagctttctgtaattccaccattttctcaggcctgagaagatggatccatgatttctcctttattaggtggatcttttgagttctttcacaggccccgtaacacccattctacagggctgccaccttgaccctggcccacagctcctcatctgcgaaccagatgaaatgcgccttaattagcctcttgtctttcacctgtccccatcttcaagtctaatggcaaactgtcctcagcatgaactgtcctcaatagcgtttgacacatcaccctggtttatacaattttgctgtggtttccgtcagcttgcagaatagaatctgaacatgccagtcatcactggggttcctggctggtgcctggggtatttacccacacttgcacacctgactgcccccagcactgtgtccttgacacccccgtgtctgtgttctctccaccgcggggactggacacgctcggcctgcatgccctctattgcaaccacatcacatccagccaaatcccttggagccaccgagccggaacctgacactttctatcggggtcagcaaacctgttctctaaagaaccagtgagtatgtattgcaggctttgtaggccacccagtctgtttcccagctactccactctgcacttaaagcaggaaaggagctgtaggcaacatgtacagaaatgggtggggctggctctccattaaactttatttatggacatgagaatgtaaatttcatgggtcacataatgttattcatcttttgatttttcccaaccatttaaagccataaaaaccaactttgcgtcaggggctgcacagaaacaagcagtggccacagcagacttcagttgactgacccttgctttatatgcatactgtttgctgatccatactctttttttactttttaaaattaaggtataacgtacatttggtgcaccaatcttaacgcaacagcccagtgaatgttgacttttgtatataaccatgctaccatcacacagatcaagatacaaaacatttttagcagcctaaggttcctaaatggtcccttctaatcacaccgtaacagaagcccaacctctttttgctgccaaagcactctccatacttcctttcataggcctggataaagtaatggggaaacaaccctgtgtaatctaaactttcacagagcagaaagaaatccagaagacaaaggcgcataaacgaaacttcggctatcattaactatcacaaccacagaagagaatgtcttttcttttcaaagacgggtgatacatcattagaaaaactgaaaggcaatgtgttagtacacattcattttcctggcagtctcatgctgacactgcatttccttacctgggtcaaggtgagcgttgcctgcctgcaggtgctgcactgtaccctgagttttcccggctgcactctttgacaggggcctttgcaatacacataaaagctgttgtagattgatctacctgctggagaagaaaaagcagaagaagtggctaataatgctgcatctaaattgagacaagaaactctttaaaagcttgttagaggcaaattttaaaactcagtcttcaggaacattttgaaacattactggaataaatattccaatgggaatacaacaatttaatttagaaaatctaactttatgctccaagagtgaaatcttttctctctcttgccaacagccctgtgacttactcagcaaagtaagcagcctactgccaagagaatcgggcaagtgtatctgcaacacagtaaaatcagaggcactctttgccgaggaagtttgaaaagatgacaggaattctttcaggatgctcctgaattctatctcgtgcttccagacacagttttgaagactgcagatttttcctcataatatctacagagaaaaaccagcccatttatcgtgatataaatgatatgatcacagtttgctgggcttctagggttgactttctaactcacagtcacacataaaataagaaaagaggccaacgctgaggaactttcagagaccaagcagctatgtgcagaaatggatggtttgcatttcatttatgatctctctacctaggcaaacaccattcaaataatacattttcaagagtaaaaggtgaacaaacaactaattcaatagttcaatctcagatcatttctctcaactgtcaccatatagggacactctgtaaactagggaaatttaatcaatttatacttccatatctgttaagaattaactttattcagaagcacttaccagaaatacaaccttcttcctgaatttctaaattttgaaaattactaaatagttttttcttttaatccttacctgggtggataatataacagatcatgacataaaagtttctttgaaattttactatgatcatcagaggcacctagagataatatatttttttttaacatttggaatgaaaatcttcagcctcacaaatgcatatgatctattaaaaacaactagaacaaaaataatgaaaaaaatgagattctaaagtcctttgcagcttcatttcccgaatttacaaaaagagcttttgcagacatattggattatcatttgtttagctatctttcctaatactgtaggtgacaatactttgcaaaatctgaagcacaacaaagatgtaaagtttcatggttttatcatttgtttgcaatatattttataattattactctataaagattaatatttagtttccagtgggaaatggaagataaaatgtaaatacatgtttatattgatgtgaaagtactattttctgacacttctgtgtaactttaatgccctaatgtacaacatattcaagtacataaatatgacattgctgttagcaaacataataatgacataaaatgtttcacatgtaatatacatgcagcatagaaccatgtattaatgttatagaaatatttgtaacaactgactgaaatatctgtaatatgtaagtaaatgttaatggaaatatttgtaacataaatatttgcaacatgcagagtatcaaaagatcacaagaactgtgacaattctgacgtgcactaagaagtgcatagaagaagaagtgcttagaagaagaacctttactgttaaaacctttatcagcaacaggaacaaatccaatttcacaatttttataaccttttgtaaaggtcaaacaataaaaagaaaaaaggaggaagaaaaggaacaggaaaagcaaaagctttgaaaggggagtcagggctgcaaatacgctagcattgttgaaagagcatattagcaagagttttacaatattaaaagaagcatctcagaaattgcaggaaactaagtgactcttctctctcccttaaggcaatagtgatgtttgcaatattgtttcagctaatgatatatcaacgcagaatctgaaagctaaggaacttttccacctccgaatgctactaccttcgctgaagtccttcagaagttattcagaaaatactgtatgccaatgtctgtgccctagaagcatacaagatgacatgcaatctattacacacactgctttccagacccagccacaagttggggattaacagccagtctaaggaagatcaaggtcaggccagtcgtggctgcagcgcttttcaagctgttggctccacttggtcaagcagctggggcatcaggtaaatcttgagagcccctccagaacggcttccctatttatttagctacataacacaattaaaagttggcaaggttttctgtgtcatgctgtgacctggacaggcatgaaaacaaataacaccccgacaatcttctgggcaaggttcccatcggcctggctgaagggcctaaagtagaaactcttgaatatggagtcataactcttagaggaatggcaaggcaattccaaaaatgacctgagaaacctttcttgtggtatgtagctgtctctagtcaatagcatgaatctcaccctttcacttgttcttggaccttaaaatcctttctctctcctaatcaactcttctgtatggcagcttcttgattatcccaataactaaagtagcttatgtttgtgttcataagagtttcctctttttgtatagtaagttttgaaacatagagagatatttcaaaaattgtacaaatcacatccttcattgtaattcatcacttgcagatatttcgccacgtttgggttccctgtgcgcgtgtgtgtgcatatagctgtgtacacatatactacatgtataaactatttggttgaaggatctgtaacacagtttctgacatcatgctacttcacctctaaattcttcaacatcctaaaactagggatgtttttcatataaaaccatttagctttttaagtgatttggttattttgtagttctattcatagactaatcaggtatattttaagtaggcattacagaaaatgacagtggtttgcaagctaataaaagatgacaataaaaaatattggggattctctcgtcaaaccaatttaggtggtgctaagtgaagccacattaaacaagtcccctgaccataccccttctcagagctgagtgactctgtaaaaatgaaaggatgaagcacaggacatctcaaacttctcctgaccatagatgccttcctggaatgctgcatcgtgtgacactgtacttctcagaaaaaaacaatttagaaaaaaatatcagatgaaggattcaatccacttgtagggcttgatttatagaaagtgaaactgctcatgtttataaacccagatttaccaaattctcctggatatctgcctacggccaagttctttcctccaacccaaaacatcaacgaactcatataattactttgtcatgtgccaggaggttaagtctacttatgtaatgattttgcaaataaagtatgttaattttattcagaagttttgttttttttttttcctgcagagaagttaaaaagaaaagtgtactgagttcagggcccttttaaagcgtgagtcaccgtggccattcagaggtccactggctttctaccattccttagcctaagaagtccatcttcttcttcttttttttttttcttttttcttttttgagatggagtctcgctgtgttgcccagactggagtggaatggtacaatctcggctcactgcaacttcctcctcttgggttcaagtgattctcctgcctcaacctcctgagtagctggaactacaggcgtgcaccaccacacccagctaattttggtatttttagtagagacagggtttcaccatgttggcctggatggtcttgatctcttgacctcatgatctgcccacctcagcctctcaaagtgctgggattacatgcatgagccaccacgcccggccaagtccatcttcttctttagttttctctcacgctttgcctaacagaaccctcagtcaaatcttctcttttcctttcttttcttggtcaaaaaagttgctgaaataacaatgtttacaacatattgaatagagccaatatttgaaaatagtatattttatttgcttgggattttttagaaaccagtataatctttacagttatcatttttcttttatgtattttagataataggcttaagggttgaagacaggatacttaggaagagtcgttctgattctaatggaaacttttcattaacctgagaagtttccatcactagttgtcactgagaatttaattgctgggataatttgttttctaggtggggagagagtaagatttaacatatttcttaccttggtaaaatactgttcagtatcaacatattgtaacagagcaaaacagcaggaacaggacggattttaagtgatatttatcacatgagctattaaaatattaagtagaacaatgtcacccaagagaactctctgcaatgatgaaaatgttctccatttgcactatctcatattaatatatacacacacagacacacacacacacgtacatagcatatgtagccattagctacaactacctatggagaacttgaaacttagtgaggaattactctctgagttttattaatttaaagtagtttcaatttaaatagctgtctgtgggtagcagctaccaaactagaaagcacagaagaagagaataaaaaccactggtgtggctggtcccctcttcaactgacaacgcggagactcactgggcagtgaaacagcttgttttaatctgtgctcatataaaaataatgttggcccgagagaaggagaaggaagaaggttttactcgtggcactggggtaggacagaaacaggggggacttccgtagtgctagaagcagagaaaaggttctcgccatcatgtgcccttatttcctacaccaaggggatctgttcttgagacgcacctggacagcaatggctccatctccatttccatcaccacctttgaaatctgacccatatgctcaaggtacagttagactggcacttcttgtatgatttctgcccttgatttccattatcatatgatatttccctaaaaatgacatctaagagaaggaaagtagccagtgcagtctcatcctcttcgaacagctggcttgcaccaacaccacagaaccagctactgataaggagctgctggcatgaggcgtcccccaagcctttgtccaaagccccccacattgccaagcctggctattggtggtttcagctccttccctctttcctccttctgactacagagttgtccttgtttcttacacatcaagaatgctgctgctggtgtcattagctctcatttttcagttacacctgccatattccctcagttcagccctgcgcctagtcatgcagggagtcacctcagttctggtggagccctggattctcctgtggaatagatgcatggccagagtttctggacccgggacagggatctggtcagaagtaacagcaggggcacagaaccttcttcctcatcatccatcaggattattgctactgtatttctgggtgctggccttcagcagggcttgaccacatttgctggaatacacgtctccacaaggacacaaccagtatgtaccaaatgaacagaatcagcaccacctctgatgtccagcaagcgcttctttacacattatggagagagaacccacttttcttcatgttgagtgaaggtattcattagttctagtttaaccaatatgtacagaaatagtccaaagtggttccacatgaaattcatttggactggacttcctgaatcacctcttctaaggacaccttgctttggagccttaaaaagatggggatcggcctgccgcagtgactcaagcctgtaatcccagcactttgggaggccgaggcaggcggatcacaaggtcaggagatccagaccatcctggctaacacgatgaaaccccttctctattaaaaatacaaaaaattagccggcttggtggccggacccctgtagtcccagctgctcgggaggctgaggcaggagaatcgcttgaacccaggagacggacgctgaagtgagctgagatcccatcactgcactccagcctgggtgacagagcgagactctgtccccccaaccaaaaaagaaaaagatggggataacgaccatttcaccattatgcaggttactgggggaaaagttgctaaactgggcaggtcaaacacggaggcttcattatctcactagaaatctccctctagggagccacagtcagcactctctggaaaggtcatgcagccaaccgattcacttgaccgtcctaacatcccactcagcgcatggccccgtgtctgcccatctttccgtctcactatgtgagtggaccactctcttcagttgaacgcttccttccctctccttctgaaggctcatgggacctcatgtgcacaccactggccctcaatgcgctcaccttgacctttctgtacctgtccaaacttttctatggatacaacctctctgtgtgtaacacttcactctatttcatatgctccaaatggctagtgaagttccctgaactcaataaacactcaataggtatttgctaggtcaataaattctcccatatttttaatggggtgaaaactgaagtgagcatggtggtgtcagggcaacaaatataaaatagaatgcagccatgatcattcaatatctagaacatctttcctaccaaccagacaccctttaaattgttgggatatcatatttgaaatcagtaaaattaaacattagaaaaattacttacataagaactaaaataaaaaaatgtttatataggacttggtgtaactgaatgttaaggagaaaaagtgaaattctaagtttaccaacaagtagaactattctaaaggaagacagttattacatgaacactcttcactccaaaccttgtccaataggttattacacccaactgaatcaaactgcctgttccatgcttttaacgagccataaacttaactcctgtggagtaaccaaggttatgctatattgtaaacagcttccaattacataaccatccatccagtgaatgtacttctaaaaaatacttctaaaacatgcttagcaatctctaaggagactctacacttaaaagttataacttaattctcaaatttttgctggggttttaaattaacgtatctgcacaataatttgacctactgaggcaaaaactgctgattaaatctaatacctttttctgattttttggttgttgttgccaatttattttttcatttttcattttgaaaataataatgaaatttcccataccaagacaaaactgtagagtgaagcaaaatttaagaattaggtttaaataaataacaaagtacaaagccaaaaagagtaaatgtagttgctttttctttcagaaatggatacgggccaggaaatgggcacagttaaggtggtgccaggaaagtcacagctttccaaaagttgaataaactccataatataaatgtagatggaagaaaccatcaatgctgcagataatgtgtccagtttcctcacaatgacatctctatagcctggggtatgtccatcttggcttaaagaggcagcacctatgggaaaactggctagccatatgtagaaagctgaaactggatcccttccttacaccttatacaaaaattaaatcaagatggattaaagactaaaatgtcagacctaaaaccataaaaaccctagaagaaaacctaggcaatgccattcaggacacaggcatgggcaaggacttcatgactgaaacaccaaaagcaatggcaacaaaagccaaaattgacaaatgggatctcattatactaaagagcttctgcacagcagaaactatcatcagagtgaacagacaacctacagaatgggagaaaatttttgcaatctacctatctgacagaaggctaatattcagaatctacaaagaactcaaacaaatttacatgaaaaaaacaagcaaccccatcaaaaagtgggcaaaggatatgaacagacacttctatgcatccatagaacagacagctatgcagccaacagacacatgaaaaaatgctcatcgtcactggtcatcagagaaatgtaaatcaaaaccacaatgagataccatctcatgccagatagaatggcaatcactaaaaagtcagaaaacaacagatgctggagacgatgtggagaaacaggaacgcttttacattgctggtgggagtgtaaattagttcaaccattgtggaagacagtgcagcgattcctcaaggatctagaactagaaataccatttgacccagccatgccattactgggtatatacacccaaaggattataaatcatgctgctaataaagacacacgcacatgtttgcttattgcagtactattcacactagcaaagacttggaaccaacccaaatatccatcaatgatagactggattaagaaaatgtggcacatatacaccgtggaatactatgcagccataaaaaagaatgagttcatgtcctttgtggggatgtggatgaagctggaaaccatcattctcagcaaactatcacaaggacagaaaaccaaacactgcatgttctcactcataggtgggaattgaacaatgagaacacttggatgcagggcggggaacatcacacactggggcctgttgtgggatggggagaggggggagggatagcattaggagaaatacctaatgtaaatgatgagttgatgggtgcagcaaaccaacatggcatatgtatatgtatcaaactggtatgttgtgcacatgcaccctataacttaaagtataataataaaaaataaaataaaataaaataaaataaagaggcagcacctctctggagccatgacctctttgtcaaaccctggcctggccttgtcacctttgggaaatcagctggccctcaatgcctgttctctcatctgcaattatatgtctactattattgtctcagtagacaataatagtatctaactcagtagactgtggtaaggattttaaaaataataatggaggtgaggcacttagaacaatgtctgctatacatggaatgttcagcacatgttgtttatttgtatttgctgccaaaaaaattctgaactcaagctcctcccacggattcttcaagctgtaggcatttacccctcctacttcctcaggtggctactttcctgtttaataaatgttgattcttagacagtatttccatcttaaatccactgcatttttgtaaatagaggaaatataaatcttaaataattctttttaaaattacttcattcccaaccaaatcctttacaattaaatatttaataatattatggaacacaaaccctgatggaaagtcccaaaattgattgaaatttttctagaatcatatttgtttctgtgaatcacttttttattatgaggtaagagatacaggggtggactgcagaaaagttaggaaggaaaataataaacaattacatgatctagtccagttgataaaattttcaagttggctaatatgctttaaaaaaaagtatttccaaaataaaagctttttttattgtatggttgtggaatggtactaaaggggattcaatatgtatttcaaaatttaatatgaatggcagacttgttaaatttgcatccactcttctttgaaaggtaggtacgattgtcagcatttcataacaaagaaaacacaagctaatgggttgaatggtgtccccaagacagcactcggggtcatcagagatttacaggtaagccttcctcattagaaagcacaagctttccttttaaccacatgataataaccttgagtcagacggtggactttacaaaatactgtaggggactgattccatggctcttgcaaagtggcacttacacacagatcggcaattatggacccaggccagcagtcacaaacaccactgcaggtgctggctcactacccccacatccctcatgcaatcagtgctaacagtttcatggaaattcccattaatgttttaaagcactggcattcagtaagaatgtgcaggtacagcaattaccaatgaggaaaattaagtctcattttcaaagattagcacatgttctacaaattgaatgttatcccaagaaatggaatccatggaatgacctgagaatcaatacaatttcttttttatttttacagaagtagtacttttcttgctatttaaaaaataatttaaaattttttaaaaaaacattctaagtgttagaaaaacctgttacgtaaatgaaccctcagaggaatggcattaattaagagagtagagcaacacggtgtgagcctccaaactcccacattctttgttcatcttcaatagccaatataattagttttgtataaatattttatttacatataatatttcctatcttcactgctaacataaaataaacctcttacaaatttcgatgctttaagcatcttatttcacctgtaacaaataagacaaaacattcaatgttaaaaaatttggatcatttctagtattgatttccaaaagcttttggtggtgattgagattcataaaatctctactacctcttaaaagaggagaagacatatttttctctagtaacatactgataagttagaaacacatggtgatgtcatcatgctggggggaaaacatagattatttttttcctttaatcaagactgataagactatgaattacatattgttctaaaagtctgcactggaataactccagctgaaacactcttcactggtactgtgggaccatgaaagtctttctatatcatgagtatctcagtcaaaaggtttccaggaatccatctaagacctcactcaggggccgcctctctcctaccctaaacactccttgctgtaagttcccttcaagttgaatgtctgtagcaggctgagctatcccatcttctgcagtgacttcacctgtttaagtcagcaatcccccgagatttgaagcttctcaagggcaagtttcatgtcagtggtctcacttctattccccacccccaccttcaaccaaaaagaatgttgtcccaggaagacattaaaccctgtgaatgatcaagtaattaagaaattggtgagattaagaaagctcgcttaaactcaacattttaaaaacacaggaaagttgctcggcctgtgctacagattacagtaatgtttctgtttacttttgatattgtctctgcctaaagaagaaaaacatcgggctttgagaatgctgcagagtcacaggccggcatgtattcttcattgcctctataaaaggtaaacttagagaaatctaaacatgcttatatacagtcaggcattgtttaacaacagggatatattctgagaaatgtgtccttagacgattgtggaattgtgcaaacatcagagtgtacttacacacacctagatggcatcacctagtacacagctgggccctatggtacagcctattgctcctaggctatgaacctgtagagcatgttactgtactgaatactgcaggcagtaactgtaacagtaactgtaacacaatggtaagtatttgtatacctaaacatatctaaacatagaaaaggtaatgtgacattatgagggctatgatatgactgggtgatagaaactttttagctcaattaaaatcttatggggccattgttatatatgtggtccatccttgactgtatgtctttatgtggtgcatgactatattagcagtcaataggaaaaaaaatgaagatataaattgataatttatcagtcagtatctagctttctaaatgtactttaatcttgtctgcaaaaaggattgggttgtttgggaaaagggagaatgatggttagaaagtggggtggtggtcctaaagaaacagaagaatattaaaaacctatcaagatgccatctatcaataatgttaacaataaatattgggggaaatctcatggactcaacactagtagtttgtgagaaaataatgaaacaatcaagacaagcctccctttaacagttttcaaatcctagaataacactgagatgtattccgaaacaccgtgaagggtatttcacaatgcatacacaactgggaaggagcctagcatgctcacaatagtaaaacgatgctgggcacagtggctcatgcctgtcatcccagcagtttgggaggctgagacaagttgagcttgagctcaggagttcgagatcagcctgggcagcacagtgagacttcatctctacaaaaaataaacaaaaaaatagctgaatatggtggcacatgcctgtacctccagctaggaatagctaggaggctgaggtgggagaattgcttgagcctgggaggtcaaggctgcagtgagctaacatggtgtcactgcacttcagcctgggctacagaatgacaccctgccttaaaaaaataaaaaaaatgtatattttgtagaattattactatagtaaaaatatttccaaaaaaaaaccatacacacacacacacacacacacacacacacacacacacacacacacacacacacatatgaatagtaagaagtaatagagtcttatattgaaagttctttgatgtcctattctggaattattctagcttcactttcccatgatcctgtgttctatccagatgcatccactcatacccttaggaggccagaaggcagccatgcaccctagatcaaaaggtgttggctcaatgctgttagggagtgaccccagacacatcccctatctctctggagcttggttcaggtctcagacgtacagcatacacacacgaacaccaaggtgccaggagacactgcaggaagaccttcaaaggggaacagatcaaacaaataggcacctgaaggaagggaagggaagtttagaggtggggccaattcaacacccagagttctatgacttccaattgcacgcactttgtttcagctgtaccatcttttctatctccagtatcctaggttttgagcagcagaatcgtggtttccctagagagtcaagacagaaaccacagcacagactgcctcctctcctttcttcagggttggatggttctctctgtgtagttggggatggcagccactggttacctgtggctctgagcacatgaaaggtggttcctgaaactaaggaattcatttttaaatcttatttacatttgtttaatttaaatttaaacagccagttctgtccagtggttatccaaatttgggcaacacaggtctaagggaatgaattccttcttaacacagattgaaggttccagggaagttacctgtatatttgcagacttttatccagtacatatgcaaataatttctgtccagtgaaacagataacacccaaaatgtgtggcctggcggaaatttcttagttgataaatagatagatagaaagatagatccctaatttctcaaggctctctgaattggtcatggtatcttatgatgtccctcattcattaaaagattaaataaaaatttttacatgtgttcactttatatttgctttataattttaccttttgtaaattatactttaggatcttatttttgaggagagagaagattgttaaggctccagcttggagttgtctctcaataagtaagcaataaatattcacctttcttcctcatcctttatccctgctaacagcatctaggaatccttatttcatcctacttccccatctgcaaccttattgggcccagaaataccacttcctctaggaagtcttacttaattcctccatttaatgtaaatcccctccccctaaatgcccactacatttgagttgcatcattcttaggggtcgtaagctacattctatctcacaatatcccatagataattttatctctcctaccaggctttagattcttttgaaggtgaaggctacattttattgcattctccctggtgttgatgaataaaaacggtaaatattatgtggaggaaccaaataactagacttgaaactaatggtgtggtataaaaaagtctttcagcttgcaaaagataaaatcacaatcaactggccttaaaataacttaatctctgtgacaatataatgaggaatgttcttccaggcccattaaaatgacatgcaatttgataattatttttacagtgtcaggattctaaactaaatgtttctcagcttctgttatctggtgatactaaatgaatgttgtcaaaagattaaatgtaaattggttataaatcttcatttaaccacatcatgcagggaaggttacattacagccaccatgttcgtgtcatcattaagaaatggagtcttattttaatagtattaagactattgaaattattgtttattctatctaattggctttggagttgaggatgaagcttttgatgggcatcactgaatacaggagcaaaactgaaataaaaatgaggggcaggccgggcggtggctcacacctgtgataccagcactttgggagggcaaggtgggtggatcatgaggtcaggagttcaagactagcttggccaacatggtgaaaccccatctctactaaaaatacaaaaattagctggcatggtggtgcatgcctgtaatcccagctacttgggagactgaggcaggagaattgcttgaaccgggacccgggaggcagaggtagcagtgagcaagatcgcaccactgcactccagcctgcgctacacagtgagactctgtcacaagaaaactgaagggcaatgaacttaaacccttctggaccccaaatggacaaatggacaggatggggaatagctgcagccactatctgcaggaaacactatcattgtctgaaaggccatcttcactttctaactagattttccaaactaattaaacaatctaatttcagtgaaaagtccttcttttaaaaacccagtttgcggccgggcgcggtggctcacgcctgtaatcccagcactttgggaggccgaggcgggtggatcatgaggtcaggagatcgagatcatcctggctaacaaggtgaaaccccgtctctactaaaaatacaaaaaattagccgggcgcggtggcgggcgcctgtagtcccagctactccggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaacccagtttgcctggctttttcaggaaatgacctatggtttgatcacctgtccaaaccatctggcggcaggaatgtgatctagttagactctcacagacggtgtctgggaagctccatcattgggctttaatgttaaagccacacggccacacagccaggacactttgatgaacagccactcacggacacagtgagcccatcatgagatgatgagaccaagttgcattacaatgattttgacagccagcaaaattatatttaaaaatgaaatctttcttttggttctgtatttgaagtaaggaaaatcactttgggggtaaaatcagggttttggaagaaactgatacttcttattaggtttaatttaactggcagtaataattaggacatgataattataccaggtgaagcctgcaatagacttagttctactttaatacttaattgatattgcaaacaccaagattttcggtgtacagacaaatatagtatccttgtataaatgtatatgctcaactaatgcagctattctacaatcgaagaatctctccttaatcaaggaaaatgattcatatcagaaaaactgtaaaaagcacctcttgacacattctccatgtgctacatgaaccaaggcccaatcatttgttcccctcagtctctctcctgatatgcatggtttccacatccctttctacagcctctgtgtgggggtaggaagaaggaagcagaaaaacaaacacacacatccacatgttccttctccttactgctctggcttctcagacttggtcccactacttacatttttttgtttgtttatttgtctgtttgtttgagacacagtctccctctgttgcccagcctggagtgcaatggtgctacctcagctcactgcaacccccacctcccggattcaagctattctcctgactctgcctccctcccaagtagctgggattacaggcgtgtgccaccacacccagctaattttttgtgtgtgtatttttagtagagatggggtttcaccatgttggtcaggctggtttcgaactcctgacctcaagtgatctgcccacctcgccctcccaaagttctaggattacaggcatgagccaccatgcccagttttaaatttttaaaagagtattaataaatacatcaatcagaggaatatgtaagattctactgagaagcacaattcctattagcgcaagggagacaaaaacactatcatggtattgttaaggctccagcttggggttgtctctcaataagtaagcaatattcacctttcttccctatcctttatccctgctaacagcatctaggaatccttaatctatccgacttctaagtaggaggtgagcaggggtgtgggaaaacattctggcaggatctctatgcaaaagaaacaggtggtttagggtgcgattgagaggtagacatgtcccacacagctccagcacagaactgcacgccggggtgacaggtctgcctttcagaggactaagctgctgtggcaacagccagccacagccctccagaggaaggaccacagttcataaactttagagtctctgggagcacttgctggggagcagcgtgatggaggtgctttccagaaggcggtgctgaccaggccgctccctgcggaagcccctctggggaaggacactgggcagcaggaatgatggtggtggctcagcaggggtggagaactcctgtgtgcagcctgtgttcctgctgagagaggccccaagccctggagtcatgacatcaggaggctgtcgtgactcgttcactaggtgtgggaagcccagcactgtgtagtacatgctgcagagggcagaaccctgaggtgtgtggcagcctagagtcctgctgagcatggcagccggggctggaaacagtgaggcctgttctggagtgcctctgtgcaaatccacctatctggggttggggattggacatgagttatttattcgtttattagttattaatttttaagtttaccagggaaattgcatgcatagcaaaatatggaaaccattcattaaaagattcatgagactaaggtatcagttcagtggacacaaaataagcattccaggagtagaaagcaccctactttgtggggtgacattgagacagtgctgggaacctaacagtgaagctccctatgtgaggacctggtgccacaaatggggtggtagataatgcacatgggcctccactcatgttcctccgtggcagcgaattaaagaacatccatcttcttacttcttttctgtttctcagttgccaaccatatgcctgtttagttacacacctcggcatggtggctcacacctgtgatcccagcactttgagaggccaagaaaggtggatcacttgagcccaggagtttgagaccagcccgggcaacatggagaaaccctgtctctacctacataaaaaataaaaattaataaataaattagctggtcatggtggcatgcacctgtactcccagctacttggcaggctgaggtgggagaaatcacttgaacccagtaggtcaaggctacggtgagccatgatcctgccactgtactccagcctgggtaacagagagagttcttgcccaaataaataactaaataaataaaataagaaatcagccaaagacttcacttgctctgacagaaactttcacaaaatctactagaacgcagtggattcagagatctgtcaaacacttctttatctaatactgcataggtgactccctgtctagaaaaattaataaaaactgacaagccacctgcactgtagctcttccgcttcctctactgttcattattggctttatttcatttctatattaaactgcatattacaaactcaggccagctggatctttgcatagatactatatcttgtttctgccagagatgatttttattcagaatgaacagtaaaaggcaacactacgtagaaaatgcacttgagttttaaaataaagatgaaaaaacttgtgcatcatccaatggtcctccgcagcatggaggaaaaaaaaaaaaacatacttcagggagataatatctttccttctccatttcacaaatgggtatcttcaattaaaacacttgtttagattcattagtgtttccttgatttgattcttcggtccatgagtaaatacattttagagattaaatgattagtttctttacatatgaaatagggctaatagtatttgcctttaatgatgttggagaatagtaaataaaataaaatacccttgccaggcatgtacagttgctcccttgtatacataaaggattggctccaagacctcctatggacagcaaaatccaacagtgctcaacacctttatataacatggtgtggtatttgcctataatctgtgtatatcctctcatatattaaaattgtttcatcagcaatggggaaaagactccctattcaataaatggtgctgggataacaggctatagatatacagaagaatgaaattcaagatggattaaagacaatccatcttggagttcatttttctgtatggtgattcctatacagaaaaatacctatcaccatacagaaaaatcaactcaagatggattaaagacttaatgtaagacttcaaactataaaaatcctagaagaaaacctagaaaatatccttcccattctaggccttggtaaagaatgtatgcttaagtcttcaaaaggaattgcaacaaaagcaaaaattgacaagagggacctaattaaacctgcataattaaagagcttcggcatagcaaaagaaacaaacaagggagtaaacaggcaactacagtctggaatcttcaggaatgagcccagcaaggccagagttcatgggggaaaaattttcaacataaacgtaaaagagtgactaaatcaatcaagggtaagaagtgaagattcaagtacaaagcagagggcagcaaaccaggtacaaaggaatctgtcacctatgcagtgagcataacccaacaggtagtttctcaaatcagagacccaaccagtaaccaaggtaaaagagggactaaatcaatcaacgaaaaaaaagtcaagatgcaagttcaaggcagaggtcaggaaacggaactccacatggacacagaatggtctactcatggcgcagccaaggggaggggcaggcagccgtcagggaaaagtactcaaaaaggcaacacttaccgaatgactgaaatttggagtcatggatttcagcagggatttgcagtgaaagaaacaggcatatagagactaagttcccaataaacgttacaattcatcctttcactctcctcttgaaatgggatgtattgtgaatgtattgagctaaattatcctgcatggctttggccagctatcccattctctggtgagtgtttattttcaaagagttagatgagtgaagagcggagaatggtaatgtaaccaatctgatgccttgttagaaaatcttccctcatgataccagaatgctttggtgtgaaagactggttcctgctggaatagtttcttttttaagactaatgcacaaaaatgcatattctgcctatgtttcttcccatgatgtgtattcatttagtgcgtaaggaattatttcttttcttccttgttcgcctcagtcctagtgcccagctcagtatcttgcatttgctgctagttgatgacactgaatttgcagcaaaatgaaatagaccttcttcaattggtctggtctgtttgtcactgagtatatgtgtcattgctgtgacagtaacctggctgatgaatgaaatttactggactatgaacagtaataagatattcctgaagccctggtttctcactttgctatcttaaaccaaagctattaaactcttcaaataagcatgctttattcagtaattcatagacttcaattaaatttggagcagcagagaactctgaacattcccattgatgccacagtggtatggccagagctaggctcaactgctccaaaatcgtcagccaaatacctcagtctcccaagccaaaatttgacatagactatgcttctccggccttatttcattactcaaaataagatgattgaaaaatgtatgaagcttacagtagaatactagtgggcacaagagaggagatgtaaatattcaggtaaaactcaataagttcagaaaaagattttcagcagatgcaaattaattggaaaaaatgtcagatgataaatctttgctttaccactttgcagtctgggtttgacaaggacataatctctaaaaaggaaggattttcaaaagaatcaacagaacattaaaggtatagagaattcagacactaattcaatcatacataatcttatctaacagttaatacactttctaagatgacgtaccagttggaggataagatgcaaaggatgaaaaagataaaagtagatttaatgcaatgttttacaggtaaaacattggttttggtttgaataacgaccttttactcttaccactttggacaacataggaggcagaattctatgataatccccaaaattccagccccctaatatacatgtcctatgtaagtaaccctctcgccttgagtgcaggtggcacctgtaaaaatgatcagatatcctcctattaggaggttatattaaataccaaagataaaggatttttgtagatgtgcaaaaggtcagaaatcggttgattttgaattaatccaaaaggagataccctgggtcggcctgacccaatcagagaagctcccatagaaaaacagtccagatcttgtggaaacgaagatacggagatagagcttccgaccgctttgaagatgtgaactatcatgctgagagtcccacgtgtcagggcattgcaggagcctcaaggagctgaaagcaaccatggctgacagccagcaagaaagctaggacttcagtcctacaacttcagggaatgaattctgccaacaatcatgtcagtgtgaaaaatgaatcccaaactgcagaaaggaacatggcccaattaatgcgttgatccatccttgtgagaccctgagtggaggatgcagttaagcactgctcacaatgtctgcgggtcagacctgaggaaatgcgggacctgactcacagaaattgtgagatcataaatgggtgtcgtttaaagccactgcactagtagtaatttattacacagcaaaaaatgactaatacgtgtggctggtttacttcacctcactgttagttttcttttttttaattttattttattattattatactttaagttttagggtacatgtgcacaatgtgcaggttagttacatatgtcatatgtatacatgtgccatgctggtgtgctgcacccattaactcatcatttagcattaggtatttctcctaatgctatccctcccccctccccccaccgcacaatagtccccagagtgtgatgttccccttcctgcgtccatgtgatctcattgttcaattcccacctatgagtgagaacatgcggtgtttggttttttgtccttgcgatagtttactgagaatgatgatttccaatttcatacatgtccctacaaaggacatgaactcatcattttttatggctgcacagtattccatggtgtatatgtgccacattttcttaatccagtctatcattgttggacatttgggttggttccaagtctttgatattgtgaatagaagaccataataggagggcactttaagaatttcatgtgattgacactcttggcatgtagctagcatgtaataaaagctcagtagaggcagttaatcataataatagtgctgctaatagcactattagtagcagcagtataaactgcagtaattgtgacaggctggaactcctagatatgcttgtaaacaaaattaaattgggatgaagaattctacaggctggtatttgactaaattaaatcaatgcttgattaaatctattgacatctatacgtatgtgtatattggcttattccaaatagacacgtgacacacacacacacacacacacacacacacacacacacacacacacacaaacataatgctccagaaacagcacagtatacctttctacaaatacactacacattttcctacctttgtatctctttcttatgtcctggtttttccccctgaaatgtcattcccacagctctacctgtaaaatttgttgacttttcattgcctacctaggatattgtgtattaacaatgttccaagagctgttgttgtcgttttgtaatatgagataggaatcatatgagataaatattactattattccaatgtatccctttttaaaggacagggaatgaaggactacaaagactgatttggctgtgttcgtggtgtggtgtcagcatctgaaattagtcactcaagctcctggttgtgccttccaccaccacaataagctttgagtcgatggcccctcatagatactcctccataccccaaaaagatttttttttccttttcttatctcttaacgatattttatttgacttagtagggtttaagctaagaccaagctgagctatatttggcatatagatacactgagtttacagaactgcctaacaatgttctggtcaacaatggactgcatatacagtggtagttttataacattacaatacggtatttttactgtactttttctatgtttagatacacaaaaacttgccaatgtcttataatttcctgtagtattcagtccattcacgtgctgtacaggtttgcagcctaagagcaacagctgtaccatgtagcctaggtgtgtgcgaggctataccatgcaggtctgtgtaagtccactccatgatgttcacacaatgccaagatcacctaacggtggactactcagaatgcatccccctcaaaaagtgacccaagactgaatttacatccactaatgtgcatgtggggaaggacaagttggagaaaaagcttgatgcgtgccgtcatttatactttcccagttggaggagagaagccaatcaaagggaattaacagagaggctgcaggccttctggaaggaatctatcttgagggaagtaggcctggggaattggatgctgctgcatcctctttctgggcacggacccaccctgacccagccactctagtattatacgccctagggagaaaatcatggcaaaaaattaaggttgttgctgcaatccccagggcccaagccatcttgctctgagctgctataagagttttacacagtgcaaagccattttctgatcaaattttataaaaaaccatactcatctgagatgccctgggttagtggtacccgaaactcctggtgttcttgggagagacaggcctgttgtcttggttcattttctgtggttataacagtatacctgagactgggtaatttatcaagaaaacatttatgtagctcacagttcttgaggctgggaagtccaagattgggcagccctgtctgggctgcatcataacatggtagacagcaacacgtggtgagagcacatctatgagtgagcaggtgcaaaagacaaaacacaaagagtgaccgaactttataacaacctgctctcatagtaactaatacagtccctcaaaagtaagaacccactcttgtcagatggcattaatccatccatgactgtaaataccttatgacccaagcacctcccgaagttcccaccacctttaaaccaacacacctacattggtgaccaagactcaacaggagcttctgtgagaagaaaccatattcaaaccatagcacctgttgaacttgagaaattcaggcttacatgttattgtggtctatttttaaagctgagagatcgggataccttctttcatctctttggtatcttcagaagtttgaaaagtatttctaagttaatctaaccttctttttcatactaacctgacactgatgtggccaaagagacctggagaacctgagatctctgctgtgcacatctccccaacactatgcaccttggagctcctcatctctgcaccctccatggagccaactccaatgctgtacacacagcagaggcttaataaatgtgctttgaccaaagattttgttgtatcaacccacagtaacaaaattgacagtagatgtagctgatgtgtttaacttcagaaaacatatatggggaaatctcatataaaaggacaatgtggatttacctgggaaatagttattaactaatgtaaactgctggctacagaaaatgactgctgttaatgtagggctgtatatatatatatatatatacttttgttatatatttatacttctattattttattattttatttcctaaacatatatgtttaggaaaccatatgtatatacaaatggaaagagttggaagcaatgatcccccaggggaatctattgcatacaggtagggagaaggcatcaataagtttaataataataataataataataataataataataaaattagatcaaactgggcaggttagaaagaacttaaggagaaagagtcagtgcttaccctaagaaagaaaagactcataaaaaaagagagactgagaaaagcagaaaaataagaatcagggctatgcgctttgagacagacaggcagacaagacagaggcagagacagatacagagagagagagagagacacgcaggcaccagaaaggagagagtgctcccctccaaggctgcgctgcaccccttcctgggtgctgtggataggggccctagggctcctccttccacaatggcactgtaatgggaaaggcccacaacaagcatgaaaccagtcctcacgagcagagccatgtgggtcaaattactgcaatttgggagaaattctgcaaagacatttgggagggatttgtgcaggaggaacaccaagaattttgtttgtttgtttgtttgtttgtagagagagccttgctctgttgccaggctggagtgcagtgctgcaatcttggcttactgcaatctccgcctcctgggttcaagcgattctcctgtcccagcctcccgagtagctgggactacaggcgcctgctaccacgcccagctattttttgtatttttagtagagacggggtttcaccgtgttggtcaggctgatctcaatcttttgaagtcgtgaactgcccgaagactccatgagtataacaagattaacttgagcctaagaattcctaggcatgggcagctcgctgcttcagccactggctcaggccaaatcagttcttcaaaatcagtcatggctccagtcccctccttggtatatgctgctacttatgaggaaatcctaatcctgagcacagaagttcattctcttgctgcgctaatgatccggccagaaagtgctgacagccggctggctgcctggctggctctcctgcaaatgcacagtcttcttgtcatacagcaggaggagcacaatggataaccagtgtatatatctacatttaactttacgtaactatcctagtatacgtatgggacttgcatacagtcttccgcatatgtacatctttacgtagttggtatgatttctctgtaataaagtccaaattttagtgtgtgtgttaattctcttaacatccacaccctttactcattgactattgcattcatttttagctatgcaacactttgaaaataagggtttttttcccccaccttaatgtaataaaccaaaccactgcaaattttatcttgcttttcattatctggaataatttagctactttttttttctctctctaccctttatatctatatccattagaacacagttcctgaaaatcatggtttttgaaaacccaaaacatatccaattatagtttaaatgtaagagactctctcaatgatcaataaatctgacacccacaaacacttgttttactttagaaatggcgcaaatatgtgagtcccaaattatgaaattatggtgttgattttcactttgtgcttgacctctacctgaaggtacaaagctgaggtctaatttgacattaattaatcttactctcttcccctcactcttaaacttgaaaaacatagtagggaaaaatgcactagccttctaccattcttatgccctatgtgacataaaaacaaaagtgaagttagctacttagtcaaagctggcaaatgcattctcaccatccctagtgtccatacagaaaacgtgcatgccttctggacagaaaacactaaggttgtgttcctctattgaaatttgggggaagtccaaaaagatggacaaaggatgttgtattttaaaaaccagtagttccattaaaaaaaaaaaaaaaacttaactacttagtgacctgagtgacatcaatgtgttcttgtgagggctattttctcatgtttggtggtgaatgtgcagacacaatgtttatcgtagagagaattctccaaatagaaggtgtagaaacctcactacgctgagctcattcaaggacctgggcataaagcaaattacaagagggattgaaccacgtaataagagagaagcctttagtctttatttctactgaagcaggtatgctttagagagacgtgtttcaactgaaatgcacaaaccacaaaatcactaaattcaaaattcaaaagagaaattcatcataagggctgtggaattgacttcttagagtatattttgtggaaaatagaaatctggagcactacattttagatgcaaagcataagtgggtccccgatgttacagttggtcaaccacacgtacagacagggactagagactcttctctccaccttcaaaaatgacaaatattggtaatgagagtcccagaactaatcctttcctgtataaatgtgaatgctcatttaaaatttgaaaaataaagttatgattcattaaaatgaaaaacaagaaatttaggggaaaaagttcttagtccattgatcactcatctcactttgctgaaagatcgttaaatggtttgaaattaatgtctgataaatatgtgagctgattgaagttataaatatcttcaaacagctattcaaagcttattaaaaatcttcactttaatgaggcgaaaacatgaaaattgactctacctaatgcctagcagagtccaatattgcactttacatattggtttacaaacattatttccaggtgtctttaaatagagctccaatcttgcactgttctgatttttcaaaatccttccagatatttggactcaagtaccatcactaagaatagaacccacagtaacatcagcctagccacaagcttccacatgcaccaccagtagctgctgctttgcggtgttgtatgctggatcttttgtacacctctaaatgatggaaggtaccacagcgcaatctatgggaccacttctgttttctatccaaactcgctgctcaagtgatcttctcagtcctatggcttacgtatctaccctttgctttttgctaaatttatgtttccagctttgagctgcagatttgtacagcaaattgtctccctgactcatctgccttgccatctctaaattactatgcccaaattagaatccctgattgttcttcaacaaaacctgcttctgcctagtctcccccatcccaacaaaaacacccccagtcacccaggtgttcaagtaactgtgattcatccttaatttctctatttccatcatattcagcttctaatccatcaacagatactgtaggttttatcatcaagatcactccagaatgagaccacctctcaccaccttcagaatgacacaagcgtcacccacgcaagcacctgctcttacctggaatccattacctgcatccatttcagcctgcctgagccatttctccaacagaggctgggcttttcttttagaaacatgaattagagcccattattcctttgctcagcacctgctgatggctacctatgcatattctttacacacatctgcccctgcccctctcccagatcaccagttcattcccagatccagccactctacatctacatacaccaaactcaatatctgccctcggccttggcacttgccattccctcttcctttccactgttcctctcaacattgcacagctagttccctcaatctatccagcactcgacttagagaagcctttcagaaatagtctgtttttgtacaaacgaccaatacctgtatcctttcgatctgtttgacatttctgtatggactcataactagctcaaattatatagcaaattaatttaattacttgcttactggccatctttcccactataaggtcagctccatgaggctaggaatcctgcctgttgttttcaccattacatctgagtacttagaaccactccgccacagagcctgcactccgtaaactttcctttattgaaggaaacataattgaatgtgcatcccttttcacagcctgggtaccagacaattcttatattctattattgtaaaggtaaactgaagtgcaaataaacataactttgaatagcaaggttgtaggttgaaatcaagtagtcattacatatgtatatatgcatgagcatatcttactgaagcaatttttatattattggcctatatggagccagtgaatactcaaattaactgtaagtgtgtctatctgttggcatgagccaagaagtatgacaacagtgacggttcacagagcaggatgtagctggctgcatttgctgtataccaagccagctccttggctagaagcaagtgggaagaagcacaccctctttgaaataatcctgcaagaggcaagctgggcttgaagtctgggaggatccaggggaagagtgaagaggaaggcactcagctgataaccaacttcctcacttgctccacttatatttagtgattgctctgatcacaatttgaataatgctcaccagagactgttagtcagaacaatgtgtcccctaggactgatctactgacttcaatttcatgttctaatacagaacagcatacataacttgaagataggaatctacacaactgtgaacaatagaggagggtcacagaaatctaataacagcctggagagaatcccattcttgctttgctgtcatgccaatgaattgcattctacaagaaactctgttaattgactgctcctatcttgcaccaggcaaaccaagtcacagtgaagagaaggtatccatggctctttaaagcagtactttataaaaattctatgcatgcccatctgaaaataacttaaaatctctgttgtagctttctgatcttctttctatctcataaaaaatatttcaaagtaacatcgtgggttcagacacctgtctccccaatgtgatgtaaattcattggactgatggttcctgtacgacaaatgctggaggtgctgaaggcattccatagatagcttatcagctttctcagaaattaagaggaaattcgctcctcactggaaacctcagataaatatgcctccctctctctctccttttcctttctccctctccttctctctctcctctaaactcagttagtttccaaagaaaatatttcagagagctgagagatcctccctaatacagaagccaaccctcctgatcaccctccatgtaaactgaaatactaacatttctcaatgtttataaagaaaatttactttctgaaagggaaaaccaaatttattgtcccagtgttataaatagtgtttgtaattacaaattgatttcagagaatgtgaagttcagttatgcctaaatagataagcatactttttaaatgggtaagaagtcattgggaaaaaatttaacagtggtgttccctaactccccaaaatctcttcagatgaggaactgcattttatttatactgagaactgcaacaaagtgataaggtgtgagagggaatcctggaaagacagagcagacagtatcagctgcctgctggatctgtatctaggacagtgaaatatcacaatttgatcatttgggaaaataacagccatacacatagcacggtcctaggaaaatcatacttgtgtggtaatcccattcaataggttaataccgaatatgctgaggttttggtattgtgaaattagagagttacctattcattcccaaatcaggaagcctaatttaaccacctgatccgctgtcccaaatgattaactacatcccagagagagaaaaatatatatgaattaaacaaggcaatctctcccagagaagacagaaggaaaactaaggaaatgcagtgctctgtaatttctctggccccacctcactaataagggcctggctgggttaaggctgctgtgtccacagtatcatagtgtcatcacctgtcacctagagatgggggtctgtcactgtgaccacttccataccccttaacctctcagggaggttaatttcacagcccttggaaagccaatttctaacatagtgtcagaataaggtatcactttcccagaacagggagagaggctttatctcaagattatgcgaaacgaggggtatgtagggtatgagcagccacatagggatttggctagcctgacaatttctgcatctcctgactcctattttctgagcctagctcacggcactgttgctgacctgcagtgcctgttgaaggctatgtgctcagggcctttgcagctcccctcccatgcctggctactgtccccttcttctgcaggggctgccttcctttcctttgcaggggtaaaaggatgatgaccaggagaaaggcgacctttcctcctcactccccaactcctgggggttcatccccatcttcctcactaaatatagctcagtttatcaaatggccagttgaatgtcagggaaaatggacccttttcctcagaagtggtggattaattgcttttcctttcacttttctgaggataggcatataatggagcagccgcttggtatgaaatcattgatttgcctcaaggttgagattaagccagtcacttcaaacattttaatattagcaaaaggctttgtgtgattttttcttctctctgctgtgactttattcaaggtctttagatcacaggggctttgacaagtttgtcagtgatcaggggctgccttaatcaagtaagaaaaaaaatcccgccaagacctcctatgcatttatatgttacaggactgtttaatgccagtatctgcacaaagcgtggtgtgtaaactacaggctttagaggatattaattaatacagattggagaatttctgatgcagctcattaacagagatcaatatttaaaacttatgtttgggtaaaaaaaaaagtcatggtaaataattgagtaaaagaggaaatacacaccagcataaaagtgtgtttatttattttgcacaaatatcaccatgagcactaatgaacaactatatttccttacagtaaaataataccacatggagacttctaaaagaaacccattgatagagtcctatagtcacccttgtgtacaaaaagtcatgtgaatactgcaaaaagaggcacatcttgtcatttcaatattaactctccaagaggtttttaaaacatctccaatatctatatgtaaaggttattcattaatattggctattatttggatgtgaatcctagaaaaaatatagacatttttaaagcaaagcatatgcaagtatttctatatgatacattaaggaatgtattgactgaaaatacaccaagataatgcatatctcgtaattcagattgaaggaacttattctaaggaaatgctatacaaatatgcacatacaagatgttcactgatgcagtgtcacaaatgcaaaaacctggattaaaaactaatagcctcagttatgttaatggaaagtgaaatactgtgaagccattaaaatgactctaatatctgaggagaaaaaacctcctcctcattttatagacaaagatggtcaattaaaaaataattaacgaaaaaattttccacttttggggaagccattttattgaatacactcacttatttaaacattcaagaaatactggacgtgtccgccagatttcatgtggttagaaacttcatccccaagctcatatattaattttaagtggggcatttgggaggtaactaggattagatgaggtcatcgcagaggggacaccctgataggactggtggtttcataggaagagaaggagatacgaatggacatgcatgctcttgtcctctaaccatgtgaggcagcaagaaggccctcaccagatgccggtggcatgctcttggactttccagcttctagaagcatgagcccaataaacttattttattaacagattatccagactgtggtattctattatagcaacagaaaatggactaagacatatactgaagagttgatgacaaaaataaatatgtgattttgacacattctatgaggaaaagaaaaagatgcagctcagaatcatagtattgaacctaacataggatgggggaaaaaagcagagaatgtgttgttaggatactatgggaaagtgagaacaggtacacgacaatttgcaactaagaatgttttggactcagagggagaatgcccctggcatcatgtcaaggctgggccacactgagttggggcagaggtggggagacagaactgaggaaaagtggagccaggccccagtgagctggctttaggattctgaattttgatttatttcagttcagtttatatactaaaaggtttgattcagttggttcattgaaaagatttaccagggaagaaatgacacaagtcatatgttttaatttagttatataacataatatagagttgtccctgaggatctgaggagggttggttccaggatgcccatggatacgacggtctgcagacactcaagtccttgatataaaatgacagagtatttgcatatagcctacacacatcctactgtatactttaaatcatctctagatgacttgtaatacctatgacaaggtaagagctgtgctaatacttttcatatttattttaaaatttgcattatgttttatatttattgttattttttactgcttttccaccaagtattttttatggattggttgaatctgcagatgcagaaccaagaatagagggcagactgtggtgacagacaccgtctgtgttatcacttgaagagctgtcctgtgggagaaatgacagcatgacaaacaggctatgtggacttcagcacatcggcacaatgtgcctccagttttttcatctggaaaaacaactggcagtgggtggtaagtgatattaatgtcccttccagttccaagtgcagtttagtgctttgggaatagtattcagagattctcttatggcagtgacatttttaccagtgttaggtgaataaaatataactttatgaaaaaaatggtataaaaggattagtatgttatttttcttatacaaaggaaactagctgaatgagaggcttaagggatatttgtcttttattatgtgaggtttttttgaaatttaaaatatgaagaaccaaaacttaccactaaatcctactgtccagattgcttttaaaagttctactgtgagaggtaaactgggaatctgagtgtgtttccagttgtgtaataattacattgccttattgttttttagccaggtaatattcttatctggaggcgatgtttaatattgtttgaatatctatgtgacttgcagcactatcataaatgagtcttacgacatgcctccgtcattctgatattgtggacaaatgatgttatagctatctacgaacattacatataaagaatgcatattgtcaagattgaattttacctgaggtctgagcccctggaaaacaatgaaaattaaagaaatactcctcatggccgggcgcagtggctgaagcctctaatcccagcactttgggaggccaaggcaggtggatcatgaggtcaggagttcgagactagcctggccaacatggcgaaaccctgtctctactaaaaaaatacaaaaactagcgcggtggctggtgcctgtaatcccagctactcggaaggctgaggcaggagaactgcttgaagccgggaggtggaggttgcagggagccgagattgcaccattgcactctagcctgggtgacagagcaagactctgtctcaaagaaagaaagaaagaaagagagagagagggagggaggaaaggagggaggaaagaaagaaaaagacggaaagaaagagagagaaagaaagaaagaaggaaaggaaggaaggaaggaaggaaggaaggaaggaaggaaggaaggaaggaagaaaggaagaaagaaagaaagaaagaaagaaagaaagaaagaaagaaagaaagaaagaaagaaagaaagaaactcctcacccttcagtgtgatcaaaaacagcttactgccaggtccccctttccccatatgaattagatgtgtcacctaacactggtaaaaatgtaactgctataagtgaatctctgaataatattctcaaagcactaaactgcacttggaactggaagggacattaatatcacttgtacccgttgactacataggacaaggccagacttccaattcctatcctttgcctcaacaatgattagctggattgcttgtccctactgatgaatcagaaatgcttattggttaaatttggtgaaggttctctctatcctcagaaccctgacctcaaccccagccagcagagagcctctcctgagaagaagctggccctagggtaaaaccctctctcatttactatcccatatgtctttcttccaccccactcctccacaccagttcttactagcttgtttattcccctgtataaaagaaagcccaagcttggtgtggtggctcacgcctgtatcctagcactttgggaggccgagatgggccgatcactggaggtcaggagtttgaaaccagcctggccaacatggtgaaactccatctctactaaaaatacaaaaaaaaaaaaaattaactgggcatgatggcacatgactgtaatcccagctactcaggaggctaaggcaggagcatcgcttgaacctgggacgcagaggttgcagtgagccgagattgcaccattgcactccgcctgggtgacaagagagaaactccatttcgaaaaaagaaagaaagagagagagagggacagagagagagagaaagaaaggagaggaaggaaggaaagagagagaaagaatgggagagagagagagagaaggagggaaggaaggaaggaaggagagagaaagaagaaagaaaagaaaagaaaagaaaagccccttttgcctaacccttgagatgcctgcagatcttatggtcagagcattcttctattgcacccatcctcctcccactattcgaatagcccatccctaagcccctgcaataatcctttctaataacgtctactcttactaaattgagatttattttttatttgacagggtttttaatgagaaatgctttttacgaggttagaatagttctggtggttgttccttagtctctcatcacatctcctttatgacttggaaagataaatttagcatggaaaaaaatgtgattattagaaaacaaaaagaattttaaatcatgaaagaaatttatgcaaacaatagggcaagacctagtacataaaaagagtcagtgaagcgaataaaaacaacaacaaaacagcaccaccaccaccacttaaccacaaagtgaaacaatttacataatgatttcttgcttttcttcttcatattattgaaagtttctttgttcatgttatctccagtggtctgttaaatgtttgcaatgcctcagtgctcctctgaacaactttgttaggaatgagaagtgctctacctatcaacaacaaaggcagccgaatggctagaaataagtttgttgaaaatacttcttgggttctgccttacctgtcaatcacaaaaagaaggtggagaaaggaggcatgcttatggcatcccagttttaaggaagaacattttagcaataagcaagcagtcaccaaaaggattcaaaaaggcagtgggtttagggtgctttgtttcactgtgaacatgaactgtcataaatgcatatctgatattttaatatcagatatttggttaaaaaaaaaaaagtgaggtaggagggtgcatttcattatctctcccagatacgtactggccatctggtgggaaagaaaacaggcagtctcagtccagggaccagaggatctcctttgtccctgtacatacacgcaagaacgcacatattacattatccaggtagagagcacgtggtaggttacaaagaagccatgaggaagaaataggaaacctgaattgtagttgcactcctctcaatatcctcatcagcaaaatgaatgagttgttaataattacaattgtaccaactgtcatactttgccatatggcttgtatatgtgtttggtattttaaatctataacatacagtcatgtgccccatctgcatcaatcatggcatgtgtatatggtggtattttgtattttaccctactttttaatgtttagatacaaaaatactctccattgtgttacagttgcctgcagtattcagtacagaaacatgctgcatgggtttgttgtctaggggcaataggctacaccgtacagcccaggtgtgcagtaggctataccatctagatttgtgtaagtatactctatgttgtttgcacaacaagaagattgtctaaccatgtgtttttcagaagtatgttgtcattaagtgacacgtgactatacataaatatgttaatagcttgtaatgaagacataagctctaattctgatcaagcctagacaaagcaacttacatacataattcttaaaataaaaacccaaggaagacgttagtattccttgtttctggaaaaggagccaagaccctgggagttaagtggccttctatgaggccagatgactgggccaggacccactacctggctgaccccaaagttcacccttttattcattctgctgcattggttgtgacctagaatattctgttgtttttctggtttagagaaacagaaagaagactcagagtagactctgaaatgtccactccccacacattgcccagagccactggaggtacaatgtgccaggcacagctgtgtgggcagcaaggcacgtggagcaggaagcaaaggatgatgccgaggcacgggccacgtgtgcagtgcccgaagggggtctcctctggtcgtggctgtgcaccagtgacagaagggtttacttactatgatactggagaccaccatgatcactgacatttccttaatgatgcacaaaatgaagcgcacaagtatccaacaaatgaccagagaaaacgctagcatacttctctgaatgtacacttcagagaaggagggaaatgcttaaatgtaatattttagataaatcactgaatacaattagtatagtaagtacactatggatttgatggtatgtagtaatacgtctctatggcaagctcatctcctggaaaactggaactacatttgtccacaagcctttctcactgagcaggaacacagcttgcaggttggccgactcatctccccagattttattttctattttatctatatttttcctggctctaatttgtttctgttttgttacattttatagattcctacaaacctctttaactattttgtaatgcaagatatttgagcataaatccctaaaagacatattattttatgatgtaaaggtttcattttttccattttatagatgattaaatagaggcccggcatggttaagcggcaagcccagagtcagccatccaacgcagcgcagagctgtgatacaacccacttccactcccacggcatctcggcttcgtgggagttgaggagcgtctcaactgcatgtcaggagaacccatgaaaaggaaagaacccagaacaaatgggtgagaaagttcaagactatgttcagcgtaagagcaaaagcctcctgagaattctgcttgcagcccattcccaggcattacagtgcaaagctaattagggagaatggcatgagtagaagaccaccaagaccaccagctgaaacgggtgttctcatggcctccagtgggctcgactatttttatatttttaatattttggtccaatcactactctatacaacttagctgtcttaaaacaataaagccaaaacaaaaataaaacaataacccaggcctcccagatgttggcttcagtctgtgttcacaagttatcttcctaatataacagcatgagtactacttccccatactgttctcatgagatctatggccaggtccaaggtcacatcatagtaaatctttatgaaggttaagaaatttataacatttgcatttgttcacgaatgtcaataatcccaaccggcaggttttacgctcaggtttgaatgacactttgctaaccaagccattaaggtttgtttcaaggagtcgggggaagctccccagcagctctgagcaaatgaggagccagagaaaaacaattaaaaattttttaaaataagatctttgaaagtatattattaattctatcatccaataagtgttttcgaagactatgcaaatgacatcttgcggtataaaagctgttacagaacagaccttccaacatttctcagtctccttctttccttcccacgcatgccctatgtgtggactggcagcaatgtttttacttttaagaggaatttcatcatttgggaaaaatttagagatattaacgaaaaattgctatgtgtctcatggctacctactgattagaagcaattaacttatttctattttgaaaaattaggctagcaaatgaagcctgtgggagaagcatatttaataaatatagaaatattaattgtaggaagtaacaataacaccatgcaaagttgtcctgtacattgaaaaatcatactgattgtttacctccttattcacagcaagggaatcaagaccatagaagtcaacctgtagctgtataattgcgtccaaatcccagtgaagagtaaatgctaaagcattagggtgaacccattaaaactgagaaaagagagggaaataaatcaatacttaagagtagagttacctaccaaagtaccattcagttcaacacatttggaggcctctttttcatatatgatgagttttcactcatatacactgataaaaaggtgaagcataaaacatctagaatgatgttttgaagaaggtgaaagaatcactgtggtgaagactatagaactgccctgcctccatctctcctaggcactttagccattttactctaaagcagatttggagttgactttttaaatttcctttcaatgttagaaatttaaattagaaaatgtatgttaaagttgattaaaacttaacaagttattctgacccattttcctcttctactgcaattctgtctaatgtcttttatgatgcctttacaattactgttatcatcatcattattattttagtctatcatgtaggaaaatataactggattttgatttccttaagaggttttctacattatttagatttgtgaaagaatgttattgtaagtaaatagcaccaaatcttaaggatacaatatataactgctaacgcaaacagtatttgagaaatgcatctagatattcattactttattaaaaaagacatagaattggcataataaattgctagataaagcaattgagtaaagtgtaatgagttcaagtagagataagatcattttatggagataaatgaattagagaggttgtgattgagaagtgagaagtggttaaagtgttttaagacaaattataatatctaggtcttatccctacttatattgataggcatgatttggtgggaaaaaaagaaacattgtcactttaagtatttccctatcctaaatgaaagctactttattcaagagtataagctaccctaagtttctttattttaaactttgaatgcttcatcacacaaatgtttatattttaatagaaatgtattatgtctgatgatatccaacatatatatacaggctattgaattctatatgtagtaataatcatgaaactcagtgttttctcaattatatcagcaaattctctaacacagatatgccaggttttcttcaactttgatgaagtcactttagttctagtaaagtagaattccttctagaaggaatttaaaagaagctgaatttcctggcttccccccacccccaacaagcacctatataatttatcagtccatatttcaaactactttatttattcaattacaacacattccatggataattctaaaataaactcccacatttaaaattaaggagccacaaaagacacttttaaaataagaaattgcataaagagagaagaaaaaataaaatttttcacaacctacaaattaccaccaagttttacattgagtttgacattcctggtattcagagcaaaatatggacacaaagactcatgcacacactgggtgacctcatttcactgttgtatgtgtgattcctcattctaagtatagaatccaggaggtgcgggtccctttgtccccaccaggaaaatgcagttttccacagtgttaaggttggttacctttttccaatggcagaaaatgcaggccagaaactgagaaagttgctcagttcatacagaaagcagactgcctaacatgaacctcttagtagtcagagcgacatatgctattgaagtaatgtgttcctttattttctaaatggatccttcccaagtaaaatgtacctaagtacataaaccatttagtgggaatacatacacaaagagttgcctcctagatgtaaatgcctcttgaacaacaatcaactattaactcatgcaaaaatattttgataacattttcacaattatctgctaaattaaaggaaactactcacagcaacaaatgccatcaacatctggcagtgaaacaactttgaggtacatctggacaaaaatgactcatgtctaccctcacctgttgcaggctttacacctacagagaggcagctcctctttgccccaacatatttagtttctggactgcattttcgccttctgttgcaaaatggcaatcaaccttattaccgtagaaaactgcatcttcatggtaaggacaaaggggtctgtacattctggaattatattcaacacttacatttacatgaaagagccttgaaaacaatagaataattagacatgtttgtgagataattatgtcatgtaatgatgcctattacccaaagagctgttggttccttaaaaaaaaaaaaacatttatcagccaatcttgcagacttgtaggatctgaagaacagcactgttctcatcagagctaaaagcatatgctatgaatggggtcctccacatggcaatgaccgcaataaattaccagtgtgtgttctgttttcttgagatgggctcaatttatcattttattgaaaaggttccattatgctaatgtcttacaaaatcacattctgctgttgctggaaggtcatgaggggatataaatttttgcatttagaactaagaagttgtatagcagtcacagactccaagggttaataagaagccatcaaattacattcaaggacttatcaatgacagctcttcagcatgctctcctagttaacaaaagagaaaaaggggaatattgttccaagcttaacatcacacacacaaaaatgcttcaagtataaacgtattaaaacttggttttaacacaggttgatcatttgaaaaaaaagtcattgaaattttatctgtcagtgtgaagtatcagtataacaggtacatttaatacgagtttaatagaggtttctagtacatagtactcagtttgtttaaattagctactatcttcaaagactttcaaagataagtttgctgaagatctacaaagaatgcaaaaattaatatgcatattttagtgtaacctcattgtgtctataaggaggataatggagatttttgactagcatcaaatcccacatctcagtgagttcttagggaaaagaaagatgatgagctaattattcaatgcaaattagatattattccttagagaaatgttttgtttccatcttttcaagaattactgtttccttccaatcatgaaggactgtggatgtaattcacgaatatatggtgccatcaatctatcaataatttgcagttatgggcaacaactgtcaaacagctgagtaaaaacacataaaaccagatagctccctttggaccaattattgtaaaccatagaaacactgaggaaaaacagttgctctttagaaacacttggtatatacttggcatccaattttgtaatgcaacctaacaagcagaatgtaaacaacagtaactgcattgctagatttgtcattctgttttgtctggttcagcagctaagtggttacgaatattaacattctacaacatcagtgtaccttaaattcaagaggccattttgaatggatcactgattgcattttgatggaattcccagggaggtgatgagtaagaagccaggttgtggtctagggctgggcacattcaatcttattctgtattaaagtacagagatggagatacacaatatgctctttcctcacctggaactaatttgacagggaaaaaaaaagctttagaaatgggtctaagatagtttggaaacccaagttcacaaaattgtgtttaaaaatatataaaaggattatagaacttcttgacaaattcaaattattatataaagtttctcattgagtagctccaaacactgtcaaaattattttttctgtcagttatgtatgtcctgtcaacaggtatatgcattcacgccaaatgaacaggccatggaaagtagacatctctttatttgggaaaccattactcaaagattttaccaaaaaaataaaaaaagatttttggaagagcttggggtgaagtggttgtttttgcatcagggtatatggaattaatgttgattcttccaaatcatgatgactctaatgaatctaatcaagtacacataaacactttgatctaattcaaagaatatggaattttgaatcaaaagacagtggttccaatcttagcctcaatatcttttagctatgacagtttggccaacaatttcatctttactctcagttctccataaaagaaggaatgataattatggccctaagagataatgtaagtgtaaatgtttcacaaactgttagaagaaagggaaatacttattattctcttgagcgtaaaatattgtatctctctggtgatgtaatggttgcagggagcaaagtatatttaccaaaacattttacatattaaataggactattttagtttcattctcttaataatcaaaaaaaatttgaaacttagaattaaaccaaagagattactggtactctttcaatgcgatgtaggtttattatatgggctattttacaactcggtaggagcagtggttcacttttttccagtggaaatacaaagaatttctgtccagtggagcagacaacctcaaatattatggtttattgccctgtaaacacttgacaagatttgtatctagtctagcaatcttatgctaacatctctttattaaattgcatatttacctatctataatcaagacactaatttttccaaagccttttgaaccaatttatacagcttgctgcttctcacattaagtaataggttgaagaaaatttttgacacttgtacattttatatctaatataatatctaatataatataatataaaatagcaaaacagctattttaccttactggaaattataatttaatggttttagaggtcacgctcaaatggaccaaataaccttcatttccaggaagtttgcctcatggactaatatactaaggaatagttcctgaagtcagacagatcttgaaatctgcaaccggggttctccactttttcccctttttcttttctgaatttgtgtgtttggttttgcttggagcacagactcacaataatctatttccctttggtggtcacagtgattgggaattgccttgatagtctgactggcaatctctggacctggatgacacagctttattctttgttgaataagagacaacagagactatgtgtaagtcacttgtgtttacttatctcttggtgacctcagatcaattaaaaatcatatgcccactggggaggaaaacagctctttgaggtctggactaatacatttttgtgattctctatcttcttttgacgcatgactgaagttgtaggactgaagctataaattctctacatggctttgcgtctacatatctgtaattcacaaaagctgttgcctccgttgtgtgaaatgtttccctgcttgttgcaggctgaattacgtcaaaattcctatgttgaagctctaacccccagcacctcctaatccaactgtatttgattaattataatgaggtctttcgggtgagccctcatgcaatctgactactgtccttataggaagaggaaatttacacaccagacaagagggtatgtagaggaaaccccgtgagaggaaacggagaagacggccatctgtacaccaaagagacatgcctagaaagaaagcaaacctacaacaccttgatcttggacatttggcctccagaaccacaaaaaatagattttggttgttgaagaaaaataaataatgacatatacaaatggaataccggcaaaattcacagaaaataaagcaaactctgagtacttcaagtgttctagatttttagggaaaaatctcctcttatagaaactgcttgctcagaaatccaatcacatacatatggtgaatctttggacaatggaacagttttaataatttgggtttaagaaaggaaaaacttttctctcatttttcagtgttaaatatgtgataaggtttctattttacattttaacaggttggggtttggtttcccaggaaaagcgtacttaatccgaacttctcgtacttctcaaactatttttcaatcacaaaatcttgcattacagtgacataattttaaagttttttgaaaaatatacatttttagctgactaaatagaataataattctggcaagtttttctgtagtaggttcttatatctttatatataacttgcaaacatggattgatcttcagacagctaggtaatttgtattaaggctgaaaacaaaagcaatgataaacagacataatatttagtttacatatttttggccctttagttatacatactatagaatggctatatttttgagtcacattaattgttttagttttgctactttaggagcctgtagctctaaaaattgtactatatatatttatagctttgttagtctgctaaaatgtttgtgtttgacacacagctctcctattatgactttccagtttctttgtgaaatcaaagatcttattttgaatacaagttataatcggatttggtggctgagacttaaatagaagaaacagtaacagaaaaatacaacgatttatccaaagtaatgggatgagctttctttttcaagaatgaaaagaatagggtattttttccctaaagcaaagtgttgttttgtaccagtatatgaaatgacaccgtgaaagataaaacttgagagaacacagcaagttgtggaaaatttgagggaagtgaattttaactgcttttgtttataacacctatgtctgaaaagaagctataaaatatattaaaattcacctaattttgattggcttatttgtgagataaattaagggggaaaatgatctcataaaacctatatttccaatgcattaatgcaaaattaaaagtagtctttttcttagttgaattaataaattcatcttagaattcttaccaaggcatagtaaaaatactatttttcccttttgtgtgatatgaccagaaagcagagattttataacccaccagaataatctctgctttgtgttgattctagcatagtgttagaaaataaaaatctacaattatgaaaggcaaagtttcctcacttgtgaatgaaccaagattccctgcaatcatattacatttaccaacaattatttttgaacacttgttaatttgattaaatcgataattaaaggcacctaggattttattatagccaaacgaccaagtctactctgacaactactttaatttccccccagccccatgatcagatctaaaatttaaaaatatagaccataaaaattcaacaatatactttatacttaaaactggctttaaaatctcccacaggctccctggagagaggagctggaaagccttaggtttgtttcaagggttttgtatttcttaatcacctccccactacagaagagctatggaatgagctgtcaaatcagaaggacgctcagccttccctgggttcagtttgtgtacatgaaatgttatgcacagaaatctgttactaatcgaacattttatgggaagaccaaggagagtcatcagagcccatgctgtccattatatatatgttcttactctccggagaaacattgatcaaactcttataaaatagtcatacactgtgtcacaaagggttattttacactcgtcattctgatattgctggtcactgtagtaattaatccagccttttattagtatcaaactggtttctgtctccatctgatgcttgcctgagaactgtgctataaaccacaggcctggggttgtatcttcagcgtatactcctgtttccagacttctcagaaaggagtgtgccagatactctgaactactgatacttcaaagaatagactcttgggtactggcgttagagctgacatcagctcaacaactttcagactgtaccagggaatgaatcagaatttccaggacttattttagtctggaaatagatgttcttcatgaaactagcacctaacccaagatccaaaaaataacaattaattacacaagaacaaatgaactgatgagttaaattatggctacttattttgaatgtttttagtattgcatttaatgttaatttttatggatatatgaagttctctttcttcttcatcagtatcactttggatataatagactattgcttttgtatataattttttttttttttaagacagagtcttgctctgtcaccaggctggagtgcagtggcatgatctcggctcactgccacctccaccttccaggttcagtggattctcctgcctcagcctcccgagtacctgggactacaggtgcaccaccaccacacccagctaatttttgtatttttagtagagacgaggtttcaccatgttggccaggatggtctcgatctcttgacctcgtgatcagcccgccttggcctcccaaagggctgggattacaggcgtgagccaccagctgcttttgcatataaaatttaaaaaactgtaagtagtatctgatttttagcatccttcgaaaggcagaaagaaatacttttactgattctccttactttttcatgagaacatagttattaacataggttcaattaggatttgttctcatcttaccaggatacaattgaacaaattgattatgcaacaaaggatacacatggagaattatatatgagaataaatctcacttcatcaaacacagcggcacgctagtccggaaaactgacgagacacgtagctagtgcctacgaagcccagtggacaaatcaggtttactacctggctattagagtcctgttcctgagaacttcaagaagaaaggaattcatcccaatttatatatacagtgcaggcaaaatatggtggagagaatgtcttggaattgtttcccgagctttgagaaagaaaagcaaataataaaggcttttaaaagtcaaatctaagattccttaaaaaaaaatctcaggcagaattaattatctgggtcaaattatatggctatagatttgtaaagcaaactcaagcaggcctatctggttaattaacagtctcattggaactatgtaaaaaataaggccatgtttcatctggatgaaaatagcatttttctgtgattaaaacaaaacaaaacaaaacaaaacgaaacctttgtgggctaggtgcagtgtttaacgcctgtaatccagcactttgggaggccgaggcagagggatcaccttgaagtcaggagtttcagaccatcctggccaacaggtcgaaatcctgtctctactaaaaatacaaaagttagccgggcatggttgcaggcgcctgtactcccagctactccggaggctgaggcaggagaatcgcttgagcccaggacgcagaggttgcagtgagccgagatcacaccacaggactccagcctgggttacaacagagcaagactccgtctcaaaaacaaacaaatgaaaaccgttttgattatttataagggggggggcagggaatggagtgtaaaaaaatagccacaacttagaaatgggccaaatagacaactagatgtccttttggtgcagcgttgagcttgttttcctattggcagggagctgtaccactttgtagaggctgagataccttgtacatttttgtttggtaaagatttccatccagtgtaacagataaccccaaagtcaatggtttaatatcctcccatttatttatctctctcacacacacacacatgctagaaagaacttttcctttgatcctttgatgagtacacagaagtacagagagttgtataatgagtaaccatcccccagattcaattataaataatgtgtaactagctggttgtcccacttccactgatcctaagattgatcacatggcatcagccagattcccttcacttatatcaacccattcactttcatctaattgtttcatctatttatatctgttggcagaataaagtaggacttgcaaaatggtgaatatctaatttcgcaatgcatctccaattattgtctgaaacttctctgtaaagaaaaattttcctcaactactagggctatttggttaccttgaaatagaattcttacaggaaaagctagataaacccttattttatttttttaattatcaatttcctgagtttgattttagggctctagttatttccaggagtttctaatgtatttgggttttttagcaaaattatgacttgttaagtcttcaataacttttttgtcttagattacacttgttttcatcttggattatcccatcttgggacactgaatcttcattagcccctgtgtccttcaagtatgtcccttctgatttcataatctccactagctttcaaataagatagccacacaagatacacaaggttcatcttgcatatgatttgtcccaggcctaaaatcttctattcttcaatgattccttgtcttttttagttaaaaacagtattaagagaccacaatctgagtggccacaaacgtactcctagttaataggtttagatgaatgatccagacactctacctgaaaagaggggagagtgggaggatcaggagacaggaaaacactagtacatgaagtgttaaaactggctgctcatcagaatcacctgtgaaaccttcaacatagagattctcaggcctcaaccattatggaatatgatgatcaaaggggagcccaggttatgtaaaaggccctaaggaaatgaagtcactccggggcccactaggcgggagtgctgagttacagtctccaagcagccacatttccagaccttgggatccagtatattagatatgcttagcagttgaagaatttctttcttatcttaaatagtaatacatattcattctagaaagttcatataaaccaaatattcgaaataaaaataagtcacaatcccatcacaagaagaaactgctattaaatcttgcatctgcattttaatattcttctttatgtatgcacatgcataaacggggatatatatggttagttattttttatagagtaagatcacaaactactcagtaatttggaattgaattttgtcatgtggtgtctttccatgccattaaataatattctcaacatcatcttcaatggatccatagtgtttcattttatagaactgccaaacattcagaacctatggttgtacctcttgatagttttccattttttactaatataaacagtgttgaacatccttctagataatctactgtgtatatctgtaatataattttatcataaactctgagagtataaatgactaagtcaaaaggtcgaaattgcattttctcttgtgagaattctaaaataattccctatcagtttaaagtaagaaaagtctagggcacatgaaaagaactagaaatgaagaagcaagtgtgcataaagagggaaggaaacatgctgactcttatcttttagagctgtcacacattgaattttaatgtttggggaaataaccaatgtagctgttaggaagctgtgattcaaacatggtagcactaaacgatacatcactgtattgggggcaggtgcaacataaacctcccatggatatttgtcaggtgaagaattcaggaataaggtttgcctatctgtatatagaattttgaagtcagggtaccttctagtgttgactgcaatggttaagtcatctgtctgtctctgacaaaagagctagaccctgcttcaggaatgcaaacttctcccactgctatggtctgactgtttctgtccccaaataattcagatgttgaaacctaatcaccaatgtgatggcattcagacataagaaatttggaggtgattaggtcatgagtatggagccaccgtgaatgggatacgtgctcttacagaagatgccctggagagctgctgtgctccctccaccatgagagggcacggctggaaggcaccatctatgaaccagcaagcagccttcggctgacatcagctttaaaggtgccttgttctttcacttcccagcatctagaactggaagaaataaatatctgttgcttataagccactgactcattttgtattttgtcatagcagcccaaaggggctaagacacccacaattgggaatcttggatgagaatgaactatatttcccattttcaaaaagcttatcaatgagtgaataaacaaatgttgttttcattcatttaacacatattattaagttagtaagcatcaacaatgtgcccagcactgtgttaggtactgcaacagcccagagtgagaggaaatgcccctgcttcctggagcctgccttccagcgggcagcctaccacctgcgtgtgctattctggtggccaggacgctgttgtctacagtaacctggtaaattaactatgttaagagagtactttttctttcttcacagaaacaagaaaaattatttgccgtggagtccaagagaggagcatatctatcgaaatggtaattgaaagagaaactggaaacatcacctgtatgaaaaatagtggatggctctgttaacgaaacaggcatgctggtgacaacaggcaacaaatctaatctaatctaatctaatctaatctaatctaatctgtttctccataataagcagcaatcatacaacccactaaatgactgctgttgcttgtcactgaagatgtccatattttactgggacataacatttcttcttggcatgaagagaatggattaagcaaatgaataaaagctatggttctactttaccagcacaaatggacaaatccaaaataaataactgttacagcaactatgctaaccgtattaattaaaatatgcaaggtatactcattctcattttcataaaaggaaatcctaaacgctcaatttgaagtatgtttcctcactatttgtaggaacttctagtcctagaattcttggtccacctttccccaagattgtattcatttgttaaatatgagacaccaccaaaattgtaatgatgccacaatgggagagttaatgaagtaaaaaaatattaaatgagtcaactattattaaaaaagaggcaacttcatatccatcaattagaaatcaaagagtctggctggctatttatcatcaaaaatcttttattggtataaaaaagtccacacaataagcagctttttaaaataaccactcaggccagagtatcactcaccaagctgtgactttatgttctttgtaacaataaagaaattacatggcaaacaacaatctgtgaaaactttcaaatcatactttcctaagctatcgctctagattaaaatgtttgccttagttttcagggggttagagaagagtgtcttatctccaaacagaacaacttcatgaagatgcatacacactttcttcttgcagctaaggaaggaccgtctttgactaggtaaagatccatgtatttgaatcatgaaaatatccaaaaagacgggctgggcatggcggctcacatctgtaatcccaaatactgggaggctgaggtgggcagatcatgaggtcaggagtttgccaccagtctggctaacatggtaaaaccctgtctctattaaaaatacaaaaattagctgggcatggtggtgggtgcctgtaatcccagcttctctggaggctgagggaggagaattgctttaatctgagaagtgggggttgcattgagctgagatggcacctttgactccagcctgggtgatagggtgggactccatctcaaaaaaaaaaaaaaaggaaatatccaaaaagacacattagcaggactcagttcccagtgtgttgtttgaggcactgaccctgatctgaaaacagtgctcagttgattcaatctgaatctgtgtccaccgtcttcctgctcacttagaataagagctgtgtttgcattgcacaatgaacacccacttgctgaaagctaacttgttcctaactgcccccatccttcatccactgccagagccagctttgttaagccccctgtgacctatatctgtgacctatccctagctaatcttctctttcaaaatatgaagtggggtacacactcatcgccaaagggtcctttgagcaagtcccagtagaaaatttatccactttttggatgaagtactcaaaaaagagtactacatttcccaacataaaatggaaaacaaatacatatgccatacatcattcagggctggaaaacaacgaaaatgtaacactccagaaaaacagccatgggaagtattattcctcatgccatccatcattatcatagagcacccactattctaatttagctccaaatgtgtggtggaggtgatcaaactttaaaattaagtaaacaaagagattcatacaaaaataaaataaaataaaataaaataaaataaaataaaataaaataaaataaaaaccctgaccccaaaactagagtaacctgacgtctcccaagtatgggttggggacctagcacctgttctgggggcaattcaggcaggtagccctggatctgtaaacctaggtagtattttagagcctgagcacaatattgggcctttgtacatgtgaactagaaagcaaagggataactgaaatggataacagatagtcagcacttggtatattccaggcctttctctaggcccttgtcacgaagtatctgacatcaacttcatgagttaggtactttttccttatctctgtatgagaaatggggaaactgtggcctggtatgtttaaaaacaaaacaaaacagtgcactattcacttgaggatcttattaaaatgaaggttactgattcagtaggtctgatagggggccaatgattctgcatttctgataaactcccaattgctgctgctggcccacagatcacactttggactgcaagaaagtaaattctccgagtcctagaggtagcaagaagtagagccaagacgggctaagttgcttggctccggggcccacacttactgccagtcggcttagcatttgcatggcagacacatcacagcccaggtaccatgaatgcgctcaaggattcaaaatcaatgtctgtcaccctttttgactgcattttctagcaacaaaaattctgtattcagtgcgtagtatataccaggaactgtggtaaacactggttcaaacgattttcatttaatccactgaagtaaattatcggccatttgattcccttcttacaggaagcaaatcacaaccccactgatgcactgggactctagtgagtttaattatcatgcacagaaaagattgagcattaatttgcaaagaattagaatctaataacacacctctaacaccaaaggtagtcaacctttggggattgaggaagaattgtaagatcttacagagcatcagaggtatcatttggaaaattaattatagtcaaatagatgaagaaggtgtaggagtttgggcctgattctgtgaaattatcaaaaagtactctaaaaaagaatgtagtgatattttccttgtcataagggtttcattttctattatataatagatattttattaattctgtttttcttacataagtagaccataaattcttgatttatgtatgaaatgtttggaagctacaggtcatacaaaataacaccttctataaaatttcacaaaatttccattagtccttatttactcagaacaaatttagaaagattgaaaagagtgtattacagacagttaaattctaccacttaatttgaaattttttctttatcttccctttaagaaagtggaatccagcagcctgcctgcatttttggcagactctgcaataattacgatgctcagatgattcccaagatggacctccccagctgtaaataccctgcctccacgctcattcctgtcaagtgcagatctccccatcttggcatatgggcagtgtcctctgaaacacttcagggtttgaagagtaaaagatgtaaatgatttgcttcactggccatgtaggcctccaggagagggacacccagacactaccatttgtagaggcctgtcgttagaagagcacactgtccagccaggcctcatggagtcttgaatgcaatgtctcccttccccttgaaatcacaatatgaccttgcagaggtgacttcagaaaaatcaaaacattttgaggctccctacaagtactttacttaacttcaacaaccaatgctgtcatttctcacctactctcccccacagttactttttatttctttatgtttcaaaacagataaccaaccacaaaaagcaaaacaattcccacagaggcatgaacccaaacaggcacgaacaaaagcacaaggtagacggggccagcctcagcctgtgctgccccggcatggtattcctctccgcagctttttgtcaattgcatgctgacactccttcccgctctatttcatgacatgtctcctctccttttggaagcatataagcaaaaacatggggctgggtgtggtggctcacacctgtaatcccagcacttcaagaggccggggtcagtggattacctgaggtcagtagttccagaccagactggccagcgtggccacagtttttcttttttttttctcaaaagcaaaaaattctgaaaaagtagtataccttgtgatatagttttaaaatctgactacttggctgaaatcaattaacatgactcttcaaaaaggtccattttaagactatatctactttctaaccaaaacatctagaggaaatgcaaaatttcctttcacctgatagctatattcaggaaaacacaggctactggatattttacataagctctgaagtgagacggtccctgggtacggcttgaattgtctgggtcggttcctcaagtggtctctgcagtttcctcatctataaagaggatatgaacatggtctaccttacaaggctgcaaggaattaaaagaggtatttcagggaaacagggtttctatagtgccaggtttgcggcaagcactcaccgacaccgcctgcaggtatggcccgttcgcgatgttctgggcagtgcagcagttctaggatttgaaaaccttccgggttgtgttgcctccaccctttcctcctgcagttccttcacaagcagccagcatgaggcttcctgaagtcagatcatgtcactccattgttcaaaagtcaaattttctcaacagggtcaaatcctgggcccagcagaccctacctgacctctccaccctgccctttttctgacatcctcttctccgagctccacctgctccaagctccaccccatactggctgctgcgttttctgggcgggggcctgcctggggctcacgagttgctgtcgcctctgccatttggcacacaaatggatgctccctgagggtgccctcctcacagtttagctcatcacacaggcctcgcggctgctgtatattacggaactccccaccaatactctttgtccccttgactctgctgtttctcgatagaacacacacttactagctgctccaaatagaatagctccgttgaggtaggcatcttgtctgtttctattttctgctacatcccagtacctggcactgtgcttggcacagagtaaggactcaatcgttatttgtttatgtagttcgttaactgtatgacggatattggaggagcctcctatttttttgctaggtccaatagcttcatctcatctgtcaggagatgatgaatggcgcctcatttaggaaacaccaataacacatgaaggtaatttacacacaggcaccctggagcccaggtgcagctcaacgttcttattgaaaatgtagtaaaaatagattttattcactgaccatattttaaggaatactattttttactatttcgggcagtactactcaaagcacagcccctgggcccgcggtgttagcatcacctgggagcttgctggaaacgcaacttctcagcttccatccaaggccaactggtctgggcccagtcatctgtgcttttataggtcctcaggtgattctgatgagcactaaagcttgagtggcactgctgtaaaaactacttcaatgactcgttccagttctttgacgtcctcttacaagtctttagtgtgacatgcttgcgttcttagtaccaacagtgtaactggttcttcatgtacatcatgttatcacctctcatgttgaccacttatcttttgccaactaaaaatacttgaaaggcaccttctcgggtttcagaagtttccatttgtttcgacaacatatgaggctacagcccagctattcacccattagagccctcccacgtccagccagcacttatattcttcgaagttaaaattgaagactctggaagcacagaaaattgggatttcttttaatctctttttctgaggcacaggttttcaaacattgtataaccaaggatttttttcatcttttcaaatgatagatgttttatgtgtttaatatgtgaagtacgtaaagaggaatggtctcaggctgctgtgattggcttggtgtgttcacctctcaccgacctgcctctgttctcccacccagcgtccgattgttccgtgagaacaacaggtaggatccataattgtaaggctggaaaaccttagccatagggcagagtttctcagagtatggtcagtaccaacattttggggcctctacccccagacaaatacatcaaaatttctggtcacagaaaaagaatgaaagaagattttttttctcgccattctggccatcaaagaaacatggaaaaacatgcaagataattctgcacatgagagtctgtgaatctctgctctagtaactttacgctatcatttttagtgaagaaaaataatcatataggcatactgtttgcatatagtcatttcaaatcattccattcagtcttaactcaaaccaagaatgaaccaagacatttgaagagatgaaatctcaatttctctgtataattttaaataaagcattcgctctaaaagctaaatgcacaggagttctgttgaatgactgactatgtttacaatttgaagcaatttagtaaacatgtatcaccactcttctaagagattttggggaaaactacagttaattggacaaaaactccatcctcaaagagattaaaaggtgaagtcagaactggagtacaaaatagcaagtaataagggagagtcctaagagttctgaaaaggattccctccagttctaatgagcaggagaggattacttgtagtttagctgttagtttaacacagagttaaatctgaaagttgacctgggatgcaccatctctcttttcccaatctttacagatgcaacatatctttacagaggccttttagtagcagcatgtagggtgccaggaagttgcccccagtgtgtagtggtgcagggagaagtgttaggatggcaaccctgcagcccccaactgcaccatgtagagttgcctgagccagtccctagcctgccaaaagcacaaggctggcaggccacaagacagaggggtaaatgagaaacagggtgatcagaggttagatgtgactcagacatgagtggaaagtcaaggtgaaacagcgcatcatcatagatcatacagtactctgaaggctgctgtcatttaccacattccataaatttactagaatttattctctattgtttgggttgaaataatcacacatttcaatttaaaaatataaagagaatattagacatttagcagaattttctcagtgcctactggtacttcagaccctatatagagagaatactatattttcttaaaatattatggtctagagagagagagagagtcagttgaaagtgtcaataattctaagttcattctcataaaagaaaattctggagaagaccaagggcaattttatgataaaacaaaataagaagactaaaattttcagatgaatatggttgataagagagtagagccagatgcactaggaaatgtattaaagaacatgaatatgtacacaacaggattcttgtgctcaaattgtttttaatattcagataataagtaaaggtttaattttgctctaaacaatgtgatttttttatttttagtaagaattttattttgggaaatcaaattaaagaactagtagataggtctcctaacataataaatccaatctgttatacagttgtacaggaacaaacatagtaaatatagggtttggtaccatttttggtttcaggcgtacactgggggatttgaaacgtattgcctgttgatggggagggacaactgtacatgtgagacacccagaaaaaatgcataaatctcaaagaggtgcctaaaattcaggcttgaataccatcttcaatggcaaaggaagaaagggagaggagaagacaagagtaaggtttgttaggcagattattcagttggtgccttctcaaggatcagagtctccagagactctgtcctcctcatcctagtaaggagagggagacacccttacaaatggagacttccttggtagatataaatttcccttacaaaagggtcacttctactctgtttttagagcttttcctgtgtctactgtttctcaaaataatcagcttaaaataatacttatgctaaagtggcatattttggggtggcatattctggtctcatacacactcaaggtggaattttccattgtttggtttataatgttggagcatgagtattctctagaggtgtcagtgtcagaatgatcttatacatactctggttgaaacgtcagaattgttatgggcttgggttcgatatttatattaatatattattctggtcacaagagtattgcaggggtttagatttatctcatttttccccatttttgacatttatttccatttctcaatttttctttccagacctgaggtgcccagctcacatgaagcagagcctctttccctcccacaatcatctcaagatcaccagagcatcagttaatgccttactttctgggcttatctactcctgtatttaaagatgttgtttctacattttcacttgtccttggaaattatctttttttattttttgcaagatcatcgaaaatttttaagttccttaaattttatttagtaagtttagtaggaggcatttcttattatgttaggcttccatcttgcaggccccagaactttctgacactgtgaaggccataccagcccacaactgccaggatctattgtatgtgggaggaaaatcaacttctaccctgtaaagtcattgtgattattttgtgtcttctgtcaaacacagtaaaaattaattctattacacctttgactatttagattagagaataaaagactaagaggcacatattaatttttttaaaataactaaacaataacaatctttgccaaagaaaagcattttgaaatgggtggtagcatagagagaaggaagagtcctttcacactaaggatgtcattgccattggcatatctggctttagaaactacaaatggctcgattagctttagagttctttctgctttttagaatttttctacatcactagaaacatatctcttatatttaatctcaatatgaaaacctgtttcatagtacttacaataaatgcattctcaaatgttacatcaaagtactccacctacagtgatgtctccttgtagtgaattagagactccaatccaaaacgtatcataaactaaatatgcacccggtgaggccatgctccatgcagactgcactaaacaaacaaacaaaatgctttaataatcttagagcattccaattacctggacttccagctggtggtgagtccttcctgctgtcagtgtgcagaatgacagccagccccacagagtctcctgggaggactgagctgctgaggtccacccgagtcaagctctggggctcccgctcacagcctcccgccgcgtttctggggtcgtcgcctccagttgcattcatttcttgaccttttctccacggtctctgcacaatgtgaacaatgctctgctgatccaggtcacaattctgtttgggagcaaggtaaaaaaaaaaaaaaaaaaaaaggaaatgtcaaacatgaaatgcgagatagagtttaacttgccctccgtggtagaagggaagcaaaagtgacatgtaactgaccaacttaggtgctcctttgcccacagcagttacacactacacacggtagacaaacaacactgaactggggccagaaacagaaatttgggaatacgtgaaacacaatagaatgctgacgtcatattcaaaaggacataaaatctagcaggaaaaaataattaccaaactggatctataagcacagtgaaaacaataattccttttttccccccaagacagagtctcactctgtcatccaggctggagtgcagtggtgtgatttccgctcattgcaacctctgcctgccgggttcaagcaattctcctgcctcagcctcccgagtagctgggattataggcgggcaccaccacacctggctacgaaaaatattcttaaatagtaaaactgattgacatcagaattgatatgtcattcatctctgttttacaaaagtacagaaagtgagttattatcaatgagagggcatttctttaaagcatcggaaatgaatgcgtttgagtaggctccacacacaccgctccacgggcaccaacacacacatcattacactggtggggaagcaagacaggagcacactcttgccacccagggttcattctctttctgacgatttaaccatgaaaaccagctaacatttacgaaaaggttttgcatctacatattgacacgtaggaacagaagactttaacattttgtagcataaaaattaaaagtcagattatttgctagcacaagaactaggctaccctaaatggaattctagtttcagaatatctactacatagggccggccgcggtggctcaggcctctaatcccagcactttgagaggcctaggtgggtggatagcctgaggtcaggagttcgagaagagcctgaccaacatggcaaaaccccatctcaactgaaaatacaaaaattagctgggcgtgttagcgtgcgcctgtaatcccagctactcgggaggctgaggcaggaggatcacttgaacgccacccccacccccccaaccaaaaaataatatctactacatagaagcagttactcatatgcttgctaccctcttaagacacagcaaggaccttactctctcagtaaatcgatgtggccggccgcagtggctcacacctgtaatcccagcactttgggaggccaaggcgggcggatcacttgaggccagtagtttgtgaccagccagggcaaaatggtgaaaccccatctctactaaaaatacaaaaaaaattagccggctttggtggcatgtacctgtaatcccagctacttgggaggctgaaacaagataattgcttgaacctgggaggcgaaggttggagtgagccaagatcatgccactgcactccagcctgggcaacagagagagagactctgtctcaaaaaataaaattaaattaaattaaatacaaataaaccaatgcctttcaaatacctcttgccattgtcattttaggaatgctccaagaacactcaagtgaaatgcatccataactcatagcgatgaatgatgcccttccctgctgctttctcaagctcttctgttgccctcaccatcaatgtccctcgaacagtggtgcccagcactcaccaacacccctgaccccaaatacaatggctagaatctgcctcctccacccaggagggcaccaggacacccttcgtccttaaatcccattccaacctcttctctactcttacaccctggggctccgtctcatccccaggccctgtgcccctccccattctcagagctcccagtctctccctaggactgctcctactcagcagaggccactgtgcatcattctctgacctgaagtgctcccctgcatgacttcccagtttctgtcaaaggaaaaaccatcccccacatcacccgcttcgagccttcccctcccacctaaaaatctcattatcctcccatgttttgtaacgggctgcaagagaatcactatcttgaattcctcctacctaatctttgacatcggcaaggcaccaacagttagcaattctgtctcagaattacccttcacatcttcaactcttttacatctcaatagtcacctccccgttttaggccttcctcatgataatagctttgtaattactccccacatctgatatcgccatactccagtccaatacatacaagaattctgggtgtgtgctacataatctttctaaagtgtctcagtattacttgtaaaatggactgtaacatctcccatgttcttcaagtgtgtttgtacttttttcctttctaaatcatgatctagatttgatttttcatcttccttacccctcctatatgatacatgtggcagattaaactattcttcaaaatcatgcacgcctgtacattagtgcgcatacatcatgctccccacttcctccctgcaatctgtgtccagccacatgaatggctttggccaaagggatgttagcagatgtggttgaaccagggccttatatttgtcccgctgctaaggtccatcaaaagaacatccctgccaggcacagtagctcacccctataatccaagcactttgggagactggggtgggcggatcacttgaggtcaggagttcaaggccagcctggccaacacggtgaaaccccgtctgtactaaaaagataaaaattagccgggcatggtggtgcgtgcctgtaatcccagctactcaagaggctgaggcaggagaatcacttaaacccaggaggcgaaggttgcagtgacctgagatctcaccactgcactgcactgcacagagcaagactccgttgcaaaaaacagaacttcccagaaagcttctacctgttcacacatggcccagacctgagtccaacccactgaggtgaccaagtgcagccacactcacagcatgaagcagggacccgcagctgaagccagcctgaggccgcgggcaccctcgctgacctgtaggcacatgagaagatggcatacttttatggcactgagatttctgcttgtcctctaatcaataatggcagacagtcctctattttccattctatttggacaagctatcactgtccatgatcagctccgtgtcaggcagcactcctccagctgtgcacagcctctagcctaagtcgtttcagagaaatgggcatcaggatccgagtatactcaaggacttgcacaggagcatgtgagctttgccacagaaggaaaagtggagaattagcaccctagcctatcttgaggtttctatccacattttttccctacctttccatgttcaggactcagttacttcctgtgatcctcctagagaaaagtaacacctttctccctcatctgaatctaaaaatctttgcttactgtgctcttcttattgcagtggttagagcttggacagtatatacatatatattgtgtgtgtgtgtgtgtgtgtgtgtgtgtgtgtgtgtctgtgtctgagtcttatcttccaacttattttagaaatacttgagagcagcaacttggccatagtagcattcatcagaacacctcacacagtgctttggagccaggagatgtagaaacatatctatgaattctaaaagtttgaaaaagtgaatgactgaagggaagtaagaaagaatgaaggagtgaatgaatcaatgaatataaacagtcataagctcagtgcccaaagtgccacagagggaaccagcagaacaagaaagaaaggacacagaatttaaagtcaaacggactcaagctctacataatttattagctgtatgaattttggcaaatgattcttcctttcccagctttctgccattgacaataatatatcaactttgaaggctgttttgaagatttaaggaaatgtaaagagctcagatcccgatccgcaatgatacatcgttggtagtattgttaccatttatgagtttcagaaaactaaagaggatgggtccctaatcttgtacatgaataaggtgtcagaattctgtttagctgcacacttctgtttggaaaatatacagagaaggcagaataagcagaagctatcaatgtgacaatctctctggtagcattccaactttctgtgaactaaaaatcgatacaaaaaaataattcctatatcaccatatagccagatgccatgaaacacgtgaagaacctgagtgaattttcagggacaggtaaaatgtgacaaatgttgatgaaatctaaaagatttcaaatccagattttcctaatgctcagggtacagctgcaaaggggaaaagaaagttctcaaacagatttcagtagttacagtgatacttataggacgcatttccctcagttggcatccctgtttctgaaatcattaattgcttaatctttgactcttacagaaaatcttcttggttccagaagcggtgcctttgacagacagtggactcacacaccacactggttcagttcaaagccacattccatggacagtacattggatacagtccagttgtacagccacgcaaaagccccaaatactacttagttctcctagtatacaaaaaaattcctcagatgtgggaagaaagagattttcggtgggaagacatcagagtgctccaatatggtttcaggctaccttagagcagaaacaatgtcttatttatctttgtttctccaataaataaaatattacctgtcaaagagaaaacccttaatacaattctttctttttttataacaatatattaatccaacaagtaaggcagtaacaaattcttcagtgtagacaaaccaagtaggtatttctgtaaccgggtttggtcttacactgtcaagcacagctgatgacccatgggagactgagggatcagtatcttgggctttctgtctataggatccttgacatggaaacataccagtattaacaaaacatccatgggagttttttttgccaaacaatgatcaactctcatctggttggacattatccaataatatacaaaaaactgatgtatttttctttttccaaaaagaagttccttcaacggcacatagttaagatccaaatatttcagattcttccaagcacttaataaagagttacaaatatcatctctaaaatgattaataatgagattctaaaattgttaacaataccacattattaatacattgttttcaggagttatgaaaatagttatgttaataataaaaaacatatagaatatacttagccgtatattgcagaccattacaggttttgagacataataaattatttattattctcacactctgatgagggaataactatcaccatctgctatgtctcaatgtgtcctcaaaatttatttgtttcaacttaaccatcaatgtgattgcatgaagaggtggagcctctagaaggtgattaaatcatgatggggcagagccttcatgaatgggattagtgcccttataaggcagtgcaagtgactttctgtcctttttgcccttttagctcttcccctcttccagcaagtgaagacacaacaagaaggccctcaccagacactgaataccaacaccttgaccttggatttcccagctttcagaattttataaattgcccagtctcaggtattttgttatagcaagacaaagaatacaagacaacatacataaagttagtgtgtaaacagagctagaaatagtgtgtaaatccaagagaactgtgcctggcacagataatgctgttttacagattacttattgtggttgctgttgattccactttatagaagacaaaggggagccacagagaagttcacgatgggttcaacaacacccagctcccgagtgtgaagccagggtaggaacccaggccatcgactcctctgctggtgttcattgactctgctgagaggaagtggagacttggatgaggcagacaaactaggacaagtctacaggggcccatggtgaagaccagggtttggatgctgcaacggaaccaccccaggtacgaaggaatgattcagagaagagccagatagctgaaatgttaaaaacatgagaagacaggatctgggacggggctgtataggaggtagcaaagtaaagattagtccagtgtgattttaaagaggaaacaaaacaaaacaaacaaaaaggatgaaagtaagaacaagtgggttgcagaggaatcagtgagagtatggaaagtgaaaagaagatggtataggtgagctggtaacacacctcgcagactccggatgctggtgctggctcaaggtaaagtctgtacctctggagatcccgtcaccccagggaagactgcacttatcacgtcgtattgtagtttctttgtatgcgttgctctctgttaccagacaataccgtctttaagaaaaaatactgcaactgtgtctgtagtacctactgtagggacctgttcataaaacacactcccctgtgtctactgaatgactctatgatcctttaagcacatacctagaagtgaggaaacattccagatggcgttagtaacttacccaagtcaagtctgatgcataattgggaaatgaaagagccaggcctgcagcctcagttttctggctctgagcccaatgctctatttcaaacatcccaccttggattgtccacctctctgtgctcacgacataagtagacatgttggcagaagtgcccagccagtgtgcttttatcagcatactgatcagtctatactcattggcatacttactgtaccactgtctatggtctgtaaagtaggtagggctgtcttcaatatcttcagtatcattcattcattttcagttccttctaaatctgttaaactctatttcctcatacaaaatgcttaaaatcatttcagtgtatggccaacaaacatatgaaataatgtttaatatcactagtgatcagggaaaggcaagtcgaaaccacaatgcgataccatcttactcctgcaagagtggccataataaaaaaatcgaaaacagtagatgttggtgtggatgcggtgatcagggaacacttctacactgctggtgggaatgtaaaccagtacagccactacagaaaatagtgtggagattccttagagaatctaaaagcagaactaccatttgatccagaaatcccactactgggtatctacccagaggaaaagaagtcattatacagaaaagatacttgcacacgcaagtttatagcagcacaattcacaattgcaaaatcgtggaaccaacccacatgtccaccaatcaatgagtggataaagaaatcgtggtatatgatggaatactgctcagccataaaaaggaatgaattaatggcattcacagcaatctggatgggattggagactattattctaagtgaagtaactcagggatggaaaaccaaacattgtatgttcttactgatagatgagagctaagctatgaggacacaaagacataagcatgatacaatggacttcagggacgtaggggaaagggtgggaggggagtgagggataaaatacaacatatatggtgcagtaggtactgcttgagtgttgggtgcaccaggatctcacaaatcaccactaactaacttacgtaaacaaataccatctgtaccccaataacttatgggaaaaaaatcatttcagtggaaggctgtcaaactttctaatgtgtaataactttacattttaaagactgaacatttctgatttttatttggatttttaatagactacattttctatctagaaaaggaatacaatcagccaagaatgatcagactaatttaaaaatcaatagtgttaacagattctaatgttaaaacatttttacattgagttctttcttaaataactttgaagacacacttttaataacaccttaaattgtccttttttgtgctgaacaatcttggcattctttctattttttgcttcttctgaaaataacttctaacaaacagatttttttttttttaaggcagggtctcactctgttacagcccaggctggagtgcagtggcatgatcaaggctcgctgctgcctcgaactcccagactcaagtgatcctcttatggcagcctcctgagttgctgagactacaggcacacgccactacacctagctaattttctagtttttttttttttttttttttgtagagatgggatctcacttatgctgcccaggctggtctcaaattctcaaattcctgggcataaatgattctcctgccttggactcccaaacactgggattccaggcctgagccactgcacctggctttaagcagatgtggttggaagcccatcacagtttttaataacgtattttctatgccaagaaaagacaaaacggcaatgatttaataagttaggccgaatgcagtggctcacgtctgtaatcccagcactttgggaggtcaaggagggcagatcacttgaggtcaggagtttgagaccagcctggccaatgtagtgaaacccgtgtctactaaaaatacattaaaaaaaattagccagacgtggtggcacaagcctgtaatcctggctacttgagaggctgaggcaggagaatctctcgaacctgggatgtggacgttgcagtgaaccaagatcgcaccagtccactccagcctgggtgacagagcgagactccgtctcaaaaaaaaaaaaaaaggtgttatttaaaggtgttttttaatgtaatggctaagaactattttgtttggtcactgctaacaatgaaatgtgtttcaagacaagatgagccagagatgttcacagtaagtcagaataatcaaaaagggaattgttcccagtgatattttttcacttgaactccagttcccctccatagttttcaatgaacactaaatgccaatttatattaattggatgagaacagaaactatcctttcaaactgatccttcatttaaaaaaagggggacttctaaaagatgaatatttgtgatttagcctttcaatttatttcacatttcttatgactgattttcattatgatcaaaaatattatgctgtgtaaagatactgaaaggccccttctctggttcccaaaggcaggcaatacaattactgtgaaaggtcaattagccccacactaattagccagtgcaggcctgggccttgtcacctccatgtccctcccaccacaggcctgagacctttctgctgctcatgaggatcctacaccagaggggctccatagggggcgggaggggggaccgctcaggaatcactcggtttggctacatgccagcaactgcagtaagtgatttagttttgaagagcagaggacagtgctgtttgagcatgtagggtcgggatttcacttctctgggttccctctttcatgaatacaaaggatatcggatcaccaaagctatgcccattaaacccactttaaaattgtgttttatattgtcaacattgcaagaaatgcctcaagtatcacttcttttttctttaagtattattttattactagttgtgataaatattatgaacactttaaaatatatatattttatttgacagaattaaattaatgtttttaaagccatggaatacgctgtatagaattactggggtcagggtttgagagcttaacaacacacgctcttgatgaagctgacccggaaactcaggcacgtcggggaggtcagcactacccaacagaaccacatgcgagtttatgccacgcttcccaaattccaatggttgcgattaacactcaaaatcatatacctccgcgattgcaaaacaacatctgcgcaaggtgtttactgtgggattatttataatagaaaattatgggctgggtgcggtggctcatgcttgtaatcccagcactttgggaggctgaggtgggcagatcacccgaggtcaggggttcaagaccagcctggcacacgtggcaaaacctggtctctactaaaaatacaaaaattagccgggtgtggttgtgcgtgcctgtaatcccagctacaggctgggaggctgaggcaggatactcgtttgagccgggaggcggaggttgcagtgagcctagatcgggccactgcactccagcctgggtgacagagtaagcctgtgtctgaaaaaaaaaaaaaaaaaaaaggaaaaaaaattttcagaaacaagtgaaatgcttgaccatagaagacaagtacaatctgtgaagaaaaaagaaaacaaagcagaaaatagaatatagtaagggactttctatgtcaaaagcaaagaaaattaagtacatacaaaagtagctgtttttgtaaaaggaaacgtagaaaggaaaatcgaagttagtgaaaatggttacctatgagggagtagggaaatgggttaaagggatcgaatgggagccatgtttccctaacgtgactatctacagtttcaggtgtgaggcacagaaaatgtttcacaaaatcacaacaatacttactaaataaaaaggagaaaaaaagcaaactctaaaactgaaaattaccagaaacatattgagctgacaatgtcagtacataaataaaagtagttcaagtaacttttggacacagtgctctgtatatcctttagtacaaaaaaaggaacccaaaagaaattttgtactttatttactaagttgattactggtatgatataggtgtaggaattcagaaactatttgtatttatgttaagatgaaaaattactaaacttactgatgtttttggaaaccgagtttttcacagtggctgaagaaggtgagaaggagcttcatgatgttggagttgaaataaaggaaacaaaatgtacttatgaatttttaaaaaatccaattcattgaggggaaattactcacctatccagaagttgcagaataatgagacccatgtatatctattcatcaccttattcaacaattatcaacttgagtccaaccttgttttatcagtatgaattatcatggataaatgatattatcaatatcactacccactttcccttcctatattattttgaggcaaatctcagatatcatattatttactcaacaaaaatgatccatatgtatctctacgaaggaggaattttcctataaaacctaactagaataccattagaggaactgaaaaattacaaataagcatttaatggcatcaaatatttatgtgtccataattttaattttttccaaatctgtttgaatcgagatccaaacaagtccatattttgggactggaaggaatgtatattatatcttcttgtaatttaattaattaatttattaatttattaatgtatttatttatttatttattttgtgagaccaggtctccctctgtcactcaggctggagtgcaggcatgatcagggctcattgcagtctcggcttccagggctcaggggattcctaacctcagcctccccagtagctgggacaactggaatgtgccactacatccagctaattttttgtatatgccatacagacagggttttgccatgttgaccaggctggtctcaaacttctaggctcaagtgatctgcctgcctcagccttccaaagtgttgggattacaggcctgagctactgtgcctggcgttcaatgtttttttattaagacataactaatatattgtagttctcccttttaaagtgtataattcagcagtgtttagaatatttgcaaggttgtgcagccatcaacactctctaatttcacaacattttctcttcagttgcttttacaagttccctcacccatctctcttcctgtttttacaattaaatttgaagaaaaatgggttaatccattgtagaatttctcataatctaaattttgccagttgcatatgggtggtattactgaacaagtttcttcattgtccttattatagaaaattttatatttgtggccaggcacagtggctcacgcctgtaatcccagcgctttgggaggccgaggcaggcggatcacaaggtcaggagatcgagaccatcctggctaacatggtgaaaccccgtctctactaaaaatacaaaaaattagccgggtgtggtggcaggtgcctgtagtcccagctactcgggaggctgaggcaagagaatggtgtgaacctgggaggtggagcttgcagtgagtggagattgcaccactgcactccagtctgggcgacagagcaagactctgtctcaaaaaaaaaaaaaaaaaaaaaagttatatttgattctacaggcttgactaggtttaggcttaatatgttttgctgggattcctgtaagggtgctgctttgttcttcaagaaggaagcactatgtgactatgcctgagtctgactacatttggctgtagtgtatcttctttatggaagatacgctaaaattgtaaaatggtgatcttttaatattatcacttcttctcaaactattagataacatatttctatcaagataaattttccctcaatagctattttgttactcagagataaattttgtataggaaggcagaataaatgctctattattttcttggtttatacattttcaaaataagttgactctagcaatgaataaaaatgcaatttttaaaagcattattaaaaaattatagaaaaggccgggtgcgaggctcatgcctgtaatcccagcactttgagaggccaaagcaggtggatcacttgagataaggagtttgagacccacctggccaacatggtgaaaccctgtctctactaaaaatacaaaaattagccaggcgtggtggcggatgcctgcaatcccagctacttgggaggctgaggcaggagaattgcttgaacctgggaagcagaggttgcagtgaaccaagaccacacaatcgcactcctgcctgggtaacaagagtgaaaatccgtctcaaaaaaaaaaaacgaaattacagacacacacatattaatgatgtccatcgattgtacttattattttgattggtggttatctatagctaattggcacatcttagaatgggatcctgaactgtggcagaggcgcaagagtctttggtagcttccctgccatcctgtatgacaagagactccagtctgctttgaacactttttgttctagacctgtaataaatcattttgacaaataaaaatggcatttaaagatgacgatgtggatggttagagatactcattgctagtggattcataaacgtctgtcagctttttcagtgacaagaggtatgttttgttcgttttttaaagataaaatacatcacgagttcaatctgatatttcccattcaaaccgaggagtagagggttttaaataatctccttcgtcttccatcttaatcttcttttctcttgttcaaaatcgtgaaaatgaaatgattagatgtcacataattactcattattttagactacattatatacacaatgtgaatgataccattaaattgattactaatcatagtttaagtttttctgcttgtagttctttttgtcttgggatgtacctcattaaagatgtatagtcaaactgctgtattctaaagtcacttggaataatgtggctatgattacaactaaagatacttgcattcatttttttgactttattttttattcttagaactttctatttaaaatatttaattctgttttataattatggaaaatattttcaagtttctaaagtcaaactttaaaaacataaaattgtcaaagatgtctcacttctacttttgtctgtttaatatattcactatctttttgtttgtttttagatttctgctttacctctaacagaagctggtgtgtgtgtgtgtgtctgtgtgtgtgtgtgtgtgtgtatttaagcacctctcttagataattgatagcatgttatatacttttttcgcttaatttcccctacaattaattctacagtagtatatacacatttccttattatttttcacaaccatacagtaacctcacgtgtggataaatcatagtttattcaaccaataccctatgttctatgacaaatgaggtcccactggccaagtttgggaaaatataaatacaaaaaagaatagattgataacaggttataatacattaaagaaaaaatccatgaatatatgataatattaaaaagtatacgtgtgaggagtaagaaagagttcttccatacagaacaacagaataaatatggcaagaactgtcggcacagacaatcatatttttgaaggcactgatataataattaattcactcaaggatcaccagtagaagctacagcaaatggatccaagattggtgggaatcgggattttggcagtttccaagtatctgcccacagattccctaataatttcaaaagaggagggttatttctgcaatgggagattcggcaggcatcactgtaactaagattcacacgggcattgtcagttacaaaggattcagcattaacgacaacaaagtttaacccaaatttagcaatgaggagacaataaaacaaatcgaggttgcaggataattctgcaaacaactgacccttacaattcaaatttttgaaggtgcaaattaggtgtgtgtgagaagactgttctatactaaagcaaaataaagatacatgataactgaatgtgatctgtatatttgactaaacttttggtcagaataatttaaaaaaattatccaaagcatacaaacaacctttaaaactcatcagtaaataaataaacaaacattaaaaaagggccaaaggctttaacagatacctcaccaaagaagatacagagatggcaaagaagtaggctccacatcttatgtcctcagggagcagcaaattaacgcaagataccactacacaccaattagaataaatcccagaacaaaggcaacaccaaatactggtgaggacgtggaataacagaactctcgttcattgctactgggaatgcaaaacggtatagtcactttggaaatctggtggtttcttacaaaactaaacatactataaccacacaatgcagcaatacctggagtatttacccaaaggagttgaaaactaaaatcatgtccacacaaaagcctgcacacagatgtttacagcagctttattcaggattgccaaaattcaatgcaaccaacatgttcttcatcaggtgaatggataaagtatcagacatacagatcatggaaaattattgagcactaaagagaaatgaagtatcaagccaggaaatgacatggaggaaccttaagtgcatattaccaagtgaaagaaccaatttgaaaaggctacatcttgtatgattccaatttgaaaaggccacatgttgtattatacgacattcggaaaaaggcaacactatagagacattgaaaatatcagtagttgccagggactgagggatgacggagggatgaatagagacagcacagagaatatttaaggcagtgaaaatactcagggtgatactatgttgatggataaatatcattatacatttgtccagacccacagagtgtacaccaagagtgtaccctcatgtaagctataaatgtgaagtgattacaatgtgtcaatttaggtttatcagctgcaaaaaatgtaccgctctggtgggggatgttgataatggagagggtatgggcacatttgggcagggagtagatgggaaataccttcctctctatgatgtgaacctaaaactgctaaaaaataaataaataaaggcttaaaaaagctataaaggacaatttgggaacaattgggaggatctttgaatatggactacaaaagaaatatcattgtatcgatgttaaattccttgaaatttacatcacacattacagcggctacacagaagattgccctttgcctttgtagatataggctgaagtgtttaggaacaaaatgtcagtctatctgcaattatgtttagcttcttgagagacagaggaaaggaaggaggggaaggtgtgagtgagggagacaaagaaagataaagcaaatgtggcaaagtgttaacagttggggactctggagaaaggttgtacagatatttgctataaatagatttttttaaaaaattttttaaaggtttgaatctcctaaaatatcttcatactcagtcactaaatggaaagtaaccactgaaaatcagaaatgttggcgaggtgaggtggctcacggctgtaatctcaggactttgggaggctgaggtgggtggatcacttgagctcaggagttcaagatcagcctggccaacatggtgaaaccctgactctgactctactaaaaatacaaaaaattagccaggggtggtggcaggagcctgtaatcccagctacttgggaggctgaggcaagagaatcgcttgaacctgggaggctgaggttgcagtgagctgacattgcaccattgcactccatccagcctggacgacagagactccattaaaacaaaaaaaagaaagaaagaaagagagagagagagaaggagagagagggaaagaaagaaagacagaaaaagaaagaaagaaggaaagaaagaaaaagaaagaaagaaagagacagaaacaaagagagaagagaagagaaaagaaaagaaaagaaaagaatcctctgtcttaatcctgagttctaatttgattgccttgtggtctgagagactgtttgttatgatttctgttcttttgcatttgctgaggagtgttttacttccaattatgtggtcaattttagaacaagtgctatgtggtgctgagaagaatgatttggggtgcagagttctatagatgtctattaggaccgcttggtctagagctgagttcaagtcctgaataaccttgttaattttctgcctcattggtctgtttaatactgacagtggggtggtaaagtctcccactattattgtgtgggagtctaagtctctttgtaggcctctaagaagttgttttatgaatatgggtgctgctgtattgggtgcatatatatttaggatagttagctcttcttgttgtattgatccctttaccattatgtaatgcctttctttgtctgttttgatctttgttggtttaatgtctgttttatcagactaagatcgcaaactctcctttttttttgcattccatttgcttggtaaatattcctccatccgtttattctgagcctgtgtgtctctgcacatgggaagggtctcctgaatacagcacactgatgggtactgactttttatccaatttgccagtctgtgtcttttgattggggcatttaagccatttacaattaaggttaatactactacgtgtgaatttgttcctgcattcatgatcctagctggttattttgcacattagttgcagtttctggaaactgaacaacctgctcctgaatgactactgggtaagttatgaaattaaggcagaaataacaaagttctttgaaaccaatgagaacagagacaatgtaccagaatcactgggacacagctaaggtagtgtcaagggggaaatttatagtactaaatgcccacatcagaaggagggaaagatctagaattgacaccctaacatcaccattaaaagaactaaagaagcaagagaaaagaaattcaaaagctaaaaggccaggcatggtggctcactcctctaatcccagcactttggaaggttgaggtgggtggatcacttgaagccaggagttcaagaccagcctggccaacatggtgaaaccccgtctctactaaaaatacaaaaattagctgggcatggtagcgtgtgcctgtaattccagctactcgggaggctgagggaggagaactgcttgaactgagacctggaaggtagaggttacagtgagtggagatgacgccactgtattccagcctgggctacagagtgagactccatctcaaaaaaaaaaaaaaaaaaaaaaggctagaagacgacaagaactaactaagatcagagcagaactgaaggagacagagacatgaaaaacccttccaaaaaatcaatgaatgcaggagctgttcacatatacaccatggaatactatgcaaccataaaaaagaatgagatcatgtcctttgcagggatatggatgaaactagaaaccatcatcctcagcaaaccaacacaggaacagaaaaaaacactgcatccatgccataaaatacaactcagcatagtattccatggtgtacaaaaaggatgagttcatgtcttttgcagggacatggatgcagctggaaaccatcattctgacaaactgtcacaaggacagaaaaccaaaccccgcatgttctcactcataggtgggaattgaacaatgagaacacatggacacagggaggggaacatcacagactggggcctgtcagggggtggggggctagggaagggatagcattaggagaaatacctaatgtaaatgatgagctgacgggtgcagcaaaccaccatggcacatgtttacctatgtaacaaacctacacgttcagcacatgtagcccagaacataaagtaaaattaaaaaaaaaataagaaaataagaaatgcggtattactacaaaatttttaggatgaaaaattgtatgtatttcatgctatctgtcatgaattcagctatctaacctgctatatcctacacatagcttacaaactgacctaagaaaggagggaaaaatgaaagcaaaatccaaagttgcttataaaaaagaaatctttgttttggaatatgagaaagctattgtataaatacagattaccaatatggtttaaatagaagaattatagtcaaataccatagcaaatgagttaaaattttgcagctcattacagttttgaggtctctaaagtgaataagcataatacccaaaatactgactttgtagaatcctaaaatccagttatgcagtctacagcagcagtcctgaatctttttggcaccagggagtggttttgtggaagacaatatttccacagatgagggcaatggggatggggtgtggtttgtggatgaaactggtccacctcagatcatcaggcattagttagattctcgtaagaagcacacagcctagatacctcacacgtgcagttcacaatagggtttgcactcctatgagaatctactgccactgctgatcagacaggagctccagcgtcatgctcatctgcccatactcaccccctgctgtgcagcccaggtcctcacaggccacagacaggttctggcgccacgggggttggagacccctggtatagagcaacgcatgggcaaaagcactgcatgagtaatcaaggtcaaaggcagaattaatggatgttctaatttactatggaggcaacatagcaaaacctcttaaacattttacaacaaagatcctgtccatattacagtcttcaaacagatatggacttccatacaagaagagtatattaaaaaaaaaatccacaccctctcagatgttcactcaaagtgataaaaatggaaacaatggaatcacatctgctaaaatccatattagaaagtatacaaataaaagtgcttatgataaacagctaatgagaataaatggatacactattaagctatcttggcagaatttatcaatgtcttagatgtacatgcagaaattctcacatatgtcctcaaaaacacatgtacatggatgtcctttgcaaccacagtaaaaaccatggcaacaatctaaacagtcatcaatattgggctggctgccattcatacatacaattggtaaacatttgttataactctagaagtacacggaaaagaaggcggtctattttttaaataaaatcagcaagttgcagaatagcatgcactattattattagcccatttgtctgtatgttgtatatcactctgtatatgcattaacttattgggtacacatagcaaattttgattaactctgaagaatgggattaagtgatggaagagaggaatttgaatgtttctgaaattttaaaaagtctaagcacacattactttgataattttaaaaagacacctgggaaattatttgcaagtaaaatactcatttaattcctgataagctttcctttctttctttctctctctcttttttttttttgacagaaaagataatgacagtaaatgctttacttagaatagaatggaattttttttctacttttctgtcaatgtctttatggatgatgttgccatcttcattttgtcactgttagttgtaacttctttctgacctatgttttaccctttctggctacaagctcattttacacacagttatttatatgaacagttgggagccactcactcacctctcttttgagaaaagaaaaatatatttgtgctttctaacttttattatctttatgccaataagtctttttattttcacctaagatttgtgtccatttttggaatggcagagatgctggaaatcatatttcaatccaactgaaatgtacgtgtgagtgtgtgtgtttgtatgtatgcatggttttatgtctttagaattctttgtgagtgctccagtaaatctggtgccttctgagacgacaagagaggattaaggaaatggtatgagttttttgtaactatctcaatgaaaaagtagagaagcatagagtgaaaaaatccttagaacagtcttgctctgtcgcccaggctggagtgcagtagcacgatctcggctcactgcaacctccgcctcccagattaaagcagttctcatgcctcaacgtctgagtagctgggattgcaggtatgcgctatcacacccagctaatttttgtatttttagtagagacagggtttcgccatattggccaggctggtctcgaactcctgacctcaagtgattcacccacctcagcttcccaaagtgctgggattacaagcaggaataaatgttactgtattaaaagtattagatcctgacccctgcttgatgtgttaagctcagtgtcctctatctgaaataaagatacacactagcgtgttctccagattcaccttaattttacctgaacaatattctaaaattttcaaattatagcacaaacatactaagtacacatataattcacaaaaattaaaaacatatatttagccaaaagtaaataaaataaaatcagtaaaataaacaaatctgagaacttcatgaatggcaaccacagcctaaatgcaaagaaggaataaaacagctacttcttggctcttgggctttcatgggcccaggatccactaatgtaagagtaatttcagagattttgaagggtaactgggtatatttatgtattgtgttatttctttcttttttttttttttttttttttttttgagatagagttttgctcttgttgcccaggctggagtgcaatggcgcaatctcggctcactgcaacgtccacctctcgggttcaagtgattctcttgcctcagcctcccaagtagctgggattacagacatgtgcaaccatgcccagctaattttgtatttttagtagagaccaggtttctccatgttggtcaggctggtctcaaactcctaacctcaggtgatccacctgcctcggtctcccaaagtgctgggattacaggcgtgagccaccgcacccggccatattgtgttatttcatctcacatcttgaccttgaactttgccagttctcctataaatagcaattccactgtagtgacttacatttgaagtttgggcagtttttgataaatatccttattactggattttcttttcaaaatgaacaagaatattggacaactcaggtcctccgtttgaagacattcacagctgagaatgatattcgtatacatctgggccacagactagcagttcatctagttaatcagttactatgtagccaacctcacaagttgctatttactgccaatatgctgcacagctacaagtgttatgggctaaattgtgtcccctcacaagtcatacattgaattccaaacccccagtatcccaaatgtgactgtttggagatagggcctttacagaggtaaccaagttaaaatgtcagcattagggtgggtcttatctaacatgaatggaatccttttaagatgagattcaggtatagacagacacagaaaacagaccatgtgaaggtacacggagaagacatctgtaagcccaggagagaggccacagaaggaatcaaccctactgacaccttgactttggaattgtgagaaaataaacatattatttatttaagccacccagtctgtagtgaaggttcattttatacaagaattatacaacattttactggtccctctcgaattctatagcagcaggcatgtatcagggatcttcacagatattttggagatttttttttttttttttttttttttccgagagggcctctggcatatactcttgacataacatctgggcaccatgggtagtacctcctttatgacagatacttcattttaattaggggatgactgcattatttcaagacaaagcaggtgtaggttattattgggtgttgtatcaaagaaataaagaaatgtaggatgacatggggttattcatttctgcattgaaaataaggggaaataaggagttatatagtaggatcttcgcaattacactgaaaccagtatagtgcgtgcttgttgaatgaatgaatatcagtaataactctcaagaactgtattaagcaccatatttactaaatatcttacatattatttgtaatcatcaaaccacactgataaataagtattgtagcagagacagctggcacctcatcgaaatctgtttcctcctcttccccgacaccagatgacctgatttcccaaattccttaacatttagggttggctacactgattccttttatctgatgggtatgactagaagagatgtgtgccactttgaagccaaagcatgttcacagaagttgtagtgaacacagacagacaacaaacagataaatacacgacaaaatggttgataaatgtgtggcggcgggggcatagatggagagatgggcaaaatacaagttagagacaaactctcaactgtaagctgggagctcacatcctatggtttcaaccacacaaccaaagactacaaaatgcagcgtggcagcataatcaaatttacatcatcaggttttggattgtcaataaactttctagagattactctgcacagccaaaattttaaaatgatatcagatacaacagctaaaattactgggttgaaactggaagcttcctttttaaacagagctgtaaatgtataaaatgccacattagggcacaggttttatcacgtttatttgctagctaattattgaatccaaagcctttccaaacttgtttttggatgttcttgtgtttgtttgtttgtttgtttttcctaaatctttatagccgtgagccttgatcttcatgttttctttctcagaaatcaatcattcctttgtgctacataccacctcctccttcctgatagtatgtaggccatcttcaaactccctacaacttcaccaacatttccaactcattttcatacttttaagcccactggcattatacatgcaatactgactccaataaaatttatcatgtgggattagcataagcagaggtggcaaacttctcatttgttgctcccaaaaacaaaatgctagatcgctctcaagtaagaagaaacttgtatcacagtgtggtttggatggttgctatgacaatatcgagttcttctttgagaaagaccatgataaggcattcattaggaacataagtacctagcagtgagggttgttttctttttcatttttaaaatatctggccaagtagctggcgtttaaacagatcaagcattttacctacattctccaaactttaatttcataacgactccttgaaataagatgatggacaacaaaactggagctcaaagagatgcataacttacctaaagggatatcactggatttgcatccaggttcatcttgtaaaaccacgttgaactgcttaccttgactgaataaatcagcaatgagtacagatatctactttaattaacacatctaaattttgcttcattctataaccaaagcagttaaagggtagaatttggaagcacttaagatgaaccctccaattcttctctattgtctccaaaggctgtcccatctaatggtacagatgtgtgaaactcagaaaaatgataacagattacagatgagacgcaacgaaagcttccagccaggaaggtgagtgaggcagatagacaagctcatgaatttccagaggaacatatcacaattctgatttgtctgtgaggaaaagacatgatgtctccctataaaaattcactgcacattgccaggcatgggggttctcgcctgtaatcccagcagtttgggagtctgaggcaggaggattgcttgagcccaggagttcagaatcagcctggacaacatggcaaaactctgtctctacaaaaaaatataaaaatcagctgggcatggtggcacatgcctgtggccccagatactcaggaggctgaggtgggaggatcgcttgagtctgggaggtccaggctgcagtgagccatgatcatgccactgcactccagcccgggcaacagagagagaccttgctccttgcaaaaaaatcactggacataatgaaattatgaacataagaaaaggttggatttaagggctattttaatgtaattcccatcattttcatcattcttttgtgattcatattatttaccatggaagacttctatttaaatcaaaaggattaactgggagggttacattgataacaaataactagctatcacaaatagaaatttgtgaagggatggaatgtgagaaaattagctttgattatgaaaaatgaaagagaaaagcctaatgtagaattcgcagctaagtgggggcaacccatgccaatcatttcaaaggctggtcacacccgaggcgtgactaacccagcagcagatggaacctggattctacatttcaccatgcttggggtgggcttggggctccatgacccacaattttcccactgcatttcccaggccaaatgcctcaggttctgtcttattccggaatcctgttcatgattagaatcatgctcaagagctaaaatcttcttctgaacttaagccccactgacggaagcactgaatatgcctaactcttacagtttccctccctgcctggaagtgggctctataccaagccaggtggtccagagccactcttctgcccacatcctatcctcatcctcatcttaaatgtagccaacaagaggaaaaacatccattctggttttggctgctggtagtaggcagcggtctaaggtagctcttgagtgtctcactccctgatctgtgtatctgccttctatgagcagcatctgtgactatgaagaatgccacccgtgtgattaggttacactatagggccaaggagaggggggttttcagatatacgtcaagtctgtaatcggctggcttgttcagcaaaagggagattatccccggcgggcctgaactactaaaaagaagtgtgcaagtgagctccatgaaacggggtctcaagttcagagacatgaagtgacagagacttcacgttcctgctaggcttgaagaagcaagtcatcgtaagttctacagctgcaagaaagtgaacttctccgaaaaggacacggagccctcaccgaggcccccaccaaccccttattgtagcctcatgagcccctaagcagaggacccattaaaccaagcccacaaacatggaaatggtgaaacactcacatttttctaccatgataccatttataaacatcggatacatttatcattccaaggattcttgccatttgcagatacctatgcttggctgctgaggaaggctgaagccccttgaggacaaagaaacatgagcttgttgtcatttgatcaaacgggctcttgaagcttaggtcagcagtaccattgtgaagtctgtttttcactttaaggccatgtgagacaaagagatttgttgtggtctgtagggttttactacaacataggatgtggaatatggcaaaagtgtagtttcctacacatgggtttcctaggatggcagtaatcaagtaccacaaactaggggtttaaacaacagaaatgcactgtctcacagctctggaggccagaccctgaaatcaaggcatcggcagggctggttccttctgagggctgggagagaaggacctgctccagggtgctctccttccttgtagatatccaccttccccttgtgcctgcacatcgtcctgcctctgtgcttgtctgtctcactttttttcccctttttctaaggacacttatcatattggattaaggcccagcctaatgaccacactttcacttgattaccactgtaaagacctgatctctccaaataaggtcacattcccaggtgcttcaaaataggtgtttttttttagccaggcatagtggctcatgcctgtaatcccagcactttgggagactgaggcaggtggatcacttgagctcagcagttcgagaccatggccaacatgatgaaaacccgtctctactgaaaatacaaaaattagccgggcatgatggcaggtacctgtaatcccagctacttaggaggctgaggcaggagaattacttgaacctgggagatggaggttgcagtgagccgagataactctagcctcagccaacagagcgagacactgtctcaaaaaaaaaaaaagattttttgaagaacacaattcactccataacgcccataaaagaggaaggagagagcatccaaggactaggtaccttactggagggcagatagccagctgcctctgctgtggcagcaagacaccaaggtgaccctcccaatttcaatagccgtgggatcatcaagggcaggagaaagggaaaggaagaaccttgaatgtgactgcatatctaagtccctaaattgaaacagaatgacctacctggaagtaagagtatgatttttttctttccttctgagagtggaaatgagggcttgtgagaaagttgaaaaatagagaaagtttcatttcagcttatctgagttgtgctgcatgaatatttttattcgcctcctatgtcctgagcatgagaattgagcaccagaggaagaatccaagactccttcactttatccccagtccacagaccgaccattgtcctcagcaataggctgactgtcattccctctcattttgcatgcagggattgtacacgctgaaaaactcccttctgtctaacctcccctgcagcaggtcaagtatagttgtttgctttaatataagatatctgttgtactaagacttcattgaataagtttcttaaacagacgagcaagtcatttttccactcttgagtggcctcttagtgagttaatcattttgtggaaatacaaataaatctaacacaaaatatcagaattttttccttcttaatagaatttaaattctttgatttaaaacatcataatttattccttgttagatttttcaaataatatattcaaatgtccatgttaaatgtcagattaagagacaatgatttttatgagtaattttttatcaccaaaagttaattgcctcatgtatatttctccactgagttagtaatattatgacaatattaatgccgtagattttcaagctaaaacagatctatttttcaaatggaaaattaattctaaaaaaatgaaagtactaatttaaatcattaatggcaatttcctctttgcagactgccttgaacttttccagttctgccctaacagtccaggagaaggaaaatacaaattttctggcatggaaataacataagaaggagctgcaagtttcttggcaaagacattgacaacttttcaggataatcacaaaagggataggataactctaaaaatgaacataatgctagtctgagccagttaagtgctcactttcatagcttctggtagaaagagcattcatggaattaaatattaaatatgttctccgaagttctgagatagtaggataactgtgtgtacttataagaaaggagcgatgtcatgggtgattttcctaaacatagcagagaatcaggaaaacagccaagcatttgctgagacggaggcacataaaacatgaatctgagaatcccaagggtagaagagagaaatgtggagggttatcatcataaatcatgttagaaactagggcaagaaactcatggtgacctctggacactaaaatgcagctggtcataattaagcttcaggctttgctcttcctgggccagttcattggcatcgtctactgccaggcctcgtaccagtctacagaagagattgcctggaacaagcctcttgatgttattcacacttatgaaccaactctggtactagatgcaaaaagcatgtcacaagagggatgggtgggatgggggggaagggacatcgcaggaatcatgccactttccagccccaccaccctctggtgccacgtccacccttgatcactattaccaacccagtatccctccagcacttcacgggagggtgtcagggatcacaaggaaacacatgggacccacacatttcgagatgcctcacctcctgctcgaaagtcaggtgaagaaggattcttgagccaaacatgaaagattttttgagagctaagctgacaggagaatttcccgtaaaaagatgaaagccctggctttaacagagccccttttcatttttacctttaaaaagcttttcctttcatgttaccctgaggttattcaccgctacgacaacaatctccaaagacgttttctccattatagaagaggaaaaggttggcgttgggatttggtcaggaaatgaagcgttgaagacaaacaagatgttctaatatagagcaaacctgatgagtcattttctaagtgagcagccacttccagatacaattcatagtatcttcctagttattactattattattattgtttttttttttttttttctgagacggactttcactcttgtcatccaggctggagtgcaatggcgggatctcgcctcactgccacctctgcctcccacattcaagcgattctcctgcctcagcctcctgagtaactgggactacagttgcctgccaccacacctggctaatttttgcaattttagtagagacaaggtttcactacattgaccaggctagtctccaactcctgacctcaggtgatctgcccacctcggcctcccaaagtgctgggattacaggtgtgagccactgcgcccggcctcttccaagttattctgtcatttggcactgatccgtctttcaaagacattcaattaatcaccagagatgcaacaccataaaggagcagaatatttcaatatattacctgatatattttcttttgtcattacccttttgtaccctgtagctttctaccttaaaggctccacctacaggcagaggctcattgccttagagaaggagagacttaaaaaaaatcccaggcaaacagagggtcaagtaaccagacttggaattgcacagatgttggtgaatctacagcagccacaatggtccaggattgaatctactccatggaagcttcgaagtgggaagagccgaggatgacctagagcccataagaagataagtctgaatcagctggaggaaggtggatacccacaggatgtgtgatggggtctggatgagagcagctgggtgagaagcagcaccactgccttccttagacccaccaggatcagttctttcggtagtgatggagatggggagggggatataaaaacccccagatctctttgattaggtgaaagtaaagcaaccaatggaatgccctaattctttctgggatctcctacagcacacaaaaaaacctgatttccaacactgggtagcagcaatactgtaggtatggccccacagagtgtctatgcacagagtcctgtggtcgctggggacccaaggggtgcagtaaatacctcatgaagggcaaggaggaggtcaaagagactttctgagaataacagtatttccaaagggtgctggctcaaaaaatgaaaatatgtaagccagatgtttagcatcctgggtaagatattaacaagcttcaacatcagatgtaaagggaaggaaaagaaaattgattccacaacatccccagtttcacttcagtagaggccaataagacagaagccaacaggaaattagacttcccttcttcaggcagaacagtggtgaggccctatgggctgatcatccccaggaaaaggatgaaaggataagaagagggaaagaacccgaatgggaaagagtatttctcaaaggggcccaagttttaatttataagattaaaagaatgagggttaaaatgtaaacaaagccaccaaaatatagaaaacacagatttggaattctaaatccatgtactccattcatggaggaggtggaaacttgctgagttctcggaccactcagccagttcacagacataaaaggagacccagcggagagggagtgggtgagtgggagatcaccgccctggagagggcagctgtcccattggggggccccacctccactttttcgagtgctcttcctccacctcaagcccggtggaagccaggggatgactcagagatggggacacagagggctctcctcccagcctgaagagctagagcaggctgtcaggaggaatgtgaatacagtgggtggacctgtactccagggctgtgggaaagactggggttccccaaggaccagatgtgggcaggtggagagacagaaagagagagagacagaggaagaagggagacagagagtgcccgccaccgcacccggctaattttttgtatttttagtagagatggggtttcaccgtgttagccaggatggtctcgatctcctgacattgtgatccgtccgcctcggcctccgaaagtgctgggattacaggcatgagccactattcccggctgggagaagtcttagggcttagacatgagggccacctggagggtggcaggaccctggaaacaagaagccaaagtcaagtctttagggcagcaggagagatcagaaggggccatgcaacccggctgaatagagaggcatcattgggaggcaggagagatgcagaaaagaggtttccagcggtgcaaatgtactaagagttcatgaaagcccccggtgctgaggaatcagctggaacccttggccaggctccaagtacccgagccaaaagctctgtttcctggccccattctcctccttcctacaccctttcaagcttcctcaaacttcttcagagcttggcctgagagagagaaggaggtgaacagagagagaggagagagacagagagagagagagaagcagagactctaattaaacctcttcctcaatgtcaatgtcaggcagagaagaacctgtggcttgaaatgagcaagaaatacaaattgtggaattgattaataacttgcctgaataccaggattagtaaatttagactttgttcactacttcaactgcccacaggactgagtaaaacaaaaatcacagaccctgctgaaactgcaggaatgatttaactcctgcacacgatttaattgggcaactggaaaaggaaatacaaccttttgttctgacgttattaaagatgtgcttgctcagcatcattattgtattaagttttctgctgaagaagattaagaagagaataagaatagaataagagtaaaaaaaaagagaaatacaatacaataaaaacataaaagaaaagaatagaaaaaagagtaagaaaaggaaaagagggatgtaagtaatgcagattcaggtgtaagcacaaactaagttccatctagagactactgaaatactgcactcactttgataacccagaaaacacaggacaagatctgaacgagacctggatctgggttgtgcttcctcgatcactaaccctagtaaccatacttattagctaaaacctctgcctctagcttttcatttggaacatacatttaatatacagccctacataagttcagccaatatgcagctcaacaatatattaactaggcaagttgtatttcagaatctgtgtgagaagcggcatgcacgcagcctcccagcattcgctggtgctggggcttgtgcgtgacaacatcagggagctcttccaaatgctggtcgctcggtacccatatggaggctttcttcctctagattgccaagctttcttaccagaggaagatttaggctgtgtccacttagggccaaaataatgaatcagttcagttgttatgtgtgcaccatttatactggggtttgacagaattttaaactttttactcgattgccttgatatcatggaattattgctatttatcagtctatatttacacaaaaggcctgacatggctacacacaggccctgtggtctgataccacgtaaggcacccacagcatccctcgccagctgagatcgaatttattcacacacatgcgtctcccctccaaatggaacttattctgactttagatctcctattaggactaatgccattaactaattgtccaataatttcagcaaaattcaaagtataaaacggaagtattacctggccccactacaggagttgtgggaacctcactggcaatcagatttttcctgtctgtcttctcttgctcttcacttcccaggaaagcaggcagatccactaacttcataattctagagcaaagtggggccttacacacaagcctacgcttgcccttggagtttattttgacttctgcataggtggctgccactgcagttgtcagaatctgaaattcaggagatgccccttgacaggcagggacaccatctgatggcagtgtgacaaggagcattgttaatacaggaagggctttctaattgagagtggatacccatgcagaaattttcggatgttcccaaggccactacaaagaaacatgaaataaaaagatatatcccatgaaactacaattttggaaaagtaaaaataattacagcaagtttgtatctgggatttgttcattttaaataaaatttaaaaacaaaaacaaagcaaaagagaacaaggaggggagagggacagtaaatgggtaaaaagaaggaaaagatggaggagaaagaccaagagctgtcaaggcccacagtcgccttaaaacagaatgtgcccatccccccacccccttctatgccccccacccccttctatgccagcgcccagtacctcactccctatctgcgctgcctcccagccaggggccttgacaagcccacactctccaggaagggtatgagcacagcctctactgcaggagaggatggagacaagctctgttcttcttgcttttatgtgagtctgatactcatatcactcatctcctttctgagcattgcaggctttaaggaccctctggctggctccttaacccagcttctgaaatcccccggagctgcctgacttcccactctggaccctaagtaaacatttacagaagcagtggatgccgcttatttcttactccacaactatctatccattcttttgccaaccaaattattatgtgccaatcacattgaggtaaagcaaaaatgaacgcactttaaaaacattaaaatgtgctcagattgcaaatgtatacagctattatacccagcaggaaaaaagccaattaatttacgtatttaagaaaattttcttacttgaggacaaaaattaaaaaggggaaggaaactcatgttgaatttcacttagaaaagtcaaagtgaaaataatcagaatgtcttcagctacccaaggatttactgttaactagaaaaaagcatcgtttccatgccacctcagctttccaaatctatcattctaatccatttttaaaaaagaataaaatctgaaaaataaagtacatctccaggcctctcatattgcaaatgacgtgtccaatcatacttctacaaggaaaaaattaatggcaaagggggccaagagttaactgctggaatggttaactagaaaaggcccagtcgaaattaatccccatgatttcatgtgaatttcaagccatagcttaatcctacatgtcagtacaacaggaactgcttagctctgctaatcagattctagaatttttcttttctttttttttttttttgtaagcatcttagtttcgcaaaggcagctggctgtgatggtattggtcactctgctgaagaatatacatgggacctaaaatagctctgggtccttttcaactgtggcagtttcatcaatggcatccgttacaagatcctggtagtaatattgatatatcaaagtaccaattaaaccatctgcacaagggtatccatccacctgtgtctgataccatgtaaggcattctttcacatctggcacaaagaaggaaaaaaggcacaattctacaagattggattttgaaagaacttctgtttgaagagtgaaaagaatagatgtgacatgaatggacagatgaattaggaggcatacagtgtaataacacaaagaaattattgtgggttcatatctaaactccatcagaaaatatattcatatattctgtaacatgaacacatttaatctatagtggttgttctcagagtaacagaaaaaaaatattcttattattaagttcactttcagaaaaatataattaaaaaccacataggacaaggagagacaaagaataaatttccttgaatcatctaaaaataaatgtatcaatatagcaacataccactgtgggctcttcatccttcctgcttcattaattacagtccagtgacacctccatgcccagtcctagctaaaaatcatactctcaacactaaatattaagtctcagattctgacaagtatgttcatgtcagtagttacaacaagcaaaatatgtgaaatcaggattatagctgtgggtgctagaagtggattctctgtcctattattctccattttcacacaactacacatccatccatcttccatctttccgattctgttctgtgccctcagaggttgacacccacaggccaaatcacttgggctcccttgtcctgcaacctccagttgggttttgacaaggggaggtaccaggaggtcaatgggtacagacggaggggagagagagagagagagagagagaaattgactggggcttccctccatccttcctggccctgcttgcttgaaatctctggttccggtggggactgcaaccctctaggatttaccatccaccagatgtcccttctgctagggctccaattctcattagctctgggaacagcatttattcctcttgtccctaaagacctaacaatagtaacagcttcgcaccatgaatagttcaggtgtcttgacatccttctttgttttttttaaaactgttttcttcagcctcctatctgagggtactgttttcttctggaatctgaactgacacaccctggaattacagggttatgtttccctgaagggaagggtgacaataggaagtactaatgaagatatttccccctcaggatgacatatgctctctaatttagtgactctcccacccccccaccaccccccaccccccaaccccatgaggtcagcatggaggcaccagaggacatatttacaattcttggccttcaccttgatgaaagcagcaatcttggggagagggagaatggtaaggaaaaactgccgaggtgcaagctgtttcttgaccctgtgcccatcctgagctgtataagattctcagagcacaggaaaagaaagccagagccagggctgagccaggtggaggaggggagggctggaagcctggacctctgggaggtgctgccccgccatgtgccctgagggccttgatgtgggagcagaagagatggcctggtgtgtccaagacagtgagggcctggttccagcccccgctcttccaggagctaaaaagagcctccacatcctactgcactgaaaagaggagttggccttgctgaagggaggatggcccacaggggctcacagggtcagggcaaagggttgctcttggggaaagctgcaaggaggtgtgaactggaggcagagctgctggaacacatctcagatgccaaccttaacagcgaagacgcatcaggcatctcagccccttcgggcagacagagacactgtgctggatggtgggacgctgcccatgacacggctcactgtgagctcccgacttagattcaatgccagaaacaggggcagagaggccaatggctgaatagaggagacttccaatctgaaacgcttgagtgtctctcccggtgggtaagattctggtttttacccttaggtggaaggtggaatgggcacactagaacactattcttttctccctctttgtgagcagcttcttcgataaaaacagtctatttttttcccaggtgcacccaagtgttcagtggcttcagtgaataaagtcactggaagatatggggctcatttctatttaattagatataacttttcattatcattattgtgaacttggctttaaattatgcaaatatatataaactatacattatcacttccctttatttaatcctttatatatatatgtatttattcctttaaataaatatatacatatatttattcctttatatatatgtgtgtctataggtctgtgttttcatggccatacagtgggctgcaggccactttgcaggaattcttcctacctaccacacttactgcttagcacacaggtgttcaaaagacatctgtaacaaataactaattacacataattgtaaagtaaagtaaagctagaccaaaatgacataaaatctgaatcaatgtttccatgcagaaaatcctagctttcactacagctttattcatttcatacttatataaaatactcatggtatttttccacatacttagtgctgagttacactcatgtttgctttccattctctgctgtctttttttaataatacagaaattttcatacaaaaatgtactgaacacgtgtagtagcattatagaatcagagcagtagctgcaaatgatttatgaaactatctactctggataatacaacagtgctatacatacacaattacttcataaaatatggaatacaaacatgaataggaatgcctatgacattcaatgtgttttgtcggcctttaaaaacttatttctgaacacagtggcttttcttcttctttaaaaaaaaaaacacattctatcagaatccatctaaactatttcagagatgtgaaaagctgtcatatttgcaaagaccaacagagaaaaaggtattacagttatccattccacctcttgatgccagttaaatatctttgggagctcatttaggtttctaaaagagaagatcatgcaaaatgcttattttaggtctccttaatggagactgaagaatgttatgcagctctctgcgttttttttttctttttatgtctaaattatttgacttctttaaacctttcacctggatacttttcaagttttccacatgcatctttaatagaggaggcctggaaccaaccaaacatagattagaacacctcacttctctaaagttaacctttatcgggcaagctcagtcactcaagaaagagtcaagagccaggatgtagacaaaagaccactgagctgccacatcttcacaggaccaactaacaggcaacagaattgcaccaaagcttgaggtctgtaacctgtactcagatccatcgtaacccacttattctttttgtagacaacctaccaacaaccattaacaaccttgtcttcaacctatacattaacaaaataaaatgcatgtcaggacacagatgacagtacctaaacaccaatagcaaactggagctgatggtggagctacatccacagacatgcactaaagaagaatagatttttttttaatggatgcaatcagaactccacagttttataacttctgaaaaaaagagataatatatttatctagtacttcttatacatgatttttatagaagaaatcgtttaattgtatacacatatatcaacataaaaaaaaggccacagaaatgcaaaaacttttttaaaccttccaatgaccaggaagatatgcactatgatttctcctttgtgcatcaagcgctttgggagctaaagaggcttgccaaagtaaagtagcgcgtccatggaagagagaagaccagattccaggccatttaacccccaaggctactgatctttgtagtatagtcaaagacgcagactcagcattcttaaacttctgattgcctttcactcacttgcctgctcttgcctcctaaatatatgtctgttcttaggaactgtatttggtctttgtagtagtcagtgagggatgccataaccaaacactactgacagggcggcctagacaacagacactgattttctcgtggctctgcagattgcaagtccaaaatcaaagtatctggacgtttggtttctcctgaggcctcctgcgttggtcttcagatatccattgtcttgctgtgtcctcacatagccttttctctgtgtttgtgctctcatggtatttctgccttttcttaaaagcatgccagacctattacattagggcccaatacttacagcctagtttaacatgaattgccttggtaaagaccctatctctaaatacagcctcactggggaggttaaacttcagcaaataaattggccggggcggggggggggtgcagaattcactttccctgaaaggcatatttattctcaatgcttcgattatatctccaatatgatgtacaccaaacctgtctcttcaggtctcaggtcttatttgtgctacagtcacaaatgtatttccaactacctacgcaatattctcattctgatatcctgttagactaaacttgtatcaaaccaaactcattggcatcctggtcaaagacattttcttttctcgtgtccttgcattaatcaatggtttgatttggtttgaactacttttcactattcctgtcttcctcatttctccagccgataagcaagtcttactgataactctgttcaaaatgtgtttgcatttagtcattttatcctccccctctaccacttgagtaaaggccttcataacctcacacctgaaagagcacgataatcatctaccaccttggacccaaggtagatgctcaaccttatttaatgccctcctattgtgtatgagaggaatccattaataggatggtatgtcactcttattgttaggttatgttataagacataggtagctttaagaaaggattaacctaagttagacttaacctaatcaagttaccccttaaaagagacgtagctcatcctggtgaaggagacttcaatcatgagagaaattcaacaagaaacagattgttcattgttagctttgaaaatgaagggagcactcactgtggcacggaatgcaggcaggtgacagtccccggggaagagccagtgaggaatggagtcctcaatcctacaaccataggaattgaattctgccacagctacctgagcttggagaatgaccccaagctcctaatgagatttcagtccttattgacaccttgatttcaatcttgtggcactccaaacacagaacacatctatctatgttatgccaaaacttctgagctacagaaatggtgagatcaccaacaggggtctctttaagactctagatatgtggtaagttgttacacagccatagaaagctaacattacttggttaccctctaattcacctcccactgccacatttatatttcttgttcaattagttcattattttggtgcccttttaccaacctcattgaacattatcataatgctaagggcctatgggtgagtattatatgccttaaacatacacacacacacacacacacacacacacacacacacagacacacacacttcccagagaaagcagttacgtgacttttggaaacataaccaaactgtcaaaagaacataaaactagttactcatatttggaaaggtaattcagtactatttgttctgctatggtgtaaaaaaaatccacaatattttaatggcaatagttattaaatagtgaaaatctagcagcatttacatcaactaatgttaagttccataagtactatgcccaaatattattttatcccttatcatgttaattcctgccattgaaacttacacccagttttcaaagaactttgatttttgcctcacctaagacagcaagtctattcccccaatttggcaatacaaaaacttttgtttcaggcaagccaatgttctcagtgctccactgtgcatctctgttcaatgcgattcctttcagaaccacttatgaagaagaattcctctccatcaatccaaacctttgagatgcatctatgcatctatgaacttcttgttcataaattcattaattaacaaacatgtactgaagtacctactgggtatactagaaatgatgagatgctttttcattggaaattggttaaaactaataaagattaggaagctgtaaaaaaaaattagacaaagatctctatgcaagaatatcaaattatactggtcaaaattcatctctactttacaaaagatgtctgtaaaccacaggaaggagacattgtttttaaaagtatacatgtatagttggctatcttttgcttaacagagaaggaaaataagaaaacatttgcttatctttaagaaaacaagctcaggaagagtaagctggaaacatggcgttgatggaacacaagtggtggatggaggtagtggagggccaggaggaggcaatgggaggataggaatgaggagggaggcagccttctctgcagggaattttttgtatagattttgctcctggaaatatgttaaaggtccaaatacattcagtcaacaaaggcaggacaatcctataactgaaaacatactgaaacaaataaacctaattatatctcaaatggatatcattacctctgtgaagggagaaaaaaaaagaaatagaagtaatccaagtgattataattcatttggaataggccttttcctcacctctgaattgcaggggttgttggtatttaagtgattgaaggtcgtctcttatgttgccgcaatcccctattattttggcaggactcatgactcgtctaaatagtcagttttcatcttttatttatgctgtttttttctcctatgtacacactatagaaatggaaacttcactgtagtaaacttttccctctttgttaatgaccactgctggcctaaaaatgttacctttattttaacactgctgcctatggctattagaaaaagttgtttcacacataaacatacttcttggaaccaaaaactttccatataactaaaatgtaatgcttgactcatccagttctatctatctatctatctatctatctatctatctatctatctatctatctatctatttatccatctgtccatttatctatctatccatctacctgtctatctatctatacttcccccacacttatatatgatcctcttttaacgacttggggaacttttcaacattttgttactccactggcttttcacacaaatggggaaaagacagacttaagggtaccagataaacaaaaattactaaatagctaagagcaactgtctcaagggtcctggggacctggaggccctgctgccaatgctgggacccagcacctccactccagctgctgctgccagatgtgagtgccagggtagtcagatgtgttgtttaactcaagtgaaaatggaaatccaggtttttagatgtaatcaaacagtttccaaatattggcattcaattcaagatatttatttctaaactatctgagggccactcccaacccatctataggtcacattcagctgctgaggacattgtgagacctcagatatggaacaacaaagccaactagagatacctaagcaccaagttatgtattacaaacaagatttgcacacaagggagaaataaaactgggagcagaagtggaaagtgctgcagaaggaagacttgaactgaatttagaaggaaaacactacatcttagagtatagaaaataaaagggaaaaaaaagtttgccaatatgtcatggctaattatgccctcagtgtctttgtaaacggaagtgccaggccactattcactgaaacttagcttggttttaccaaacctcgaaaagttaatattatgatacatccagaaagatgaagataaacatgacatgtttataatgtgatttccccattctacctctaattttttaaaaaaattatcattgctttttttttaaagttgtgagtatgtttcatataatgtttctgatcttttctcaatgtccagttgtttttacttcttgctgggtcagagtataattcttgaacgagcttcgctcttatttccaaatgcttttagaccatgggtccaaaaagccatattagctagaattttgcataaactgaagataagaaaactatgagtgcatgacattcttataagaaaaatgttttggtttttagtttcctaattaagttttgttaaatcaatgttgtcagctctgacttctagtgtctctgtgtcactagcatttgattgctgaataagtattattttggtgtattttaaagtattattatctgtcacaatatatatgattttggaactatttgtaagtatactgaaaattctatatctaaaaccatatatacatttatcatatagatacacctatctatagtatctatatctgttttagatacatattttacatatatacatgttaatgtcatgttaatgacatgttgatatcatctcttttcttttacatgttttaatctttttcttgctcaattcccttgactatttcacaatggaaataaaaaagaagttcttaggaccaaatcttctataaccttattacacaattgggttatttctattattttttaaatatatggaaaataatcttcataagttccctttctcccaaatagtatattgtaaatattcttatacaattaaagatgggtcagaaaaagaattctacaagaagtaaccctaaatgaaccctagtctacataacaaaagatgtacaatggtcagagatggcctgactgagggtgtcgggtaatttggtaatgctggttcacaagaaatgatggttctaaggggctgcagggctggagagagtaccagacacccctctctgtggaggccactttctagtaaatgatcagctggtgttaacccctatggggcaatttccaatatgagtaattacttcttgtgcatctaaatcttccctgaatgtgcagctgggaatactttcattacatgttattctttccacaccataaattaatccctacacgtgctgtagatcccctgtgaatctcaaaaaggagttgcgaagattaatcatttaatttgtgtgaattgtgtgaaaattgttttcccctggctctttgagaagctcagtatatgctcagctgcacacaacggaagtatttgaacaaattaatttactgagcaactactatgtgtccggtactacgccaggcagtgggagaatgaagaaaattattagacaatctctgacttcaagggatttattagctagtaacaaaactgaaatgacatggttaggccacaacctcaaatgcctatggccaacgaggcagagctaagagcaactgtttcaaaggcccaggcacgctgccaatgctgaggcccagcacatccactccagctgatgctaccgatggacacgatcaccagtgtgtccaggtgtgttgtttaactcaagtgaaaatggaaatcctgctttttatgtgtaattaaccagttctccaatgttggcattaaattcaagatttgtatttttaaaactatctatctgtgggccaatccccacccacctataggtcacattcagctcctgaggacattgtgagaccatggatctgaaacagcaacaacaaaaccagctagcgggatggtgtggtggcttgtgcctgtaatcccctcaatttgggaagccaaggcaagtggatcacttgaggtcaagagttcgagaccagcctggccaacatggtgaaatcccatctccactaaaaatacaaaaattagccagtcatgctggtgggcgcctataatcccagctactcaggaagctgaggcaggagaatcgctttaacccaggaggtggaggttgcagtgaactgagaccatgccactgcgctccagcctgggcggcaaagagacaccgtctcaataaaaaaaaaaaaaaaaaacaccaactagatataactaagcagcaaattaagcaccaaattatgtattatgtacataataaattatgtattacaaacaagatgtgcatatatgggaaaaatgaaactggaagtggaaaatgccacagaaggaagacctgaactgaatttggaaggaaaatactatacctttgactatagaaaatgtaaggggaaaaaaacagtttgatgacatgtcatgattaatgatgctctattgcatgctaatacaatggagattatcctaaatgatggagacatgaccttcacagaaaaatctggaaggcactgcaaacattgaataattttcatataaactcagatgtgaacaacatccatgctcccaaacatttctccgctagtaataagaagatgattatgaaaatgaaaaccttgttcctttcagctattacgatataaaaagtggttattgttaatacattgtgagatcaagagtgttatacagacaagaatgatgaccctaacatttgctttcaagatgttttgaaatatttgtcaagctggtcattgtgtggagatgacatttaaggattaaaggctctttgcaaactcccctctcctggccatgcctggcctatgcaggatcctttctaataagaaaggatgcaaatgcatgggtggtgacaggcacgtggccttcttcaccgtcactgctaccaggaaccgagggatcactacacatgtctcagttgtttgtagcccctcagggtcaggaaacacctttcaaatccacgttttatttcctgatcgatgaaatgcagccactgtggcatattcatgcatctctgctaagaaagaaataatattcatgcatctctgctaagaaagaaaagtcaaaaatagaaggggaaaaaaaactttttgtgggaagagagaaactggaacaaaatgggttggaataaaagattgatgaagaggtattcaatgcttgcagggaaaaaactgggaaaacaattgatgtcaggaagctttagataagacactcaagaatttcattttaatatttattgcttgtagtgaaattgatcggtatctccggcatgatgaggtcatgaaagaagagattgatgcaggcaaattcattatttctgcttctgttctttctgttttgatattagtctattttctcccaataaactatcctattgcatacctcccaacttttgccatttgtggtaatgtaattttcctgtcatcttttatgaaatactagagtacccatctgttgtacgggtagggataaaatagcttccttcagaagaaaacactgactgtaaacagccaagccccatgaaagacaagtgaatcttctagtggtcctttatcagattatattttctggtgccagggcagcccatcttgcttgaccttttttacttatgtacatgagaaaaaccgtgggtcctaatcagtcatatgataatattctgggtttttttttcctagcatagttattcaactaagatattttaatgcaaatactctgatttcaatttattgaaatcaaggaaataaacataaaaaaatggaaacaaacaatgtaatttagtcaggtatcttgaaagatcaagcactacattatgtgtctcagagactggcttcagaagtcagccgctgtcctcagagacatgactgaccttaaaacgcaggtgacaatgataccccttttcctcagagattgtagcaaatcccaactcaaaatctcacaaaaacaaatcacaacaacagagtctcactctgtcacccagcctggagtgcagtggcatgatctcagctggctcactgcaacctacgactcccaggttcaagcgattctcctgcctcagcctcccgagtagctgggatcacaggtgcctgccaccatggccaactaatttttgtatttttagtagagatggggttttaccatgttggtcaggctgttctcgaactcctgacctcaagtgatctgcatgcctcagcctcccaaactgctgggattacaggcgtgagccagaaaatcacaactctatccagaagatgctcctgaatctgacatccagggggataggatcagctgccttcttggatgtggtgaagggatctttatctcagctgtcttgccgaataagcacatggagctgatttcgattgtgcactgcagatcagcaaaaatctttctacttacactgtgcgtaagctgtatggaaaaagttgtactgttgaaattatttttaatattatcacattgtaattgttagattagattttttttaacttttaagctcaaaggtacatgtgcaggatgtgcatgttagttacataagtaaacttgtgtcatggagttttgctgtacagattacttcatcacccaggtattaagccaagtatctattagttatttttcttgataatctccttcctctcatcctctgccttccagaaggccccagtgtgtgttgttccctatatgtattcatgtgttctcatgacttagctcccacttatatgtaagaacatgctgtgtttggttttcccttcctgaattagtttgctaaggataatggcttccagctccatccatgtccctgcaaaggacatgatctcattcttttttatggctgcatagtattcaatggtgtatatgtaccacattttctttatctagtctgtatgagaatatagacgggaagacaaagagagagtaatgaaagataagagctaaagtcccaccaaaccatcttaatttttgccaccaacttaggatacttccctcatgtcacatgtcaaccaaaactgcagctgtctgatccaccgtctcatgtccaggccaggtggcctctcaacatctgtaataccataatagcttcttccttggatgccctgcctctaccaggccagttccccaccatagccagagggccgaagtcctagcaggtgccatggtgacggaagcagaggatgccagaagcagaggatgccagatgcagggtcaggagctgaggaaagcaggcggcctgcagcaagaaaatgggtccctggagcctgcaggagcaacagccctgccgacaccttgttttctgcctggggcattctgacctccagaagtctaaaggaagaaatttctgttgtttaagttcccacgttcatggtaattgtggggtggggggagcggggagggatagcattaggagatatacctaatgtaaatgatgagttaatgggtgcagcacaccaacatggcacatgtatacatatgtaacaaacctgcacattgtgcatatgtaccctagaacttaaattataataaaaatatatatatataaaaaaaagcagcaatgggagactttacagtactggatacatgaaggttttatgtacaatttttaaaaactagtgaattcaaaacaactgacatacctttagggtcaatgaaatttgaaacaaccacagcaaatactttgttagtgtccatattattacataattattaataacattaagtataccatcttttcagtatttaagtgaaaatttacaatcattcagtaaggaaagttttctgatgaccatagcgttctttttacttggtaactgaaatagtgaaaacagaaaatcataaaggctatctttttccaacaaagccctgactggaaagaaataacaaggtcatagtctctgctaacaagggcaactaactttcctgtaacagttgaagttttgttatagtggtttgaaagattgctgatttataactttgagatttaaaacacttgctataagaatagatttgttaaaatatttgttgtagcaaagaaaaatagctgtgaaagatgcttcctgggagatggtttgtacctggcaactcataatcattagctcacaatgacttcactgatctgggtctaatcaaagcatgaggaatctgaaaatcagaaacatagctaagttattctcccctgtaaaatctattatacaggtgaaaataaaagttactctaacgacacataatctcaacttgtttaagtaataataatttttttcctttttttttttttttttttgagacagagtctcgctctgtcgcccaggcaggagtgcagtggcacaatcttggctcactgcaacctccacctcctgggttcaagcgattctcctgcctcagcctcccaaatagctgggactacaggtgcgtaccaccatgcccagctaattttttgtatttttagtagagacagggtttcaccgtgttggccaggctataaataattattatgtcatattcttaagactgctcagtgcttagggtgagaaagccttcccaagggagggtctgttctctcctgcctggtcatagggcatagtacatctctctccatttattttctattctttgagacaattattcctcatgttccaatattctttttcttttcactgtctttctgtcttgaataaatctccaacatcccccacaactatcccttttaagtttcagatacccagacaacaaagcacataaccaagacgcttgatcacacacacgtgcatgcatacacgtacacacttatacaccatgcatatatgtgtgtgtttgcacacaaaaatcttgcttcgcaaacagaaggcggcatgtaaataactgcttggaactcattggcagataaagaaacagaggagatgtcaattatttaagataacaaatgggtcttttctcttagtattgctcccctgccagagcaggttcaatcttaagaattttacctttatcccacccctctgccactgtttcattttatggccttaggactgtcatttggcttttccttgaccagttctttccataagacttgctggcctttgtttcctttctgatttttactgttctcttgtccttgctgccctcactgtaactggcttctgttcatttctccaacctgtcaagagcatttagaatcccattcctacccagctaggttctgttgccccatctgactttacgacatcctcatgcaaggtgaccatgtactctactccatcaccccagtcactgacgaagagccctgggcacagggctgacccaggcgatacaacacctgtgtctgccaagttaatggcattccattattaattactcgttaggagaaatgtgtgggatgacaggggataacacacacctctaacattcccagacatcgaagcaagcatctcatgggcttctgtggaagttcatttacataagtggttcttgatcctgatcttgtagaggtcataaagcctttgtggatcggataaaagctatggattatcttttcgaaaagctgtgcacacacacatgccacagcattttgcataaaatttcagaagattcaaggatttcccttgaagtacatctctagaactcctggagtttagaacattcaggttaagagtatctagtgaaggtaattttaaatattgtagcatctacattatctttaaaagaaatgtacactagatgccagaagaaaatataatttgaaggattttctttaatctagatgatatcacatatataccttaaaaataatcttgattgacctatgctctcaggccaaagaaagaattattcatgcaatcaaatgaaaatgatttttttctgctgtaaaaagtaaaattattttttaaattgtggtaaagtacacatttcatacaatttgccatcttacccatctctaagtgtacagttcagtagtgctaaggaccacagttgtgcagccaatctccagagccatttcatcttaaaaaactgaaactctatactcattaaagcattacacaataactctcaatctcccccttaacccagtccctagcaaccaacattttaccttctagtctctatgaatttggctactctaggtagttcacagagtatttttctttttgtaactggcttatttcacttagcatcatgtctcaaggtctttgttgctgcatgtgtcaggatttcatgcgttttcaagggccgaataatattctattgcatgttgcatgtatatactgtatcaatttttttttatttttttgaaatgtagttttgctcttgttccccaggctggaatccaatggtgcgatcttggctcactgcaacctccacctcccgggttcaagcaattctcctgtctcagcctcccaagtagctgggattacaggcgcgtaccatcatgcccggctaatttttgtatttttagtagagatgggtttcatcatgttggctagactggtctcaaatccctgacctcaggtaatccacccacaccagcctcccaaaatgctgggattacaggcgtgagccaccatgcccagccgctgcatcagatttttgtttatccattcacacatcaatgattacctggattgtttccaccttttggccattataaataatgctgctgtgaacgtgggtatgtaaaatcaaatttttagcaaagaaatcttactgctgtgtaaatactattgtttgttttaaatttttgaaacttttaaaaatcatttcattgttaggcacaactgacaaaaagagaagtacacaaaacaactcaatgagtcatcaggtagcaaacagtcatatcgccaccacccaagtcaagacacaaagaaggtttccatgtagcgcttgctctctgaggtgtgtctactacacaacacagagttcccatgcagaattaatctggtctccccaagaatgctgccagacagagattagtaatcccatgttctgggttgagtaaagggaagcttagagaatgtcttacaaggtcacatagctagtaagtgatagaaataggattctaaacatcagcctttttcaccccacctccacatgggttggactacatagaggccagctggtgcagtaaaacacatcaattatattaaaattatccagaggtataaatgtgactcatacttggttaatgaccacattgtttatccttttgatattcttcattgtgacttctgaccactgttctaattttgccctttagagtaatttaaacagatgccttaacatttccacatgcaagatcctaagtagctaaagaccgtgggcacatccccaggaagactcattcccaggaattctccctaggttctctcagggaacggcatctccaggcaacttactcccctgactgtcctcttgtggtcacattagtgtgttaacacccctagtaagtaaaggtatgtccagaactgacactgaattttagatgttcactatcaacccaacgaacagttcattcactcattcaacaaatatttctttagagctttgcactattccagactatacctcctctgacaatgctttgattaatgcagggaaagtcacaggcacatttttctactcttgccacactgttgtcttatactgaacatgggatcaagtaaaatctgtatgcgtttcacaggaactactgccaaggaaggtccccagcatcctatatttatataattggtttttcgaaatgatctttgtgctgtcttcacagtagatcaccagggtttcatgtggtaatatttcaaaattagtattttggtggttgatcaacagaatccaataatattttttaaatgttttttcagactttaaaagttaaatttttatatctgtttagaaagaatcctttccttccttatatgcctctccttccttaaaaacaaacaaatgaagtgtgtataattgttctctgttgttatggtttgcatcttatagccatgaactctaacgaccgacttcctatgtgctaaaagtggtaattgatctaactgcattacaatttttcaatataagcaactagttattgaagtggcttaatttggcaaggaaacacctaatgagtcaatggctttattcggttaattcagtgaaaagtgctaatgattcagaaagtttaaggagttattgtaaggccgcctgtaggaaagtactaataaccaagctatgaccaactgcctcaaaagcagggttgccagggtaggcaacttaggatacaaagcactcagtgaaatttgcatttcaaatttgttgttcatctgcaattcaaatttaactggttgtcttgtgttttatctagcaactctattttgcagccttcaacatagcaatgattaattaacaggagatgttaataccagatttacttctccatgggcattcactacccacaaaaaaggtagccaacgtattttgatgtttgacttctgcaaaattagaagacataagtcttttttggaaatggcttaaaaatagaaggggcaggataaaactgcagatgccaactgtcattttccactccatccattcatttcataaaattatacagccagaaaaagatcatttagtccaaatctatttacttagaaatgtcacaagaccaagaaagtatcttacttttcaataattcctcagaatctgacttcgcatctactcaacctatttcattttggatgctgtaaggtcttcagagctagaaaggatgctgcagtaaatctggccatcaggcagctaacaaagagggcacaccagacagcagacaatgggctaatgctggagatggccctggaagggcatgggtcaggttctatgatgtcctggtgatagaagtattccaaggctggacagttctgcaaaagggataggagctggggaaatcaagaggagcagtggccaggaaaaatgtgcgtgacttaggcatacaagatgtataggaccatgaaaaatgggaaagcaaaactccataagaatttttggtaggctgctagttttttaagttacattccacagccggatgtgatagagtcccagtcatgatacctcatgtcactggccaacagggttgattgagccacaaccaggcttatgaagttggctttgcccctactcactgcttcagctgaatatctccctaaactgaacattctggtaaaaatgacatcttcctagaaataagaccaatttaagcataggtgagattcacagtctataatagagaaaaccataatttatgactttttataagctaagtttatcattgctaacactgttctttctttcatgcacacattccaccgacaaacagccaaaaattttaaataaaccaaaaggattcaatacatattcacagttctagacttattggctctagaaattggggccttttccttttgttttatgctaattaggcttgaagtcataatttcccttaaacacatgagcactattaagcgccaattctggggtatttaaagagttacaaagagagtgcaaaaggggaaaaaaaacatgaatacgacctcattcctttctttaaaaggatctcagtatagttaatgaaataagacatatttatatgaaaagttggcatatattgcctgtgcttttatgtaaaagctgcattagtataaaaaacagtaaagattatagaaattcaaagaatccatatcacttttgataggggtgctcaaaatttcattgcagtaaaaaaaagagggaattgaacctggacttaaacagttaagattcaagtaaaactgattatttgagcatctactcaacggggagagtaggcttattcacatatattctctaaatttatgtcatttcattcaaacattaaagcatatcatttaccaataaagcctcaaccatttacttcttccatatttcatatataggtaatgatatggtttggctgtgtccccatccaaatctcaccttgaattgtaataatcctctcacatcaagggcagggccagctggacataattgaatcatgggggcactttccccgatactgttcccatggtagtgaataagtctcaagagatacgactgttttataaatgtgagttcccctgcacaagctctcctgcctgtctccatgtaagacctggccttgctcctccttgccttctgccataattgtgaggcctctccaggcatgtggaggtgtgagtcaattaaacctctttgctttataaattacccagtcttgggtaagtctttattagcagcatgaaaacacactaatacaggtaatgaggtatgctagtagaaattaagtttgtactgtgtttgttttccctatgtcttgggaacagatgtatcagaaactcacacactcactcgattggggagaaacgtggggattctctctacaaagagcacaatcactgaaagtagtctgcctgaaggatagtgtcctatttcaactttgacatgtgatggctcctgagggtagagcattgaaaagaaggcaaaggatggtcgagatacatcccattcacctatttccctgtctcaagtaaatgtatatcctgggaaggacagacagacatgtaatagggagaagtgaggtggctggctacattcagttcagtaattgaatatagatacaggtattggttctgaagtttttttaacatggtaaaatatatatataatctacctttttagtcatttgtagttgcacagttcagctacattaagcatattcacattgttgtccaaccaacaccaccatccaactccagaaatttttaattttcccaaactaaaactccatacccattaaacactcacttcctgattcctacccctctccaggccctggtaactgctattctattttctgtctctaggaatttgactacttgagtatctcataaaagtggaatcatacgatatttctgtgtgactgcttatttcacttcgaatattttccgagttcttccatgtcatagcatgtatcaaaattttattcctttttaacggtgaataataatatcagaatatgaaaaatgcctacagcagcaaaaagtaagccaaatagatgtgaagccaacaaagggcctccatgttatatacatacataccacattttatttatccacttattcattgatggacatttagctactatgaattatactgctatgaacagtgatgtacagatatctgttcaagtccctgccttcaggttttgggggtatatacctagaaatgaaattgctgggtgatcatctatatttcagttgtgtggaaccaccatactgatttccacagcggttgcaccagcaaagtacaagaatttctatttctctacatccctgttgaactttttacttccttttttgttgttttgataatagttatcctaatggatgtggtacttcactgtggttttgaccagcatttccctaataattagtgatgttgagtgtcttttactgagcttattggcgtgattatgaagatttgaaagttacattttataaacatagcatcaatccaggcaggccaaagatataacatttgtgaaagcaaaaacgaattgaaaaaacacaaacaggtgacttttcaatgccattgatcagcatgctacatttagtacttaaatactgaaaaagaaacttaaaaatccaaatatagaataaacggttaagtgtattacgaagcacttgtcacaaaagaacactaagttataaaagtaggaagactggtaggtaatacaccaaaatgtttaaggtggttatttttaagtgtgtttcataagtaagctttgttttattctttacacagtcttcatccttggcactcaagaaatatttcctgattaagtcacaaattgatttttttataatagtgtgtaattacgaaataagaaacaaacatatttgttttaaaaggaaaaataaagtaaactagtaaattggttctgctgtacattagaattgtctagggagcttttaaaataatataaatgtgtggtacttctcttcatcaaagatcagaatctttgggggtggaggagcccaagcatctgtaatattaatacacaaagaaagttgagaactactgttgtggaaaataagaatgaattaggccctttggaagtgttctcttcatcgtccgttgctgcagttgattaaagatgaaccactcaaccagcctaaattgttgacccacaaaaccatgtgcaaactataatagctgttttaatgctctaagttctgatgtggttacttacacaacaacaaattattaactcacttaaaattttccccaataagggcttattgtgtgttaggcacaatacaagtgcgtaacattcattatctcattaaattgtcctaacaaaccaataaggaaaatacattatttcaaatgaaaataggcttgggatgcttacacagtttgctctttagcatccaattccaatcactaatatactaacatttgcctaatataaattagaggaaattaagagagacaaattgcaagatattgcattgtaaatacataatacatacacaaatacacaaaaattcattgtaaataattcatcagcatgcttatttttcaactaatgtaaacactcaacattaggtagtcagttaggtatgcctttggcataactgaataatatatataatatacattgtactcattaggtaacttctcatcattcatcctacttccacccacttaccctgccaagtccattgtctatgactgcacactccatgtccatgtgtacacattctttagctcttacttataagtgaaaaaatgagctatttgtctttctctatctgacttgtttcacttaagataatggcctcccgttccattcatgttgctgcaaagtacatgattccatgttttctatggttaaatataattttattgtgtatatctgccagtttctttatccaatcattcattgatggacacttaggttgattccatatctttgctattatgaacagtgctgcaataaacacaaagtgcaggtatcttcttgatgtaatgatttttcctttgggtagatacccagtagtggaattttaaaactgtaatagaaatacaaaaagccaaaaaaaaaaaaaaaaaaaaaaccaagcattttaagatcaaacaagcaaaaaaaaccaaaaaaaaaaaaaaccccacaaaatttcaagatacttcaccaaaaaaaaaaatatatgaaaagcaaataggtaaatgaaaacatgtgcaacatcattaaccattaagaatgtgcaaattaaaaccattaagacaccactacacacctattagaattgttaaaaataaaaagactatttcaagaattggccaggatattgtgctgctaattgggaatttaaaattatataaccactacaaaaacagttttgcattttcatgaaaggctaatcatatacctcatatggtctagccattccactcttaggtattacccaaaagaaatgaaagtttattatgaaatattgaaaaaatgaaaatgcatttctaaacaagccttgggtaaaagaagaaatgaaaatggaaattaataaaattcaaaagtgaatgaaaatgaagacataacataacaaaatttaggggatgcagctaaagcaatatgcaaagaaaattttttgggactaaacagaaaaaagtttccaattgtcttcacattccaccttcacaaacaaaaaatgaagagcaaatgaaaagcaaagcaagaagaaaaaagaaaacaataacgatcaaggtgaaaaatcactggttgagaaaacagaacaataggaaaaagaccatgaaaccacaactttgttctttttgttgatcaataaaaattatactgtcttgtcaggctgatcaggaaataaagagaaaggatacaaattaccaatgtcagaaacaagagaagtgacaacactacacattgtagagataccacaaggataagagaatattctgagcaattttctacctataaatttggcaacttagatgaaattttacaattcctgtaaaggctaaacacaaggacctactaaatttcaagccagagagaaaagaaaacttgaatagacttatgtctattgaagaaactgatactgcattaaaaaacctcaaacgaagaaaacttttaggcccagatgtcttcactaatgaagtctatcaaacatttaagaaagaaaaagaagcaattctacacaaatgcttgagaaaagtgaagacaaggcaatacttccaatttattttttttcagccattattactttgatacaaaaacaagacaaagatattgtgagaaaagaaaaccgaaaatgaatattccttaagaacacagaaatgttaacaaatagaattcaacaatatgtcaaataacgatacattgtgactgaatggggtttcacccaagaatgcaagtttgatttaacctttgaaaatcaaacataatttaccatggtaagagagtgaaaaagagaaatataatactctcataaggtttaaaataaaagcatctgacaaaaatctgaagtctgtcttatacagtcccacagcaaattaggaaaaatagagaactttctcaacctgataaagatcatctatgaaaatctacagttaacattacatttaatgatgaaagattgtctactttccctctgagattgaggccttaatgttaagtcttacaacttccactcaacattatactggagctgatagccagtgcaataagtcaagaaaaataaaatgcataagattagaaaaaaattagaaaattcctattctcaaatgacttgattgcctccatagaaatttctatagaatctaaaaaatgtcattaaaactaataagtaaacttaacaattatctcggttataaagtcaatatacaaaatatctaaaattggaattaagaaacaccatttacaatagatcaacatataaaatacgcaaaaataaatttacaaacagtttgtgtgaattgtacactgaaaagtataaaacattgctgagtgatattaaagaagaaagacctaaataaatggagcagtatttgctctggaattggaagacgtaacattattaaaatgtcattattccccaaagtaatctacagattgtcaatcaaaatcttagaagatggtgatagaaactgacaagctaattctaagattcatgtgacaatgcagagaacctgaaacaggcaaaaacattttgaaaatgtagtacaaaattaaaagactaacaccatctgacttcgggtctcattgtaaagctacagaaatcaagacaatgtggaattgacatcaagataaataaatatatcaatggaacaaaatgagggtaaattcaaaaatatgttgaccattgagcttttgaccaagtatcaaaggcaatttaattgataaaggacggtcttttaaacaaatggttctagaacaattgactatccattataaaaatatgaactatggtctatatcttgcatctcttgcaccatatataaaaatgaacttgattcacaatagcaaagacttggaaccaacccaaatgtccaacaatgatagactggattaagaaaatgtgacacatatataccatggaatactatgcagccataaaaaatgatgagttcatgtcctttgtagggacatggatgaaattggaaatcatcattctcagtaaactatcacaagaatgaaaaaccaaacaccgcatattctcactcataggtgggaattgaacaatgagatcacatggacacaggcaggggaatatcacactctggggactgttgtggggtggggggaggggggagggatagcactgggagatatacctaatgctagatgacgagttagtgggtgcagcacaccagcatggcacatgtatacatatacatatgtaactaacctgcacaatgtgcacatgtaccctaaaacttaaagtataataaaaaaaaaatgaacttgaaatggatctcaccaataaatgtaaaatctaaaactgaaaatttgaaaaaccacttatagaaaaaaacataagagaaaatctttataatctttgcttagacaagaatttcttagataataatacaaaaatctataaaaatctataaaagacttcatttattttgactgtcaaaataaaaaaaattaaagacttcaaatttaaagatttttttaaaaagccaaatattgagagaatatcttgcaaatcacatatttgatatatgatatattcttgtatctaggatatatataaaaattttcaaactcagtaagaaagcaaacaatcatattgaaaatactaagaaaaagatttaaacaaacacttcatcaaagaaaatacttgagtggcaaataagcatgaaaagatgtgcaacatttttagtcattagggaaacgcaaaataaaaccacaatgagatactactacaaacctatcagaatgtctaaaattaaaaaggctaatcataccaaatactggtgaaggttgggaataactgaaactcccatgcaccgcttctgggaacataaaatggtaatcagtttggaaaagattttggtgatttttacaattgagacataagctgatcatatgactaagctattctactcctagaaatgaaagcatatgtctattcaataattagtacacaatattcagagtaactttatttataacagtgcaatagccaaaaatgtgataaaaacaaatgtcaatcaacaggtaaatgggcaaatactgtggtaagtctacacacctgtatacaggtgtgcaactttctagtgtgtagatttaccacagtgtttacccacttacctgatcatttgtttttatcacattaaatataccagcaacatgaaaaaattttaaaataattatgtttaataaaacaggccagagtaaggagtgcattctatattattccatgtaagtacattatagacaatgcaaactaatctagagtggcaggaagcagattagcagcttcttgaggctgggaaagagtggggaaggtgccgcaaagcagcacagagaacttcttggggaatttctgtgtttactgtcgttactgtggtgatggtactgaggtatacaaagacactaaaattcacaaacatttatatgccagatacatgcagtttattgtatgttgattatgcctcaataaatccacatgaaaagaaacccaaattaacccaaaattatttgtaggggtaaagtaaatgcattagaatacaggtagacaaggagatactggaaatcttgaacagtatcagtaatgctttgctaagcactggcacagggggtccacaggtgcgcagggggtccacaggtgctcagttcataattctgcttcacaacttgcacacacactataaactctagtatatataaaatagtaaaaatattgatccttatatacaattaaaatggcctctatttcacaatgacaaatatgtgtgtatatgtgtacgtatctatgtgtaagtgtatatgtgtacatgtatatgtactggaatgtgtatcggcatgaaggggaagaataaaaataaaaataaaatgacaaaaatgtctcacatgaaccaatggcaatattgtgtcctaaactagtgagtatgactaattcaacttttgcatctgatgtaaaacaaaacaaaacaaaacaaaattactactgttgctttaatccactgggtgatttcccagtaatttaatttaaaaaaactggcattaagaactaagcagaacgaggatattttaatttggaaaaaaaaatccataaatacacaagtaataacattattttaaaattaaatgactgatttcagaaggaaatgttttcaacaactttattagtgctagagccctcatgccacagctcctggaagacttcaggctctcaatttaagctctttgaatgtaaagagagccagacaaacagcttttcttctgtaacactccatttggctggttaacacaagttatcgattctgggatttagggttgccaaatgctttcttaagagctctgtgctattgactatcctcgtttcctctgcacttcttttcttagtcttgggtaaaatttaaaactctttgtaccatttttcaactcatctcgacggaaacagcctcaatttactataaaaatgtcaatggctcactagtgacctaacctcaaaggattgggaacgctgcctcagacatctcttttctatgttcccagggtctacagaggctctaccacaacaagatggggaagcccagtctgtaatccagcaggacagtggaatgctactggtgagacctacaaactaagtctgcagcacagtcctgcagcttccccgaaagctcagcccaacaagcttcctgaatttcacattcattttacacaacatacatgttagtagatatttttaacgtacatatgtctatttaggggaaattattagcatcattattgccaacttacaagttattattttgcaagttttatgccctttagaagtgactttgtaacagtttaaaatattattttctttaggtaaagagtcatatttgaaaaagagtaagtcaaacaaattgtatacattttataaatttgttgaaaaccttattcttagagactgtaaagcaatggagatctttgcaaacatccgtggtcatgtctaatggtgacggcacacataatagccaatcagagctcagtaaaacataagccagcaaatcagaggccgctcatagaaggagtccaaattcctttactgcaggatgaataacttgtaaaatcctaacattcacattctaatcctctgaatgaatgctgagtagggaggagacgaagcttagaagcaaaaggaagcttgcatcctttgatgtcctctattgttgaagttacaacaaattaagacaaaaataatagttatgttagaagacaaattaaatacacgaatcataaagtagaaagaatttttgaagaaatgatattcagcgttcccagggattataagtcaggcaaaattaagtcatgcagcattttaatgtaaatattttgcatgatacatttacccacaggcttatcctaaagcagtatgtttgcacttttatcatttgccttaggatgaaaaaaaatcaatgaatttaagagttttaaacctctttaatatttgcacaatattagatgtgctataatctcatataaaactacctcctagagagcttttgagaattgcttttgcctggggtctctggtactaatacttcaagagattagaaacatcttacttaagaagagttttctttttgcccattaaaatcaaacaagctttgttaaacactgaggcagaagagattcataaatcaatgatactcccctgaactgcccaaggtttgcatcatagattaaaaaccaatctcagaattgaaaaagctacagtgccacatatctgtcacaacactaatttactgaacttaggaagaaaataacactagcatagatttaaatagttttctatgcaatatgcaatgaatcaatgtactgacttgcttggggtttatgaaaacaacaactgacaatgaatatcatcctaagtaaagagaggagttatggtttaaaatcatgtgactacacaattcctacatttttttaaagaataatttacatcaaaatttttctctaactctaccctattatcacagattcttttccttgcattcttttcaatactatttatctgctatgaataatatttccatgtttaaagcattctattattttatgacctaacaaactccaggatttaaacaatgctcatctaacaggaaataccgcccttccaatctaaccttcatatgctttcgttttcttccttttcttctctctgaacatggaaaatgagtgccatttctatgctgaatattgatcaggagagaaaaatatatgaggtgtgagttatattgtgactacggtgattttccatccactcagtattacttatcgtgtcaatcacttaatcctgcagcataagttcttttttgcttatgatggaaagttttgttgtgttttattttttatttttgttttttgaaaaaagacatgagcaatctgattttctttggacttcacaaaatccaagaaagaagatttactgaaaattcatttcttaaaaaatgtgaggtccttgacaatggtcttctctacagtttcaatgttaggttttgaaaatgtgaggtccttgacgacggttttctctacagtttcaatgttaggttttgaaaatgttaggtccttgacaatggttttctctacagtttcaatgttaggttttgaaaatgttaggtccttgacaatggtcttctctacagttttcaatgttaggttttgaaaatgttaggtccttgacaatggttttctctacagtttcaatgttaggttttggtcatctctgagcgtgcataacatgaatggaaagtttttttcggagatcagaccgttatgatttttggaagtgtttcctgtcaaggagaagctcatggtctccaaggtcttatctttctactgggtggatgggccaagggaacacgaagaagcataatggagctctgtctgagagaatcaccagagtcttccccagcgtttctcaatggtctacaaacaggtctgcgggcttggatcacagacggagatccaagatgggcatgggcatttacgtgggcagggcaagcgacgctggccacactgcaaggccctcaacgttcccacgtgaaaaaagaaattgttcctcaaacagcaccactaggtcgggtgcggtggctgacgcgtggaatcccagcattttgagaggccaaggcaggcgggtcacaaagtcaagagatcaagaccatcctggccaacatggtgataccccgtctctactaaaaatacaaaaagttaatgggcatggtggtgcacacctgtagtcctagctactcaggaggctgaggcaggagaatcacttgaacccaggagacaggagacagaggctgcagcgagccgagatcgcaccactgcactgcagcctggcaacagagtgagattccgtctcaaaaaaacgaacaaacaaaaaacagcaaaacaagcacacgtgagaagccctgcttgttctgtgaacacagtcatttctgcctttccttcacagtaattcaaaagcatttactgaacaacgaatgtgtattagaacttacaaagatgggtgaataagaaacagctccttccttcaaaggtctccctatctacgggagaaaagagaccggtaaataaagggccgtgcagacgtatcttataagtgctgagctagcagcaggacaaacgaataaaggaagaaatggcagctctgatattaaagccctcagctcctcctggaaagaggaaccaagccttggtgaagcttcagagaagaaggaacaattaaaacaggctccagggatgaggagaatggactggatggaggaggagcgagcggctgccaaggtaggtgtgcctccaagcacagaaggcagccaatggtcatgcccggttcctgggccagagagcaggggggtggtaccaggtggtgctagggcccctgctacatggctggagtttctcttcttctctagttcattccatgttctaaacacaacaaatcacattgcctccaggtgttaggaccaagaatattaaggtcctgaaccaaaatgccaatatttggtaaaatggcattccctcatttatatatataagtgcgtatctgtatgtgttcgggtacttctataaaatctgccagtttttaacttcctaaatataatggctaactcttttattgtagacaaaataactaaataattgcacagacataatccaacatcatgggtttgattttcttaagggtagaacagctccagccatataaatgcagtgtgtgagtgaaaatgaggacggaagagcgggtgcagcacgggggacccagcagtccttgagccaaggtctggaccctcaaaagcagtggacgtggaaggtggtagctccgatagccagtgggcatatacgcacagagagcctcactctccagctccaaagccttccatatcgatggctccttttagcactacagggtcctaaggagagatgtcaaaaatgtttaacaaccgttgcagcagtaccgggttggaagggactccgtaagcaagttcctacctcctgagcatcaggtctggccttggtgatggtttttctctgtcaaggagattttcagcatttgcagtacattaattttatgcatgaaatttatcttcatgtactgttcctttgtttatttttgagaggaatataaaggggaactaagaacaaacttttgctcgaagccctactctagaaagaattctagagtaacaggatctctaaatttcaaaggaagccaaaaaataaaaaaataaaaaaactcaataattttgtacattttatatatgttttggtagaataaaataaatcctgtaaaaccacagaaaggtaatttaagtacttggaaatctatgtcaatatagccaagataatggaggtaaactaacctggatcagagaaaacaaaagttggaaaacactgagggatcatcttgtcggcctatcagaaacggtatccaatctacaacatcacagcaagtcaacatccgatttcttcttaaggctttccaacagcaagaactttgccatcttacaaggcagtccatcctatcaatgaatagctctacgtcttagaaagttcccctcaggaaagaaatctggtcctctatacctttcatctatcaatccaagttctgtcctctggtgtcctaaagagcaagtcaggtcttttgaaaaagatgtctcttctcatatttccagtgcttatcatgtgcctctataattatgctcttttccatggtttataagcacattgctgatgtgatgtggggtctctgcattttttcttggtgctgtcttgggaagcggcatagtatggtggtatcttctgaaactgcagactccaggcccaaatgggctgtggaaaggggaccttctttatacatgtacataagttctgagcaataaaaaattttattctatctggtatttgtgcagtagctttttataaaagaaagcaaacagcttcacctttgtttctgttatatatcctcctgttggttcagcgcataattccaactataaaggctgaaactgaattctagatattgagtctgtcactcagggcatccgttgttcctgcaagctcagaaccaagtctgctatgcattccttctgtgttttgtacaagcagatggaaaatgtctgaaacaaaaagaaactaaacaggtagtgctttcacatgccactagagatttccttctacttcaactgtgccattgtatttaagtgaagttctggaagttacaaatccccctgttactctgctgtcctatgaaaggctatgaagaaggtgcatgtgtgaaagtgccagctgcttcactgacacactcaccttcacagcctaagcaagggtgttgatcccacttgacacatcaggaactcgtgttgtggaggcattcaacagcccacctaaagccactgagtgggtgggaggcaggtgagtgactgcaatacagaccccaggggtccttcacttacaaacacatcaagagaagacacagtgttgatgcccagatatatcgtttcaggttttccatcactctattacgattttagaaataattttaggcagggcacactggctcacacctgtaatcccagcactttgggaggccaaggcaggccgatcacttgaggtctggaattcaaggccagcctggccaacgtggtgaaaccccatctctattaaaaaaaaaaaaaaaatgccaggagaattctatcacaagaagcacaaggatgatctgtgccccgccataattcaatcgctcccaaccaggcccctcctccagcaatgggaattacaatttaacaggagatttgggtggagacacagagccaaaccatatcaaccatcaatcctaaacagtgggtttaactttcctttcaggtctcagaaaagtacacaggacaataaaatatgcccgcttcatcatttcatttatgtatccatcccttcattctttcatgctgtaaacaacataaactgtagctcattcctttcttctgctctatgaaaacatttttacagcttcccatctttcttcctacttatccttggttacttgtcatttcttcagcatttgtacttcccctttcaaaatgtgagcttggtggacaccacctaaattggttttgttagatatcaccccatttttctttctgagtatcatcacatgtcagtaaatagttggaatttattcttccagaaccttaaatcaaattccttcagaggatctagaccctgccttttctagaaatgtggaggccagttttcctaaaagccatagtacgtgtctgattgacctggcattttctttcttgctgactgagacctccgtagcggtggggttattgtctctgacactgcaactcagtatggaatatgtgttccccttgtagcttcctccaccatttttgagaatgcatgttaaccaataaagtcaaaactttaatgacttttagtgggatgtattcagatatttgttcattcaataagtattgatcaatttcttgcaaaatgccagtcttgtgacctatgtagttaaaatgtcacccctactcttccttcccaagaactctgccatctgctctttaaaggttacaaatgctggctcagctcaaccagaattaatccaggcatgtggtttctttggctaacatgttgcattacaaaacgaagtcatttctccaaaatttcacatacaagatttcacatacaattccaaattattaattcctcttgaaaaactggaagacaactctgagactatatatccatagggccaaaaccagtgagagacaagcagcagcttcccctgcagaaaggttttatttctccatgtgaatgaagataagttctccaggagcagtgtcaacacagcacacaacctggcctgcgcccctctctctcctgagccctgtaggcatccaggtttatacctcctgccctaagtaaagcctcaatcctcctctcctttaggacgcacataaattatttctgccattcctgctcccttggattggtaaattatcgtatcagtataaacccatgccatcactagcccatatggcccttcatgaaaaattggaaaaaggcaccctaattctactttatatccatctgttggaaaattgctgtgaattactgattttgtcatatgaagttacatggcttctttatcccagaaatttatcataataaataaccaatagcaaatcttggaatcgcactgtgtgaatggtgtccctccacatgagacactggcaggcagggcccagacagcaccaacatccacgacagcccccaacccacacctgcttgtcacctactacagttccatccaatagcaccaccaccaacacttccactgccccacacacagcttcatgaaggccattatgccaaggggaggttttttccttccaactattatttctatgaaattttttccttctaaaatttgctctccaaatattttaccctgcacagggctctacatgctgctatttgaaagaccagtagcagaatcttcactaaccttccaaacagatattttgagataatattaaggggactttatttccatagtttaaagaaatattttgccctgttactatactttttcctattttgaattttaactagagaaagagacccatatattcttgatgtgaaaagggacaagttactctttctctgctactctctttttataaaaaataaagcaaataaaatgccacattaaaatctttttttttttttttttgaaacagggtctcactgtccctcaggctagagtgcacatgcaggcacacctcttgtcattgtgcttcaagttgttgtgctttgaagatactgcattttttaacaaattgaaggtttatggcgaccgtgcatcaagcaagtccacaggagacattttgccaacagccatgtgctcacttcatgtctctgcatcacattttggtaattcatataatatttcaaacttttccactatcattatatctgttattgtgatgtatgatccacgatcactgacataaatatcgtctagttttggggcaccaccaaccatgcctatataaaacagcaaacttataaatgttacatgtgttccgactgatacgccaactgcctgttagacactgtctctgtctttctcctcaggtgtgcctcccgatagcctgagacgcaactatactgtattagaccaattaataatgctacgacggcatctaaatgttcaagcgaaaggcagagttgcatgtctctcactttaaatcaaagctagaaatgataaagctcagtgaggaaggcacgttgaaagccaagacaggctttgcaccaggttggctgtaccaacaagttagtcaagttgtgaatgctaagaaaacttcatgaaggcaatgaaaagtgctactccagtgaacacacaaacgaaacgaaagcaaacagccatattgctgatatggagaaagtctgagttatctggatacaagatcgaaacagccacaacattccctaaagccaaagcctaatctaaagcaaggccccaactcccttcaattctacgaaggctgagagaggtcaggaagctgtaaaagacaaggttgaagctagcagaggttggttcatgaggattaaggaaagaaactgtctccatcatgtaaaaatgcgaggtgaagcaacaaatgctgctgtagaagctgcagcaagttatccagagcatctagctaagattggatacaccaaacaacagatattcagtgtagagaaaacagccttttattgcaagatgccatctgggactttcatagctagagaggaaaagtcaatgcatggcttcaaaacttccaaggacaggctgattatcttgttaggggcaaatgcagctggtttaaagccaatgctcatttccattaaaatcctagggcccatcatgctgaaatttctgtggccatgctctataaatggaaaaacagcctatatgccagcacatctgtttacagtgtgttttaccgaatattttaagtgcactgttgagaactccagctcagaatattactgcttattgacaatacaactggtcacccgaaagatacacaaggagattaattttgtttttatgcctactgactcaacatccattctgcatcccatggattaaggagcaattttaacttgcaagtcttattatttaagaagtatatttcataaggctatagctgtcccagatattgagtcttcttatggagcttggcaaagatctttgaaaaccttctggaaaggattcctcatcctaggtgctctaacaacattcatgattcatgggaagaggtcaaaatatcaatatgaacaggaattagaagatttggattccatctttcaatgacttactcctcagtggaggaagtcactgcagatgtggtaaaaataacaagagaacaagaactagaagtggagcctgaagatgtgaccaaattgctgcaatctcattacttgaatggatgaagagttgtttcttatggatgattttgtttttgtttttgagacaagagtcttgctctgtcctccaggctggagtgcagtggcctgatcttagctcactgtaacctccgcctcctgggttcaagcgattttcctgcctcagcctcccgagtacctgtgattataggtacacggcaccacgtttggctactttttttctttttcttttttttttttaattgttgtatttttagtagagatggggtttcgctaggttaggcagggtggtcttgaactcctgacctcaggtgatctgcctgcctcggcctcccaaagtgctgggactacaggcatgggccactgcacctgacctgtaggttggttttgagacataatgctatcgcataattaatagactacattacagtgtaaacataacttttaaatgcagcgggaaaccaaaacactcatgggttgcactttcttgctatatttgttttaccgtggtcttctggaatctaacctgtagtatctctgagggtgtgcctgtaacaataccagagttcattttttctaaatataccttttgttaaatcaccaccattttcttaaaaagcaatatgtttatgccaacaacatactcagagtgagattaaattctttaaaagaagttgactttttgaatgtaataaacttaatatataataattacatcaaactgctcttatttctcctattttatcgctcaccagtgattttgataatgccttcttctcctcacccttctacacagttcaaggccaggcctgccattccttcagaggtagagggctacacaactggtaagtccatgccgagtgaagcgagggtggccaactcttccagcaaagagaggggccctgggacttgagactttaagtgctgaaacaggaaacgtcctgggtaaactggggaggattggtctcacttaagggcaactagattcaagtaattacagtgattctgccacacaccttggctttctctgagcagtgcggcccatctcacactggaatgcgtgatgctaaagaacctctacagggtaagcaagggcagcaaggacaatggaatagttgggctccatctgtgaaataccagagcagcaaacaggagtatgagaggtttccataacactttctgaagactgtttgtcatttttccacttatctaatcaggtgttttcataaaactcaacagaatatgtatacaagtataaaatgtatacaatgtatacaagtataaaatgttcatattactctatcttcacctcttcttctttttcactagaaagatgtcacactctcaatgccaatttcagtctatgttacagctacaacgatacctcctctctctggaagcctcaggggaatgtctgggtaatggagagcaccgtatccacactttacaattttaaaacttaaagccacacatctgcggcacatgacagtgccaactgccaagtactgaactgacagagattcacaccataatgctaattctctgcacaaggaaggaataaaagtatgtgtcaaaaatctgaaaatgattgatgcctgccatctcatcaagactgtctgtcacacgatttcgattgatgatttgagattgcatgtgagcgggacgcaggtgctgcaggttgcctaactagctcaacacttattctcaacaacacaaagacaaattaatctccacatcagaatactttccataaagttcattagactttactacatctacaaaaggcttgaggtggttggcctaatctcagggatactaaattcctaaccatagaggacagctcaacaaatcagccactttcaaaggtactggtgagtccaagagacccaaaaatgtgagaagcagtgctctggccattgtgaaggcactgaattgttttcatcactgggggagaacatatctactctcagataaggatatccctggattttctggctgtccagttgagactgctaaggactcggtcagaggtgtaattagaagaacaacttgtgatttcagtgattatttctaaagcacacagtactgtttaaacatgactcttatgtatcttgtgactacaaatattgaattagtaaactctcatctctaaaaaggaaccccaaatattgacttgaaaataaccacttttagccacaagattatagatgcaacctgttgaaccatttagtatgaatctgcctaattaagcaagaggatttcaaataaccaaatatttctattataaaacacaacccaaaataacagttaagaaaagttatctcacctcccccatcctcacataaccaaggtatttgaaattgttttaatatttgcataaatatttaaaaagtttcacctttaacagaataggtaactagacgatgcctcatcttttctcagagttcaacacatttggacccattctttagatgaatgcacttgtttataaaaatgtgtgatgaatgtcactacattagcacgtaatagataatccaagttattttcagacttaatcagttgtaagtaaagtgtgagggatttgagaacacagagagagggctggtggctctgcagctcctggtcaacatggaaaatatgcagcatttcccgtggagcctctcagtctcgctggcagctgcaggatcagcaggtctcgatccatcatcattcctccttggccccatacgggctgtgaggacacctgggtctaataacagaagctaatcactcggcagtcatttatgaaagagacataggaatggaaagaaaaccaggaaaaatgaaacagatgaatacaaaagtacgctgaagagactgatgttaaatggaatgggattataggatattttaagaaaatgtgagagtattacaagtaacaaactacttctaatagcaaaatattgccataaaaatacattattaatgttacataatacacaatatttcattataacatattataaatgcatctttaaatatctttaaagttttaagaggataaatctaaaaattaactttccgataagtttggaacatgcatagaatgtagagatttaactttgataaataactctgtactaggacagtggcccgggagacagaaggagaagaagcatttgctcctgacttcaaggttcttaccatctccaggagagacaaatgtacaattataaccacagcaggagatgataaggctaataggtaaatctaaaagaagtagtctctgaaaaagagtgttctctccctctccctctccctctccctacggtctccctctctttccacggtctccctctcatgcggagccgaagctggactgtactgctgccatctcggctcactgcaacctccctgcctgattctcctgcctcagcctgccgagtgcctgctactgcaggcacgcgccgccatgcctgactggttttggtggagacggggttttgctgtgttggccgggccggtctccagcccctaaccgcgagtgatccgccagcctcggcctcccgaggtgccgggattgcagacggagtctccttcactcagtgctcaatggtgcccaggctggagtgcagtggcgtgatctcggctcactacaacctacacctcccagccgcctgccttggcctcccaaagtgccgagattgcagcctctgcccggccgccaccctgtctgggaagtgaggagtgtctctgcctggccgcccattgtctgggatgtgaggagcccctctgcccggctgcccagtctggaaagtgaggagcgtctccgcccggccgccatcccatctaggaagtgaggagcgcctcttcccggccaccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccaccctgtctgagaagtgaggagaccctctgcccggcaaccaccccgtctgagaagtgaggagcccctccgcccggcagccgccccgtctgagaagtgaggagcccctccgaccggcagccgccccgtctgagaagtgaggagcccctccgcccggcagccgccccgtctgagaagtgaggagcctctccgcccggcagccaccccatctgggaagtgaggagcgtctccgcccggcagccaccccgtccgggagggaggtggtgggggtcagccccccgcccggccagccgccccgtccgggagggaggtgggggggtcagccccccgcccggccagccgcgccgtctgggagggaggtgggggggtcagcccccgcccggccagccgccccgtccgggagggaggtgggggggtcagccccccgcccggccagccgccccgtccgggaggtgaggggcgcctctgcccggcggcccctactgggaagtgaggagcccctctgcccggccagccgccccgtccgggagggaggtgggggggtcagccccccgcccggccagccgccccgtccgggaggtgaggggcgcctctgcccggccgcccctactgggaagtgaggagcccctctgcctggccaccaccccgtctgggaggtgtacccaacagctcattgagaatgggccatgatgacaatggtggctttgtggaatagaaaggggggaagggtgggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaagtagtctctgatttttgcaattttatttcgtgagaaccaagaaaatcagaaaagctctctaattctatgcattttgtcccaattactcagtttctctatttcaagtaaattggatataacacttgaataggattctgccttgataagtatttatccaaccttattctaaagtttaattcattgttctgaaaattggatgaaaaaagtgaacttcttaaaggtttgtgaataaaaaatatatagtcaaaccataatgaaattcttcctgaataccaatgtctagacatttccctgtagaaaactggcagatatctaatagagtattgcttctgaaaattaactgtgtagttctgtggtacaaaatcacttgtaaaaaatctcctggtgtcaaaacagcatggaactggtaccaaaacagatatatagaccaatggaacagaacagaggactcagaaataacaccacgcatctacaaacatctgatccttgacaaacctgacaaaaacaagaaatggggaaaggattccctatttaataaacggtgttgggaaaactggctagccatatgcagaaaactgaaactggaccctttccttacatcttatacaaaaattaactcaagacctaaacgttaagacctaaaatcataaaaaccccagaagaaaacctaggcaatacctttcaggacataagcatcggcaaagacgtcatgactaaaacaccaaaagaaatggcaacaaaagccaaacttgacaaatgggatctaattaaactaaagagctttgctcagcaaaagaaactatcctcagagtcaacaggcaacctaaagaatgggagaaaatttttgcaatctatctatctgacaagggctaatattcagaatctacagggaacttaaacaaatttacaagggaaaaaaaaacatcaaaaagtgggcaaaggatatgaacagacacttctcaagacatttatgcggccaagaaacatatgaaaaaaagctcatcatcactggtcattagagaaatgcaaatcaaaaccacagtgagataccatctcatgccagttagaatggggatcattaaaaagtcaggaaacaacagatgctgcagaggatgtggagaaatagaaacacttttacactattggtgggagtgtaaattagttcaaccattgtggaagacagtttggtgattcctcaaggatccagaatcagaaataccatttgacccagcaatcccattactgggtatatacccaaaggattataaatcattctactataaagacacatgcacatgtatgtttattgtggcactgttcacaatagcaaagacttggaacaaacccaaatggccatcaatgatagactggattaagaaaatgtggcacatatacactgtggaatactatgcagctataaaaaaggatgagttcatgtcctttgcagggacatggatgaaggtggaaaccatcattctcagcaaactaacacaggcacagaaaaccaaacactgcatgttcccactcataagtgggagttgaaaaatgagaacacatggatacagggaggggaccaacacacactggggcctgtcagggggtggggggatgggagtggatagcattaggagaaatacctaatgtagatgatggattgatgggtgcaggaaaccaccatggcatgtgtatacctatgtaacaaacctgcctgttctgtacatgtataccacaacctaatgtattaaaaaaaaaaaaactcctggtgtcacttcggccattcaaagtcaaatgttcttctaaatctaggtattcattaaattaacattgtagagggtttgctttttaatgaaatagttttttttgaaacctcactaattggtatagtgactcttgcatggctcttccatcggtatacatatttaagtttgaattattgctaaatcctctttgtgaataactaacttggccttgttctttagttctgtgtcaacctatttggtagaaagtggcaaaagtagaggcaagaatatttcaaatcatgcaagtgatgctgaactcagtttctgtcatatatttaagcacatctgattatggccaacgtttcccttcaactttcactctacatgattgcaatatagtttttccacgagtaagtgagaagtgcagataatactttcaaaacaaaacaaaacaacgttggtgtttaataagaccctgaataagctattgatctgtgaattagcaccaggcacgatgtgaagtagtttacatatattatctcatatcaccttcttaataacttaatgaggtgctattatgataaatattatagggtgaaaaggactaatcattaagaagtcaggtcacttgccaaagtttacatagtaagtaagtggtggacctgggattttgactcattgattaattgacacgacaaataattaagtgtctactatgcaccatgcagtgtgctagggagggaagaatcatttacttactcctcagtgactctaaggcagatttaaggcacggcttctctaagctcttgtgttgtcatttgccgcatgacacagacatagaaactagagtgattttcctccttgtcaagcccaatcatggtgatgattttaaaaaatattattaatgattacctttggcttctaatccctaacgtgatatacttatctactgattacagaaatctttgcttagttttattttccaagcaaacacaaaatatgatggtaggaaaaaagagtccaggttgctcctttcataaaatcttattcctaggtttctctcttgtggcactttaaaaaaaagtatccatgaaagccaaggattgatgtaaataaccattaggaagagcttaatgttgacaagtagaagtcgagtttgttttagaaaaacaataggaaaacctgttatatactgtctgcaatgctaaataaatatttctcatcagaagaaatatctgcttattacatttttgtcttcctgattagtatgctttattcctgacatcaacttgaaaaaagatgcaataaatgagaagtttaaataacacaggtataagactgttaaccttgggatcaagggattatttgttaatatttttaaaatgataatacctttatattaaggctaggttctagacgcacctcacattctccacccctttctggctttgcagaagccatgactgggtctgtggaataaagccttagccatcccgtgtggttgttgtttgctactacagcagtagccatagctcttaccctcccctaggaacagcaagttgcattgctatcctggtttcccagaaacagtaataagaaaagagtaggaagtataatggtagactacatggtggcactagtggtggatcaggtgaagtatattggatatctgagactagatggggtttttttaagtgtacttacataggatcaaacaacatttaactttctgaatatgcatttagtaagtataaggcacaagttgtttctgtacattcattttcatggaaggggtgtgtgtgtgtatgtgtatgtgtgcaagcatgctcacaagtgtagaagacagggattatagaagtaaaataataatgcaagatatgcaaaatttaaacagttaaaattttaggaaacctacatgatttctaatgttgcaagataagaaagcttctgctaaaaccaacatatacaaaaacgttacttatgaaatacttttgtagagatttcacccatgagcaatagaaaaaaaggaaagttatttaatatattagaaaaccctaagaaacgtggtctgtggtcactccctctctggcacctttaccacagtgatgacagagctatgcggaaaagaatttctgtgccagttcagccatctgctgttggctcacaaatggagttaacagtctaaaaggaaagtttgttttgaggtgccattcccatgtgcatacaatccacaaactgcagtgtataaacgtggctcagtctaataccaagttaagacttggtttttttgaagagcatattgcacagcattttctggaaatgctcccaatattagatacatgtcacattcgcatagaaacatatggtcttcaatgtgcaatctcaaatcgtctacagagactctgcaatcagagattccctgttttaccttccttttataagtcaattttcacttagcaaactatcacactgtggtgatttggaggcattattttaattcctaatgtaaatttacttttaacagatgtgattctatgaatcatatagcagcatatgatattagttattagctgaaatgatgccaaggggtgttacgtgctggaaactagagcaactgagccaaaccaaggtcacccccatcactgccctcacagctgggtcagggaggtctggcctggcccttgtccattctgaaggttgagagaaaaatggcgtctttatgatgccccctgcccaccgagatactcagatatatttcgccctgtccttgaagcagccccactactactaacagtggctctgaaaatgtggacttgacagatagtacctgtcactggctttctatccaggctccattcctttctgggctgcaggtttgaaaatggatgtgccccagggaacctgaatacagtgagttcacacacaagcaggaaagaagtgagtttcttttggtttgggttgaagcagttgctcaaacgtgataggcagaagaggtaaggatttcactgtgctttaacaaaatgcttccatggtaatcagtcctgtatactgtataatcactatacagaaacaaagtgtgcaccaaaaggtaaagaattttcctaggacaagaccgcagctccacaaacaaccaaggaagctgttcagaaacctctttctgtgctctcttactcccctgagttcatccccaggccccagggcctcccattccagatgtgaagaggtgaagaccacgcctggaataactccgaatacaacacaattgctcctcacatatcagctgttcttttccctgttcactactgagaaaacatagataaatcacggcactttctgtctagcattgaaaatggtcattttaagaatcagggcagatgttggctacacacagaaagctgcccaagggtaggcttgaagcaaaataaattaagaaacccatcatgtactcttgagtgcagggaaacaaactgataatagcaacaagtatgcatccttttcaagtaaagataatgagtcaacctgctgattgcatattgtggtgactgaatacattgtgcaatgattaacaaaagaactgattgttcgtaattcaaggaatatctttccatttactgaggctttacttaacctctagcaatagttttgtcaagttattcacaaaggccgtataaatcttttgttagattattccaaggttcagcatatttttgatgcacgcaattttaaatggtagcttagaaaaatcacatcttctgcctgttgttagcatacagaaatgcaattgatttcagtatgctgaatttttattcagcaaagttatacattctcttatgaatttatatgacttatcgttatattcttttgagctttgtagtcacattagctatgaataatgataggttcttactttccaaccttgaaacttgctatgttttgaatgtgtccctcaaatttcatatgttggaaacttaatccccaaattcgtatgttgatggtatttggaggtggggcctttgggaggtaattaagattagataaggccatcagagtggggccctcataatgagactggtggctttataagaagagaaaggagatcttagctggcatgctcttgccctctgccatgttatgacacaggagaaaggtcctgaccagataccattgccacgttctaggacattccagccttcagaactatgagccaaatgaactcttttctttgtaaattacccaggctgtggtattctgttgtaacaacataaaacaaagacaataacttttgttcttttactagccatattcctttcagtggactggtcataatgaatataatcgtgttttttcccaatcttaaaaataacctttgagcatttttgccgtattttccacagtttttaaatagatctttttctattagattaatgaaaatttggctgggttcagtggctcacacctgtaatctcagcactttgggaggcaaaggtggatgaattgcttgtgcccaggagttcgagaccagcctgggcaacatagtgaaaaatctgtctctacaaaaaaaaaaaaaaaaagctagccaggtgtgatggtgcatgcctgtagtcccagctccctgggaggctatggtgggaagatcacaggagcccaggaggccgaggctgcagtgtgctgcaattgtgccactgtactctagcctgggtgacagagtgagaccttgcccccatacccccacccccaaaaacaagaaaaaaaaagtcctctatttctagtttgatacgtttttaaccatgactgcatgagaaattttttaaaatactttttcagcatctactgagatcatgtaattgttttaatctgtcaatatggtaaattacattattgattatttatgtttacataacatgactatttcatgttactccagacaggtatatctggaataaatcctagagggttgtgagatatatatctatggatatatacatatatctatatatgtgtctatatctatttctaaatttgctttcctagtatttgtagtcatatcatcctttaacaacattttaatttcagatttatatttgttaagtgtacttttttattcctaatattatttgtgtctttagtatttttttcttgatcagtcttgtgagatgtgtatctattttctttgctttttaaagagcaaactattatatttattatatttattttatttttttctttgttgatgtctggaattatttttattattttatttatccattttctttaggttctttctgttgtcttttttctgacatcttatgttggatgcttagttcactaattttcagcctctgttcctttctgatgaaaaaaaaataaagctcaccaattttccttgaagagccattatagccacacatgtaaaaggatcaatttttagtatatagaattttttttttattttgtatttttctacattaataataccatctaatttcctttatgatttcttctttgatccattagttacttaagaggttttcttaattttcaatatgggttgacctagttaagttttctaacttcatttcattgtattcaaagaatactgggtataagaaattaatctttggctttgatgattcttgctttatgacttaaatatgtgtgtttgaataaagagaatgtattatttgtgatgaatatcacatttataaatttgtgtcagatatagtacttatgtatatatatatttttatatagcatttgttaattttattgcttaaattttatctatggctccctcttatttcactgagacaaatagatttagaaatctcccattacattgctgaaatgatctatttcttcttttaaaaagagcttcaagctcattcatatttttttggtaattattttacttgaaacaatggttttgaagatactggctatcaagcattgaaaactaacaatccctaagagacagaaacaaataaggtgagtcttaacattactccaacttactgccttgagagcgtttccaggctggggcctaaggctaaagtgaggagataaagctgagagttgagggagacgatggcctccaaatttcacaggacaaaatattggtgagaggtgctcagagacagagtgtcagagatctgcaaagacttgttcaagtttatgcatgtgagaaaactaaaaagaacctacccaaaaggattagagataacagtgtcagggacccacgagggtaaggaacagtgcctcttatacccaccagtgaaactgaaaaccttgctggttcacagagcattgagtagaatacacagagtggccggcctctggtgggcaacagtaagtcctagactgacccttattccagttctgcctaacaaccaacaacgtgacctggaaggataaaactatttccaagtaacttaactcggtcccagaacaacgaccaaaaatatctgtagaagagaaaaaaacatatctaataatccacaaagcataagtcacaatatctgatatccagatattgtggtcaacagaaactgacgaggaatgcaataaatacctatattagaaaagaagatctcaaatcaatgacattttctataatataaaactaaataaagaagaacaaattaaatccaaagaaagtaaatcagagtcaaaatcaattatataaaacagggatggacaaattttttctgtaaagtgtcagacaataaatattgtcatctttgtaagtctcctatggttttgttgcatattcttattatttctttttacaaccctttaaaaaagtaaaaatcattcttagatgcaaggccttacaaaaacagagctaaatttggtctacagactgtaatttacccaatactgaagtaaaaagcaaaaaagaaaaagagagagagaaagagagacagaaattctaaaaatcaacagcaaattagttgagatagtacaatagataaacatgtaggcagagagagaagacataaattataacatcagcaaaggcaaaggttacatcactacagattgtgcagatattaaaaatataaagacagattatggacaattttataccagtaaatttgactacttggatgaaatggacaaattctttgaaagacatagtcagtcaataaaaaagagataataacctgaatagaatttgttgaagagactgattttgtaaaaacctttcagtgaattctagcaaatatttagggtaaaaattacatgaatctacacaaactttagcagaaaattaaaaaggaatgactggcctggcacggtggctcacgcctgtaatcctagcactttgtgaggctgaggtgggtggatcacttgaggtcaggagttcaagaccagcctggccaatatggtgaaaccatctctactaaaaatacaaaaattagccaggcgtgttggcatgcgcctgaaatcccagctacatgagggggcagaggcaggagaatcgctggaacccaggaagcagaggttgcagtgagctgagatcgcgccactgcactccaacctgggcaagagagtgaaattctgtctcaaacaaacaaataaacaaacaaaaaatgaatgactactttccaactcaatgaagccaccactgccataataccaaaaccagataaaatattacattcctcagaaacagataaaaaattaacatttttcacaaatgaaattcaacactgtattttaaaaagtacattatgatcaagtagagtacattccaataatgagaggtgatgcaaaacgggaagagaagtaaacttccttgccctgataaagagaatctatggaggacctacagctaactttatagttgacggtaaaagactgaaggctttccccttaaaaggaggaacacagtgaggatgtctgctcttatcagttctattcaacattgtactggaggttttagtcaatgcaataattccaaattaagaactccagataaacaaaagacatcgaggctgggaaagaagaagaaaaactgtattccttcaaagatggcatagtttctatgtgaaaatcctatgggaactcctaccagaagtactaagtgagtttagccaagttggaagagaataagctcaatatacaaaattaattgtatttctacatactagcaacaaactgttggaaattaaaacgttaacactaccatttaccacatcatttaaaaaaatataaaacaggaaaacatctgaccaaacaacagaaagaaacagaagagacattgaaaacccaaaacaaaacaccactgagaggaaataaagtagcctcaagtaaatgaagtatgttatgttacaggttagaagactcagtgttgtcaaaatatcaatactctccaaattcatctatagattcattgcaatcctaatcaaaatcacaacaggctttatttatttattttagaaactgacaaagtgattctaaattttatagagtaacacaaatgacctggaatatctaaaacaaagttagagaacactactaaatttttagaactaatcaagctaccgtaaaaaagagtacgttattggtacagatacagacaaatagatcaatagaacagaagactccagaaacagacacaaacatgttgacaactgatcttgataaaggagcagaggctattcagtgcagaatgaatagtcttttcaaaataccatactgtagcaattagagattgatatgcaaaaaatgaactttgatttctgctttacatcatatacaaaattaacacacaattgatcatagtcttaaatttaaaacctaaaactatataacttctagaagaaaacaaaataattcctttatgaccttgggttaagaaaacactttttagctaagatccccaaagcatgaccaaaaaaaagagcaaagttacaaattaaatgtgttaaatttaagactttctgcttgtgaaatatactattaaaatatagaaaagacaagtcacgaacttggataaagcatttgcaagttatatatctgataaagaggacttatgtctgtaatgtagcacatgcagaactcaatggtaagaaaacaactcaccatcctgggcaacagagcgagaccctgactctataaaaaataaaaaaataataaaaatccaagcaaggtggcatgtgcctgtagtcccatctcttcaggaggctgagatgggaggatcacttgagcctaaggaggttgagtctgcagtgatccatgatcctgccactgtactccggcctgggccacagagcgagtctacgtttccaaaaataaaaataaaaaataaaacaacccaataaaaagtggaaaatgaagaaaacaacccaataaaaaaatgggcaaaagatttgaatggacactgcagcaaagaagacatatagatggcaaataagtacctgagaagatgcccagcattactttctattaggaaaatgcaaattaagaccacaatgagatactactacacacctgtcaaattgaataccttttaattaaaaggtagaccaaaccaagtgttgtcaagaatataaaacaactagaattcatctatgtttctggtctaaatggaaaatggtacaactactttggagaagagattgccattttctttgggaccaggacatttcgcagggaagtatttgcacaagaggcaaaaaaaagcacatgactacacaaagaactgtatacaaatgtccagctttacatgtactcgtcaaaacctatttaaacccaaatgtcagaacagataaacaaactgtagtatatatttatgcaatgaaataatattcagcaataaaaaggaaggcacttgcaaaatacactgtaacatagatgaatctcaaaatgattgtaatggatgaaagaatccagtcaaaatgtatataccctgaggtttttgtgtgtgtttgtgtgtgtgtgtgtatgggtgtgtgtttattaaaatatatgtaacttttctgctagagtttttttcctgtggtataaaaacaaggtagttttcctaccacctttgagtagataagtgtacttaacattaaatgccaaaggtagacaccagcaagcttttgagccaccccctccggacaccagagtgctacttattctaacataccctaccgggtcagatacaaatgaaagacagactgagcaggggacacagagctcagtaatattgacagcggggttcaaaaggatttgagacatggacttcacaaacagcagcaccgtaggtctccctgaagcactcccagtgaattcctatggttggcaatatctggaagatctctgcacccaggtcatcccaccagggggccctgagaaccagaactactttttatcactgtgcttcacgtagtctatgaagcagaaaaggcagattacggcaggttgtcacaaagaacaaggtgagtcaaaccgcaggactgcctttacttaagcatacaacagaaaaggctgtgtgtcaaactttctgaaccatttatcttttatagactgctgaagactgttgagttcagcgtctcttaatccaaagcgctgttttagaaaagataatctacgtggcaaaaaatctggtcaggtcagtgtgactgcgcatcctggggccatcttgattatgaaaaactctaatatgggaggagagagactttcagtaacaatcactcaggggaaagcaatggcatcaccctgaagggcatggattaacagataaatagtgaagcaggttaaaatctaacagtcacattcctgtaaaagatatcttcatctcacgtctaattattttcttttccattgctcttctctaattagtacttgcttagtaatggaagcatcgagaaaggacagagagagtattataattctagcaatagaaagctagacacctcattttctagatttgattacacatcttaaaagtatccatttttccccaaatttacatggcacctataatggcataatttaaactttaagtagataagatgaatagatggggactgaatgcagcgtgcttactttaaaacaaaaatgtgggttccttatttcctaatgagtaaacagaaatagaactttcctataattttcaatgctgtattttattttgattatctttactagtatgttgaatgagaagtttttcacacaccaatgtccactgcaaatgtttttagaagttctcactaagtggtggtagcaggccaatgccaccatgctctcaacctcatcgtgtggcaggttgatttagtcagcttcccatattttccaagttctgcttttatttccatccccttaagcaatgaaagtcacaccattagagttggctctaagctacctagggtaagagtggacggttagcagaaaatacataagcaataaccaaatctaatttttatctttctctcgaataggcagcacaaaaattactggaactgctaaaaaaaaaaaatgaaattgagtgctaagcatttcagcagctattctttcacatatattaaatgctatttagctattatatattatgtacataaaataaatgttaaatgctaaaatgttaaattttaaaaactaagtatacgtatatgaataaatttttaaaaaaattcatattcacatatgtatacttaattttttgaagaatattaaaggtaagacaatatagagacatgaataatacacaatctgcaaaaattaactattggattaatcaactatgtagtttaccttgtacatagttcctggaatttttggaaagtggcatgatataatagaaagagtccagacattagaattaggtagactgatattgaaaccccacagcctacttgattttgagcatgtattacttaagttgtagtgtcctcatctgtgaaattccatataaatctaatgtggggattgaccaattttatgtgtctgtagtgtcagtatttgctagcacatattggctagcaaagaatgtacagtttttaatatgcaaatctgctagaagtagggacaaactgcacacttacaacttaagcatgcaattctccatagcttttatgatgattgcagttatattattattttatcgttataagttccacaagtttctttgactatccgaatataaccaaactagtttcctttatctcttcatatgaaatgggtgtatttgtctagaatttaattctgcagcatatggaaatttgcctctgcaatgttatgtattcctgtgacattctctggaccattctcaaccgaagaggaaggtatacacaccattccttgatttttaaaaacttaacaataaaagaaaactaagagagtggttgttatcatacctcggtatttaaaatagcaaggcaaaagcataaatcctctgaccatttactcacaattgctcatgaggcagatagtggcaacttttaagaagacaagatgagaataaaattgcgtcacaaagcagtctcttgattaccaatattaaaatcatttgtacttatcaggaacaatggggagatcagaccttctaactctaaatgagtaatataacagattatagtctctattttggccagaatcacaaaatgtactttttaaagtatactttaaaaatatggatcatatgaagtatgcataaaaataagatggcatttccacctctaattagcagctggaaaagctagagtaagtgtatggcaaatctctactatggccaattatatttccaatgaagcaataaagcatacatttattacataatttaacagatatatatattttcagttccttcctcccttcgttatactgaggaatcttcctctggacagtgctatcctcagatgttttactctttgtattatttgtctttactgtgtctatcaaccatcagcaaaccattaattgaataagttgacgtattagcttttatatttttgaactaagcaaataaattactagtttatttatgcagttatccttatttggagactcttaaaatatcatatgaaaggtttttttttaaatgcaaacacaatttacttttcctcagtcaattaaaaaaataatattgttactctcacttaaaagaatatacatcaacaacagaaatactcattaaatggaactatgtcaggctctgtgggagattagaaatacaaagcctataagacagtctacaggtttgaatttctctttaaaaatatttattatatttttctgttttcatagaattagagaataatatatagtttcatgttatattgataatagagaaattggactttatttacaatttaattataggtgtttgaaattatgttctaggctagagatctaaaacataattatgttttagatctagaacataattatgttctaggctagagatctaaaacatagatctcacattatctatttaattaagagactttttaaaaggcaagatatgagaactggaacttaaattttaacaccatctgtaatctatctatctatctatctatatatatataacaatttagtttttcattttgtgtagatatatatacacacacacatatatgatttctgggaggagtcaggaaatacctctaaacaatacatactgtctctctaaagtccttcaccaattacttcccatattaagtactgaaacaaaaaccatttacctaactgcagctgtagtagcaagaagaaaagcccatttcttcagcatgaataaaaggcaaaagtaagcaggaaagtgggttggagatgaaaaaagaaattactcaggacaaactgggtatttccttttgaaccaaattaaaaaaaaaaaacatggtcaattttgatggattctaacattcatctcagggaccctgagtgacataaaggaaaccaagtcaggaacaatgtctctgtcttcggaagtctcctgtgaagcagaatttgtttacaaggtaaaggattaattaggtttaccttaactgatctatttgacaaaaactcaaatgtaaattattaagagcaaagatcaactcatcaaaagaaatgaagattctgcatacaagtgcccagcagatccatctataggttgatacagggagtacttatacaggagtcttgttggtcctccagtatacagggctatctcagacattctgtgtgagggcactgtgggcactttacacctgccacattcagagacaaggccaaaaccaccaacgtgacctttattatctcccttaaatgtagatttctgtaattaaatatcttctacccttggtcactactacttagcaggattacgctattcaataaattgactacgtaatgtagaaagcagaaaatgttcttgcagctttaatcttctctaactgaaagatgctaatctttctactctgtggtcctaaattgtgccccttgctgctttcatagccgtccccccacccccatcccatttcttccagggccatcatttcctctttcaggacaagaaatgactacagtgttccatgaatataataccatggtttacaccacgataagagactgtgtttcactatgattgctgtaaggtggccacatgggccccagactaccatagtagactacaatatttaagaaataatctaatatataatacatttttttttgcttggtcaaaacaaagtttaaattaaatattaaaatcacataaagttattttgaggatatcaacaaactgattctaaagcttatatagagaagaagaagacccagaaaagcctacacaacactgaaggagaacaaatatcattggtaccacccgactttaatgcttactataatgtcacagtaataaagtgtgattattagtaaaaaaaaaaaaaaaaaaaaaaagataagatagacaataaacaaatcaatggagatcccagaaatagatccacacaaatacagtcaactgatctttgacaaagaggcaaaggcaatagaatggagaaataatcatcttttcaaaaaatgatgctggaacaaatagccatccacatgcaaaaaatagaataaatcattacagtttacatccttaacaaaaatcaactaaaaatgcgccataaacttcaatataaaatgcaaaactataaaacatggagaagataacaaataagatcatctagatgaccttgggtttgctggtgattttttacatgtaacaccaaaggcacaatccatgaaagaaataattgataggcagggcttcattaaaattaaagacttctgctctgcaaaagacactctccagagaatgaaaagccgagtcacaatcagagagaaaatattcacaaaatatatatctgataaaggagtagtatccaagatatacaaagaagtcttgcaactcagaaacacataagtaagggacccatttttaaatggtcaaaagagttaagcagacatcctaccaaaggaaaaataaagaaataaataaatacagctggcaagtaagcatattaaaagatgctcaccatcatatgtcattatggaattcagaaataaaacaaaattagatagtactgcccacctagttgatggctaaaattcagaacactgaaaacagccaatgtcagtgagaatgtggagcaaaaagaactctcattccttcctggtgggaatgcaaaacgttatgaccagtttggaagatagtttggcagtttcttacaaaactaagcagatttaccatgcaatccagcaatcacactttattcatatctggacaatacctggaaacaagatgtccattaatgcatcagcaggtgaatgaacaaactctggtttatccttacaatagaatattatgcagcaataaaaagaattattgagtcaccaatagatatgaaggaaatttaaatacatattgctaagtgaaagtctgtctgtaaaggctatatactttctggctctaactaaaagatatttggaaaaagcaaaactatatatagaagcagtgaaagatcagtgattgccacaggttcaggggaaggagggagagatgagtacgtggagtacagggtatgtttagggtagtggtgctcttctgcatgacgttataacggtggatacatgccattagatatttgtcaaaacctacagaatgtacaacacaaagaatgaagcttaatggaagctatggactgtagttaataataacgtatcaatattgcttcaccaatttaacaaatgtaacacacaaatgcaagatgtgttaataacagaggaaagtgtatgtgtgtgttgggggagaaatagggaaaatctttgtgcaacttttctgtatgtacaatttgtctgtaatcctaaaattacagacaaaagttagtttatgaattttaataaacagtttggaatatttttcgaaatctttatttttcacttgccatactgaaagttacctggcatggttcttttcagccttgtaagcaatcaaaatatttccacaatctaattcaatcaagcttggtattttactgtttgaaaatcttagcattatttacagatttaaggtatttctattccttctttttaaaataataattaaattgtttaatgaaagcatttctgactgtaaacgtttaaatgctacaaatttacatttctctgttcataaaagaacttatttttggtttcttatctttaagacaatgccacattcatgataaaaatatacttcaccaattttgaaatagttctagtagataactattaaagatcattaaaaactcttgagtggatgcattcagttctctaaatctagagtgcagcatatcataaagtgtctcctatccctatcttatcattttagatttttttctccaaagtagtgctcactatcagaaatcaccttgtttaggccaggcagagcagctcacgcctgtaatcccagcactttgggaggccaaggcgggtggatcacttgaagtcaggagttggagataagcctggccaacatggtgaaacctcctatctactaaaaataaaaaaattagctgggtgtggtggcggctgcctgcaatcccagatactgaggagactgagtcaggagaatcatttgaacctgggaggtggaggttgcagtgagccgagattgtgctactgcacaccatcctgggtgacacagtgacacactgtggcaaaaaaaaaaaaaaaaaaaaatatatatatatatatatgaaatcactttcttcacatatctgtttacttgtttcctaaatcatctctcccaattccccagcccatcagccccataggaacagatgtacttggaagtgccacagcagaggaaaaccaccaggtaaataaatatttgggaggtgactgattgaataaattaacttatctagatttggtttgtcaaggacattcggaaaattaggtagaatttagctccatgaatgttgagaaagttgagttttgagagccctaacatggccaattcattttacagaggtggaaaatggggctgacagatgttaactcaccttgtccaaagtcttagtaatggaatcaggaaaaaattcaatcacttgacttttaaccaataatcttttttactacaagagttaatttgctaatgaaatctcctcagtattttctcaaaacagaacaaaaccatgagttaagtattcctttttctttgctataactaaatataccttttaaaattaaaaaaaaaaaaacataaacatggttataagtgatcttatttcctgcatttgaggcagctaaaccagtatttcccaaaatgtcttaatacccacttcttgatctgctgcaaggaaaaatattgttcagtggtcaaatacgttcaagaatcatgattattatatagagaatagacgtttgcctcttaatggaattggaaaattcctacagtaaagatacatgtttagttaagggttggctaaactacttcactgtggcatcctctcttcaaagaacccatcaatattctacagaacaaatatgccatacaacacatttttatccgaaaatcttttataattggcttatattattgttttattcttcaaaatgttttctaaactgtctcagttctcgtcccatgtcatacaatattttataatttttcaaattctcacttttatgttctcacttactaaaatacggcaaaatataatttatatatacatatgtgtgtgtgtgtgggtgggtgtgggtgtgggtgcgggtgtgggtgtgtggtacctggaacacaataagtggaaaaatttgtttcctctgtcttatcgcacccctttaaaaataacacaaacagaaagtgttctttctaatagtgcaacttacggtccatttattttttaatatttgttatttaatccatggcactcacttttttgaactgcagtaaggtgttcttcaacaattcctaatttttctgtgaatcgtttacttggacaatgccacattcacatatacatcccctaacatttgcatttattcagtttccttttaaaataagtgctaaacaaattaatggattttgaaggagaaaggctttcctttcaaaagaatggtaacctttatgtagttgtttttagatatttcctataaaacctgtctactctcgatacagtcagacatcttttcttcttttttaaatattaaaaataagcacataaaataagtcatttgttctttaaaaaacaaacaaaaaaaccaaaaaacaaaaaacctacaaacacaaaatcatgtaaaccagaaatctttcacagaggtcaagaagtcaaaagtaaacaccgacaatgaaacaccgacaatggtaagatccttgtgaggctctcgctccacctttctcattacttctatgtttccgtggcacaccacgggccagtgcttactaagacctctgcttagcgatggagttagtgggtctgcacctctgattgtgctgggcatgagacatactgattaaaaatggtaaaaggataaaggaactggcctttgagagacaacatggatgaatgatgagtttttgaattaaatttttgacagctttgatctttactgaaaatttaaatgaaaaacaaaacaaagcaaaacagagttccaggattttagaagtgccttttatcttaagtgaaatgttctcatcagaaactttggcatcccatccagtgcctttgatgctggctgtgaaacaagacaatccatcttcttagctgggaagacaggcccttcaccacccaggaaaccataacttgtaaacatcagtcaagttcagatggctacatttttacttcagaagttcgctttgcatttggagtggctcattaggggaaaagagagagagagagaaagggttatggaccaaagtgtgtttctcaaaaaattcatatgttgaacccctaacccccaatgtgatcgtatttggaggtagggcctttcgaaggtgattagggttagatgaggtcacgaggatgaggtcacaagccaggattggaaagcttgataagatgaaaaaaaaagagtgagctttctactctgtgtgagaacacagcaagaaggcatctctctgcaggccaggaagagaggcctcaccagcaatcaccttgatcttgaacgttccagcctccagaactcagagaactaaacatgtgcgtttaagtgcccagtctatgagactttcttttatagtagctggagcagactaataccgacagaccaagagagagaaaatggagagaaattttctggcttgtcttttaattattctttatttataaaaaaagccacattgatttttgcagcagtgatgcaagtgtgctgtgcataggtttgatgttctgctcaaattaagtctaagtttttccactaaaggaattatagtgttaatatgccaagagtcctatctgctcacgtacttccagtctctgtaaatacgtgcagcctgatatcaaagcaaaccttgaggccattaactataacattcttggagaaacagctgaagacctactaagaaaaaagtaccaaataaccaaagctggcaattacaattccaccccgaaaagaaggaaggcatgcatatgaattatgaaaaatagggactgtgcagctctcagattttcaacaatgaattgctcacattctacaccgtgtgtgttaaatgtttaaaagtaaaagatcccaaacattttgccaaatatgcagtgttccaaagggaagtatcaaaaggatactcatttataaaattatggttcagtagataaattataaggcctcaaagaacatgctgttacttctacttgccaatttataaattgactcaagtcttcatttaatttatgaaaaatcaaatcatctcaagaatgttttcgttatttttctctaccatgtaaaatatatgttttgtatgtttgataagttgtatcctgtcaattttagaatttagctatttggaacatataaaccacatttctacaactcaaaatagtataatgcttagttacctatctttaaaaaagtaatagtaatgcactgagatatttgggggtgggaggtggcggacacaagtttaactttcaaaaataagggccgtgtaaaataactgaaaaataatcctatttgaattaaaattgaataatattaaaaataaatttctactgaaaattacacctgtttctctattttatttttcttccttttaggatagcagaaaattctgttagataaatcagactaacatgggagacattgtaaatattaagaaacaatagtaggaagaggcggactcacattcatcttgctctttctgctattcccttccaaaaccaactgtgaacaagcactcagggtggccagggtacgtgaggaagcctcctctagcccagaaaaaaactttatttcacaaaaagttatccttcacaataaaaaacactattctataaaaattgtttcccctggccaggcgcagtggctcacgcctgtaatctcaacgctttgggaggctgaggcgggtggatcacgaggtcaggagatcgagaccatcctgactaacacggtgaaatcctgtctctaataaaaatacaaaaaattagccaggcgtcgtggtgggcgcctgtagtcacagctactcgggaggctgaggcaggagaatggcatgaacccaggaggcaaagcttgcagtgagccaagatcacaccactgcactccagcctgggtgacagagcgagactccttctcaaacaaaaaaaaaaaaaaaaaaaaaaaaaattgtctcccctgacttgagttatgggaaagagggttagcttcacttggccctccatgcccctgcccaggcacgtgtctgtattagtgttctgcagaggcaattcaaagtacattgtccaaagcccctctttgaaaatcttttgatgctgctgtaattcaatttggtttctatgttgaatctgaagttctgtgttactactaaccccctttctgtaggaaaaaaatgtatttttctatacaaacccatatgccatcgaggtacctgtatttaatatacctccatttagtagctaataaatatgtctatttgaaaactatttattcttccatacttaatcatagtgaactataaatccaaacttgacagcacaagaaaagtgacatttttcttctttcatttctatgctactttttccaaattatttcttgttctttttaaaaatgaagcaaagacatcatcattgttactattatgccttcagttaacaaaaaccttttaaaaagattatttgaaatgcatatgtaatatgcatgactacgttaacaggattatatgctattagatattgtgatataaaattacaactcactgggagatacagtcctctttgggcctctctcccttctatacatcttgctggacttgccaagatcaaaaggtcctgcccgcttttaacagactattactcagggttgcttatgcaactggtaacctaaagagataaggcaaggtcttcccctagacaaaaggcttgcatgcggcttgctataacagtagtcccagctcagtattcaccggctgtgatgcaaatccacccatgagtaagttccctctgagccaattgcttcattccctgcacacaagctgctgcactgctgagcactgtgtaataaagccctttgcctttggccccaagactcacgtcttccaccagcagcctgatacagtagcaggctcactgatttgtaagaggggtaaaatcaaaccccagacttgataataccatctacacagacattcactggtatgattcaagaatataaataactggtattcaatgtatccaaaaacaatcatgatgaatatttcaccaatgcattgctctttaaaataatacccaaataattatctgtactgtttccataccttgacctttcaactggacttttccttaatttgagcttttttgagttgtcatcagtgtcgtggagacttgcgccttccaattacacagtggtgttcaaacagaagaaattccaaacttttcttccttttgactataactaccctgggagtaaaatgtcccccaaataaaaacataaaataaataaaataaaagaaagaaagaaagtatctacttggcaagtgggaggtcagaagaaaaggggcttcaaacatcaaagaaggttctcaaaatactctttcaaatgaagaaagccccacgctcggtgccttatcttgcaagctcacatggccagacagcaacctttaaaggattatcttaacatgcggcgagctgggccctctcatgtgttctgaaatttaaaccagaaaatggctgcacaactgacatggttgtggggtgtgaaggggaatcaggaagagggaggagaggcttacatttccagaatgagccagagttcagataaagatatttgtgtaaaaaacaaagcaaccaggaatatgatcctgggctgtcaatttgtagaatacaatctaatacttatacgccataggtagtcacagaagttataagaaactacaagccctaaggcattttttagaatagaaatctctcttctccctctctctctctctctcttttttttttttttttgccaatatgtagtgtgggattttctttggctaaaaactgttccaatttccctgttttctaaatatactttactaagcatttttttttacaatcaggagtattgtaacctttgtatattttatcaataataaaataaatccataatttaaaaaaatcacacaaaagtgtataaagtaaaaagtcaaagtcccacatccccacctctgaatttcacctttatctgtgtgtatatgtatattttgatattgtattttgtaagtgtattgttctgtaatgtgctttttcatttaatagcatgattcacattcttccatgtcagtaaatacagagctttctatttttttcatgtctagacagtactttacaagatgattatattcagtaatgtatttaaccattcccctactgatgaatgttgaaatattttcccctaattttttactgtttcaaaatcaaaaatatgtacatcaacttcaagctttttactatagcccgtggactcttacgtgatttactacctgtctttgtcttcctctggaacttcttataccaaatctttgtgcccctggcctttcttccatgcctgggctaagccaaccttgtctctgcatctctgtggaatgtcctgtcccaaggtattggcgtggtggttcctgctgtctcatcactcgctccaaggttacttccttggtgaggtctttctagagctcctgttctacacaatctaatttatccttagtcaatatcttttataccttctcggtttattttctgtacagcacccatcaccctctggaataatcttgttcatgtatttcttactgtttactgttttcatgtaagatttttctctggtatgctctaatgtgtcctttattagaacaatgtctgccacatcataggctctcaataaacgtccactgagaagatgcataatggaagtatacttcaacttggattgtagcacatttacacaaatatttccattagagagatgcctcgaagtaaaattactgcccaaagatttgtacacacaaaatattgatgggtacttgccatgggtactgcaaaaaagctttaatggcaatttatattgtcaccaatattatggcaacggcccttttcccacaaatgcagttttataatgccaatttgacaggttataataatttttttgtaaattaaaaatcaccttgttctaaagaatctttttacatttatcacatttgtgttttatctccaaattaatcattgttgaaaatcttttttattcttttatcttttgggattacagaatgtcattctagttttcttccattattatacaagattgaaaggattttggttggctttcttagatcttatatccaaatgggatttattattatatgtggcataataagaactattattcttttaaaatgtattaattgtcttttgcttattaaaaaatagtcatggtggacatttctttaaattttcaaaaataaacacagaaaagaaaataaaaatcaccccaatagaaacttgcctgatttctttccactgcattccctgtaaaggtgtgttaatagaaatgtttctttgatcatacctataaagtggtgtttataaaaatgtttattcccggccaggcacgatgggtcatgcctgtaatcccagcactttgggaggccgaggtgggtggatcacctgaggtcgggagttcgagaccagcctgaccaacatggagaaaccccgcctctataaaaaatacaaaattagctgggtgtggtggtacataatcccagctacttgggaggctgagacaggagaatagcttgaacccgggaggtggaggttgcggtgactagagattgcaccattccatgccagcctgggcaacaagagtgaaactccatctcaaaataaaataaattttaaaaaattaaaatgtttattcccttatacaacattccctcatactcttttgtatacagtttgatatggtttggctgtgtccctacccaaatctcatctcgaattgtagttcccataatccccatgtgttacgggagggacccggtgggaggtagttgaatcctgaggccagttacccccatgcctgctgttctcatgatgtgaatgagttctcaggggagctgatggttttatcagggactttttccccttttgctcggcagttctccttgctgccatcatgtgatgaaggacatgtttgcttccccttccaccatgattgtaagttcactgaggcctctccagccatgcagaactgtgagtcaattaaacctctttcctttattaattacacagttttgggcagtcctttagagcagtgtgaggacaggctaatacactgttttttcgcttatgctatgaacattttcttttgaaaatgtgatttttaataatggtacagtatcttaatgtgtatgtgtattgtaatttgtatgagtgtattttaatggttcctattgttctacaagtaattcctttttctgttattaaaaattaacccaccaatgaaaacccatgctcataaaatctccaggaccatctctgatttcattcacaggatagattcctaaatgtggactcaataagaaaaggagtataaattatttcacagctcttttcaggccttttacaggcaggttgtgtgtactatttaaagtactattaatcccaccacatacaagatgtattaggtacttcttaagagtgcactgaatataagaaatctgttacaaaatgttagcagagcagaaagagaaaaaaagaaagaaaaaagggatagaatgagattagatcacctggtaaactgtaggaaacagctactgcccccaggactcaggaaactcaagaaagtactttatcagaacttctgagtgctgagtgcatgccaggacccctgaggatgggccgactgagtgggtagaaaccaccaaggcactgcctcccagtcacggaggagtggcatggagaagggatcacagacacttccagaagcaggagagagggaagggtagaaaagagaaaatgacagcgcctttcccctgacctgcctttggatccactgagcagatgtcacaggaactcgctggcaagggcatctgggaaatacagtttcctcccgagccaagcattgcggagcagcacaaagggcgtggctggggaagggttgggagaacagggaatcactctcacacccaagagtgcatggagcatatctgggtgtctacacaggtaagagagtgaggggtcaaaaccgggcttcttatgactctaaaatgtatttttagagcagttaccaggagagctgacattgttgaatctacctgagaagccagaagccagactctttgtattactacagaatgtgattccatgctgttgccaaatgccaggaatttctacatcgactgccatcaggacatggaagtctcattgtttcttaaaacgcaactattcttgaagacatggaaggtcatccttcttacatccttacatccttctttctgtggccctcctaggcttgtcacgagtcagcacgaatcccaaaggtaccagcagcacagaagctcacactctgtcatcagagctgggttggcagtgacagaaatgcttatgcaaacacaggctgacttctcactgaatgtatagaacatctaggaaagaaaggcaaaggatttaggccaaagcaatacctcaatgcagacaactaactagtggcagctagctagtcacctgctctcaactcttcaacgtccttcaaatattttctctaattgatatagcataatttgtgatgccaacaaccaagtgttttttcacaattacagagagccaaacctgtgtctctgctgctcccttaggctacttataatattggcctagttctcttagctgtcagcacaattaccttgtgattaaaaagataacatcaataggaatttcttttttatcagctaagccatggttacatgttgcatggacactagcactcattaccccatccatattttggtgagatttttgcccatttccttcgttttcacagaaaatgaaataaagcataagcttgttggttgcaaaggtgacatatagtaagtcaaataaacccataatgaagttcccttatacttcaggttagcttcaaaatcccactcaaatatgtatccaaaaagaaataaaacaggaaactttctggaataagttcttttgttgctatttttatattgaattggcaaatgtcatttcactgtctgaggtcaagggaacacaagggaacaggcagttctcgaaacagaaaagttggaggtgctgtgccgtctctagctaagaaaactctagttctatgaaatatcattccacctgagaaaattttcacatgattaaaagataacagtgccataaatctacccttgaacatcaggtgtgactcttactatactacccaatgtcttttaaaaaatatttagatcattagccaatttgtgtgggtgatacaattgtacacattccacaaaaatatcagccatttgtctagttcagcatctggtaatgtcaattaagggttttatttactcacaaagagaaaaaagtaaagatattagtttcaaattaagtccaacagtctattgagtacgtagtttaaatgtatttcagctcttcatcctccccagggcagagatcactggcagaaattagcatccacggataggaaccaacaacagggtagctgatgatgtttaggtgaactcccctctttataataacagaaataaccccttttcccctacaaagcccgtctacattttgcatagcactaaggatggcagacctaggagctgagttagccaaccctgaaggtatcctgcctcaagacttgtggctatttggaaaaataagcatcctcgtcatggggtcagtggaatcggggcagtttgctggagtgaaagcccccaattaggtcaccctgtacttgtcatcaagaatgagtacacatggcctctctatcatcaagtggccacctacgctttttgagtggtaattcttgaaatatggttttctctatgaagaaagcttttctctccatagaaaaagcttaacagcaaatttcactgtagtcgaaatgtttcacctttctttcctttttgatgtgatcgtcagctcttgactgcatctcgttttctcatgcctgctttctttctgctgtcagtcacaatcctttgtgacaaggtgggatcacctggcagatgatttggatgttgcctctcatggagatatatctcattgaccctttcgaattcagagatttttttttaatatagaaaaaaaggcatagcattttaacatcactaactaaggcaaaagataaggacactggactgaaaaaccaaggatgttgtataaatattcgtccttgtgtcactattttattggcttgaggtatccaggaaacaacttcatttccccaaattacattttattaccaaacaaaagatgaaaaaagtactacttatcccattaaactagcataatggttactttaattggaggggtgggagagaaagaaaggtgaatctacttagatttcttggagaaatgaacttacaaaaatggaagctggtggcaaagccaaagtgaaattcacgtttacttattccatgcaatatttctctgtccaacctatgtaaagcactacaaatgaatacagtcatagcaactaattgagttatcagcatctccagagtagatgttactagtatgtcctggcatatgaatggtagtattatgtgggatattagtagttcactaagagtcctataggacttcttgtgtctggaaaaagagtttagtgagtgatactgaaaaaccaacagcttggctcacgggcatcattgaacaaatggtactgagcatggaacgcagctactcagaacttatgagccaaatgggtgttttccgtacatggcttcttgtccagaatgctactgctattagcccaatggccatcactggttatcaaacatcctgacccaagtcaaagccagacgaagacagaaggccatcgtgggaaggtgaagcgattcatgcttagggcaagataattatttggtatcctttcaatccatttgttcaacatttgctcccaggagaggcgggatgcttcctggggacagattagagaagaagggacactgctaagtgctcatgtattatttcaagcagttcactctgggccccgacccaaatcctcaggcaacaaagcagcaccctgcaggtaataggaactgtcttctttagaaagcagtgtggtgaccaggtgttgctaatcatcagagtctcttggtgactcacagccgccctcatgcagctttgcgagttctgactgccaacacacacaggactcttcctaagtattatttcagctgaattctgggatgtgaacatcagactttcaaacccggctttctcactttctactggggtgaccctaaatacaagttatttcatttctctggactcagtttcctcatttataaacatgagaataacattatctactccactggttgctgtgaggaccaaataaaataacacaattaaggtgttatctggtatataataaccattcgataaaacttagcgattattatttatggcatccattccacaatggtactcaatggtactgtgtacactgcctaagaatcctaacctttatttttgctccactcatcacttctatttccagttctgtgatgccaacaaattgggtaattgtacagcagcatgttattatgtttcttcacctccccttcttactatgggtcccttctccgccttcctcaaacatggcagccctgtgggatgttgaggctcttgaggctcctcagtttgaaatgaatgagcttgctgaagtggaaacattagaagggcatgattggcagattattttgctccagcaccttcttgacagaagtgcacaaagctcttcaagaagatggagctgctgccagatgccctctgtccagcctcctggaagcccaggagaaagctggagtggacgccatccttctggcctcctcctgaaggacatactggtttccttaatttcttttctactttttgtccttcagtctgttgtccctgcacagctatagagaaaacaaggattacagattccatgtcgttttgcagccagggaacatctttggctagagatttgacggaagtcagtgccaagtggctgtgtccctgtaagcagtccattatttctaatggtctatttgcatgcaaacctccaggccagaggcagaagtaaacatcccagaaacttgtccctggagactctgggacactctcatttacacgctgtgctccattcacggcgctgagtttactcacacgtgctacacatgcgatcctcacgacagccctgtaagatggtattagcatctccattttatcagaagaaaaataacttccgagagggttaagcaatgggtaaacacggacataaatatggcaacaagagacactggggactactagagaggggagtgagggaggagggagggttgaaaaactaactattcggtgctatgctcactacttgcgttgcagaatgatttgaaccccaaagctcagcatcacgcaatatacccatccagcaaacctacacaggtaccacctgaatgtaaaataaaagttgaaattataaaaaattgtaaattacaaataaatgaataaataaaattttttaaaatacagttaagaaggggactttgcagtctggtgtacctgacactaaagcccgtgtatctttaccatatcatgtttaaaaaatcattttcaagagaggcaagaaatttcagtggagaaaaagactgagtatgtagaatggaagattctctagatgtgttgattttgtttatcacggtgtcaactaccggaggagtaggcaattttatgtggatgtagaccatgcacctttatcaggagtactttttcaggtcaattcccttccctagcactaaaaataattaatagatctctttgagagactaagacagtgaggagaaagtacatttacctaccacaactaatgagacctgaataactggaacagaatatttggaaaaaaataatggtttaaatggttaacgatgtgtaactagtaatataatagctacttcaacggagctttcatgtaaaacagaatttcattgcaagtttaagttttcttttgagaaaaatttggctatgtaaaggtgagtttggcaattttaagtttacaacttattggtcaataagtagtagtaagcctcttttgtgtttgttgagttaataaactatggttcttggacaatttctttgttggatgttaatctataactcttatttgacctgttatttgacatttctaacctcttccttaaacattaaccagaaccctgagtactttcttttccaacacgggtaagggattgattttttttcttaatttcataacttatgaagctaaaatgtgcaatattttgactgagtgaattaggaattcttgttgggatttgggaaaaagaaagttatgagaaactgatgactgcctatgtaatacttcctttataggaaattcttaatacccttatataggaaattttaatacccttcttacatatcttttgttcctggtgacatagaagaacaagtttaacaacatcttaagaaagaaaattattaaatatttacagtcacaaacctttgttcaaaaaagcacttaaaaattatatttaatagagtttaattgagtaaagtgaatcacatagccctcaaactagaataggtttagagagactagtgtttttgtgtggtcaaagaagacttatggaaaaaaaaggaaaatgatgtacagaaaatggaagtcaggtacacaaacagttgtattggttacaccttggtgtctatttgaactgctttgaagaatttgtcacctttcagaggccaaaacttggtgatcttcgtgattggaacaagaggaggttatagcctgattacacagtttactctgtacagggaaaactttaggccagacttaaaatacgcaaggaggcagcttaggctaaatttgctttaacaattctctctttatggtcaacctccaaaaatcatgaggggttaaccaaaactctaggcactgatgacattttgtcactattataaacatattcacacagttttaaattttattgggaagtagttggatagtgggttttgtaaagtgaaaagaaggactttaggttacttttctgtaaggattagagtagaaggaacctctgtgtgttgaaattttttgattttaggagataaaacctggtctgctatagtttttttttttttttaagttttagtttgtttatgtgatatttagtatgagtgactttagtttggtttggtctggtcggttggagcctagtacatgagtttagtcaaaagcaatagcctcttataattttatgttttatttatttatttgtttgtttgtttatttatttatttattcatttattggataggtgagagggtgacccaaactttactgttggcttcgtggtacttttagctattattattttcagttttcggtctcagtgtgtcttatatgttacagtgacttgttgatcactttttggagtttttgttgtttgggttgaagagggaccagttgacagtttatagatgtctgtatgtaaacatttgagaaaatatagtattttggggaggctactattatgactattaggaagataatattaagagtttgaaatatggtttctggtcagagtctctatgaatcaattaaaattgaagagttttaaacgtgagttagataaatagtatttgttttagccaagtagtctgttaatctctcacaattgaatctttataatttttatgtataacaaaaagtgttcataacaaaacagattctttttgtgtagtcaatggataatctagtgtgattttattattaggaacaattttagtaacagaatttagtcttttgtgtaacaatagtctttgtagtagaatttcttatggagtctattatgagggatgcatttataatgactgtcccatttattttaaactatggaaaaagagacctaataagtcatgtatcctgagaagagtgaaggacaaaatctttaggccaaacgttataaatagaatgaaacagctttagactaaacttcatgtaacaccttcaagtgtgagccacagtgatgagtaaccagggtctcaagctggtattttttcaagcaaaaaatacttcaaaaaagccactggagtaggggtggggagcgggtaagaagatccatatctgcttatcaactcctgtttttttttttttccatttctttttgtatttggtgtctacaaaagagccttaacatggtttaataaacatgtgtcatagactgcatggagttgcttatgttgtttcaggatacttaaaggaaatgctcactggaacgttctagattttggatttggaatgttcacccagttaagtatactgtaaatattcaaaactccagaaaaatagtctgaaatacagaacacttatggtcctatgaattttggatagggatactagacatgtacttacaaaatggttttgaaaattccttagtacaagaaagactctgccaatctgatacaaatatggctttgtacacacacacacacacacacacaaacacacaccccactctctctctctagatatatatacatatatatacatattaacatataacacatatacacaagtaaatatacttttcactgaattttgggtggacatggacccacggttcttgtctgggacatcagctactaggtctgagtcccctgtctgtgccctgtgcatctgggaatgtgtacacactcttcaaaactccagttaatcaccatcctccctgggaagcttccatgctagaggattgaggaatccaactcttgagaaacaagaacatcctcttcagctcttcattctaatacttagcagatatcatagtgttttcttagttgggagactagattctgtctccctcatttgccccaacttcatgcccactggagctccagacacccactggaggaggcagtgacaacaggatttgcctccaaagaacacagaccgcacccttgtgtgaataagggaattttgttactcctgattactttacccatcctagaatacgctgaatttagccataaaagaagttgaaaaagatactcagaagaagaaaaaagaacactagagtggcaaattgtattatattaccagttttacacatatccacatggatccttatgtttgtggggtccacagcctgaccactgtaatccctcacattcatgtttccccgccgtgtagaaaagctatacagggtattcctgctgtacacgcagccactgtgcaaagatgaccctactctccttggcactgaggagccgaagtcatcccctgagagagaggcagcctacaaatgaatacctggggccaggggcctccagagaggggagttactacaccaggcaatgcttctctcccagacagcttgaatattaaatgtgtaaacatactagacagcaaagtagtgccgaaaccaagaaatggacacacggagagagagggggaaagggaaggggagagggagggagtgggagagggagacggagagtgagagggaaagggagggggagggggaggggaggaggagagagagaggcagaaggagaagaacagggagagggagagggagggaggggggagggggaggggaaagggggaggaagagggggagagggagagggaaagagagaggtaggaagagaccacgaggagagaggaggaggaagacaaagtaaaggcaggaggagaagcccagtctgggaggtagagacagcaacaacttgagtcatgcgctggacacagtgcccacttagcaggaaccgctgcagctacagatgggtcccaaatcatgaacgaggacgttctggttgcacttccatcctaagaggatggtggagggtgatgctttttgtttcttactcatttccctgtgcatccatacagttagccaataccctctaaagtaataaaagtgtatttctgctccgagtaacttggttgaactaatattcaaatccaaatctgcagactggtaggctgactaggctatgtgaatgtgtaaggaacacagaatgtgcatacaaattccatacagacagagaggactgggctggcattaaggaagaccagtcacttcagaggactggccaagaggccagtgacaccacgctcggtgacaccacagctcttctcatggtttcaaccccagaggcagatattcttggctgccttcttgagtgccctgacgggggccactccttttgtctctttctttgatttctctgggtgcagactaaaattctccttgaatctagttcaaactgtccaaaagaggggatctattcagttcgattcatcacactggatggagttcttagaccaacacacgccacaggcccatggccagcctacagatcggctccctgatgtcatgccatggccatggaaagactgaaccatcacagaaggggctgccagcactgggacaggcatgtaagtcatatgagaccatctaccttggtcaaccaggcagtgctaatcgggagagtaagaggacagcacggagattagcaacccaaagcaataccccagcaggtattagagttgaccattggagcttggcatgttttggttattaatactccaaactattcatgcttaaggcaatgtggaatttcaagtgaaagccagatggttcttgggcaagaggaggaaagaaaaacaaagcatcatgtgcttgggagaacgcctagtaaaacaagaggatcccagtctctcccagcagagtgtgggcatcgttcactccctttggtacaatccattccctttctcgtcgggattcacacagcatggtcaaaggcaatactttaacatcacgaaatcaagctaggtttacaaatgtaaggtaagagataaagaaagaccatctatctggagttcttttctcccctttctttctatgtgtagaataaaaggacagagaagagacagaaatttaaagggaaacaaggcaagtgctgaaataaacctgccatctattttaagtgaaacaatttatttgggtttcaagaatacttttttctgtctctcgttcttcctaaatcccagattatcagtctaatcgaagatcataaaggagatgacaaaacaattatcagagagaaaactggattccacttagcagcggctaccaaaagtacagtttaatgtgttttcaatgaggtgggcccctgggggcctgaacacccacaggccaacggatgtttctatgtaagaagagcaacgtcatcagcaaaagcaatttcccacttttattaatccagtttattttaaggcatgattattcaagctttcgtctgctatagttagtcttgtattttcaggataataagactggtgaggctagttatcaagtgcctatgcacagaattcaaatggcctttgttctacctggcagtctcaagaactgttaaatgagcttaaactttattacaagaagaaacagaacatgctgagtgaaaggtctgcttagttgcttaccataaaaccacaactacttaggaaacttatgctctgcatattctaaacctgaaggagcctctaatggggcatttggggtcagttttaagatgattcctcaaaaatgcccccaaataagacctggaaggggattccacacttggctgtctctgcagagccacaggcaacaacacagaggtgccatgatttatttaatggaagcttggtagtgactcaatatcaagaactcaccttgagaagccacatttcaagtatctgaaaacaactggcaggcctttattcaaatactttaaatagatcaaagctgtttattctctaaactcctctccccttcttacacattttaaccaagtcaatgttttccttctatttctctcagaggtctaaacatctctaaactatatttggcctaaagttttgcttgaccacatgattttaagaactgttgaatttgagtgccattgccagggaagctgggaagatggctggataccagcatttacaaaggtctcatcactccatgagtgataaattcccatttctcacatggttcctatgggctgggagtaggagtcctcaattcattgtccttctgaaaggcccagatctatgaattgggagattacttgtattcagcagttacattttctactttttgtgggctttgaggagattagaaggggtaagagaaagatatttgacatacttctttctctacccctcaagactaaataaatactaactcaactatcttactacttcaagtttctaaataaatctcccattcagggtcaggctaatccccttaactctcctctccagtatcattctgatcccatccgacacctcccaaactgagcctcaatgcctttcccgcatggacccgcctctggctggtgaagccaaaggtcctgagagcatgcatgtggacagagctaggcaggtttccttggcgtctcctggggacgtcacatattatcctccattatgattgtcacagtacatggtatgagcagacaatagattttaaggcactttaaaaaaatgcttgtgtaaatgaaatggagcatttggattcaatttagtagccttatacaatatctgctttttatttcagagaagacttctgaggtagctgatgaacatgccggcagagaggttgaattccgaggtgaaccagtcattccaatccaagggagacagcgtttggaagctttaatgtaaacagaaaccctgcgggactcacttgtgcatacagctgtcaaaacaattcaatatccagagataaacagggtataagacacccactagtatattatactggaatgcaacatctttttaaaattatgttgccatattctgtactttatcgagtaccttccattttaatatttcatctaatagactgtaatttggcactttgggtagtaaatagtgaattaaatgctgatgtggcttattagggcaagtaaatttgaaatcaagtatagtgatagcattataatgtgacatgtcatcagtttacagaagagatttctcaaaggaacacagagttctgaatacatgggtgttggtatcatcatagagaacagcaagtattcattattcatttaggaaaggaaatgtgtacctggataatagtttaaagctatatatatatatatacacacatatatatatgtgtgtatatatatatatgtatatatacacacatatatatgtgtgtatatatatgtatatatacacacatatatatgtgtgtatatatatatatatgtatatatacatatatatatgtatcattaacatcaaggctgcatgaaccaatttgctttgcacaaagacacaggagaggtggtatcaagtagtggaaggagttgtggctttggagttaaagatactcattcagattctatcatttgctagatataagccttgagaaatatacttctgtgggcttcaatgctctctactgtttaaaaaaaaaccttgaaaaattccaccttgcagcattgttttcaaattgtcaatttcaactggcgctcagtgaatgggaggtgttggaaatgaagacattcagcacataaataaggaagtaaggtgtttaagagtctgtatcactggacctatgggcagtctttctgggccactgtcaagcctccctttttgagaagctacaacagccacatgggagagtccagcgaccagagtggccgccgtggtccagataaggaaaaccgccatggattcagccagacttagagcaggatccgcaggcgaaccgttcttcctcttccagctatttctggataagcccactgtgtcccttcctctgcagagcacacctgcatctttgattccccaccttgaagtccttgtcctttcctagcctgagtcattccactcagctcaaaagacagtgtctgggcatcgtctccattggaagacagttcctgatgtttcctaaagttctctttactcccccgtcacatcctcatagcatgcagcaataaatagaaattaccctgtttttcaattatatttctataactattgttgccctcctccctttcagtaatgtaaaaaattttcacagtatcttctgtatcctaattttccccactcaattcgatttttgagatgaactggcagctgcctattaccttttactttttcctctctaagtgatacttttagtaagcaatttacagctacctccaaggtgaatttgtgtgtaacttaattacattcacttataccctcattataattacagtagcttaaaatccccatctgtggaacaaaagatgtttccatttatcatgtttctattgtgtataagctgtccttaatattaaacaccacaatactctcaaaagatgagactatctctggtaaatgctatacctgtcccccccactatctctttataaatgcctcagttaaaaatgatatgtttttaccattacgcacttttttctgatttttttttattagtccaaagaaataaagtgctaacaaatagctgggtggatgaagtgagtgaggccattaatattctatactgatagttaatatacattctcttttccacattacgtccttagacttcaggcataactccaagtaaaaattcaacagaataaggaaaactgcattcattagtagaattgtttttctttttcccttataacacagcacaattgcagatcaggagacacacaagcagacctcccagactcgtgggtcacacttagggggttattggtcaaaaatttctggatatctgctttctgagaaagtagcaagattttgctggcatttactttttgataattaaaactagatttttattttatcctataatcggtagtattctcccccactcagagtcataaataaggttaaatagtacaagacgtatttagtcacctaatgatgctgatgatccatctcagccaaaacaaatccttaaaaccaggcaaataatattaatctcacaaaagaagcaactgttaactagaaatggaaatccaattaaatacatttcctgaataattaaataataatgaaaacttgaggaacatgtacaggcatacctcagagatactaagggttcagtttctgaccactgtgtaaagtgaatatagcaatacagggaggcatacaagttttgtggtttcctagtgaatagaaatgttacatttatacaatgctgtagtctattaagcgtataatagcattatgtatataaaaacagcatacaaactttaatttaaaaatacgttattgctaaaaaatgctaacaattacccgagccttcaacaactgtaatctttttgctcatggaaggtcttgctttgatattgatgactgctgactgactaggatggtggttgctagaagttgggatgactgtggcaatttcttataaaaagacaacagtgaagtttgctgcactgattggctctttctttcatgaaagatttctccatagcatatgatgctgatagcattttacccagagtagaatgtattttcaaatttggagttaatcctctcaaaccctctcaaagccactgctttatcagctaagttatgcagtatctaaatccttggatgtcatttcaacaacgttcacagcatcttcaccaggagcacattccatctcaataaactgctttctttgttcatccgtaagaagcaactcctcacctgttcatgttttattatgagattgcagcaatttggtcacatcttcaggctccaatttaattctagatctcttgctattttcaccacatctgcgatgacttcctgtgctgaagtcttgaagacctcaaagtcatccatgaggactggaatccacttcttccaaactcatgttaatgttaatattttgacctcttcccatgaatcacaaattttcttaatgacatctagaatggtgaattatttccaattaacttttcccagttccattagaggcatccctacctatggcagttatagcctaatgaaatgtatttcttgaataataagacttgaaaattagaattactccttgattcatgggctacagaatgaccgttatgttagcaagcatgaaaacaacattcacctccttgaacatctccatcagagctcttgggtaaccagctgcatcatgaatgagtggtaatgttctgaagagtcatttttttctgagcattagggcacagtaaggctcaacagtggacttaaaatattcactcgagtatgccctaaacacaggtaccatcatccaggctgtgttgttgcatttacaaagcaaggtcagagtagattcagcataatccttaagggccctaggactatcagaatggtaaatgagcattagcttcaacttaaagtcaccaggtacatttgcccttcacaaaagggcaggctgttcttggaagctttgaagccatgcattgattttttctctttagctatgaaagtcctggatagcatcttccaatagaaggctgtttcatctacactgaagatctgttgtttactgttgtcaccttcatcgatgatcataaccagaacttctgggtgacttgctgcagcttctacatcagcacttgctgcttcaccttacatgtctatgcagtggagatggcttctctccttcaacttcatcaaccaacctctactaccttcaaatgtttcttgtgcatcttcctcacctctctcagccttcatgatattaaaaagagttagacccttgtctgaatcaggtcttggctcaatggaatgttgtaactggcttgaacttctattcagaccactaaaatgttctccacatcagcaatgagactgtctcacattcatattatttatgtgttcactggagtagcacttccctcaagaatttttcctttgcattcacaaattggctatttggcacaagaggcctagttttcaacctgtctcagttttggacatggcttcctcattgagctaaattattcctagcttttgatttaaagtgagagatttgcaactcctcctttcacttgaatgctcagaggccactgtaggattattagctggcctgatttcaatattattttgtctccgagaatagggaagcccaaggagaggaagagaggtgggggaactgctggtcagtggagcagtcagaagacacacattaagtttgccaccttgtaagggagcagttcatcgcactccaaaacaataagatcaaagatcaccgctcacagatcaccaaagcagataaagtgataaactttaaaatattgcaagaattaccaaatgatagagatagagtgagcacatgttgttggaaagatggtgctgctaatagacttgcttgatacagggttgccacaaagcttcaatttgtaaaaaaaaaaaaaaacaaaaaaaaaaaacactcattatctgcaaagcatgctaaagggaagcatggtaaaatgagctgtgcctgtgataccagcaaatatttattacacgctgcatttctttaaattgtcttatatggcgggtattactttttcctatttcacaggtcagaaagctgcaatgcagagaggagaaatgatttgtttaaggaagtagagtaagtaggcatcagaggcagcattacattagcttcgaagtctttattttcactaaaataccctgccttcccctcccttttgttgctctgtgtcccactttagtatgaaggggcctatgtttatatcacagtaaagtcatgacttaagtagttttagacatagtatttcccccctcatgaaatttaactcctgcagcctattctatttctttaacaaagacatacagaatcatattaattatctttttaaaaaacctgaaaataccatcaagatacttatggaactcacatgaaagtgaaatagggagtatgtccccattccctcaaggaattgagtaataaactaagttttaaccaccaatggtagcaggtttgcatgccacttcacccagataacataaacacaccagttatctgcaacccctgtacgcccaacatggtataaagcaaaaagagaaccatttaacagcttttatattagctagtcattccagtaataaaacaggaagacaatcatacataaatgtcaccacacaaaaactttctctattacttattaataaccaacctgataatatcattaacggcttgtagagctaattgcggtggctttttactgctccctttgatatgtgcactatcctgaggaggataacatctgttagatctaactcatcccaaacatcaaatgtgacaccgtggtgtttaaataacttgactgcgcgctatttcagcaggtcctttcccgctctcctttctcatcttcacaaggctgaccacaggcagaggccttcctgtgctcattactgagtttcatgcagacacgatggagtgggagggaaagtttattaccttcattctgcttgaatccatccctgactttttggtccttcacagatttctttgggaaaataaaaatgatatattgttttctgaacaaaaggaaattaatttcaatcttttaaaaaccaacttgaatgttattcagttcggttttttccctaaaaaaaaaagtttcagattccaaagtttttcaaaaagtaacttcaaatttcatctatgtcaaaataagtaaaataggtcctcttgtcctattgagaatgacaagctcagtataatcttggaaaaatcaatttctataaatgactaacccgccaattgtattttgattttttttaaaaaaagaggtgcctatgcagatgcaggatacatataaatatagagtcaaccatctcctagtgactcaatcattaaatatttagctgacttaaattacactgcatgcatggggactacagttaatgacgatgtattgtggaaaatgctgagagactggatggtgtgttctcccagcaaaatgctaactaagtgaggtaatacatttgataatttgctaaatttaaccgtgccacagtgtctgtctacttcaaaacagcacgtggtatataataaaaacatataattttatgtcaagtttaaaagtatatttatactaaaaattaaactcatttttaaccctatagtttatgtgaaactatatgttatgtaactgaaatattttcacctaatgtgaaatcttgtctctgctcctgccacaaaacagaaacatgagaaagtccactcgtacttgtcagaggtgggttctcttcatcttgctgattcctctggtgggtctggtaaggctgagcttggtgttccctggactcccagaatggtttgggtccagcactgggctggccctcaggaggctgccctgcacatccccgtgcctgtgctgggttccgccccagcctgtctgtgaaatatgcgtgtacgtacgtgtgcacatatgtgcgtgtatgcatgtgtgtgcgcaggtataagggacagagacagacagatgaacacagatggagaaagaaaaattggtaggttgtattgagattccaatcaaaatctaaaatatgattttatagtttcaaactcaatctaaaccttttttgcagggtaatgttttatgactaagcagacgcagaagtcactctcaaataaatatagactacgtcaataaggtaacattgcattcaattatctccccaaggcagaatccctgtcttttctaaatgatgtaaataccttgttctctgtgtccacaatttaaaatggaagttaattaaaaagtcgacttgagcagggaccccaaatatagattcatttatttatttatttttaagttacacaaaagtattactatactagggtgcacactacaaaatatgctaatagaatttttgaagcaatgatgtgaataaaatgaatgaaacattttagaaggttcataaaggcaacaagaattgaaaatccagtaattacacactaagaaaaaataagcaaaaaaaaaaaaaaaaaaaaatttctccaaccaaatgtttactggaaggctgtgataatttttatactaaaggttattattctcaacaaaagcttatttttttccttagtaatagttcttaagctcaatttacaagcacaaattctctaatcttattgtgagaaggctgttacgaataatttttgttgttcatacagagaaattgagaaacaacgataataattgctcaaattattgaagttaagaagaaaataaaaattaatggtctagtgtttattcttataaaccctcctcacaacacacacacacacacacacacacagagagagagagagagagagagagagagagagagagagagagagagagagagaaattttccacttgtctgcaaatagtccctaaggttcttagccaaggtgtgtacctcaaagtctaaagtatgaagacttaaaagtggaatcaacagagcattttatcatgaaagccacacaagtgtggtatctgaaatggtgttctaaacatccttcgaatgctgccttttcttcaccttattgccaggaaaagcacagaagaatgcgtcaggtggaaatctgcatgggaggacaagcaatgaaacaaggtggcctctggctgagtagatgcactcactcattcctccaaccagcgctgtctgtgctaactccatggcggaattcctctgagtgctggggaacacaacagtgaacgtgacagacaaggtccttgtaaaacacacggtctcgtggggaaggcagagccaacaacacaaaaatattctctgcaaagcagagaactgaggtaaactcgtgtggttgtcagtgactggggtgttattttaggagaaggctgaattcatgcaattcttgagttaattatgttcttcgggctggccctggggactgcagtggcaatggaccaggtttcattgcaggaggagggtgttggcagcgactctgggcagtgtggggctaggccgaggaaggcgcctgaggagacagacacccttcctctctgacctctagggcccaggtccagcttcccaagacacccagcacaaggaaagctccaatcgtcatctttcatttctatcaagagtgacacttacggatctctaacaacgtttctatccaattttgggtctctaactatgtttctatcctgatgaaaaaagccagagggtttaataagaaaatgaaaattaaatgcactacttcctcacttagcacacagcaaggttgaggggcagcttttctgagcctgaccctaggaatttcctaactcaggtcaaaaggtgactgactcccaagccaaaggtctctaaggacaggtgtgttaataacaccactgccatgggtggagctttcagaggtctccaaggacagatgtcttaacaacactgctgccatgggtggagcctctctgtgccacgtactgtgctcggggagggacatgaaccacctcaccctggacccctctctcttctccagtatctgcattacatgtgcccagggggcccttctctactctgctgggatgccagcatctggcccagcatctggcacagaacagactcagcccaaatgtagaatataaagtcgggtatgggggtctgatgccctggcaaaggaactgaaagacttacccactgtccagtccaaagtccctaaaagaaagtcacagaggccaagaccccagacactttttgtccccaacacccaaagcttcattttaaaatcctttcagttcctccagaaaaaaaaaaaaaaaaacaaaaaaacctgaccctcaattcttagacattttatgtaaatgaggagaaagtaaggtgctagcccttcccgatcacttcttgttttgaatggatgtgtgagtcctgccaaagtgcaggctagtttgtgttctccaaatgcctcctagctcagtgagggtggtgtgcgcagggctgggatgggccacacaacatataggagcccaaatagcaagaaggcagttggagcacagcttaatcctgttgaaagaagccaccaagaagagctggggcaccggtgggtgcaggtgatgagcaaagctaccttcttccctaggtaatgattgcccatggggaaataatcagtaattcttcatctaggaaaatactagttgctgttcagagcctctgactggaagtgaggcatttccaagtatcaaacaatgattaaaagaaataaaaaacctttgcatcttggcatgctcatttaagaaagaaaacaaaatagacgtacacacagcccatttgcattccctctacccagtctaaaaggtgtccgatgattcattttaatcatttaccaatttcttggtaaccagtgtgtattgcagcagatacttggcaaaagcatgttaatttgctactaatatctgtataaaccagacattaatattctcaatttacaaataagcaaccagaacttcagcgaagataagtaacttagccaagattatccttctaataagtggtaaagctggaattcaaacacaggcctagtggagtccaaagctttccccactcctcagtaaaaagctaaacaaacttcctaattttctgagcttcctacatactctttgcactagggtaacaaccccatggctggctttattgcagagtttctctgcactggcatttggcctttgcctgtctaattttggctagttgcataagattctcacttagtgcaggctcaaggtgagacagtatttttgttttttcttaggtttatctctggagattgccaatgcttgcaagaatagcaatgctatcattaacctaataatgttggattaacttcaagagctgggtaatagcgccaatgttcatttcccgtaaatgttggaaactcctttaacctcatgagatcctacataacgtgggaaagagtccagttctgactccaaaatcttaataattcactctttcgttaactgctttttaaaaattaaatgtataacaccaaatagtgaaaaataataataatcagtttgtacctaaatttctttaaagaaatttttagttttttaaagaaatctttccaatgattctgactttttggaggggaatgccacatggtgattatactgctaaggtatatatatatatatatatatacacacacacacacacacacacacacacacaccttatatatatatatatatttggatttttttgagacagagtctcgttctgtcacccagtctggagtgcactggcacaatctcagctcactgcaaccttcgcctcccgggttcaagtgattctcctgcctcagcctcctgagtagctaggactatagatgcccccaccacgcctggctaatatttgtatttttttagtacagtcggggttttgccatgttggccaggctgatctcgaactcctgacctcaactgatccacccacctcggccttccaaagtgctgggattacaggcatgaaccacaatgcccagccctgctaaggtatattaacggtcagtttagtattatttgactatttgttaacataataggagtaaaacttaacactttttagggtagagatggtacaaaaaattaaagtgtaataaatataaatctataaaaacagaagttaaataagaagaaatcttctggggaagaagaaataatagagtatagattattcttaacgtaagtcaaatatttgataaggaccacaggcaccttcttttaattcagatgctgaattttctttagtcctagaaagaagtgttgttagaattccaaggatatttggatgaaacttcgctgtaaactcacgtggaaactattttagctggccacagatgtgaaactaaaaatgttgaaatacttatttcaagtgcatctcgaaaatctgcaatgacttcctcctggaagataattttcttactacgcatgcttgacatggatttcgaacatctgcaatgacttcatccaggaagataattttcttactgcgcatgcttgacgtggatttcgaaaatctgcaatgacttcctcctggaagataatcttcttactgcgcatgcttgacgtggatttcgaaaatctgcaatgacttcctcctggaagataattttcttactgcgcatgcttgacgtggatttcgaacatctgcaatgacttcctcctggaagataattttcttactgcgcatgcttgacgtggatttcgaaaatctgcaatgacttcctcctggaagataattttcttactgcgcatgcttgacgtggatttcgaaaatctgcaatgacttccttctggaagataattttcttactgcgcatgcttgacgtggatttcgaacatctgcaatgacttcatcctggaagataattttcttactgcacatgcttgacgtggatttcgaacatctgcaatgacttcatcttggaagataattttcttactgctcatgcttgacagctgggtctccacactgcatcacttccaggctcctttcacacagccctcctggcattctgcctggaaatatgtcatatagcaagtttcacacttttttaacatacttgcaaaaaatcttaggttagtgctaacctaagattagtgcattgtttctaaaaggccaacgcattacatttttcctgagaataaatattgacaactccaggatttaaatagtgcacttggctaagattatggattttaggtagtctgtatatctttatgatattgtcctatgtattttaacattcttcacttttcttagtactgccatttcatgatttttttttccttttggatgctattgattagtacataaattccttggttgtacaccctgttttcattgctaatccagtagaagaaaagcaatatgcccaaaatcttttacaaaaaaaaaagctttcttgcatctgctgcttgcattctttgtgtgatacagtattttctctcattattgttggtcttcaaaggcaacaacagcataaggtctgctcaggccagagggcctcctgatatagtcctcatggagaccacacagagcctttccaagaggtcaaaggaggccagaagtttttggttctttttctcctaacttttatgttcatcccaggtaagcctccatctccaatctctgtctactagaatctatacacaagctggtgcaccagcttgcctgctctcacttgccttcctttgatgataccataatgtctctgattctacaacttaatttttctttcactcaagtctagtccagtagatacacattcctgttatggcaaaagatcatgtactgctatttatggaactgtaatttattctgtacttataggtgaattaggcaaaccaataatgccagcaaagcatatagattgaggccaacatttgcagtcattagacaaagtggactcagccactatttctaagtctttagtttggcctaatacctaatgttacattgatgccatactgtaagctccttgaagtaattttctacatttttaaaactcagcctatcattgctaaaataataaaaattctaatgcaagttgctctttatttctattacctgtaaggacacttgtatttgagaatacacacttgaaatgagttaaatataccaacatggatgtttggcttcaaagaccaggagcatgtcggatccgggctcactgctaagctttctctgactaggcatataaatcaacatcttcagtgcttttagggccaccatgcagcaattccatgatgcttggctcaagctctgcgcatctcacattagtcctcctttcacccaagctggctccagtaattgggtgactgttctggcagaatcatgtgctaccatttaaagtgaactagacaaccagttgatactgggtgaggataggagattcttttttttttttttttttttttgagacagagtctcgctctgttgcccaggctggagtgcaatggtgcactctcagctcactgcaacctccacctccagggttcaaacgattctcctttctcagtcccctgagtggctgggattacaagtgcctgccaccacgcccagctaatttttgtatttttagtagagacggggtttcaccatgctggctaggagttggtctcaaactcctgacctcgtgatccacctgtcttggcctcccaaagtgctgggattacaggcctgagccaccatacccggccgaggctaggagattcatagaggacagagaagacattctaggcttcatattgaaattgtaaatgtgaacccataaacaagtcaatagagatcaacttttgcatgcacgatcttatttactcttacataataccaccaactaccacttaactggaatgtcataatgtagaatctagacaatctttattaaattattaaattagctagaatcactcaacatggtattgtggtaagagtaaataataaattttatctagcaaatttatttttggatatacattacttcaaatagttgtgtgaccacaggagcatcataactctcaccggttttttcttctgggagacagctaataaacaactttactacaatttagaaaataatcctttagatttagttaaaattaaaaacatttcatatactggtagctcaaataaaattttggttgctcactaaaccatattatttctcagacatgattatatggtcattttgattacaaaagaaatacaaagcaaagtttatttggaaaccttttcaaatgtttctacattgttagcaaagcattatatattttcaaaagtatccaaaattttttttgttacactgtagtaacttataatctagcttgtatttcctattttcccataatattaacaaacatttacgtatttgagaaagaattccttgaagcataatgagaatatacttgttcaaaaatctcgctttcatgttttcattttaggactataaacattaggtagttcagaagaggaggtgcaatgcaaaaggtcctctgcaatgctagggagctctgggcaaagtgagagcgttctgctttcccttagagaggtcctggcctaaaatgaacacgtacttccacgagcttcgggtgtgatacagaaatatgtatgactctatgtaatccttatcatggcgttcctaccaactcaaacatttttaaggttaactgagtactcgatgtaattgtaatacatccacctagtcactactacaagatagtctgtgtggctgcaggctatgaaggatagctttttattttttccttatcaaggtaatatttggaacacttcaaaaaagccatcacagtgccattatagatgaaaggcttcccggtagaaatttcatttcctatacctgtaacaggctttcctgcagaaatgatagcatatgtgatacatccaaaaggcttatctcatgaagtcccagtgaaatgtattaattttgcttttggaaaataaaaacatcactaatttactgagaactctgcaatgcagtgtaaattctgtacccaagaagtagagctcatcacttaagtgaatagaaaagtagcctatagatgttactgtggttatgataaaacacttttaaatcctgtatatgtttaaagtttaaagaaaagcatttgcatctcgttttcctagtgtaattaattggaccttgaatgttgtatgtttccctgtgatatttgaatgaaagccaggggttgtcttattatttgccttaatatctatttgcagtaaaaagctaacaaagaagtgtccaaatttgcaggtagtgaacccccatttaaaagatatactatctcaatcaactcacctatgtaactttattaatataaaaagagatatcctggctgagggcagccagaagttactctgggataactagccttcaagacgtacctcttggtagtcatactctagcataataccttcccacaatgaattatggctgccctgtgtgatcaatacaatataacagcagtaacaatatgtgctagattatataaaggaatgcagctgccacttgaacatttggattgctcatccaggggaagccagctgtcctgccatgggaacacagacactgtcctgcagaaaggtccaaacagagaagaactgaaggcccttggccaacagccagcatcaatttgccacatgcacttcagtttgccacagtgccaaccacattggaagtgaatcttctatcatcagttaagtcttcagatgaatgtagctcactgacatctaactgccattgcatgagatacccaaatcaagaatcgcccagcagtctctccacaattccagacctacgcaaaccatgaaagataatgcatgactattgtcctaggccatacgttttgaagtaactcattatgcagccatagacactgatacaaacgccaaagttacaagaaattctcctttgtttgcaaaaaaaaaaagaaagttcttactccagatgcccactgtcacctggggttgttgtgtggtttagcagtttgaatttcaaggtgcatatgctttaaaataaagggctggctctcaggcctagtctgtctagctgagcatacatataggactattattatctgagttattaacatttcttcaaacacagcattatccagtttaaattctgtcttcctcagtagacactaagttgtagaactcaggcactgtgctgtacccaatgcaccaggcaccttttctggtatacagtaaaagctcagtaaatgttggagacaggaatatgtcattcatatgtgaataattaaatgtagacaaagcgaatcgaatcatttcttgaagcctaatgagttctgggcaaggccttaagctgagttaagagttactattgcagagcttttgttttcacttccaggcagtccttggaatgctgctgggccattttgtttgtatatgtactaaaccagctgggattgtaggagttttagaatgttttgaaagaataaatttctctgaaatgagaagtggattgtcattttaggattcggagtagttgaggatgtgttcctcgtgtttgaacaggagtgcagtcagcattagtgttgtccagccctccttgctgccccaccacatagaatatcgagccagctagtccctttgtttttaggtgggacgtgtcactagttctggctaacaaggtggaacgatgggtatcacttcccagccagagcataagacgccaactcttccctgcctttgtgactgtggcaacttgtcatggtggagcctcgtgacaaggaccttgtctgtcgcgttcactgttgtcactcagtcagcctggagcccgaggtcccacatcgagcagacccactctggacccgtcgcttgtgttagaaaacattttttgttgttgtgtaaagccactggaactattggcacatttgttacagaaacataattttctgtgctgataaaggccagtgtaagatcgatataaattaatcaccctcccatatgcacatgcacacacacacacatttatacaaaagaagcaatcatatttactgtgtttttacctgcccagaattcttctccttttttggtaagaacaacttcactgacttctgagaaaccacaagtctgatgcatttaggttcaaggtgggctaacttatcccctaaacacacaggcatgaacacacacacacaatatacacacaggcatagggtttgactagggtgggcctatccacctgtttagttcccatggccatagtggtgttggagatagtatgcaaccgaggacagcgcaataagggtcactcctatgacttttgctggaactattaagaaagaggccttctcttcccactaggcttgctaactgatagaatgtaagcctgaagcttatggtgcctttctgtcaccaagaggacacagctgacttaatgaagtaaattccagaaaatttgcttaattattgttaaatgattctgtgaactctcttcatttagcaactgttcaggaaggtaagaaaaagaagcaaactcgggaatatcaacagatttgagatgtctgaattaacttcgagcacctggattaagtcatgtctaggccaacattaatgccaggaactcaaatatttaatccaacaatctctctttttttcttacgccagtctggctggatttctgcttcttgtaattgaaagagtcctagctaatacatcttctatatgcacacggctgtactagatatttggaggtagatggaaatgcagaagccgaagacaagcaaatataacatggtccttgcttcagaaatttaaaatttgtttacagggacaactataataaatgaaaagctaaacgctccaatccatgagctcttccagcagcgttaaggaggtctagaaaagctacttatttcctgcactgtcaccgctgacattgagtgttagggaactccttacccatttttattgaggcagaagagcacactcggcagtagaaatgtaagattttggccggtcacagtggctcatgcctgtaatcctagcactttgggaggccaaggtgggtggatcacttgaggtcaggagttcaagaacagcctggccaatgtagtgaaaccccatctctagtaaaaatacaaaaattatctgggcatggtgactcccacctgtaagccaagctacttgggaggctgaggcctgagaaccacttgagcctagtacctggacgttgcagtgagctgggatctcaccactgcactccaccctgggtgacagagcaggattctgactcaaaaaaaaaaaaaaaaaagaaagattttctcaaatttgtggaaaagaaactaaacaaaaattcactatgaatcaatttactataaaagttctatttaacacttgcaacataaagcaaatactttaaaattaaaaatcccagagtgctatgtaatacaaacatgaaaaacatataaaaggcttctagtatcatttcctaactaacatctggcttactgaataaagctttataacatcaacttcatttttccacagttattatcataggtagttataatgtttttcttaaaaaaatgaatatcaacacaaatttgctgttataaagagtaagacaacttcagccagatctttctctttttgttttttttttttgagacagagttttgctcttatcacccaggctggagtgcaatggcacaatctcggctcactgaaacctctgcctcctgggtgcaagcgattctcctgcctcagcctcccaagtagctgggattacaggcacccagcaccacacccagctaatttttgtatttttagtaaagactgggtttcaccagttggccaggctggttttgaattcctgacctcaggtgatccacccgcctcagcctcccaaagtgctgggattacaggcgtgaggcactccacctgggccagccagatcttttaacttcatcaggatcttcactttattttcagggaaacaaatatgcaaatctccttttctctacagtaatctgtgtgtatattacatgatgtggcaaatgatacattcctgcttgccacaactaattttcactaatttctccagatattctatttaagagggctattttctaatgggcaatctttaatattgatccagtaatttaccatacagactcaagaaaaagaaactgaagatgtaaatttttacttcagcaaaataccttcttcacatgacttaaaacataaacatgattatcaggaagtattatgaaaaatgggactatgaaaaatgggacaataaaaattctcctagggaaacttccatcaacaagaggggacggaaaaacagcattttctctcaccaaggaacaatcccctccccattttttttcatcttgttggtgaaactctaaaatgaatgtgaaagccacataagcaacagcaattgggtaggaactgtggaaggaagccagagatattgtcatggagagacatcttcctgaaagtgaggggaacactgaggggtcaaaatcagaatggggtaaaccaatgggtggatagctccactagaccaaatttggtttagagtaacagaggaggcaggtgaaaattaataatcacacagcaaggccacggttggaagaagcagtctgtatccatgaggcagagagtaagaaagtgagcaatactagaatagcaggtggactactgctctacgccccaccacatacaggacacccctccacaatacatgtccatgaaacccaagtattcaatgttgaataacacatacacacacacacatgcatgtatgcatgcatgcacacaatctatacaaacatactacaagaaaaagtctatttatagactaagaaatctcatcagaaaaatgttgttactcaacagaactctctggcaacctattctagtaagaaatgaaaaccaaacaatgaatcaaccaagcagttgtgtccatgaaacaagacaacagagcagaaatacaagagctggagacataacagagaaacttaaggaacaactgaaaaaaaaataaaaataagatgtgaagtgacacaaaggtacaaactcactgcaaaaagcactacaaggaaaaagatagaaaaaagaacaatgagctaaacggcctgtatgatttggaaaaaaaagaaatcaaagaagaggctgggcacagtggctcacgcttgtaattgcggcactttgggaggccaaagtgggcggatcaccttaggtgaggagtttgagaccagcctggtccaccatggtgaaaccccatctgtactgaaaatacaaaaattagctgggcatggtggcaggtgcctgtaatcccagctacttgggaggctgaggcaggagaattgcttgaacctgggaggtggaagttgcagtgacctgagattgtgccactgcactccagcctgggtgacagagcaagactctgtctcaagaaaaaaacaaacaaacaacaacaaaaaaaaaaaacaaagaagatttgaatctacatatggaaataacactttgtaataaaaggaaaatgacctgtagacaacaccagattataacttattaaaatgatcagtttgtggtttgtggagcaaaagaatcttctggacagccaagcagaaagatcaattcacttatgtggagaaataaatcagacttgcctctgactttcccacagcaacatgtaaatatcaaaaaaaaaaaaaaaaaaaaaagctaaaatgacaccagtaaaaaacacaaggaaagagtgttccaagaaaagtaatacagcatgttgaatattgttctcaaaattttttggaaaaaaccgaactatcattagcttaataatagaactaagactgaaatcattgtggattttagggtaatggaaaacagtttagtgcactttgtcctgactgtaaaacaacagcatttctttaaaatgggaggtgaaccagaaaaggtagatgggtgggaagcagaggaagtacatttcttaaaacagaggatacatcttttctcaaatgcttatggaacagtcatttccttgaagagactgcatatcaggccccaataaaatatgaattaatttgaatgagggaactactatatacatcatactctgagtacaatgtaatatacacttagaaattaataaagcaaaaataacgtgttattaatttaaaataattattttaagcaattcttgaataaaataggaaatccaaatgagaatcacagaatatagtaaaaacattgatgataatggaaacgcaacacaaggcaacccacgctgtgcatctgaactgatgctcagagaaaaattcatagttgcaaaagcaagtgtttttaaaaacaaggaataaaaagtatgttttcatgccaaaatgtggcaaatggagacagaactacgattaaatatatataaacaacataaccataaaagtcagaaaaaaagaatattaagaaaaaaatagaaattgctgaatcagaaaatgggcaaaaagagcagaaacatcaaataaactaaaaagctagttcttcactgggaaaaaaaaaaacctatgcagatactccttgacttacaataggtttatatcaccataaattcattgtaagttgaaaataccataatctgaaaatgcatttaatacatttaactatggcatatcatagcttactgtagcctactttaaatgtgttcagaacacttacattagcctacagctgggcaaaatcatctaagaaaaagcctatttttataataaagtgttaaatatctcatgtaatttattgaatactgaaagtgaaaagcagaatggctgtgtgggtagttcaattacggttcctactgaatgcctatcacttttccactattgaaaactcaaaaaatcatgtcaaaccatcataagttgagcatcatctttaagcaataaacttcaaactaatataaggaaagagaaagaaaatatacaaaattaaaataaggagaatggtaaatatgagggaaagaactttgcacaattctttgtaaatttattaacttgaagtaaatgaacaactttataagaaaatagaatttatcaaaattgagtcaagacaggaaatctcatcagaccaatttccacagaagcaaacagttattttggactcgataactttttaaccagctttaagcaacttctagagattattctgagtatttcaaaccacagtgttgccgggtgaagtggctcatcccagtaatcccagcactttgagaggccaaggcaggaggatcacctaaggccaggaattcaagaccagcctggccgacatggcaaaacccagtctctaccaaaaaacaaaaattacccaggtgtggtggcacacacctgtaattccagctactcgagaggctaaggcactagaatcgcttgaacccagaaagcagaggttgcagtgagctgagattgcaccactgcactccagcctgggtgacagagtgagactctgtctcaaaaaaaaaaaaaaaaagtttcaaaccatagtgtcattccgataagcagtattattccagcgtttgccaaccatgctcaggcatggagagttaaggaaattaatagccatatgtacttttctccaaaaggaatctatcggaacacaaggccgttcccacactttccacttcccactcacagttgcccccctactccctcacggtaaaacaaatgcagaagtctcactcttgagggctcttagcttaattcattgtctcggggtataagactttaggctgacccccaaaaaaggaaaagttaaaatatgtgtgtccactcagcctcctttaactaaagcactatacaataaatcataaatagtaggggtttgtgtctttccttgtcatatatatatatatttcttttatttcctttttttttttttaagacaaggtctttctctgttgcacaagctggagtacagtggtgtgatcacagctcaccgaagcctgaagcctcaaactcttggcctcaagtgatcttcctgcctcagcctccttagtagctagaatgccatcatatctgagtgattgttttttagctttcttagagacaaggtcctgctgtattgcccgggctggtttcacactcctaggctcaagtctcgggctcccaaagtgctggggttacaggcatgagccactctgcctggccctgtcatgcatatatttctgttaagggtatagggatatctggccagtgttgggatggtctggactcagatacccatgaagatctcatctagtctcaaggctttaaacaccgtctggattctcactcccagatttatatcttttccgccttgctttgttctcaacataactggccaacttcttctcaacattggtttacagcatgtccatgaacgtgaaattctttcaactcacaaggcccaacaccatctggcgcctttcgtcacttgtagctcgcctccagctctcctcactcactctggcctccagcctctcctgccagcgaatgcttgcccccttggagctttgggcttgctgctcctttaatctcattcttccccatgcagccctgtgcctcactccctcacccgggctgcgtctttactcaaatgccttcttgtcaaagaggtcgaccactccgccttatttagaactgcactctctgcttcctatccccagcgagttttatttttatctacagcatatatcaccatctgaaataccactgtgcatatctgatggatttatcttgtctgtcgtcagccttttctctttaaaaggaggctccaagagggcaccggtgattcctttccattgtgtgaagctgtaacccccacacctaaaacacagcctgacacaggtgtcagaaatagttactgaatccctggaatcatcaccgtattcctggattcaggaatggggaaaaaagtgttccatctgaggacagaactggatcaagttccaaagcagcctcaaagtttggatgggattggagtggggagtgacacaagtcgttgtaattacatgggcggggaaatcatggagttttgtgggaggaaggccaatgtcagaagaacgtttcagggaaatgggtccaggtggctcacttatcatcattaaaaagctatgcaagtttttacttctctttctcctctatccataaagtcctggtggtgaaggcttacctgtttttttcatggcattaaaccgaaccattcacttcatgattttgcctggtatcccagtaggtcttccctatcctaatacataaaatagaggttggttggcaatttgctgcttcatctgtcagtttagaaataatcctttttggccgggtgcagtggctcatgcctgtaatcccagcactttgggaggctgaggcaggcggatcacgaggtcaggagttcgagaccagcctgaccaacctggtgaaacccccatctctactaaaaatacaaaaattagccgatgtggtggcatgtgcctgtaatcccagctactcaggaggctgaggcaggagaatcatttaaacacaggaggtggaggttgcagtgagccgagatcgcacgattgcactccagcctgggcgacagagtgagactctgtcagaaaaaaaaaaaaagaaagaaagaaagaaagaaaatccttttttcttttcctcattagcaaagagctcagtgcttcctccaaaaggatattgggtctagaaatttgccaaatacctgtgagcatgtcctttaggattccaaatagtacactcatattttgaaatttggcaaaggcttgaaaccaacacttatgggtttttggtttgtttgtttcactcttgttgcccaggctagagtgcagtggtacaatcttggctcactgcaacctccacctcccaggttcaagcgattctcctacctcagcctcccgagtagctcggactacaggcgtgcaccaccacacccagctaattttgtattttgagtagagacggggttttgccatgttgggcaggctggtctcgaactcctgacctcaggtgatctgcccgcctcggcctcccaaagtgctgggattacaggcgtgagctactgcgaccggccacttctgattttttaaaaagtgaacatagagccacacaccaagtaaggaaatacttttagcagcatagaatccaacgcttgccttccttcatagatctctatatacacaaaatagaaatgaaaccaagcactaggcctatattattaatgcaagaagtgtttgcttgggattggatgagcaaaaatgtcataaaaacaaaacaccatgaatgtttcacaatatgccccgctcagaggtcagcccctccatgtgtcctgcagagctcctgaagcctttaagagacaactcaaaaaaggagtgaggcagcctgttctgacacttggacgtcttccaacgcagactttcagtattatttttctaaacatcctaaatctctagtgagaacatggaatagactatttctgtaatggcagatcttacaaaagagaaacaacttcccgaaaacatgcctatgtccagtcacagagaccaagcatcaaaatcacctgcaggggtttctctaagtcgccctcacacatgcttggacatctgtatgaattcaatgcacagtaaatactcctttgagggtctcttatggacaagacttcgagagaagaataagatacattctgcctccaaggaactcatcatctagtccacggtgtgtggtgatgggaatgcagatgccaggtgctatgaagtgaaccgtgtcacccccaacatttacatgctaaagctctaaactcagatacctcagaatgttttgggggacacggcctttaaagaggtgatcaagttaaaatgaacccattagggtggacccgaatctaatctgaatggtgtccttataggaaggcaagattaggacaggagagatactggcgttgcaggagcccagaagaaacgctacgcgggggtgtagtgagaatgtgccatccgcaagccaaggagacaggcctcaggaaaaaccacctgctggcactgtgcactcagagtaaaccccgagtgatctcagagttctagactccagacctgggagaacatataaaccacgcagtctgtggtatggcggccctagcaaactaactcacctgaatgtaaatatacaactacaaagcaacaaataaaaagatggcaacaacaagcaagcaatggaatggaccctcctgctgggctgaacatcaagacagggatttagaaccagctttacacaaggagcatcatttttccctaggtatgatttttatccaattcactttgattaatgacagctaccatttagcaagggctttttatgtgccaggcaccaaactcaacacttttcatgcattcacttactcaaccttcactgcaaccatgtaagatcgttgccattgttattccaaatggacagatgtggacactaaaacagagaggtaaattttgacctttgctgaagtcagatggctgcaagagttggaactagagttcaagtccaaagagtccaactctagaatccttagaaccactgtgcatactgcatgaacagtactcttaccttctctagtcaagagttcaatgtgaactttattccagaaaaacacaccattcaacatcttcatcaaatattataaagaatgcagtacttagatatagactctctatgcagcatttcctagctacatttgacctctctgtttcaatgtatctgtgtagcaaatattctatgaaacacaatttcttaattattgacctcgttgtgtctttaccagcactgtgactataccatgtggtgtgagagtcactccagtgaataaacacagactgaggtcaagagtctaatcattaccaaggccctgggaaccctccttgaagagaagagataggagcgcactatccaccatgaaaagttgaggtaggtagcaaagtcagtgtctacaccacccgccagcttctcctcccctcttccacacgggtgcatggctgccaccacttcctgatgggaagcttttcagaatacagataacatcctcactctcctgcctccctccccaccccagtatttttatttagtagatctggtatggctctaggaagctattcttgaaagtttaataatgattccaactttctgccaggtttaagagccataataatgttgaccaaaattgtagattttccaggatactctaagctttgataattttgtgcggacagttactagatcatgtgatctaaacgagggttggaaatacccccatttatattcccaggcagactttcccttgcccacttccaaagcaacctagactttgggactactctattccctcactgctcttgccctcactcacttaaaatacttttatctaatacaaaggtgctagatgttgacctgattgaagtagagctgttaagaggtaactgaagcttcagctaaataatgccagggggtaacattgtccagggaaactgttcaccagcagacctctgttgctcctgatgtactccaagttattttcagtttagcctttcataacgttgtacaaagaggctttattcataaaacagtagctttggttggcctcccacatcgtgaaaacaaatgtaatatagtaattaagtgtgctgatatgttatcattgcaaatgtcaagttcattgtagcagatgtgtcaactgaagatcactacccattaaaatcaaacaaccagtaggccccaaactcaccatctgatttcatgcgtcaacttcaatgcttaagacagtcaatcacaactgtcttccatgtaattgtcttaaaattattacataacaaagaatcagatctcaattcttatcacctgctagtcataattaaaatgtgaatgaagggctaatgactgacacagttacagggtataaaatactttcacaattttacttccccaaatagatggcattattattaagaaaaattactcaaaatgtgaaataaggaaaaaaacgactgatgtgttaatgtcttgctagagcaaagctcactaaatctccttgaactctctagagaaatgtaacttggttaaacttactacattttctattcatttgggcccaggtattttacacattttaaagtttgggttcctaatttaaaaaaaaaaagtgataaaatcagatgactaatatttttatcaagttaaaaagttttattatccagtaggataataaattagccactatgatatctacatcttttcaattttatttcagcatttctttttcatctgactatataaaattcctactctcatatcttcttttgaaccagttttgtcatcctgctgattccctcattagtagtcacatggatcttatgaaaataaatataatatcccattagaaacatatctgctactagtcggggtacttacataaagttgcagcaattatcagaaaaaggtaatatgcaagtctcctctaaaatttcccaactatattcagaaaaaaaaaacaaaacaaaagcttaagtgactgcttaggtgaaaataagacttccagaagaatgtctgtcaaagttgtaccaagaacattttgaaaatacaggttaattcaaagaagcactcacaaaatgccctcaatatgattttgagaggaattattacaagtggtatgtattcttgaaagccaggtttagggtacatctctaaagcagaataggttgttttcaaattgctaggtcattcaaggcctttaaaccactatattctatccataatttgcaaacgtaccactaacttacactaaagagatagtgagaaataagttcttgtggaagcaatttacacatacagagttgactataaagtcctaggcactttggcaaacatgcttaggggtggaaagtttcttttttggtaaagatcccatagattactatttacattttagcatcatctaaacaatctggaagctcctgaagctcatgtctcatcttcaccatggacacaatcacatattcttactctaagcatctctcatttttattctagttgattctcattcttcattcttcgtaaatgattataatgaatcctctgcctcttccttcccctcttcttcacctcactttcccctcccctcccagctttccctctgccttctcctcccctccccgctccttgtcttccatccctgcctctcccactccccctgtctctctgacactgttgtctccaaccacacacaggctccctgggtttctttcacaaataaaggaacgatttgcatagatggggtaatgtgcatctgcttttgtggtgtaccttccattcttcctttcttctgggaatagtaactccctcccttttcttttcttttgtattttttttttatagacagtgtctcactctattgcccaggctggagtgcagtggcacaatcataactcatgacagcctcaaactcctgggcttctgcgatcctcctgcctcaacctcctgagtagttggaactacaggtgtgctctaccatgcctgccatatttttttttgagagggggtctcactatgttgcccaggctggtctcaagcttctggcttaaagtgatcatccagccttggcctccccaaatgctggcattacaggtgtgcaccaccacgcccagacccctctcccttttctgtagcacaccccaccctcaccccatgcacttttgcatgattatcaatatgggttgaaccacatgaaattgccaattttgtagatcaaacatgatagaatattagcaaatagaatcatgagattgaacatatccttttaataacactaacgtattcagtattttatcaagcatataatttaaagttgtattactagttataaatttaatatttacctctttcaagcccaagcacaaaatatttggtttgtttaaactacatcatgtaggatgaaattaatacctcaagtgggattctcaacacactaactagaaacagctctcagagaagataattcaaagacgaatttaaaatcaatcccacagcaagtaaaaccaacttttttaccaagtagttcagtcacatgggagcagcggaatcagtgtgacattttcttttcacgggatatgtgcaaccatgctgtttaaaagggaagaaataagataagctgattttatttccaccagtgaaaaaagttttcaatacagcagctttcatcgactcagcatggctaacaaaataacattatcaatgaaaataaaataatagatcagctgcacaatctaggcatttttgtttttagaggccttctctaacatttctctgtagagatctgtgaatgcctggttcctgtgaatgaaaaccaccctgctgttttttctgctcctgctgagagacttgcaaagaataaaatctttttttttttccagctggagatcaattggtttgaggactgctctggcccccaggaagtattctttgcccccatggggggaagagatcctcagttccccaccctgaccagagtttgcccccattggatagttttcaaagctgaatccagaaacagacctaaaagcatatccaaaaaatgtgccactgaaaaacagctaacgattcacatggaaagtccacaccctccatctagccgggtctcctcctgcctcccttggggaagaagggggagaatgccctttccaatttcgctcgactgaaagcaagggctgtgtctgtcccccttgctgaaaagcctccttttgtttttcttttctactgtcaggaagcctgcctcagaggagtggacaatgcataccaatgaggaaaggagagcagaggtgattgaaagtgaagataatttttccctgtcatttacaggctgcttctcaaaccatgccccttttgtgattccacttcaaaacacattcttgccaactctcatccaggaggcttttccttagtgatctgctccactatcttggagtttggcttctgttatcacctgaggagctgaaaagcgttcagattcaaggaagcctctcctctgcccaaatcagcagaatttaaggctcatgaggatgaggactgtgacagggaagaaggaggtgacagggaaaggaaatgatactttagcttatttcattgttgaatggagcaaagttgaaaatgattcttctggtgtctctccttaaatcttggggtattgatacagactcatacaaaaatgaaaaggagagaaatgaacatattcatatagtcctttggggtttcacagtgatctacctacagcgacatgttattttaaattacaataatctatttaaagagaaatatggtggaatttacttttaaaaaggttacgttgcagggatgttttaaaagataaaaattaaatggcaactcaaaaaatatctgtcaggcatttaaaaatggatttcaagacaagcatttgaatcctactttacaagaagtgactaggttaattaggaaaataaggtatcttctgataacagtaaaccttgagatacatgtgtagctcttataccggaatgaccatgaatcactaacaaatttactttctagacaaaagatggaccacttagacagcacagtataagaaacaaggaatgttaaatgaagcttaacatcatgtaacagatgttaggttttctcctctcccccaaggaggactgtaatactgttggagatgacacttgtcaactgtgcaatgtgtgtgataaattacagaagcaaaaacataatattattatttaataatccattttaaatatcactgtcatttaaataccacctgtaagaaaagttgtataaatttggcaatgaaaaatacacaatccagaaaaaattacaattaaggatcaggtttttctttgaatatagttataatttttaaaaatcccttatcacttttattaactataattattaggagactggagacaaatataaccattgaagcaaactgagtacctttcaagggccaccgtctttttcctctaacctcctcaggctcacatccccacctcaccccaccacatttaaattactttaaaaacactaaaaaatgtttcctatattagaaatttgaatctatcaaccctgatacttctttagatcctggaactccctttgctttaaacacaatgtccaactattgagaaagaaatttcccataaagaaaaccatagtatttctttggtcacagctgagaggcatttttttttttctgatctggaaaacaacaatcacagaaagcaggttgtttgcaaaatgagatcttaatttacttaaaaacagaatagtaagatgaacctactaaaagtaacaccatagcactgctacaaatgatttacagttgttcacattactgccataatattggaacgataaatgacatgccaaggggctcaaagtaaatttctggagttgaactgcacaaagcaaattgctgagtttgtgtcatatcctaccgtgaggatggcatatctagagcaaggctcaatctagaaggtgtctggactgaggattctagggtacgatgaataacaaatggaacaaagatgtcacccacaggaagtggggactacgggactcactgtggacacctaagccaccgcctccctatgcgatgaaaatctgttcttcatagcaatccagtatacattcaaacaagcagaagaacaacacggggtaagggctacttaactaacttatattatcctattttccatggaattccagcaatcataagaaaaagttccatcttcttggttttgaatgttttaaattaaaagaatttcccttcccaacactacaaatatgtacaatgacacattaaatacaactgtgctttctaaaacctgatacttgacagagagctcttcttcaaagctcaactgcaagttaaattttactgcttatcttttgtttatcaccaacaagaaaaaaattgagcttgagaactgtaagcttataactgggtaaattatgttttgtataagaaatacaagtatccatatttggattacttttgtatagatgggatatacaaaggtgccgacattacaggactgaaaaaaagagccaacttgttttgcattaaaacatttttttaaactttcaaaacaataagagactagtggtctcttaaacacagtttaatgaatttatctctggcaatgtattgtgatatgtttgtgtgataaacctgataccatgaaaacatgaaaataatttctggaatgtttcatttcttaagcaaaaatttcttaaatatgaaaattgggggcttcttctgtgcagtaataggtaagaccagtctggtctgaagcccatatcaaatatttcaacatttcatgcctatataattggctttaaaagactaaaaactctctgtacagtctgttttttttattgttgtttttctcagtccttaatatcctggagtcagaacaaatgaagaagccccatcagcttcagaccacgacacacagcttgcaagagtaaatgatttatggagctacaagcatgagttatgagggagcggtctacatatttgcgttgtgtagctatgcagggggaaagagacaaatgagattcttgaaacatttgtgaaatatagaaaggaagaaaatagaaaaaagttaataagctgcctcagatagtaactaattagatagcaaggtattactgacaaaatgaaacaagaacaaaaggcaacaaaagttggtttagggccaaacattatctgtattttcacttttggatctctactcatttcctttttttccatttcattcaaaaaactattgtgcaaatcaccattctattgtcttctaacattgccgctattttcactggattttattcaatttaggaattaaattaaaagtttcaacatttccagtcatgttattctttcatgttttttgccttaaggagtagaccatagacatcacctattttaatagtttcatctagtccagaatcggcacttggagcttcaagctgggggttagggagaaagcacagacacaggcaggctgctatgctgggccctaagggcaatgtcaaactcaagattgcagatacaggctgggcgcggtggctcacgcctgtagtcccagcactttgggaggctgaggcaggtggatcacttgaggtcaagaattcaagaccagcctggccaacatggggaaatcctgtctctactaaaaatacaaaaaatcagccaggtgtagtggcaggcacctataatgccagctactcgggaggctgaagcaggagaattgcccgaacctgggaggtggagactgcagtgagctgaaatcatgccactgcactccagcctgggccacagggtgagactctgtctcaacaataacaacaaaaaagatttcagatacagagctgttggctttaggaaatgcacagaacttactgctccataatacaaacaaaactttaaaagggtgatgactgattccagattactcttgcttttatcttaagctaatctctgtgttaggtaaggacaagcaggtttgaacggctgttaggacaaggcatcattgtctacaggtgttatgatgaccatgaagattagaaagtagtgaatctgccgggcgtggtggctcacacctgtaatcccagcactttgggaggccaaggcggctggatcacgaggtcaggagatcaagaccatcctggctaacatggtgaaacccctatctctactaaaatacaaaaaaaaaattagccgcgcatggttggtggtgcctgtagtcccagctactcgggaggctgaagcaggagaatggcataagcccaggaggcggaggttgcagtgaaccaagatcgcaccactgcactccagcctggtcaactgagcaagactccgtctcaaaaaaaaaaaaaaaaagtgaatctttgaagttttaaaataatgctatctatggatagaataaaataatcagaatggaaagtgtaaagatgacatatatatagtgagcattcttaaaactgattatcattgatgtccatctattaattaggctgccttacaaaggaacggattttctatcactggaggcactgtatatttttataacttgttcccaaacttatgattttacagaccagtaaaatttctgttcttttatttaagaaaattaagatatctgatgctaaggaacagttaaaattttcactgatttctgagagatggcaaaatgctagtaaacaacacctcttcaaaaacaataggattctacttccttcacttctgaatgtttctgaaatcgaagatgcggcagaaccatcaattccaggttcaccttgccggcaaccctgcgtaatagacttagcgtagctacaattggttgtgcctacgcaaaaatagccaactggggaaagttatttggactggtaacactagaaactatttaaattttaacacgagtgtcacaccactttgtttaaatgtgttcaaacagaagacacaatgtggcaccgaaatgcagcaattgtgtggaggcaatcaagtatcacagggcagataatgaattcaataaaggcagctgaaattgccaaatcttcaaaaggtagaaacagatcgtgtgaagagtatcactcatgtatctaaatatctttatggtgaaagcttcctactttaagagtagctgttcaacacttagtgatatgtgattaagaggtaattaagaagttaagaaggccaggctcatggctcacacctgtaatcccagcactttgggagggtgaagcgggtaggtcacaaggtcaacagatcatgaccatcctggccaacatgatgaaacccgtctgtactaaaaatacaaaaattagctggacctggtgacacccatctgtagtcccagctacttgggaggctgaggcaagggaatcgcttgaacccgggaggcagaggatgcagtgagcccaaattgcgccactgcactccagcctggtgacagagtgagactgtctcaaaaaaagttaagacaacctcaaatttaaataaagaaatgtatttttagaatatattattcagactattctgactaatgggagatcttcataggtaatactcagcaacactcgttaataggcatctctccatttgaaagactgcaaaacgctgaattctgttgtttagtgcactgaattttaatcatttaaaaattgtgatgtctttaaatcaggcatgccatctccagttctcagtggctccactactttccaatatttgacctccagtatcatgctttaaaataccggcctggcacttgtggacatttgtgctaatggcccttggtttccatttataccactgccataacaatgacaaaattgtcgagggtgagtatttgtttgcacattctgtcctattttcctaaataatatattttttaaatcctcatttaagtgctttccatattttcccaccatttgaatcccccagaccccacctctacctggtgacattcaagataatcgtagcagagcagctttagctgtcaagaagtctgtcctttgctaagaggtggtaaggatggttaattattctgatcaagtctattcggtctgtgccaagaagaaaactatgtttctggaggtaggatggaagcaaagtcactagatttccttccttctccttttcatattccttacaagttgctgagtaagtatattttatttggaagcattttgataaattcaattaaacctgctgccaggctgtaagaatttttctgtgtgtagtttgtgggcagaacatcatcaatcagttttctccaccatttttggtttctagactattcctgtagttaaataaaaagtatatttactatattctcaaattattttctttctgctctttttcttaataacttacctacttactgacacgtgattggggacagacaatattttacatttctacaaagcattttatctcatttttctatttctaaaatgaaaatttgagtaaagatgtacatccttaaattctgtacacagaaaatatactaaaatgaatcaacttaataatcaattaaagaaattttttatttaaaaatggataagaatgtgtttgaaatatatggttcagtcttaaactaaacacaaagcagttctcctaactaaacagctgttttaaatctatagctcttctgctccagcatcctaacagctggaggaaattagagtccagagagacatgtgcataatttgaattaaacagatgcgggctgtgaagacaatcaaacaacacagggtaagagatgcaaacaatattactgaaactccaaggagtttttattttttattttcataatgatggcaaatgtggccatagttgtgatacaaactacctacccatcctagtaaaaagtcgtgactttttttcaaaagtgcaaaaggaaacatgccaaattctaaatcaaagccaggacagggccatctctgtatttttccatttatagcactcttgatgccacgcgttgactgtgagctaggggtcgctgcctttcctgcccccggcagccgggcatcccctgaggggatctgcatcctgcaaaacatgccaggccactcacaccatcacatgctggcagctgtgggggcagaagactgaggaagagtgagagatgaccagaagctgaagggagacatatgtaaagtagaaaaggagtaacttaaatgtcattttctgattcaaaatatgagtgacctgctttaatgagcaaaaccctgcatttaaagccacaagtagttcaagcactgagggccagatggtaccctttgaaattaaagcgctctcaaatggaacatagcagggaacctccctgtgcccgactgtgtaacaacacttctcccagataatgtccgttaacgtttatggctttcggtttctagctcagttcatgaacgtgtttacgggtcttctgttgagaaatcaagagttagtgtccacgtggcaggttttccaagacctaagtgtgaacgtgatcatcacatttcttccacctcttcaccttcatagtagacttttcaatactccatgaactcttgattactgatatgaagcacaataaatatagacaagcatttggaaaacagcctgagggttctgtaaatagctaaacattttaccacatgacccggcaattctactctaggtatacgcccaagagcagtaaaaacataggcctatacaaaagcctgcacacaaatattcatggtagcatcattcacgatactcaacaagtagaaacaacccaaatgtccatcaactcattagtggataaataaaatatggtacatacatacaatggaatattatttggcaataaaaatgaagtgcagattcatgctatgacatagatgaaacttgaaaacattgtactaagtgaaagaaggcaatcacaaaaagatatatattgtgtaattccatttatatgaaatgtccacaatagacaaatccacagaaagtaaattaatggttgccaggaactgagaaaagggaatgactgctactgagtatgaggttttcttttggggttgatgaaagtgttctgaaattgattgtggtggtggagtgaaaacgctcccaagatactaaaaaccatagaatggtatgcttaaatgggtgaagtgcatagcatgtggactgcatatcaacaaagttgaggccagcactcaaagagattgcagaacaagaattggagtgttcctggagcttcagatgtaggctccacgaaaaagtgatgaagagagagggacagacagtgtgtgtgtgtgtgtgtgtgtgtgtgtgtgtgtgtatgcgtgtgtgttgaggggggggatggctggaacctgtggaaaacacccattaggagggcagatggacccagtggctgatggtgtgcacggttcctgcacactcatgaaggaatccaagcacacccagggcactcctgcctgcaccaggggagctgcagggagggctcctgtcagcagaccactgcagcccccaaaagccccttctcaggaggaggggagggagaagccagctagaatcatctgcgagggtgtggggcaccaggacaaggacccaccctgtacccagtcccaccccccaaccctggaggtgtcacaaactgggaagcaggcacaagggaacatacaggtaggcaaggcaaagaaccagagacaaagcccattccttccttaggctccaggaaaagcaggtgcaagcaggggcggcaggggtgggaggggtgttggtaagaagatccaacatcaaattaacttcgacgttcgtattattgtcttggcttggatgttctaattacatccttaagactatgtctgtgacttctagtacctgtaaggaagtttgttaaagagtgaataaaaatgtcaggggaccttctgatttcccatccagggacagggaaaaattgctcttcctcaacaaaaggctggtgagagatgaaaatagttttgttttgattatattgcaaagtgttcaactttattataagatgtgtgattaataataatagctaaaatcaactgagcttaagaagacgtttacatgcatgtggtcagtcctcacaaaaacactatgaggtgtataaataaataaatgtacaagaataagacatttactattctcattgctcagatgaagaaactgaggcacactaaggttgagccagcaggtgcagggtcaacaagctggaacccaggaagttggttctgcagcccagtcctagccctggaactccacagtgcccacaacgctcccaagtgaaatatatgatggagcatctatgggaggtgaggttagggggattttactttttgaaaaatgctttttggtatttgaaatattctcatataaacatccatgacctataatgacagagagagagagacagacacagagatagagacagagccagagacagggacagggacagggacagggacagagaaagagaaagagagagagagaaccattttagaaagttgctggaccagggaatattttgcacaacatgaaatgattacttactatcctccctcctgatttgggaaaattttagaaaattacagtggaaagcagcagcccccaacctttttggcatcagggactggtttcgtgggagacagtttctccacagactggagcagggagatggtttcaggatgattcaagcgcattacatttattgtgcaccttatttctattatttgtactttgtaatatataatggaataattatacagctcaccataatgtagagtcagtgggagctgtgagcttgttttcctgcaactagatggtctcattgggagtgatgggcaacagtgacagatcatcaggcattagattctcataaggagcgtgcaacctagattcttcacatgtacatttcacaatggcggggaggggggactcctggtgtaaagcattatgtttaaaataccatagcctgagatcaaaattttaggcacaaatttaatcacattgaatcctttgtcttctattagttaaaaggttgtcctgctgccatcttggaatgagtgcaagttggaaaatctagatccgagggtttcacatctgagcatgcataacagtgccctggagagctgctaacagtgcagattgcctgcatccagccagcagagtcagggagatttcaggggagcccctgcccagtggaactcttaaaactgcatttataacaaccttcccatctcctttctaggagattcggatacagacagcccatggcaaatgttctgaggagtaatatggtattatttttaaaagctaacacccataaatactacattaaattaaaattcagggatgaatgaaggacttgtagctatgactctgtagctcagagacataaaaagtgtaagaagcaaaattattactcactaagagataagcaggaaaaagatggggacacttacagttttaacggcttacctcttttgtagagccagaaaagtcagcagcggttggaactctggtaacaatacagttttggtcttctacttatgtactctcttctctattactaaattttaaaaaccagaacagcaaacctaaatcaagcgatacagtcgagctcaaagaaagactgagctcaaatgccttacgtctgccccaagagaagctagcattgaactcacacatcctccctgtgagcacaggcttgccagccacagctcaccaccgctttcttatgacccaaactcatgtccagagatctctgattctccttaacagaactccaggtaatcattaataattgagaggaaacaggcttacttggaaatcttattatgcacgatgtttatcaataaccctccatcaggaaggaagcaacaggcagcacctgcgtggctgttttgtgccaggcactctctggatacttgcctaacattattaccctcacagcgccctgaagatcagatgttatcctgatttttattatccctgtcttctcaagtaaagaatctaggctgttaagaacaataactaatttacctgccatcccatgagacacagttgatggagctaagacccagggtggttccttgtgactttcaactttccctttgatattttggcctctcttaatttagctacatgaaatgttaacctattatgtactcttagttcaattttttggtttatttgtaatcagaaatgatacaatatggcaccttctcaatgagtccatcaattcatatcattgtctattaactcaggatggctagctactcattaacaaatgtctaccaaattcctccatggccttgctagatagtataaataaacaggagaagaacaacgcattacaggaaaacagcaacagtctactgcaaacaaggagaatcaagtaagtaaggcaaagacactaaaggactcaggaacatcattacataatgttgaccagtaactattaatataatgcaatataaaataggaatgcaaaggtattgactgaaggagctacaaaattaagagatattctactaaactattaaagtatgtattctatttataaaataaaaataatttatctaaataagttaaataggaagtaatatctaatttcagcaaggaaagcttatcttcaagtttagatgaagtccttaattacaagtaactatcacatatggctgctctgggacccacaatttgagctgagcagcagatcatggtttgccactgggaattctttagtcttgtccaggaaagattcttagaatctgcataatggaaacagttactaagacaccatgtatgtatgctttacttgctaacttcaaagagttctagagttctgttttcatattttctgagttattttgttttagcatgaaagtatatttagaaagaagggctacttaataatatttctttaatcaaattcttcatataaaaacttctggtccaaataccatttctgctagaaaaatttacctgcccctagtatacaacagtaacattgctgtcaagccagtgatgcatcattgatagaaatgcattggccacagcatgaaacagtatcacatggtagtttttatgccactgcacatgagctgacagccttacttgggtcttgcatgtagagctctcacagggcagggaaggtccagaatacagcaggtttgactgcacatcccaatattagtggtacttttaaaaaatgactttgggtcacagagttctttacgagtaagaactggggataattgagagggctcaggtatctgctacttttaaaaatggcttataggacattaagagtcataagaaggaggctgggtgcagtggctcacgcctgtaataatagcactctgggaggctgaggcgggcggattgcctgagctcaggagttcgagaccagcccaggcaacatggtgaaaccctgtctctactaaaatacaaaaaaattagctggacatgatggcgtgcaccagtagtcccagctacttgggaggctgaggcaagaaaatttcttgaacccgggaggcagaggttgcagtgagccgagatcgcgccactgcgctccagcctgggcgacagagcaagactccatctccaagagaccaaaaaaaaaaaaaaaaaaaaaaagcatcataagaaggaaagtaaaaatgattattcttctagtcgctttctggattctttgcctttcattgcttctatagtacatattaatattacaaagaaatctgaattggaatagacaatcatttcccttacatataaaaatgtaactgaataaagacattaccctaaccatcctggggttacattcctagatactcttggattccatctacaccttctcaactaagcacttacagatgtctggctttatatatgtacacatcagtaactagaactaagtgttgaggtaatgaacaacaaggagatgacagagtgactaactctggccatgatgaaaatggcagatctaagatggaaattatactaggaaattccccaatcctagaaatacagttggccttcctccctcccttccaccttccctccttccttcccttttcctctttcattttttatttcctttgtaagacatctagacaaagtttaggtgctatataactcagggacaatcttcagcttcattgtgtgagattttattcatgattgccttatcacacacaatgacagggagtaggagaaacctcatttgagtatataatctgctgagtgtgatgcaaatgtcagtatctgtggtatctttgcagttacaacccactggtttcctctattctcttaccacttagaggtgaatttctaattctaggaactggtcgtcatcagaaattgatgaagacttcaagacgttaaatcaattcagccactgctacatggtaccttatagaagagaccattaattatactaaataatgtctattcatttattcaacaaatatttatccagtgcctacccactggataaaaataaccaccctgagtgtttagatgaatgcctaatgacaagggtgatgcttatgccattctaaaagtgatgaattgaactgaacatttatttccacacaaaaacctacacacagatgtttatagtagctttgttcataattgccaaagtttggaagcaaccagcgtgtcctcatagggtgaacagataaataaactgtggtacattccattcagacaaggaaacgccattcaatgcaaaaaaagatatatgtgaccaagccatgaaaggtacaaaagaaacttaaatgaagattatcaagtgaaagaaggcgatatgaagaggcgactttatgattctatctataggacatcctggaaaaggcacagctataaaaagggtaaacagatcagcggttgctcagggtagagggaagaaatgggtgatgaggtagagcacagaaaatctctaaagcagtgaaaagactgcacaatcctacagtgttggatccatgtcactaaacatttgtccaggccctagaatgtacaacaccaagagtgaaccctaatgtagaggactggctctgagtgacaatgatgtgtcaatgaccagttgtaagaaacgtaccactgggggtgtgccgggcgtggtggctcacgcttgtaatcccagcactttgggaggccgaggcaggtggatcactaagtcaggagttcaagaccagcctggccaagatggtgaaatcccgtctctactaaaaatacaaaaaaattagccgggtgtggtcatgggggcctgtaatcccagttactcaggaggctgaggcagagaattgcttgaacccgggaggtggaggttgcagtgagccgagatcacgccactgtatcccagcctgggtgacagagcaagactctgtctcaaagaaaaaaaaaaaaaagaaaagaaaagaaatgtaccactggcggatgggggtgggaatgttgatagtggggaggttgtgtgtaagtaagggaatgaggttgagaattttccacaatttccacacaattttgctgtgaacccagaactgctgctctaaaaaacaagtttcattaattaaaaatcaaattgctgctttcaaggttcatggttcacagccacataggagatgggtgtcttagcctcatgtaaggtggagaattagaactaaaatccttatgtagaatggagtcctagaaaaccaatgactttcgttaaaggattgactagaaaaaaaaaaaatctacccatcagaacaggtagaagaaaacttattgacctgatactagaccttacatttgatggtttgtaatcagagatctgctcttccttcgacaaaaggtttaaccttatactatttatatagtccatttttcacaacgctgaaaaataaacataaaaaagtagttacacactgcatgccagagacaagcttaaaactatggtgaagagacacactgccagcctgccacgaagcagccccacaaagcccaagaactcacattctaacacagaaaccttgtgaaaatataatcttccaagggagagaagcaatacacccagtcaccatcaggattagttacctaagaaccacagacacagaattttgtacagatatcattaaattactatttttcaaatgattaaagacttaatggaagaacattgaaatataaaacaagagcaggattccatcagaaaaggcagtgacattggaaaaagaatcacatagaaaacccatcaatgaaatatccattctttgaatgccactgggaatgcaaaatggcccaaaaatggtacaactatgaatatacaactaagggcaaaagaaaggtatgattaaattacctggaatgcagcacaaagagataaagtgatgaagaacttagagaggaagtgagaggtactgaaaaaggaataaaaagtccaacatataatgaacttatattctagaattagaggaaaatgcaaaaggaagagaagcaatatttgatgacactggtgtatatttttctagaaccgatacgaatgttctcatacaggaatcacagtgaatacggaaagaaagccaaagctgaacgcatggatgtgatagcgactaaccacaaagatttgaaatgatttctaaagctgcaagagagaaacagattacctccaaaaatactgcaagtagactcatagcatacttaccagtagcaaagataaaagctatacgctatgtcttcaaaggactgcaaaagaataatctcaatatagaattatctttcctgtaattcagaaaataagacaagttattcctaaagaacaacaaggtgggtgatgtgaaatgccttgtcagataccgcaaattataataaaactatagtaatataacaacgtagtattggtgcagggaaagacaaatagacaaacagaacagagtagacggttcaaaatagatccaggtatacatagaaactatatatatgtcaaaggtgtccttatgaggcatgactgttcaatcatgggaatacacaacaggtgatccctgtgaagaaaataaaataaaactggatcttgcgtggacagcacatgtacacaaagataaagtccagttgttaaagacctatatttaaaaactaattttcttttttctgagacaaggtctggctctgtcacccacgctgtaatgcagtggcacaatctcggctcactacaacctctgcctcctgggctcaagccatcctcccacctcatccccaagtggctgggactacaggtgcaccagcttgcctggctaattttcatatttttttgtagagacgggtttcaccatgttgcccaggctggtgttaaactcctgagctcaagggatccgcccacctgggcctcccaaagtgctgggattacaggcatgagccaccatacccagccaaaaaccaaaactttaaaatgtatacaaaaatattctttaaaaatattcaaggccacaacatatgaaaactttcacattagacacagaagatacaaatcataaacaaagatgaagtaagttttccacattaatgtgggaaatcttatacatccaataacagcatcaaagttaaggagacaaaccagaggttgacaggttatttgtttcctacgttagccccaaaatactaatatacattgtgcattaaaataattcacattttaaaaccatcacaggcccatgagaaagtttggccaaagtatactaaatgctcagaagacaaaatgcaaatgaatagtaaatgtgaaaagatgcttaattgagaagtaattagagaaatgcaagttaaatctacaatgacagaaaagtttacaccagtcaggctcaaaatttaaaagtctgaaaatattaaacgttggcgaggatgtgaataattgggagttaaattgttatgatcacctagcagagcaattatttagtatctattaatagtaaagctgaagttattggtgcacaaataccacacccaggaattggtctagagaaagtcttatacctgtgcacaagacttgtataagaatgttcagtgcagcactatttgtgaagcaaaaaaattagaaacaccttaaattcccaatagcatgagaataaatccattgtgatgtcacacatggtatgctattcattagtgaacacaggtgacctactgctatatccactaacacgcattaatctcaaaatatgattgaacaaatatgttcagttgcatacaataggtaacatcatatcatttatttaaagtttaaaagcatgcaaattagcagtattccatattacttataggctggtaaataaatgtttttttttctttttttttttgatggagtctcgctctgtcgcccaggctggactgcagtggcgcaatctcggctcactgcaagctccacttcgcgggttcacaccattctcctgcctcagcctcccgggtagctgggactacaggcgccccagaccacgcccagctaatgttttgcattttttttagttgagacggggtaataaatgtattttttaaagtataaaaacatagttgataatgacaaatcccaagttcaggataatagttacctctgtagagaaggaagaaatggaacacaatcagagagcagtacatccatcgcttcagttttagttgtaatatttttcttaagttgaatggtgggcccactagtatttgtcatataattcccatattgttttccatccctggggttttgcaataacaattacaaatatgtatctccctacaaagtttatacaatggtttatatataattcattcatctttgacttgtaatggaaatctgacttgcacaggaagtcaagattgctaatgtcagacttgcaaaagaacaagcatgctaatcaaattcaaagtcactaatgtaatttccatgtatttctattatagttctcgatttagattctacatctaacctcatcttgactgagaatgtatgtatagattctcaaataagctttatctgaagaatgtcttactatatattatttggtagcactaggtatcaaacactgaggctcaaatttatatttctgttctgttctaacctcaacaacagacagataaacaaacttcctactggagatcgccacctaaaatttatttgaaaccttaaacctctcaaataaagtttatttgaactgcccctcccacaataacccattcctctttttcttccactctcctctgtgcctggtggcatcaacatctaacatgagttctatatctcacatagccaagtatcaatgtgtcatacttcaattttctctttcccttgcatctcacaatgcgtacatctgctagtcccattgacacaacctctaaaacatcacaaagctacatgtgtccctccattacaacgtctagtaccctagcgaagccccatgctccgtcccccaaacacctagactagcctcccaattagcctccttgcttccaccaacttccagccacacttacctcccttatggccttggcatgtgcttacctaatgcccactctaggtcctttgctccctctctctggaatgattttctgcagatattcccagggctggctcctttagctttcagctcaaacttcaccttccaagagaagcttttcctaaatttccaatataaggtagtgtcaccagtcctcagcctattttaattctttccaagcacttatcactaactgaaatttaccatttttattgctttacttgctttaaacctgaagattgtatttggttgcatgtaccggaatactgactacagaagtataaccaattggggtttatttttcgcatgttacaagaagtctaaacaaaagccatctagaactggctgggggctccctgatgccctcagcaacccaagtttcttctatccttctgccctgtccttttagcacgtggcttttatcttcatggcactctgactaaaagcattaataaccttcttgcacatggaatgcaggctccacaagaaaagggaccttgtctgtcttacccatcaccggaagaatgacaggtgctgtgttaacagcttgatcagctagagcagtgaaagaggaactcaagagtcctcaacctcagcatcattcctgcatcctgggagtcctgcaccacagcctccattcattggccctggagattctacccggatttctcttctcatgaagccctggccttcatggccttctttattggccctgccttagtccagggcttagtctcacgctacagtctcctaagtggcccgccacctgccccatttcgcctgccaccctgtcacacccacgacacaaactgatcatattcatctctagaactcttatgttttcttaaagtctgcactcaaatagaaagctccacaaaagtggggacgcaccggtcctgcttaccactgctctccaggcctaggaaccaggagtgcttgctgtggaggagacacttggcaagtatttattaacagaatccaaggaagcatctaaattcccgaagattatgtgcaaagcccctctgcgtttgacccggctcatcctcttcccggtatcaccttcctcattctcacttttgccatttgtttagtcacagcaaataattgtaattctaaagtagtgccagacctttgcatcttttattttataatatctgcataaaatattccttccttttaaaatcagaaatcttctgttcatcacttaattcccagcttatgattctcctcagcttagaggccttactgactcagcctaggggagcagacagtgcctcctggatgcagcactttgatgatgatgacgatgacgacgacgacgacgatgatgatgatgatgttaaaatcacaatgccagcaactgacatcatggggtgttacaacgtacaaggcactcttgtaagtatttctgtttggtgactcatttaacccttgtagcaaccccatgaggtagataacacaatttttctcattttaggagaggaactgaggcacagagacattaactaatgcaccaaaggtcaaaatggcataagctacattccaacccatgtggcccacctcctaatccatgcactatgacttgtggacatatttgtacactgtgacctgaaagattgttgggagcagggctcataccttatgatacataatgggtgcccaataaaagaccgttgagtgaacagattttaaaacaatcagttgtataaatacagaatggggaaactggcttacatatatatatatatatcttgtaaaaacagagttggggtttaaatggactgtatggctctctaagtcatatcattgatcctaaaaataaattacaggccacattaataggcagattataccaaggggcatgtagtaactccagcatagatcaggccactttgagaatctagtacagtcctctctctttagaaaagaccaaatggagttcgtccaaagtaggtaaaacatatggctgctaaaataggaagagaaataactgaagggcatatggattatcgtcaagtatctgagaaagtgttatgtacaaaaatttcttctgatttaaaagggcagaacaaatctaagggtggaagaacaatgtgctcagataaggaagcaaattccagttgtgtgtgctgggcccactcaggctgcctcctaagaatggacagggaacacctcttcccaacgccgccttcagtgttattatgttggtcccttaaaaaaaacagggctggcaggttttgcagggaaactccaaagtgacaatcagagctttgtatttatagagagtcagtttacctgcttatcactgcatttatcccatttagttgctaaaaaaaaaaagaaaaaaatggacttggttgccttgtggagaatggatagtagttgagccttgtggtgaatggatagtaattgagaatgcggcagagagagatgacttcgtaaccaacagatacatatcatcaatgcgcacagaaacttaaggaggggccaatgtgatacgcgaactgttgtcagtcctttacatttagttatttttaaatttatttttcaggaagtatctataaaaacactatatgtaaaactatttataggtcaggaggctgaggcaggagaattgcttgaactgagacccaggaggcagaggttgcagtgagccaagatcgcgccactgcactccagcctgggctacagagcaagactctgtctcaaaaaaaacaaaacaaaacaaaaacaaaactatttataggttaaacactctttataagtaaaactcatttatttaaagaaacagactgatatttttatagttctctcatcaatctcttctattaaaaacaaacaaaatactaaaagaaaactgccaatcattttgaataagagatggtccactacattcctccaccagaggcaagaattaaaaatttaccaagtcaagcaggaaaccctaaaagattatcaacaaatgtattatatttttcaaattcgtaatgcaaaatctataggtatgttttctaatcagtccaagactccaaagtaattagtgaatttattgccattttcaaaaagtaataccccttgatatttaagtttcaatagtatggttttaataaactgaaatgaatcattagaagaatttcccccctttatcataactgattaagtctattttaaagcttatatgccctcttcagggaaatctttaaaaatttccaattgtttatatcagtgaacagggctgaataaccaatgtataattggttaaatcagatacattatttccccctcaaaacaatgccattgagttgaaggcaaaggatagaaatgaactcaccagctatatacaatattatatgacataagcaatattaaagattggtatataagaaaccaagcttggctgggcgccgtggctcatgcctgtaatctcagcactttgggaggccgaggcagacggatcatgaggtcaggagttcaaaaccatcctggccaacatggtaacactccaactctattaaaaatacaaaaattagctgggtgtgttggcacgcagctgtaatcccagctactagcagggctgaggcaggagaatcgcttgaatccaagaggtggagactgcagtgagctgagttcacaccactgcaccccaacctggcaacaaagcgagacaccgtctaaaacaaacaaacaaacaaacaaacagaaaccgacctttaaaataaatacaaacacaaaaagattagtatgtatttaatctgcaaggctaaagccacacaactggatttcagtgtactacaaaatgacagatcatataaattcaaaatcttcattctgcttatcaattacagaggcaaaaatataactatttaagtgggtcttagaatgtattttctcttcagagtgcttcctgatcctcttgccctctattttacattcaagcgactcatgaattcttaggagaaatctgaaattacttcatgccccttgttaaacagattttgaatggtaagtactcctgcaaaattgctcccccaaataaaatttcacatacagatacattcagtgcattaaaaaagtaaactccattagaatagaatatagtattttcttaagataactgtttagacttaactcaaaggagttcccacaaatatattctgttctcagttagttcaagtgtggaataggcaatttggcatggggtaaatctgtccccttttgcaatgttttaaaacagaataaatcgtgggatgaatttactgcgcattacaaataaaatgtttatattttctttgtgaattattcatcaaattaaactaataacatgttaaaatttgcttatgtgtcagtcctttgtaggtaaaatttcatataacactcaaaacaaacatataaaatataggcattattactatctacacttcatatagatcagaaaaataaagactggagagcttaaatgacttgtccttcccagagagtctgactttagagtgattcatatctactgtacttcattataacagtgtatttgaaagtctagttgaactcttaagtgatttcatctagtgtatgacattcttgaagttttgacttctcatttatatatagcaataagcacatgtgtaggatggcatcataaaactcccttggaatgaaaaaaacatataaaaagttttaggctcctacaagaacagcatgtatctcaatgttcctcaaaatgagaattgactccaaggtacaaaacaggtaaactgaggaagcagatgttaattaaccactttagcaggttctgaagttcttagtgtccaaggtttaaataacactagaactatcttaaacaaatgtttgtgtttatttcctgttttctgaacaatgtttttgatgaattacgcatagatggaatgcaaacacacagacccaattccctttgaaatatgtaagcctataaaaatgagcagaaaatatccttggcaaaacctgcactgagctttcaaaagcccacatatttgaaattgagtttgtgatgtactcaaaacacaaacatcagtgggttctcgcattcctcatttctccctctaatgtcagaatattctattaatttaaaaagcagagttctgtgccataattagtctacatattaaatcttatctgagtgacacctctgaatgcaaagtatccagaacaaataataagacaagaaacattccatgcaaaataaaattcaatgacagaataaaatcttcaatccaatgcagtttacacaagtacacccacaaaaattataatttttcccaggaaatgcattccccaaatgaatgtatgcttctctgtgtgaagacatatatgtacaaaaggctaaaacattttttaaaaatccaaaaacaattgatactagaacactatactgacaccaactttataaatcatgggcttgcccaacaattcagtaaatacttgatgttctgcctccattcaaatgagtctgtgcatcctctgatttagcacatggccaaagaaagatctttcagcccatccttctgtgctttacaaaggctactatggcaatcttcacttgtccaatgtgaatttcagttaatttaacttctgctgctaaattgtttatgataattttatttttatcaatattaaacctaatatttgaaaaaaaaagttaacacaacatattaggccagactctcccattcccatttaattgtgttttctgtgtcttatgggcatcactaaagttatactttaacataaactattataacataaaggatcacatcccacacatttaacttcatctgccatttaacttatatctaaggaagatcaatgctggaataaatatttactaatggtaacttattaattaaagctatgacccaagcccatatataaatagaaaatgaaggagcacacatactcccatatgtattcatcataagtgagtttggtatataagcttcaaagaagtttctcatatacaatcttattgttccttgacagtcatctcaggcttgttacaatgacttagtaaaaagggaaaaaagtaaagatggaatttcagtgaatcatctttgggttcagagcttttgggtgtatagacacaacctctcatttcttaaattcttccctaaaggatgatgactgtattaagcaaaatctcagataacatcaggtcaattggatgatggaatcttagtccaataatggagacaacagaatatctgaaactaggacttcagtgaacagtaacacagtttcagtatggcatctcttctctgtcatttatcaggtttcctgtaccctaataagatgcatcctatgttaagagtttggagattggattgctgcagagtttcaccctctcacacattgcttgccttggaatgtgagtgtaatcacaatggaaacatctatgagatgagagcctattaaatgaatccacagactatatatcttcagcatcttataagctataagaatcttagctttttttttttcttcaagtctatgcttattgatggcaatcctcagagatgttttgtaagtccacatgggcacagaaatgtcaaggcttcctttcaaagaaaaataacatttctgagagttctgaattatgcaaagaggtaagtcattcagggatactttctgacatgtagaggcaaccagacacaaatagatgaaataacggtcttcccaaagtgagcatttgccctgtacagatgatcattctttgattctagactcggacacgtagcaacacttactagttcgtataataatgtacctgttctttggaggaactcaagaggatatgtacatttgcctaaataaaggaggccagcagtaagttccatttgcaaggcaaaccttcagagagaagatgcttgtatcagtcctgtagtgaatgagcatctcatttacatgaccaatctcttacacagaaataaatcactgcgtgactgtgctctgggtataatggtattgagcctggcctccttttatcttataatcagttaaaataggaactatattggtcatttgcagaattcttttatatacaaacaaaaaatcatggtggaaatgtattcagtgctctaaattgatactagcctctttctgttttatagtcaatagaaaaagcaatctctactaaaaatacaaaaattagctgggtgtggtggtacatgcctgaaatcccagcgacttgagaggctgaggcaggagaatcacttgaacctgggaggcagaggttgcagtgagccaagatcatgctattgcactccagcctaggcgacagagtaagactccatctccaaaaaaaaaaaaaaaaaaaaaaaaaaaatttgaataaattaccaaaaaaaaccatgaaatttcaataaatttagttcagaaatgaagccattacatccctaaattctattacataaatatgttactaatgtttactctataaccacagcagatcatctgtttccttttttttttttgaaacagagtctctttgtggcccaggctggagtgcaatggcgcaatcttggctcactgccacctccgcctcccaggttcaagagattctccgcctcagccttccacgtagctgggattacaggtgatttttgtatttttagtagagacggggtttcaccatgttggtcaagctggtgtcgaactcctgacctcgtgatctgcctgtcttggcctcccaaagtgctgggattacgggcatgagccactgtgcccgatctggctcatttatttcctaaaattataatgtatgactaacaaatcaatttaaaaactatgtacaactggagtacacaattgtcaagaactatttacttttgcttagtttaaatatttggtaaagagtttgcaaataaatactcatcatgtctattcagatctataatgtgctaaaaattctgtttaagacttcaagaaagaggccaggagtggtggctcatgcctgtaatctcagcactttgggaggacaagatgagtggatcacctgaggtcaggagttcaagaccagcctggccaacatggtgaaaccccgtctctactaaaaacacaaaaatgagccaggcgtggtagcgggcgcctgtaatcccagctactcgggaggctgaggcaggagaatcgcttgaacccgggaggcggagcttgcagtgagcagggattgtgccattgcactccagcctgggcgacagagcgagactctgtctcaaaaaaaataaataaataaataaaaaaaggcttcaagaaagaggcattaatgtctctataagttttactcaccctgtactcttagtatgaacaagtctttaaatgtgtctgctaatcaattaaattatttttctcatttcttatgttaaatatcactcattgaatacatactctccctttaaaagagagacaaatagcaagcttattttctaagaaagtgatagtttcaattcctctgtgaaagtggacagatatcctaggttttttttaaattcaactttatattaaaatgcttacacattctaacgcagttgtaagagatagcagagaaagatgccagctaccttttccccagcttccgccagtggtaacatcttgccaagctagacgttataattgtactataagcattgttacagtcagcacagaggacggccgtcaccaaagggtcccttctgttaccctttcacagtcgtaccctcctctcacctgcttccacccccttcagaactgctgggaagcatgaatctgccctccatttctatcattttgtcgttttgagaatgttatataaataaaattattcagtgtacgatctttggggatgggctttttccacacagcacatttcccctgagatccatccaagatattttgtatatcaacagtcggctccttttttactgctgagtaatattctagggtgtggaggtaccagtttgttgaaccacagatccactgaaagacatcagagttgtttccgtgttctgctaatgtgaataaaactgctataaacattcatatacagatttgtgtgtgtacctacgtcttcatttctctaggataaataactaagagtataactctgtcatctggtaaatacatatgtcattttttatgaaactgctatattcttttccagagtggttctaccattttatattcccagtagcaatttgcgagtaatccaatttctccacatcctcaccagcatttggtgttgtctttattttgtattttaatttacctactttacctattactctagatatttctttatacattcttaacttgtcatgctctactgcagttgctattttgtaggtcaagtttagaaatcttacctttccttgcatctgtgtttatgtttgcctgaaatgtttcttctacatgtagaactacattagacaatgctataacttttgctgcaaccctctaacataatttagaaaactcaagaggagaaaaacagtgcattgtatttaaccatatttttgcttactatgtttttccctccttcctagtgttccaaaattcctttttttgttgtttcatttgtttagaaaatttctttagccattcttttagggtaggtctgctggtgacaaattcgcttagtttttctttatctaaaaaaaaaagtattgatttgttctttcttcctgaacgacattttcactgggtataatattacaggttggcagttcttttctttcagcatttgaaaaacattgtgccacttccttctagccttcatggtttctgatgagaaatccactgtaattagaacaatgttagccctatagggaaggtgtgatatttctctggcttctttcaagatctaaaatttgtctttagttttaagaagttgaattacgttgtgtgttggtgtgggtttctttgggtttttcctgttttagattcactcagctttataaatccatctataactttatgtctcttgcaaactttggaagtttccaacacttatttctttgagcatttgcccaccattatcttctccttccaggaatcccctgacacaaactttaaatgctctgttggagaaccacaggtctctgaggctctattccttttttctttttccagcctaccttttctttgccatttggaccgtgtcatttctatgttccaacttccagttcactgactcttttctctgttccttccattcttatgtcaaacccatcagtgagtgttttatttcagaaatttcaaacaagaggctctccactcagcctttactagtgttggtggggacaaggatagggccgcagtttttctgttgcatttggctggagtagactggttattgtctaaatgttttctatgttgctaggcagcccctttctgagtcctctggataaaaaacaggccattgttggggatttcttccttccttcctttcttccttttcccttcccttcccccttcctttacccctcccttctctctctctctctctctctctctgcccctcccttcctctctgcttcttttttcttctcttttctttttgtctatatatgttgacatttcctggttgccagcttcttcagttccacatctgaggtaacgtagcaaaaagaaaactcaagaaattcacctctggattcttccttgggttctaaaatccctactctgtccacattcttctcactactttcagaatcttcctaagcttgtacagcggacccttgaataacatgggttgaaactgcatgggtccatttatatgcagattttcttctgcctctgccacccctgagacagtgagactaactccccctcttcctcttcctctttagcctactcaacatgaagacaaagacaatgaaaatcttgatgatccacttctacttaatgaatagtaagtatcctctctcctttttgtaatgctgttaatgttttctctagtttttttattataagcatacagtacatattacatatgaaaaatatgtattaatcaactgttcatggtatcagtaaggcttcccgtcaatagcagactactggtaaagtgtgaggggagataaaagtatacatgagttttgtctacatagcggttggcacccctaactccatgactccacgagtcaactgtacaatatgcaatgtctaggctttttagtgtagttgctgggaggaagagggaaaagtatgcctactccagcttcccagaagcaaaatctgtgccagatcattcgttttcaatgtctatattttttccattttcctttaattttttaaagttcttaaagtcttgccaataacaaaactgaacagatgagtgtgtaatgaaaataactatactctaacagtgcttctctaagtggcctgtggatatgctctcccagaactgaaaattctatgaaaattttttagatgtgacatcaattctattataatcttacaaataccctttgccagttaaatagacaaactcgctttttaaaattatgacatttcataagactgtggtctcaagctatagttccccaaagtacctgaggtgaggcactaaaactaatttcctcctcaaagaaggtgaaactaagtgtgagagatactgctcagtatgtggggtgaccattgcctcagttttcctaggacactcccaacatataattttgtcctggaataattattgacagggtcttcttttatactcacaatatctcattttgcatgataagctaatatatatgttcatatcacctatgataaagaatacgaaaccaggaggaagacacccagcaagcatagacaccaccccagccatctcttcttctcttcaggacaccaaggtgtatatttaacattcattaatggaagcattaagtagctcatatggaaggtccatcttctttttctcagcagcaacttattattagatattttgtgcttatactgtgaaatatagcacctgtaatgataatgggtaactaaatgatattgactaaatagttgtaaacatatgttctaagattatacaagaatatctaggatgctaaaattctgccagttgtacacttaaagaaaacatagccatcaatttgcaattacatgtgtaacttcctagtctttacagtgaaactcttctatgaacaaagtttgccaacttctcggcacctaaatcatttaactgtgatttaatagaagttccataagtatgaacctttctttttcagtgtcctcagacacaagttctcaacagccagctaggcatctccaaacacacgtactcagctggcatcaactcccatcatgttggaacaatgcagcatccttcccccaaccaaaccgggtcttcagacttcccatttccttctatggcatgacatttttctctagttccccaccaatgaaacttcaatgccaagttagtcaaggttatgtgaaatatagcccatattttattttttgtccaatcttcaacatctctcttcaggttctagaagaacaagaacccatcctttttggcaagcattctctatgctcattcccctattcctccatctacagaatcctacctcaactcaattcatccaagaagttcttcctggtgacttccaaccagatgtgttttctccacctttaaaacttcataatattttcaggtgcgatacggcagttatgtttcatattcttatattatagctattaggttgaacaacatgaaattgttgaacctgtaaaaatggcaatcccatatggttcaatctaatatttctctcggttttagggctcataaataaagagcagtctccatgaaaacaggggctgagttaggtctctcttttggatcccctgagaagcctaggacattggaagtgcttaagaagtgtttgtcaaaatagactcataaatcaacacatgtcttaggcatatatgtttgcaaagtcaatcatctgaagcaattagtctaactacatatgaaatcgctaattgttttatgaatcagcacaaatggcagtttagaacctgaaggttttggcaatataaaatgttttgattcaaggagctgttttaaaattatttatttgtgaaggaaacatccttggatttagaggttggcagatacagtgaaaatctttttagttgactgaaatagaaaaaaaaaaaatcaaaaccctttttagcacatgcacttcccttataaaaccaaattgcctgaaagcagaggccagcagtttgtgcacaacgagtatgtgcctcaacaccatcagcaggagatgcaatgcagaatgacaggaacaatttgcatttctgtagcttctttgtatacccaaattctgagagcattttacaaagccataaatatcgttacccacaagagacagggaaaggatgcagatacaaggacggactttgtgtactctgacccaggagcccccctgcgcggagcagtgatacccacacagctgtaaacctgagtgcaattaattgatgctggttaagaaaaggggaacatacatctgcagggtccttcacagtcacagggaccattcccagaaagcgtttcgtctttcttgcattcacaaagaatagcgtcaacaaatgttgagttgtatttgcgagtttccccaacaaaggacgggtctctagttctaggtgatggtggtattatcagtcacctcaccagtccccctaattcctacaaaaatcaccaatccgaatgacatgtgtgtagggctttcatggggctaggagcagtgggctgccagaagctctgctggggccaggagagaagagagcatcgttcacacttattacgttgcaggggcctatttccagggacaatgttactgaaccttggagaaattcatgcaaaggtatactgttgttgtgctccaggcttccttccccatcagctgcagaactgtgcgattctggtcctggccaaggagtgcccaaagctagttgccaatgggccccggagcccacacctcctctagcgcagcatagcagcagccctcactaacctccaggggtcacaattgggttacaaattcctcacagtgcagggactgagcagcctgattgggaacaatttattcgaatccttcttcgttaagattcaaatggaataagtaaggtagaaattgaacagacacagaaattgtgccttgctgctcctgtagtcagtagacatttattcactaagcctagctcgtgtgttctttctctctctctttctcactcgcagttgttcttccaatctttcctgcttgctgttttaatgcataattaagaaggtcagaattaatgaagcagtgtggagtaaagttcaaggaatccccaggcactatttattctattagatctcaggcatgaatgtcagattggcagcgcaggcggcatgagcaatggagctggcggcatcccaagaacggccgccaagggagactcacctgcacagtccagtcattcctcagctccttccctgcgaaaatcacacgcaactggtcagccggaaccccctgtcgcttagcaaccacctccttgagctggaagatgctggtgtcagaatcgacctccactgggaaaccatggctggagttgaacctgacaaacactgaccaaggaaattggaagggagaagagaaagtgagcatcactcgaagcccttaaatggtgatagcaacatttctcaaccgatttacccctcgcagcccttcagtgaatggtatatattttctttcacttacaacaaaaaacttaatgctatagagcaatatttgggaaaaacagagttagttacccacgagatttccctttcatatattcgtcagtgacctgcaaaccaaaattgcattctccctttgacatccatcctgggaaacagagagacttgagcaggacacttgcttgattggaattgaaagagtcccatgagtttattgaaaagactcagctctgacagcatgtacacactcacactccctccacagtgaccctcttaataaaaataggaggcgatgtgttagcactcaaggtatagcaatggaaaaaaatctaagctgctctatagaccagagtgaagacccactcggggctatggctcagagccctagacttgggtggtcctggccaaaatgctccactgggtctatgaagacaattatttgccctctttttggcagggagggggtggagacactagtgacaccatttgtcttattgaagccactgttccccgtgagacccaggctgcatcctctagtctgtctgtctgcatgccgtcttctcactgcacctgctgtcccacctcttcagcgtctctcactgccctttactttccattctttctctcactgcttgaagtcacgctctcatcacatcttttctagagtctcataatagcccccaactggagtcttgatccacgccatcacctccaaaaggccctacatagttctgcaaaatgagccttattaatacagagctatgtcacaccactcaaatcctttaagtctcacactgtcggctggtgaggaaagactccaagatccctttcatctagcacaaacctacattccagcattttcttcattaatctccatgtgtactcttttaaactaaatgctcccagaaaaaaaaaaatcacaaaaaactgctgcacacaacttcttgcttttattcatgacctccctccttctcctcttcctattgaaatcctgcctacctccatggcccacttcaaatgtgacctcccccaagaagcttctggctatcagctactgcaaaagcctgatcttccttattcagggcaccagtggcatttactatatatgtcttttaatattcaccacattcctcatggaagcaggatagcacacgggttaaaagaacatcctgaagcattaggaagacctatgaaaaatccccacagactcctttaattggcttaggatgctaggggtcaatctattaacctccctctttaggtctcagttcccttatcttgaaaacataaataaaccacagaccatattattcggttcattaaataatatttatagtatttaaaactatcgtcttgtaacatttaaaaataatggacatttagctgtttttgatatacattttgccttctttaaaagataacaaactcctcaagggcaagtgttattgtttatttactgctgtgtttcctttaaatgtagtactatagctaattatttctcaataccaatgtgagatgacccacctcatcataattataataatcattacaatgccaataataatcaggcacttactatgtgccagacattgtgctctcatatggtttttctaagcctcccagtgatctggtcaggtccctattattatccttattttacagaataataaacgaaggcacagggaatgggacccacttttctaaggacattaattactttctaatggaactgggtttcaaatttatttcaatctaactctaaagctcattccatttctactaaaataggcttcctgaaaccatctcagaagaaaagtccaggccaggcacaatggctcaagcctgtaatcctaacactttgggaggccaaggggcaaggatgacttgagcccagaagttcaagaccagcctgggcaacaaagtgagaccccatctctacaaaaaatttttttaaacaatcagcagggcgtggtggcgtgcacttgcagtcccagctactctggaggctgaggtgggatgactgtgtaagcccaggaattagaggtttcagtgagctatggttgtgccattgcactcagtcaccctgggtgacagagaccttgtctaaaaaaaaaaaaaaaaaaaaaaaaaaaaaaaaaaaaaagtccacatttctatccctcatgattaaaaagataacaataaaaaggctttatgacataaatcagatattccctatatgggtgtgcagtacaaataaataaaagctccagtgaggagctaagagcaaaggaccgtgaacaataaccatgaacaacatgggccccaaaacagacgtgacactccagtgagggcaggtggtccagatggcaccacaagaacaaaggcctgacatctctgaccagcacggaaagtgtttagaaaaaggaaggacgaccagtgacaaagtgctccaaataaagaaaattcatgaaaaatactaattacggaggaaaaggtgcttttgatacacttttaagtcaatttcatttgacgcctttgaaaatagaggggaagaaataaaaatgtattggaagccctgaggtatcttcacagcatcctcagatcagagaccataagacaaccaattcatcagaaaagacacatgacaagttaggggctatagggacaaaagatatgaccccagttctaaatttcattttctactagtgagaatagatttaaagtaaaacaccataggaaggaatgtgggaagaagtggctggaatttgtgccaaagctgctataaaaccagataaaaattccaggagatcctaagtttatgattttgctccaggggttcaaatcatggaactcctactgcaaggatgagagtttttttgtaaagggaaactgcaaaaaatattaaagatacctctgtccaactactgaaatcctaagtatatacaagttttttctataatagaaaagttacagatttaaagttacagtatttagataaatcataaatactacggatatgaatatttttaacagtaaatctaacatacaatataaatttaaaatggaaagataaaccaaatacataatatttgaccaactaaaacattcgcatgaataagaaaaaacatcttaagaaactcactgagttcataatcaagtgccattatgtgaaaaatggctagtgctgaatggcagtaatgtgatttgagtgggtctcaacctttttctgacatatgtgggaaacatgtcatgtcccatctgtaccagcccctgaactccagccatgatttccaaaacaggagtggaaggaagtacccagttctccccacctactacctctttaaagtcacagaaggcagaacgtctttagagctacataaagagaaatttgaatgctggttgtaacgcttgctaattttatgacaagttacctggccaccttgactgttagcttcctgatctaataaatcggtataagggatgcaacaccaatgtctgttacacaagatttattgagattatggatgtattagaaaatctcagaaagagactagtacagggcctatcctcctagtgctgggcaagtgtgtgctccaaaaatagttccctattctaggcacctagaggaggtagagctaatgaaagcagtgtcctttgcttgcatggtaactaagggagattagataggatgtgggtaaatactaaataaagtagccaatttttctggattctgctcctcttggtggacagaaaacttccagagaccaagagatatgatagagaatatggctcacctctactttctaaggtttaattacatatgaaaagcttggaaatgcattgttttaataattgttttgatgacgtataatatagtatcagaaacaaacaacataccagtaaacattatcaatcatgtgtattatcaatcaacatcataatgcactgataacaaaaaacataatgagatatatccagattccttttttatgatatccctaaccagggttgagaagtcccagagagtaaggaagtgaatgggtgggaagaggggaaagggttattggtggatgggcccttatatttcttttaagacaattttatttaccaagtctgaccagggtataaacttcataaatatagtagtcaatatcaataattaatgattcttaaatgattctggctgctcctcaagcagccattccgcctcctgcactgagaagagcaatgtcattcatcagcacagccccatcctccttgtcattggtcaaatgattggttcagggatgatgcaagccaatctgtgcctggcactccccttgttccagtgattgattctgcagaatacaggtgacataaggtggactaatcaaagtcatatccagaactgtcaaaggttcggtgaagtccttttagatggcaaataacatcatgtgatgcctcagacagttttgctgagagacccaaagaaaatcacagcccaagatagaccattaacatgagcacaaaaatggactcagtgcactgaaggcaggcaattcttcctcatgagagggtttcctaagctccgtgggatgttcggctccacctgcagcccagtaagtatcagaggcacgccccggttaattgcggcaacacaaaagtaactccacatgtttccaaatgtcccttgcctgggaagtttcttctgcacctttgagaactatcactaaatctagtattccctaactttagcaaaccaaccaacctgtcctcacaccctcctgcgattactaccccatttttctatatagaaattttcattgagaatttcttatcaccctggtctccatttctttattttatactcttccgtgagccaacacttgaagactgctcttggtaaagcaatgagctctacacttcaatcctgtcatcacatttcagttcttatcaggttgaccttccagggacattcaatatagttggcttctgttctcatcatcctttcttctcttggcacccgccagagaaacccttctggtttcccctacaaaagaggacatacttttgtagcttcctcttctggattctctccctttattggccctgcagattttggagcatcccaggagtctgaatctgtgtattctcccaggtgacctcctctaatcccgtggctgtaatgcaatggatatgtcatcaactcccaaatccttatttccagacttgccatctccctggacctttctttctctttctctttctttctcttcctccctccctccctccttcccttcctccctccctcctttatttctttcttttcctctctctctctctcccttcctctctctctctctctctcatctcactctgtctcccactatagagtgcagtggcacgatctcagctcactgcaacctccgcctcgcaggttcaagcaattctcctgcctcagcctcccgagtacctgcgattacagatgcccaccaccacacccagcaatttttgtatttttagtagagaaggggtttcctcatgttggccaggctggtctcgaactcctgacctcaggtgatcaattcgcctcagcctccctaagtgctggtattacaggcatgagccaccacacctggccctcactggaacttcagataattgcatctactagcatttgatatctacacggatgtccagtagataaataaaataaacattctcttcctacacctgtcttagtgctttgccttattcctaccctctttgatccatcaataaattttgttaacggtagtccttcatttctaacctaatctcatctacagcaatctatttccctacccaataatttgtggtggaacacaaatctctagaactgcatctttggactcatagctcaatgttaagtgaccttgcatgtgcaatttcatcttcattgggttgttataaggatctgcattattactagctacaagcatttttatagctcgttttttattttttaattgctatttttatgttttatattttattatttatttttatttttataactattacctgcatactcatttagcacttgagtatatgctgtatgataccatcctctagtagcttgtttcataattctttatttctgtctttgaagatctttgtgacaggaagcctcatttcatctccccacttatacatagaggccaggatttttgccttttataatgaattattaaatgctatcggatcaaccctcctgcaaaaaaactactataaaattgggacttcactaaagaaagcagattcttgaaaagccatagaagagtgaacaaaaaaaatgaagatttctagttagggggtccacatcaggagaagtacagttacgtaaagggagtgcccattctcacagctttaggcttgaagccaggtgcagtccgtgcacatggcatgtgggccagcaggcactttggttgcaaagccacagtttttctggctgaagaagcaaaacaccaagactgggacacctgcctccgaggagacacagaagaaaatgagtcagaaagagaaacccaaatttctatctatccacgtctctggctaacccctgaatgatgaaggtgcgttatcagactcaaagttgctcagctaaaggaaggatgtgctcaaggaggtgaagtataatgcccctgtgacagtaaatcccctgtgaatgtaaacgcccctatgactgtaaatgcccctttgagtgtaacacccctgtgaatatgaacgcccgtgaatgtaaacgcccctgtgattgtaatccccctgtgaatgtaaacgcccctgtgattgtaatccccctgtgaatgtaaacgcccctatgattgtaacacccctgtgattgtcttcctcctgaagaatacagcatggaaaggggaacaaaaacaacctcacagtggagaaacctgacaggcgctaccgcagccaggtgatcaaggtcaacatcaacagtggtaagtcatcttgatcatgtttacccttgacacagtgtgatgcaatgggcaatttatctctgtgggctttctctcaaaaacacataagcccagtctaatcttcacgaaaacatcgcacaaaacgcaattgagggacgttgtaaaaaacacctggccagcactgcgcaaacctttcaaggtcatccaaaacaagaacagtctttagaaactgttagagtctaagggcctaaggagatgagtaaatgcaatgtggtagcctggatggaatcctggaaaagaaaagagacattcggtaaaactaagaatatccaaatacagtttgaattttagttaataagaatgtatcagcattctttcattaatgataacagatgtagtataacaatgtaagaagtttaaaatagggaaactgggtgtggggtacatgggaactccctgtactatttttgcatctttttctgtaaaactaaaactgttgtaaaataaatgttcatatatattaaagaaaaagatctagatggagatcagacttgcacacaaagaacagattttcttttcaagatcaaccaaaataaatgtcttccaaaacaaacaaacaaagaaccaagggtcactggagaaaaaattacagaattcagtgtctccagtaattacgtttataatgtctgcgatataattttaaaagtatctaacatttcaaagaaccatgaaagtaaaccattctcggagaaaagaaaatcaagtgagacaaaaccctgaaatgactctaattttgaaactaggaaacaaaattttaaaggagctagtagtattactgtccttaaaggagtaaaaaaaaaaaaaaaaaaattgcaatgagtggaaagatatgacagataatcagagaaatagaaattataaaaaggaatcaggccgggcatggtggctcactcctagcaattttttgggaggcccacacgggcagatcacttgagcccaggagtttgagatcaacctgagcaatacagtgagaccttagctctattttaaaaaaaagaaaaaaagagagagagagagaatcaaatagaaattctagaactaaaactacaattgcctggaataaaaatctgttaaataaatttaatacccaaatggagattaaagaggaaagcattagtgaagaataaagaattgtttttaaatgaatagatgttagggacatattagataatatcaaatgatctaatatatatgttgttggagtcacaaagaaaaaatgaaagaatggggcagaaaaatttttcaaaaaataatgccctcaaattttaatatgtgatgaaataaataaatttacatattcaagatgttcaacaaatgtcaagcaggataaatatgaacgtgcttgtgtcaaggcaaatcatagcatagtcaaactatggaaagccaaagacaaggaacaagctttgaaaacaacaagaaaagtttgtctgtcacatacagggttaaaatgatgtaattaagggttaacttctggtcagaaacaatggagtccagaagtgacggcacaatattacagttcaggaagaaaacaaaaagcaaaaaatgcttgtcaatgcagaagtttatatccagtgaaaatatcttttaaaaatgagaataaaataaagatattttaagattaaataaaattaagataatttatcacaagcagactcatatcacaagaaatatcaaataaactcttcaggctgaagtgaaatggtacaagacagagattcaaatccacaagaaacagtaaaagcatcataagtgctaaatacagaagataattaggtaggaatttttttgctttattcaacataatttatttaatgcagatgactgggtaaagcagaaattctattccatggggagtttagaacatataatatgtatgccaagtatggcataataggtgcggggtaaatatgggtcttttatttattttatgaagtggagcaatattaacaatgaagaaactaagaagttaaggacagacattatatttcttatagtaaaaatcaaaatgaataaaaatattgacccaaaaagcaagcaaaaatcataatggaattccaaaaaatattgaaataatccttccaaaaagggcaggagataatgaagaatggaagaaaaatagagaggtagatagaaaaatacaataaactggtgaccagaactcaccacatcaataattacattaaattttaatgaagtaaacactccaattaaaaggcagggactacgtggacagagggaagtgggtccagctatactctgtctacagggctgcattttagatataaagacacaaatggtttcaaaataaatgaataaaaaatacgccaagtaaaatgtaatcataagaaggcagggatgacaatattattaatatcacaaaaaatagattcaaaggcaaaactattttgaaaaaacaaaaagagagaaacttaagactatgctgccaccacttgaaaaggtggatcgcaaggctcaagaatcatagcccaagccttcccactccttccctccttgaggtggaagaggtgcccggtactgcatcgggccagactgggaatgtcaaggtctcctgccacttccaggttccccggctggaaacagaatgaggacttcctaccctcctcagggagtaagagaccctggtcttagaacatagcaactgatgaggacatcgcgcatagcctcaaggaaacagctttggttctttgacgagggtgtatctccagtagaattccctcctctctctctttttccttctctctctccccaacatactctttttttattctttgattaattcttccacttttaaaattatttagtagaaaccacattaagggagatggagaatgagaggtaggaaaaaggcaactgaaaatctatataataagacgtgtatactgtggctaagaccatggatgttagaaccctctgtgtgggttcacagactagctctgtcccatcctaaccaactatgtaagcatgtcacacagtttctctctctcaatttattaccaacaaaataggcaataataatagtatctggccagacacggtggctcacacctgtaatcccagaagtttgggaggctgaagtgggcagatcacctgaggtcaggagttcgagaccagcctggccaacatggtgaaaccccatctctactaaaaatatcaaaattagctgggcgtggtggcgcacacctgtaatcccagctactcaggaggctgagacaggagaatcacatgaacccaggaggtggaggttgcagtgaactgagatcgcgccatggcactccagcctgggcgacaagagtgagactgtgtctccaaaaaaaaacgatgagaaagtggacataataataagggcaaaactctttggggaaggagatgacaaagaaaggagaagaaagactggatgataactagagagggtttgtgtcttataaggtatacgttctcagtatactttgtacctcatcaaaaataataatcatagtatctacctcctaaagttgttgtgagaatttaataaatcaatataagaaaggtatttagaagagtgcctaggcacattttaagtttcagcaattattgactcttaacttcaggtccaacatatagtgtaaaaattattgtaattatcacgtcagttgtgccatattaatgtttggttttaaaaatgtaccatttattttctttaaataagaaaagtgttcccaatggagctctattccactacactttatagtaaattgtaattggtctaaagtgtcgttagtatactgatagtgatatcttctgtttaaatagagctctcaattttcaaagtgcttttacagacattatctcagttaatcttcacaatagcactgaaagataattgggagaccatttactattcctatttttaaaataaagaaacagatgcacaaagaataaaagtggcttgcccaaacttcacaaggaaagaagcaggaaaaagaatcttgggtcctaaactccctcctctgtgtcagtggctttcacactggactgtatgttaccctgagggtatatgggacgtgccaatggaaagttctcctattcctcacacaccgttccttcaaacagatatgtctggaaacacatttatggctgtttcatgatggatcattttgtcccagcttcccttcgaaatcaacattctcccacttcacaaaacaaaggaatacactcaatctcccccacggtggctctggtgcaccaccacagggtgttaaaggagcatgccttgaacaactgggaacggggagcctcttttaacccaacccgttaactcacagtagagctttatttctttcagagtaaggtaaaggttggcattaggaacgatgatgtattttttagccatttcggactgtgttttcagcacgtgggttgagttaggctggtatgaatacagatacacagtaaagagggacaagagagatggtgatgttcatttaactctcatagctcttctaccccttggtattgccaaagaagtaattcctcctcagggaagttctcagaagatcagagctaagattgttgtctataatactgaagatgacggtatcttatatcacccaggagacaaactgctggcaaagttccatctcttacctaaccatccatctgtccatctgcccattcatccacacatccacatagccagccatccacccatccatccacctactcctctgtagtatagttatgcgttttgagaaatgcatccttaggcaatttcatcattgtgcaaacatcatggagtgtatttatgcaaacctagattatatagcctattacacacctaggctatatgatatagtatattgccccaaggcaacgtgtacagcatgctactgcactgaatactgtaggcaattataatacagtagtgtttgtgtctctaagcatagcaaaggtacagtaaaaatatggtactataatcttaagggaccaccatcatatatgtggtccctcattgactgaaatgttactatgtggtgcttgacagatataagatggctatgggggcccatttttttctgaaaaattaactcctattggctgtctgatttgaaaaagattggttttacatcatgtcaaaaggcggtcactttccacaaatggaatatgcagctccaaggttttgatttaaaaaatgttaaataaaataattttattataaatattgtattgacaaaagtgtattaaactgaagaacatttcaatttttcccaatgtttcaaaatttgtcagattgaacaaaatacctctaaatgatagaatggcaagaaaaattaagtgagttaaaaaaaactttataaaatatatttgatacatttcctagaaattgaataggtgaatgtctctatataattttgtccaagtaattagcttcaaattctttattttcaacaaaattaaagatggattcaattgggttataaattgacagatcactggagtaattatgacaaatattactaataaatttttgttacaattttgaagacattaaaagaatgaagttgctataataaaatctcttctattccaataaacttattagttagaacacgggcttacacccataacaatgaaaaggaagaacaaaatgatgctgaatccatttcattccagcaataagtaagattcatccacagacaggttaccatgcataaaaataagcccattcatctaattaagggatttatttctaatatttttatgcttagtaattatttgtcaaaaataccaagaaaccattcacccaaatatatatttatatttttaagtgatttgtatactaaaaatagcatgacacatcatgattcactagaaattaatactaaggcttatggtacaagagaatttaaaaatatatcataaactttaattcttatacatgtttttgttgcaaagatatattttgagatgatgtgtaaagatatttaaaacaaaaaatagttgattcttgttattttctataggctatagttgtagtctgtaaagtcaccacgaacagtaaactgctgaatactaaagcattgttcctaggggaaaaatacagggttaggttcctttgagcctctggttacaacattttcatccaccagtcaatacataaccttgttttatgtgtgtttctgtttaaagacagcttgtttattacattttattgattcattaacattgcactcatagccaatatcactataactaatgccttaactaggtttctataatgtgtatttctccacaacggacatcaccacctacttaaactcaggaacactagccagtacttcagtactatgcttggggccatttcgaacaatgaaatcaccaataaaaagcaccaaaatatgaaaaacatgacactacatagacctcaaagagggcatttgtttgcagtacgaaagttgaaacaagaaagcagaacactcaacctcaactgagaacatgcttattgagcaactcaaatcttcacaactctgccatttctgtgaatgaccttaaaagcttccagtactgattttggggcaaggaataattttaccatgttggtgaatttgcaaatatggaacccgtgaaaaatgaagattaactatattacattgggataaagttatgcaggagagtagaatagaaatgaaaaagtttgtaaaaaagaaacaatatcaaatttcagactattaaaaatcatcttttacatgtattattagcaagatgatactgaagggtaaatcatcagttttaatatcccccaaaaacatttttaaaatgatgcaattgctgtataatttaaccttaatatttataatctgaccatactgcaactacttaaacctataataaaatttttatatcaacttaaaaatgtgcaaggaagtatatggtttctcaaggtgttttataatacatatgagcaaaataatttcaagattactaactttagaaatagaagctaaaatcacaatgaggctgattaatacaaacaaagaaataaaaactacacaaaatcccaaacttaagagtcaggcgttgaaaccaaatagccattcagtgatgcagacacaaactctggggctcacactgtaatgagtgtgttgtgtttgtcttattaataatgatgaagtatttttttataaatactgctttgctcatttttatatagacaattttcaaacaattttatatttctcagttgcttcaatcaaaaagaggtttgtggccgggcgtggtggctctcatctgtaatcccagcactttgggaggccgaggtgggcagatcacttgaggtgaggaattacagccagtctggccaacatgacaaaaccccgtctctaataaaaacacaaaaattaggctgggtgcagtggctcgtgcctgtaatccaagctctttgagaggctgaggtgggtggatcacgaggtcaggagtttgagaccagcctggccaacacggttaaacccagtctctactaaaattacaaaaattagccaggcgtggtggcacacacctgtaatccccagctacttaggaggctgagacagggagaattgcttgaacctgggaggtagaggttgcagtgagccaagatcgctccactgcactccagcctgggtgatagagtgagactctatctcaaaaaaaaaaaaaaaaaaaaattacctgggtgtggtggcacgtgcctgtaatcccagctactcaggagtctgagacaggagaatcacttgaacccaggaagcagaggttgcagtaagccaagatcgcaccactgcactccagtctgggtgataagagcgagactccatctcaaaaaaaaaaaaaaaaaattttttttaaattaatagaggtttgtaagaatatctaagaaaaatatttcctcagacaggagcattactttaaggaaaagatagtactatataaatatattccactgttaaatatttccagtacgtgtcttttcctcccagagatgggacagcttgctggctctgtgagtaaaattaattagtcctagctttttgttgcctttttttttttttttcccagtggcagcttgtaactttatctcttttttttaaatatccataaattttccatgcaacaataggataaatttatttcactaattttaggataaagaaaatgaataaaattaaatgacttatattgagtaaaataaaagaagaggaagaaataaatgtttttgttttgtttttaagacagggtctcactctgtcactaaggctggagtatagttgcatgacatcggctcactgcatgcaacctctgcctcccaggctcaagggattctcctgccccagcctcccgagtagctgggactacaggcatgcaccaccacacctggctaatttttgtttttttagtacagacgggattcgccttgttggccaggcaggacttcaactcctgaccccaggtgatccaccctccttggcctcccaaagtgctgggattacaggcatgagccaccgtgcctggccagaaataaacgtttttattgtgagccaacagaaattactgattcatgcattaaaaatattgaagcagatacagtccaaaggcagcatcatattactgtagagatactacatgcaatctgcttggaagactgtgcatagtaagcacttattaggtagataatggcactcccctgaactgaaaacagaagttataaataatatttaaaatccaaaaacatgatggtactaatattagtacaagaaattaccaccttatatcttatattaacttagcaaaaattattaattaatatttaatgaaattgtcagttagatggtcagtaaaaggaagtctttggcccacagatcaaaattcacaatacaattttatccttaatctttaaatacaaaattacatttacgagcgtatttttaacttcgcagcagagatttaagccagtggcaaatacagaggctctcaagccagactacctcagtttaaatgtctgcttctcaactttcttgctttaataccttcaaaagtaaaatactgttcacatgtatcttacagagttgttataagtatgaaatgtctgactacatgtaaaattcttagattaatgcatagtatacagtaagcactcagtaaatgttagcagctactaaataaaaagtagccgcattttcaaaaatgattcggaactttctagtaatcaccaacattactttcagaagctctagttggaaatatttgttaaaatcttctcttaaaatctcaacagatagggagaaggtggaatctcacacactgcaggtgggaatgtaaaatgctaccgccactttggaaaacagtccagcaatccctcaaatgctcaaacctagagttatcatatgatcctgcaattctactcctaggctatatacttgatagaaatgaaaaatatgtccaaataaaaacttgcacatgaatgtccctatcagcattattattaatagccaaaaggtggaaaccacccaaatgctcatcaattaaccaatgatatatgcatgtgtttgttgtatccatacattggaatattactcagcaatgaaaaaggatgaagtgctggttcataccacaacctgggtgaaccttgaaaacattgtactcagtgaaagaagccagtcataagatgttgtatgattccattgatattgaatgtctagagttggcaaatctatagacacagagagtgcattagtgattgcctaaggtggtggtggacagtgtttggggagaaacaggagttactgctaaagggaagtgggtttcttttgggagtgatgaaaatcaaaattgactgtggtgatggttacaaaactctgtgaatatactaacaaacaatgaattttagaatttaaatgggtgaattttatagtatgtgaattatatcttagtaaaactgtatctcctccgctgtccctccctaaaataaaaccaaccaaatctctgtatacccatcacttattaaagtacttggcaaaacactgtgacttagtacttttgggataagcggatgaatgaatgtgcattcacttcactttaaatgttttttcccctattttcatctattagagaaaactgtaatcatgagaagaaacttacaaaatttgtaaacatcatctttcacatttagagtttgtttttataatgtgacaaagtttttctgttaaatatctcacagttgctgtacctagaagtgctttaagaacctgaaatagtactaatggtatgaaaaaggtagacttatatttcaacctttaatatagaaaatataatttgctcaaattactcacactgttctaatttccatatgctctaaagtaagtatgaataagatttagacctaattgctggtgacattaaaattcattcaattcttactgtcaacaaatatttactgaataagtaactatttgctaggcacagtgctagaaagtgatattacaaaaatgaataacacagcctggtgacagagatattacaacagaattatgtacaagaatatgatacatgctatattagggcttgtgccatgcgtaccacaccaaatgttttaagaatgaagagaaaaaaaaggaggctgggtgtggtggctcacgcctgtaatcccagaactttaggaggccgaggcgggaggatcacttgaggtcaggagttggagaccagtctggccaacatggcaaaaccccatctctactaaaaatacaataattagctggacgtggtggcacacacctgtaataccagctactcaggaggctgaggcaagagaatcacttgaacctgggaggtggaggctgcagtgagctgagattgtgccactgcactccagcctggaggacagagttaaagtgtctcaaaaaaaaaaaaaaaaaaaaaaaaaaaaagaaagaaaaagaaaagaaaagaaaacaaaaaaagaagagaccagcactttgggaggccgaggtgggtggatcacttgaggtcaagagttcaagaccagcctggccaacatggtgaaatctcatctctattaaaaatacaaaaattagccaggtgtggtggtgcgttcctgtaaccccagctactcggggcggggggctgaggcaggagaatcgcttgaacttgggaggtggaggttgcagtgagccaagatcacgccactgcactgcagcctgggcgacaggctgagacttcgtctaaaaaaaaaaaaagagacaatgaagaagagtggctaaaagctggagtagttcaaaatatttcagagataagggaaaatataggaatgatagagaaaaataagtaggggatttccaggtagagatttgttttttattgctacaggttaaagacacagtttaggaattactcttttagacaacaacagtgtattttcattagccatgaggttgtcagtattataggatggaggtatttacagtagtgagcagagagcaggcagagtcttatataactgtgagaactctggagctgtcccatgaaacttttaacgagctaaattttctattttacaaaaggacaacgtaaataattcatctttcaatattaagacaacatgttaactaatcaaaaatatcctggctatcacaaaattcaaaaggaaaatgtcaaaatatctacatgtttatattttgaattgaaagatattctaaaagttgtttcatgattatgaactgcacaatggagaccaatgtttggttcacaaatgtgtgctgttaattagattgagagtgattgtatatggtttctcacaaaggcatcttgagttcaaccatgtaaattgatggaattatcaaaacatcagacctatttcatttcaacctggcttttataaccaaggtgtgtgtgtatgtgtatggtgtgtatacatgtgtggatgtgtgtggatgtgtgcgtacatgtatagtctcccccaatataaatgtgaggctacattttcaggttaagagggctaatgtgtatcttgccttctcatcacaaattgttctacaagtccatccataatgataattatatccttcaatagacggctgcttacttcccaaattttaaactgaacaaaaatattacggatccaccagataattttaaatctatctacttgaactgcaaaattaggagttgaatgaaaaccttacttagtgcagtatgtttaaaactcatctttggctaggtgcagtggctcacgtctgtaatcctaatagttttggaggccgaggtgggtgcatcacctgaggtcaggagttcgagaccagcctgggcaacatggcaacatcccatctctactaaaaatacaaaacttagctgggtgtggtagtgggcgactgaaagcccagctacttgggaggctgaggcgggaggttgcagtgagctgagatcgcaccattgcactcccacctgggtgacggagtgagactccgtctcaaaaaaaacaattaaaaattaaaaacgaaaaaaaaaccacgtcatctttgagcatgttagtacttgctttgatacaaagggtctgcttgagtttgtattaaatcatttaactctccttgtagtttcctctgttattaaatgatgagaatgttcctaacctattgcaaatgattacttaccatggaaatacaaccacaattatactcaagattattccaagcacaaagttttgcatggaatcactgtaacattaacactgtctaataagaaacaaaacccaaatctttctgttaggagattattctccatgggtctccggccttctgcaatcttacctcactacctctatgctggactagctttccaagggggtttgtataggaagcatccttataagacaaaggtagtgtcttcctctggatcaaagggcagaagtgcttcctgtctgtcataaaagattcgggttccctgagctccgggttcctctccttttaacacatcctgctgtgtgtgcaggtgtcacttcacattgccctgtggaaactggggcctggagatgttgacaatgtgactactgctatggggcaagtaataaactatccagctccctgacccaggaatctcatgtcttggggccaatgtttggttcacaagtgtgtgctgttaattagattgggcaccagctgagtgactgtatatgatttctcacaaaggcatctcgagttcaagattggcatccatgaaactgtgagcagcctgcaagagggataaagtctcagatacttcacagttcctgacactgtctatcatttccttgacttaggcattacattcttactctctgaagctgttattttgttgttgtttttggggacttaataagcacattttaaagataaaaataaagcttaaactgaaatcaaaataccagtctttattttattttaatcaaagactgccctgacctttttttgagatgagatcatgaggtgacgtttaagctttgtaaatgcttatacataacaagtactttcaacaaaaaattctaacaattcttgatgccttatatgccagcttagaagaaatcaatcattgtttactttttcacttaaatttgcagatgctgattaaaaggcgattactattttttttacacttaggtctttctttaatcaaaattgactatatctctataaatgggaatcagggatctgctattacacaaaaatagatgtcaacatatgaaaattaaataaatgaactttgccactgccctgtaattaagtgataaagatttcattcacttttctaaggttttaatcatttatgataacttttattttcttaaggaaaaattgaactttgattttaaaaattctaaagttttcctaaaatatagcactaatatgtaatggagcaaactttcaaagtcacattctatttcattagaaatttgtctacaaatggccgggcgcagtggctcatgcctgtaatcctagcactttgggaggccgaggcgtgtggatcacgaggtcaggagatcaagaccatcctggctaacacagtgataacccatctctactaaaaatacaaaaaaaaaaaaaaaaaaaattagccaggcgtggtggcgggcgcctgtagtcccagctattcaggaggctgaggcaggagaatggcgtgaacccagaaggcggagcttgcagtgagccgagatcgcgccactgcactccagcctgggcaacagagtgagattccgtctcaaaaaaaaaagaagaagaaaaaaagaaaaagaaagaaatttgtgtataaatacaagttttaagagccccccctcctccttcttaataaatattaatgcatttgctcctccactaaaaacactttaagaaaatcaacagccatggcgatctcatggctgtgatgtgctcagggcaagcatctatgtaacatatccctattctgcaacacctcacccagcagacagaatgtttacctaaaactccctgagcttatgaaaacttcaacaatcatgtcaacatttaagctcgttcccaattaaccagtcttaccaagcatcacttctatgaacattttaaagaaaaaccagtgaagtggtgaaatcaactctgtccaagcttgcatgcaactctaggaaggcggttagcttatctctcaactagttcttatattacaccactatatttaacatctgacttttgttgctgtttataatattaccctttattttccttcaattttagaacctcagtttgtggccacctacagaataaactttcagctttaccaaattttctcttcttatgagagatgcacaacacttaatagagagaacactatttttcaagctgcaatatactgtggtgttttcatgttagacataaatagtgtcagtgaaaatgttgatcaaagaaatgaaattctaataggatgtcagaagaagcagattaaacaaatgatctagctgttccaaagacatcaaaatgcaaaataattcttttctggaggtattacttagccaaatgtaatttctttagcaatttcaagaaagaataggaagtgttaatgttagtttaattatagaaataatgtcaagtgacaatggcagggaagaaactgaatgctgatttgatctacacacagtgacatggacatttagaaaatatattatatgataattatataatcctggctaaattctttgataggtttcagttgcccctgtaaatgttctaaaattaaattcaggagggtatattgtgatatttaagaatttaacaaagttatctcaagaacatctcacactctcatgctatctgcaatccttgaatatatggtgactaatatatcttaatgtatttttgtatatcaatattttatcatgttatttcttaagacgacaactccaaataacaaagtgttgaaagaaaatatcagaaccaccaatatttttctttccttgacatacttgcagatatatatttttatgtttataacagaagttaataaagaaacatgcccagcttattatttctggattgattgcagaaacagctactaccttttttgatgatgtggaagtttatgcatgtattgaggaggcaatagctgtgataaattacttcaagaaaataacactttccattgcctttctttttttccttacaacctgtgttatggagtgaaatgtacttggccttgtcttcaggaggcagaagcaatcatttgcagaataggctttgtgtgctaacatttaatattaatctattcccaggcattatattattaactttgaatagatgctgacaagtcttgtttttggagggaggtggggcagggtatcgctctgtcacccaggctgaagtgcagtgttgccatcatggctcactgcagccttgacctcccaggctcaagtaatcctcccacctcaccctcaagagtaagcaggacaataggcatgtgccactacacagggcaattttttttattcttgttttttttttagagacaggagtctcactatgttgcccaggctggtctcatatgcctgtgctcaaaggatcctcctgcatcggtctcccaaagtgctggaattacaggcatgagccaccacatccatttcacttttgctttttttttaatgtgccattgttgcatctgtttctactgaagaataaaacagataccactatgctctttgttttccttttttttttcttttaatcactacccatttattaaaggctaggtggatttgggtaattcatcactgctaagtaaggtaactaagagcacgtttatggatatattatatacactggttacctcgtttcaataaataagcagctggtaagtcatctcccagttttatccccaacttctaaaagaaaaataggtcgaaaaaattaacaaatctggttaggaaaaatacactgagcccaactattatgattccctggattctattattacgtttatttattagtattatgagtctttgctaaaatgttgacttcttatggaaggcctctcaacagtgctgtttaaaaatcacacgtaatcaatcctttcactcggcacaccctaacctttttcccttcttcctttttctccacagctttcatcaatatcaaacacaattcatcatgaaaatcaagatttattcgttttgttcactactctatccccaatgtctggcacatactagctgctcaataaataagaatgaatgtgtagtataccacatggatgaagtatgggaggtattcattcaagcacttatcatgcgctctcctaaattacttaacatcagtgactgcccccactccacccgctcctcatccagcctccactgaatgaggaaacagcaccatgaatgaatagctcatgataaaaatttagcgatcgtcatcagtgtatccctttatccctatcattgagcctttggttctatctccaaaatatttattagatttctctacctctctccatctgcattgtcgtgaccattatctgtcttttgaatcagagcaatactctcagaacaggactcccaaaggcagtcagaggaatcccttgacacaagaaaaaactcacgtcacttcctactttaaaggcctcaatggccttctattgttcacaggataaaatctacactccttactgcagcctacagggctgcacggcctggctcccacttgtcctccagcctcaaccccctgtcacgctcccgctacgccgcccaccgagctcccgctatgctgtgtctggaagaagccaaccccttgctggattttacaccttggtacttgttgttccctttgcctggagcactcttgcctcctatctttccatgactcattcacagcctctagagagtatctcaaatgccagctgcacaggtcttcctgtgaccaccctaattaagcagcctccctaactactctctcatcaccttgtttactgctaccgtggttcttatcaccactttgttaacttactctttgttaaatgtaagccccgacaggacagggactttgcctctgtatattcacagggactaataaaatacgtggaacatggaaattgctccatatataacaaccgaatcaataaatagaacattctccctcacttgggtggcatccctcgtctcactaattagaatgcctgacacagaagagacatgctacaaatgttgaagtgaatgagaaaactgaaatcttttattgtatcctgagtggcacccagaaagatctttgttcattaatatttgcatataataactggactgagagaaaaatgaattcatttgattgacatttactcagtgtctgtccagtgctggaaagagcatatggcaatttggcttgcaagcacagaacagaggatatcatttctaaactgttcggtaatcccataaatataggacacacacatttcaccaaggcatttggcaaagtttctcattatatcttgtctttaacatgcaggaatgcagattggatggtagcccagctgatgggtttggtactagagagtggttagatgaagacagcttaagcatgttcaacagctctttcaatgcagcaaatatttcttgagcagctccggccagccaagtactgagcttgaggctagagtaataaaataattaagtgtggtctcttacctagaagggtgcataagtcttcccgtaaaacatttcagatctctgccctgtaccattgacattatttttaaattaatatattggatggatatatacagaatgtacttctatcaaaatcatatgagaattttaggggaaaaaacagaagaaataataaatcaggatccaagagatgataggtatctcaaaggctggaatgaattctttaaattaaatttagtgcagatatgaggtcctaccaatgaatccaaaataccaactacatatttacaaaatgggggaaatatggaatgtatccactcataaacattccttagggattttaatttacagtactctataaaaatctattgtgatatagtgatcacagaaactagtttcaccttctggtgtatttacaaggaagtaatcagcctgtgctcagaccacacttaagactactgtgtttgaaggcacgcaccacactataagaaaagttcagaggaggcggtcgagatggacacgaggatccttgctgcaacagccaatggtgttgctaaaacactgacactaatgaagaatttgtggaatgttaagaaagtgggggggttgcaggggggggtgggtgacagaggaagtcattctacaaaaaggtacttgcagatgcatgtttatagcagcacagttccaggttgcaaaaatgcggaaccagcccaaatgcccatcaatcaatgagtggatcaagaaactgtggtatgtgtgtgtgtgtgtatacacacacacacacacacacatacacatactactcagccattaaaaggaatgaattaatggcatttgcagcaacctggatgggaatggagatgattcttctaagtgaagtaactcaggaatggcaaaccaaatatcgtatgttctcactcataagtgggagctaagccatgaagatgcaaaggcctaagaatgacacagtggactctggggactcaacaggaaaggatgggaagggggtgagggataaaagactacaaattgggttcagtgtatactgcttggatgatgggttcaccaaaatctcacaaatcgctactaaagaacttacacatgtagccaaatatcacctgttccccaaaaacctatggaaataaaaaatttaaaaaaagaaagtgtgggtgaatggtagagaaggagggagctaactgtccataagtattcaaagagcaggtatgcagaagaaatagtaaacctgttttacacgatcctagggcacaggactaggaaactacatgaggacagattttgattcaccataaaaaggcctgactatcagtgctgtcctgcgaaagtgaagcatctcgtgaggaagtcagctctctatcaatgacaggtctcccacggccactgggacatcctctggacaaagacatcagactcaggacttaaacgctgcatagacagcagatttctagaccctatgtccttgacattttatgatataatgaaaagggaactaaaaaataaggaagtatacattttcattcactcaaccaatgcttgctatggctaggcgctgttttaggcaccgtggacacagcagctaacttaggcaaagtaatcccagcattttgggaggctgaggcaggcagatcacgaggtcaggagttcaagaccagcctggccaacacagtgaaaccccgcctccactactagtacaacaattagccaggcgtggtggcaggcgctacttgggaagctgaggcaggagaatcgcttgaacccgggaggcggaggttgcagtgagccaagattgcattactgcactccagcctaggcaacactgcgaaactctgtctcaaaaaaaagtatgcttgtgaagcatacattctagatggtttgggacaaaatgaaacacaagcataaaacaccaatctttgggtttgagaggatacttggtgctagtttgaggcaaagctacacctgaggcattcacactttaattttgtttatttatttttaaattttatttatttgtttttttgagatggagtctcattctgtggcccaggctggaatgcagtggtgcaatctcggctcactgcaaactccagctcccagtttcaagtcattctcctgcctcagtctcctgagtaactggtattacaggtgtgcgccaccatgcctaatttctgtatttttagtagagatggggtggggcggtttcaccatgttggccagaatggtctcaaactcctgaccttaggtgatcggccagcctcggctacccaaagtgctgggattacaggcatgacccaccacgcccagcccacactctattttttatttatttatttattttcatttttatttatttatttatttattgacagagttttgcttgtcacccaggctggagtgcagtggcacaatcttggctcaccgcaacatccacctcccgggttcaagcgattctcctgcctcagcctcctgagtagctgggattacagtcacctgccaccgctcccggctaatttttgtatttttagtagagatgggttttcaccatgttggccaggctggtctcgaactcctgacctcaggtgattcacctgcctcagccttccaaagtgctgggattacaggcgtgagccactgtacctcgcctccacactttatttttaagctggaagttatcatagatagagccatttgttacaataactgcagtagaccttttgcctttattcccgctatatgttctcctttcctttctaacctgtggcttccactcctcaccactgcaaaacaatttacaattaattgcttatactgcaattattaataaaatatattttgccatttactaaactattagatatgttttctgagtttttacacattaaaactttccacagtaaacattataagtgttcattattagaattcataaattatacagaagtgcaaaaactaaaggatgtatctacttctgttactttcacagaataatctatgcatatgtactaatacagatttagacatatgttatcccaaatctggtagtacttttgtagcttttcattttattctagtactaaaattattagaacactagtctttttggaattgatttttaaagtcccctaattggaattgcagccatctttttggtctgtcctccgattgaagaagatctaacagtgcaatcatcatatgacacttaataagcatccttgctgggcacctggtccataagaacattgagaataaatactttcctgacattcagtcagattgattgatgcacatcaagtcaatgacactggggaacgctttgtggatggaatgactacataataacaggaaaactctaggaagatacacttaatgaatccttattgatctaaatacacctaaaacttgtttgtaactttaacctctgccacattatagaggaagacattccaaactcaaactttttttttatatactttaagttctagggtacatgggcacaacatgcaggtttgttacatatgtatacatgtgccatgtgggtgtgctgcccccattaactcatcatttacattaggtatatctcctaatgctacccctccccccaccccccaccccaagacaggtgtgatgttccccactctgtgtccaagtgttctcattgttcaattcccacctatgagtgagaacatgcagtccaaactctaacttttattttattttattttattttattttattttattttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccacgcccggctaattttttttttgtatttttagtagagacggggtttcaccttgttagccaggatggtctcgatctcctgacctcatgatccacccgccttggcctcccaaagtgctgggattacaggtgtgagccaccgcgcccggccccaaacttttattttatatatatatatcttagtagaagttgaacaaatatttccgaagctgttcagaacaaggtagaattcaacatactggaaatgtgtgtgtggcctgaaaattatagccagctactccagaaacctatagttgtggtgttttggaatttggtgacttggccatggttattcaattaaggaaaatattctcatacttatttttatatcagtctttcctactcaggtccttcaaagaaaacatggttaaacctattctctccccttcatagttgcttaattttattttttccaacccaggaagtcctaacttgtacaagtgtatcctcataaaatactaatgccttggtcatgttatctactctgaagtcattttaagcctttccctttgctaggatgcttaccacaactggatatttcaagtatggaagcaccatgatgtgaagcaaagatgggaaagtagttttatttctgtttgcaaacaaatgatgtctccttcttcactggtattttaggtaaaggcattaggaaaaactactggcttcagagaagaggacttaatgacactaagttgtgtgatctggtgaacacactttgaatcagttttgtccaaatgcatttccctatgtttgccaacatcaagctccctattataacatagtttctagaacagtgctgcccaatagaaggactagtaaagccaccgatgtgggccacatataaaattttaaattttctggtggccatgataaaaaagtaaaaatatgcagatataattttaatattttatgtagatgcaaaatattatgatttcaacaaataatcaatataggaggtattaataagatagtggtcattctttttttgtaccaagtttttgaaattgggtgtatgttttgtaattacagcacaactcagttgggactgtccatatgtggctaacggctactatattggcagacaattctagaaccaagctgaaaaccataaactgatggcaagtgtggaaagagcacagtttgcactctcagactactagattacctagactctttactcttgaaacatcaaatatgaattcatctattaaaaatgtcaccataattatagatgtaggttagcctttcttttacaatgatggggtaaaaataactgatttcccaccagctttccggtgcaacatccattaccataataaagcaaatttaaatttaattagaatgtaattaaaggtaatgtgggtgattccaggatagctgatttgttttactagtaacagaaacgccctttgccacttatatgaagctggaacaatattaatcaaatgacttattatctgagagaacaaagtacagaaatatttacataacatagtaccataggcagaatatccacgttaaactaatgttaagaacgacaaagggaagatacgccagcataatacatcttacttcttttccaataatacaactgggacattgcaaatacccaacttctagaatctgtcaggaagagtaatctacatgtatttaattctctcctgcacatgttgaatgactaaattgtgaaaatatatttgaatgcttttttttagaaatcactatacttctttgttaggttacttaatttttagcataaacccaccaaatcccatgtcaattgttaaaaatggatctattcaagcctacagtataaatttatggtttcccaggaaatcacaggaaagttgttgtaaaaggtattaaaattattgccaataaatcccatgtttaaaaatattctattaaatgtaaatgttgaaagtagtattaataacagctatgttcaaagaaaactttaagggcaaacataaaacaatttacttggaaggccatattacaagattcaaagatttgctagattctttgaacaggtttcgatgggagatgatgatcttgtgatctgtagataagagactctgaatatcaagtgatcagaaaccaaagcagagataaggctactgaaaatagcctatttcctgtgctggtctggacctaggctttggggtataggcaggcctgataccagaagtccgatgtagcaaaaggaatgaaggaaaaagatgaagagacaaaaacatgctgacactgtcattatttctacaaatgtcaaaataaaattcaaaatgaaatcgattttttaattataaaaattcttctgagaattgtttattttcccctccagacataagtaaacttaaggcaaggaatcatatttaccttctgatatgcttcacatagaatttgccactttttatcagcaatattaaaaatgattatgtgatgaatagctttcagtctatacgccctgagagcaggcaagaaaaattattcaaaaaaacaaaatgcttctcactattaaccaaaaaacagcctatgaaaaggcacagtcaaatgatcttggtcaacaaggctaaggcacccattcattatttattgagggcttattgggtataaggacatctaagaattattcaacgtcaagtgttgtgggccaaaagccacaagagaaaaggattttcacttccaagtccagcctaatagttccaatcttggaaagaacgagagaaataacagaggaagagaaaagaaagagaaacttggaggaggaacaaataaacagcagacatgttgttactggagaagacaaaaaatgcagtgagaagatagagacgtaagaaccgcgcaggtacatgcatgtatgcatgtgtgtgcatgtgtatgcatgtgagtgtgtgtgtgcatgagtgtgtgtgtgtttgcatgagtgtgcatgtgagtgtacgtgtgcaaatcaagagacacaagcacagggctgcgtgtgcaatgcggctagctgcgtcatgcctccggaagtacaaaacaccactatttatttatttacgcctctggaagtacaaaacagcactatttatctatttatgtattttgagacggagtctcgctttgtcgcaatctcagctcactgcagtggcgcaatctcagctcactgcaacctccgcctcccgggctcaagtgattctcctgcctcagcctcccaagtagctgggattacaggcgcacaccaccatgcccagctaatttttgtatttttagtagagacagggtttcaccatgttggacaggatggtcttgttctcacctcgtgagccgcctgccttggcctcccaaagtgctgggattacaggcgtgagccaccgcacctggcctaacaccactctttttttttttttttttgagacggagtttcactcttgtttcccaggttggagtgcaatggcacgatctcagctcactgcaacctccgcctctcggtttcaaacgattctcctgcctcagcctcccgagtagctgggattacaggcatgtgccaccacgccctacttatttttatttatttatttatgtatttttagtagatacggggtttctccatgttggtcaggctgatctcaaactcccgacctcaggtgatccacccgcctcggcctcccaaagtgctgggattacaggtgtgagccaccgcgcccagcccactctttttgagggtagggttcacaactgtgtatatgtaaaatttttagtctcaagatttctttaaagtggtaaacagtcatgctgcagactcataaactgtgtaaattcatacaaaagtttagtaaatcttctcaatcccgtttgtataggctttcttaagtgaaacaaaggggcagaaataaacaataggtaatgataactgtggaaaagaaaacaggcagcacagcatgaggaaaggacgagcacagggaagcccaatgggtcagaatgatgtgcaagctcggtcttgcctggttcaacctcatgaacaagagaagatcagcaaacgtgataccccagccacaagagtaacactgataataataattacgattctatcgtcatcattcatgtggaggtgcatgccaggtgctttcgaattgttaaccacccacaagaagcctgaacacctagagttctcctcatcgtgtacataagcaaagggaagggagagagagtctttaattggccccagaatatacagcaataaatggaggagctgaggagtaaggccaactggttctgaaatcctgcctgtggtgtctggctgtaaaactctgactcttgcctaagctgaagtctagcctgggacctgaagtgcagcaactctgactgaagctggatggttactctacttccagtattgtgctcaatgaagaggtcagtttttgagcaaatacacttgactctttgagggagttaagaaaaatgaaattgaaataaagccagaatatacaccagagaaaattttggtgtctattttcctgaaatcacacaatctatcttaaaatttttacaatgctcaaaggtgtttcatcattgcccaccaacttctatcctggtaggtaccaggaaattatcatctctcaggtttcaaataaagcaggtataggccagctgttcttgctcacagtgatactacaggcagtcaaaaaataaattcgctgatgaatgttacctcctagaacttccacgcgtgggacttacacactgatgcacgagtttccattggcatttttgacagcatctatactcctcttatatcaacagaatatgtccagaactactggctttataagagtcgagttatgcagttgctacacagggtcattttgccagtcctttcattcaaaaccatctttggtgactcccttcattgagaacaagatgcaaagtcttcaggtgttcacagtcctttacgattccctttttccacctatttcttgctatactttcccctttcagtatccactcttttctcatcctcctcctctctgctgcggcctctcctacttcacaaacaccagccacagggagcttgtttctaggtcatgcttcatattctcctgcataactgcatgttctctgggataacctttcccctacagcatctctaactattcaggaagctaaccttgtggaaggtccattcaaattatacccgtcttacaaatcctgctctatctcttgctgttgtttggcaacactaggatcctttactgtttgtcagcctcatcctgtttcccggcttctgcaactgtttttctcagtacagtgcagagtcccagagtgcagggtcctaaagcgcagggtcctagagcacagggtcctagagcgcagagtcctagagcacagggcgaacatggttatccacggtgagatcttcttcccctagtacctaccacagtctcccatataggagacattcacatgtatttgtttaattttatgaacaactgtagagcttactctgagaaaagaggtttcatactgacctgtaattggatattctctttctggcctagtatataacctccctgattcaggctgcggctcagagttcttcaaagagtaagtacagttatcactgttgaaagtgactctggctgtaaacatcaaagacgtgatttctaatgttgttgtggctgaaactccgcttaaacactagggagaacaacaagtccacagaagtcacatgtctgttcattaaacgcacaggaagaccttgaactaaacccttcacaaaacatctaacacagagcttgcaatggtgaggagcctctctctcctgcacagccagtgaacaatctaggcttggagagacagagagaagagcaagagcattctaataagcaggtgtctgtgacctcctgagtaaccaaccgtgaaaccaagagataagtacagtcatgggtcactgaacaacgaggacacattttaagaattgcgttgttaggggattttgttttgggaacaccacggaagggacttacataaacccagatggtacaggcgactccacacctaggctctatggggcagcctgctgctcttggctacaaaccggcacaacatgtttactgaatgccttaggcaactgtaacacaacaagaaacatttgtatatataaacacaaaaaagtaaagtaaaaacacagtataaaaggtaaaaaatgggacactcgtctaggaaacatggagtttgcagaactggaagttgctctgggtgatcagggagcgagtggcgagtgaatgggaagacctaggacatgactgtccattaccacagacttcaccaacactgcacactcaggctacgctaaagttagaaaaaaacatttcctttcctctgtgataaattaactttagcttactgtaactttttttactttataaactttttaactttttgactcttttaataataccggtttaacacacaaatgtattgcacagctacacaaaagtattccttcttcatatccttactctatatgctgttttccaccttaaaaaaaaaaacaacctttaaaacttttttctttttttttgagacggtgtcatgctctgttgcccgggttggagtgcggtggtgtgatcttggctcactgaaacctctgtatcccaggttcaggagattctcctgcctcagtctcctgagtagctgggattacaggcgcatgccaacatccccagctaattttttttgtatttttagtagagatggggtttcaccatgttggccaggctggtcttgaactccgtatctcaggtgatttgcccacctaagcctcccaaactgctgggataacaggcttgagccaccatgcctggcctatctttaaaacatttttgttaaaaagcaagacataaacacacagtagcctgggcttagagagggtcaagatcatcaatatcactgtctcccacctccactcacatctggtcccactggagggtcttcagggacaataacaaacatagagctgtcatctcctgtgatcacaatgccttcttttggacacctgctgaaggacctgcctgaggctgttttacagttatctgtttttttttctcaaaaataattagtaggagccaggcgcagtggctcacgcctgtaatccagcactttgggaggtcgaggcaggcagatcacgaggtcaagagattgagaccatcctggccaacatagtgaaacctcgtctctactgaaaatacaaaaattcgctgggcgtggtggcgcatgcctgtaatctcagctacttgggaggctgaggcaggacaatcgcttaaacccgggaggtggaggttgcagtgggccaagattgtgccactgcactccagcctgggtgagagagcaagattttgtctcaaaaaaaaaaaaaatagtataagttctataaaataactataaatacacaaaccagtaatatggtcatttttctaatcacgtactatacataattgtatgtgctggacttttacacaattggtatcgtagtaggctcattgaccccagggtcaccacgcacacgaggaacgcattgtactaggatgttaccatggcgaagacatcactaggctataggagcttttcagctccatgacaatcttatgggaccacccttgcagatgtggtctgtcactaactgaaatgtcatggggcacatggctgtatacatttttttactgtatttgaatgatacggacaattactgacgaccaaaaatagggaggagaggaagaagatgacatggaagtaagtagaaactatttctgaaggagaaaaacttacatgggaaaaagactccttctttgtgccatggatttgccagttgacatgactgaaaagcagtcacccaaacaatgaccaggaggaccgagtgctgctggtgaagcccaccagagaccagcggacggggactgctgctgtgttagcgaggggaaaaacagcctaggacactgcccaccccatcttcaagggcttccctgactctagcaaatcataaaaaccaaaacccataaatgatgaggccaccaagtcataaagaagaagtcaaacccaatcattacccttttgttagatagtatggaaggagacagtgtattttaactgattctctttttttttaagacagagtcttgctctgtcacccagcctggagcgcagtggcacgatctcacctcactgcaccctccgcctcctgggttcaagtgattctcccgcctcagcctcctgagtacctggcactacaggtgtgcaccaccaagcccagctaatttttgtgtgtgtgtgtgtgtgtgtatttttagtaaagacagagttttgccatgttggccagcttgtcccaaactcctgacctcaagtgatctgcctacctcagcctctcaaagtgctgggattacaggcatgagccactgcgcctggcctaaactgattttcattctactagaattaatgttctcatataaagaattaagtagtcagctatatggaaaagtgaagctttcaaaaataacccattccctattgatctagccagcttcagatttataatagcaaacaggataccaaattataacgagaccacaaattcttatctgcagaatcctcatgtccatggagaggtaaacttaagtctcttcaaaatctgtaaatactattagctaattattctgaaactggttgctgatacattttaaggtttctcttaaagttaactcactttctaagattctaccactactggtgggggaaaaaaaagcagtttttttgttaacgtataatgtttccattaagtggaaattcaagggcaggcagatgctatctcttaagagttgagcattttgtattaaaattaaccagcatgatatttggcatctcactgggatgcaaaagggaacattatttgctgctgcgtgccattagtgccagaaacattttttcataaaatgaagagtgcagctccactaatctattagtcctaagccattttagatcataccattgattaactaaaatatttttttttcaaatgacggctgatgacagagcactaccttaaaagtcaaagaactataaattaaacatgaatccagttaccatgttctgtcaaaacaagaaatacatgcgtgtgtttgtgtcctttatatgggccaacataagcttttcctattatttctggaaatattcagatttattagcacacataaaatcctcagactgaaattattataacatttatttcaaactgaaaaaaataccaaaggagtaatctggggggcttggtgtctcatggtggactcctatttgcttttgccccttttcttctttgggtcttaccttccagcatgcttaaacttctagttatagaaacccatggcaacactcactgcccagaataactatgtttactcagataatgaaaagtggtgtgataaccttatctcctgggataattaggttatgtccaaaaagccaggctccttaaagatccttttcaatgatctccatgcttgatacagggcactgactttactacaaaaatatttaaaacactgtggcttttcatactttcacaactttttattttatgttcagctgctactcaaaaaactaactttgtgcagtattccaaccaatacatcatcacataaatacatcttttacacaagcaagtgcacttgaagaaattccagttgaaggcatacaagaacctccaaggttacccaggaaacctattctgacgagttatgtatatgtcaaaacacatgagtctacatcttcataaaactgtgtgactgagagtgcatcaggggttaagctacgtaaacaaacaaaaccagcaataatggcaacagaaatattcacaatattggaatcaaaagtaactatttgtgacatctaatgttgattggttatccataattttttaaagccttcatattaaaaacaacgaaagaaaaatacatgaaccaagtatactatgtaaaatggataaatgaaagcagagaaaagaaagcaagcaagaataaatatctactccaaaacccaactctaaaatgagatgcataggctctttaaatcacaaaatctgtgtggcttactaatggaaggatccttagagatcatcttgtccaatctaccttccaacgtggaaatttattatccatcatacctaataccaaactgacgcagtccagcagaaacactccggcctgagggtatgcactgattccattgttggacagctagctctatttgttacagcccaacttttgacggatgtgtaagacttgaagacattaagacccagaaatgactctatgattatactatgattataatgactatatgattatacctcattataattactacagcctccataaatatatgctactcaaagtgtaaaaagtcacatcaccagaagacaaacataatgtgaacccctatcccaaggataatttatctgccatatgcacaaaacccagtctcacgatattcgagtctgggtcctctctgagaaacagacatcaagatctgatgacatgtgcaagaaatttattgggtgagacacctgtgaaggaagcggggatggattctttggggagttgcgattgttttgtgtcttatgtgtggtggaggtaaaagaagttatgcctatgtaaaaacacatagaactgtgcaccaaaaaagttaatttaactatatgcaaatttttaaaattagaaaatatatatttaaaaatttggagggaggtgtaggaagctgagaagcatcagactgggatacagattcaactctgtgaaggaggcagtggcggcagtgggggcggggaaggaaggaaagaagggacgtagggaaggagggagagagggagagagggagacggggaaaggaaagaagattttaaatatgtgataacacatgatgttccaaaaggtgaagaaaaacaagccatctcacagattgctggaggcagtctacaatggtaaggctaccaagaaggacaagttggacagctctatcaaaattagaaaggcacaagccctctgatccagcaattctacttttaggtatttacatgacagaaatatgtagacatatgtaagatgatgtgtctataaaactactaattgcaagattgcttataacagctaaagctgaaaaaattcagctcagtgtcaataataggggacaagttaagttaaataccttgtgttccattcatttaagggaataccatacattcttgaaaaatactgatgctcatatgtactgatgtagagatatttccactgaatgaaacattgcaaaaatatgctatcatttgatcatctgtattaaaaagatatatatggttgtctatgcataaagtatgtctaaaaaagaagaaagcaacgatagcatcagatgcctcttaatataaaggaactggctgtttgggcaagagaagttggtgggaaatgtcccactgtaaatcctagtggaaaattttgaaatttgaatcatgtaaatatattacctgttttgaaaggtaagcagactctattttaatgaagatgaaaaagatcattctaaatgttaggtgaagaatacggttcattagggaataagtgtcaaggcaggaagacctcttcaggaatggtggtagcaaaacagggggtctccgtggggctgacagaccctgcatacatgctaaagatgcagccaacaggagttgatactgtaactagatataatggatcgggggaaggggactcaggctggactgacttttggcttgagtatccagataaacaatgttggcatctgttgagatgggtatgactgagttacaaacagcttagcaggtgtaagaagacaaaaacaagaattctgtttgggacacattaacgtagagatgtttgttagccttccgaatcaagagagtaacagtacatcggagtccataaacgtgcctactgagatcaacagtgcttttaatttgcggttcttcagctgcagtgagacggggcatgcttcttaggagtcctggtcattgtgatgtataacactgtgactatctgttcatcatgtttgctcatttgcctattgggcattttgttccttattatttgtaagtgctgttagcatattcaagaaaattggcccttttatcacttacattaaatggttttcttcagttcatcaattttacttttacattgtttatatcattttccctagaggaactctaaatttttatgtggtcatatttactagtttttctatggcctgtggcatatattcttttcataatcaggaaaaacaaagacaaatctcatcagtaattattaatgtgaatgtaaattctataacataaaaaatacattttatataatttcagaagttttgtagtacttacacaagtgttgagggcattcattcgtcacttttgtagttaacccactggaatatctttaataaagtaataggatttttctttattccttagaaaaattggatatttagggatattcttcaattcaaagctcatgatcaactaaggattctttagaggaatggtacgtattattttttacttacagcattaaaactcagctagagataacaattgtgtttgcatagcttatttttaaaacatgtgggcacagtgactttgtgcaattattttagaaaacaccaaagtagtatgagagacactgctattttttaaatgctactcagcacaactaatgacttataaaataggtaattatttcctttgaggtcagaagtagacttaaatgttacagcagaaagccaaaataaatgtgattggtttttctcaaaatagtaaattagcacttgactcccacctgcacactggtatttatcttcctctccacaactagtaactcaatttgatgcagtagcagggtactgggatgccacacgtggtttaactcaccaaggagacagctgctttgtactgacacccactacacttgtctttaccccaacaactgttcacattaatctgagttaactaccctttggagcaacctgttcaatctcagttagtcgcctactggagtgcacagacacaggtgattgagatttgagggaaccacagtcacactgacagaaatggaatctcacccactgcatcttcagtctggctggagaacctgaaggagctaaaggcttgttagaaaatcctaaagaaccataatcttctatcgcatatgcaaagcctgttttacgtcaaatgattgtcagtggctattaagttgcattcacacaaatcgctaacaaattaatatctgacattaagaggggtttatttcagtcttttgtttttcttaaattataaaatgaattgctcttttatttttgaaacgtgcatacactttaaaaatgaaagtgactcccctctccacccaaccccctcctaattccactctccaggggaaagtgctgttaatattttggtgtacaactttgcaggctcttaaagctgcattactactcatacatatgtatatgtacgtatgtatgaatatgtatgattgatatatatgatgcacatatcaatctagcctgctgtttaagcaaaaatggtatcatacaaaaagttctacaattccatttgtactcaataatgcacaaaactccttccgttaaaggaactacagttctaccacatttttttcttttggtgtcatggtgtaccacaccacgtgcatatcagaatttatgtaaacattctcccttggggggccattccagttgtctctgtttttcataattaacaataatgcatctgtgaatatgtaccaccatacacttgctcatctatttgtgagagaccgaatatgagaagtgaagtttctgggtcagagaacatgtccacttgcatttctgataggtattatcaaatgccttttcaaatggtggttgttttacttgacattctaccaacaagaaagactattttataaggctgcatattcaaaagttattttaaaagcctcattacatgtaagacaccatatggagcatgtcacaagataaacacatcagtactctcatataaaagtagattttggccaggcgtggtggctcatgcctgtaataccagcatattgggaggccgaggtgggtggatcacctgaggtcaggagttcaagaccagcctgaccaacatggtgaaatcccatctctactaaaaacacaaaaattagccgggcgtggtagtgcatacctgtaatcacagctactcgggaggctgaggcaggagaatcatttgaacctaggaggcagaggttgcagtgagccaagatcgcaccattgcactccagcctgggcaatagagtgagactctagtctcaaaaaaaaagaaaagaaaagtagattttaaggaaaaaaacgcataatcacctactaagaaggtctagaaagtgtgattaactctttaaaatctaataagatatgaactctacctccttgaccacccagtgtctaaagggttattcctggggtcagctttgcagaaagtgcttccttatggagtggttgttagttgactttgccagacagcctctgcgttttcattctctaacggaggctggcaagactttgtatagagatagaaacaccaattctagtttgttccttgagaaggaaggccaagtgactggttttctgaggctgtgtgtatctcccaggcacaagcctctgtccccaggagagcctgcacgcgtggcaggacacatttgtggtggggctttttacgctccctgtcatcactttttatgattttctcagtaattccttttctttactgaggaaatgaacacacataaaactggaaaaacgagcaaagaattacataaaatctacacaaggacttcctggcaaaaagcttcactaacataatagatttaagttcttacaatcagtggttcccaggcctttgaatttcatggaccagaattttttttttaagtgaagaattcaacatagaaacaactattatttgttctttaaaaacatttttgaaaacctcactcaaacaaataacctagcaaaactgttttataaaataacgcctggctgggtatgaggactcatgcctctaatcccaacactttgggaggccaaggtgggaggatcacttgaggccaagagttccagaccagcctgtgcaacaaagtgcgacccccatctctactttcaaaaaataataaaattaaattaaaataatgggtattttaacaccaaaaagaagagttttgcctagacagcctcccagacataagaacagacactacatccaccatttccctttttttttttttttttttttttttggcggagggttaaacactcactaatatttaggaattagtcctctgcaatttttcacttgtcctgataaaatccagattttacaaagtttaaacaccacaaaaatcacagggctgtctatagaaggaagaattcctgttactcttagctgaatattcccaataattctttgactttctttctttgtcttatcaaaccaatgagaatctccaggcatgcatgttttaggtcaaattaaggaaacgcccctatgcctgatcctatttggaatttccatttttactcatgtatgtcccacgacaataaaattattgaaaagcaagtgccaccagtgtggatgcatggtctccacaaatccactcttcactgaggagatttccccacatccactaaggtgtgggtcgcctccagctgcagcgccatacctcatgagatcagcagagctcaggctgaatagcattcctcctttcctcctctctactcacacttcctcagaggctatccagcatgataatgaagaacacaggtggtggggtcagacagccactgactacctctgtcactctggatgggtgaccgtcctctctgagtatcacttcctcctctgtaaatgagaacaatactgctcactgcatagggctgcttgtgtgagaacagcacgagcaggcccacatggtgttggaaaaggccccgacgcatagcaagggacaaatagtgctggtgattgacactagcccctgccaggctcttgggcattaggaatccatagtcaagcaatgaaagggtcctgccctcatggagtttacactctagcaggaaagacaaatatttaataatcatgcaaactgaaattagaactctgataggtgatactaagaagggggtaaaggtgttcctgaagcctggggtctgggtctgtctgtggagatccaggataagccaccactcctgaaactttaaagatgagtaggagttaacaatttggcacagggagaaaggagcaggggtccagggagaaggagctcacccttccttccttccttccttcctcttcctttttcctaaattgtaaatgtcacctactctaaataaggcagtgtcttaaagaacaacctaataatctatgtactggtataaaccttaaacaaagttcaaatttactccaatgcacaaaaattcagttaatctctatgaaacaatcaaggatggcattatattctagaattcttctgctggccctcctccaaagcgacatatgaaaagctgaagcagcatacatttagcttgtttcacagaagaatacttatcttctaagtgcacaaagtaaaacattagaaagggattcagtacagaatattaaaactctgtatttttcaactgcctgcactgaggaaagatagaaaatctatcccacaaaaaagtatgagtttggaccagtttgtttaaatttaacaaaacaaagttcatcatggctgatgaatcaatctttgttttgagtccctatttttacgcaaaaccgcactttgcccgacagcatgagctacttgtgaaataaacacttcaagcctcaaatttcaaaggagttataagtatgttgggggcagcaatgcaggaataactttcccaccccctggtcactatcaacttggagaaaaattatttccaatttgccttctactttgtacccttgtggtgtctcagatttcacagtccctgaaggatgtgctgtccgtgcactcacaaacaccccactctggccatctccactttgctacagatcacagtctctttgcttccagtaacttttctctatgttccagggtcacaacccctcctcattatccccaatttccttggggtaaatttctaagaagtgtctttataccttaaatccttgtttctttttaaagcaagaaaatgctggcatgaggtcagatgcaaatcactttgcatcctcaaagcaactaaatattgtcccattgtagagatgggatgtccttaccatagtgacagtgacagcatactctctcatggctccctgcagagtccttggaagcgatgtgacaggttttcataaagagggaagagaaaaggacttaaaacactgcctgcaggagcctctacacccttattactttctgggttattgcctcatgaggaaaaagaaattcaatcatttgtcggggggaaaaagtgtgctttttcttttcaaagtctacccttttatgaaatatttaagcaaacatttatttacttctaaaccaccaggaaaagaaagaaaagcaaccaacatttaacttcacagaagaaataaacatttcactaactgttatacctttaaatttgttttgatatacagaagatcatgaatacagtcatctatattttcctagtcagtgcaacaaaaaataacactcactaatagatcagaaaatggagatgacaacacttaattccagaatccaggaattttttcccatagtttcctgtaatccctttaagactctaaacaaagtattctaccttttttctttaagaaaacaaaacgaatttcatgcttatttgatatttctaataaatgattttaataatagactaagccaaaaaggaagctggtctatattcattaagaaaaatgcaaccataatcacatttcgtgaatggacaactttcacatatccacactctcaatgcctacaaagtttaaatggaaagatggatcgttcaggaaaagcgttgagagcagcatccagacctcagcactgccctcacactgagcccttcaaaaggacggcacgaggggccaggtgcagtggctcatgcctgtaatcccagcactttgggaagccaaggagggtggatcacttgaggccagaagctcgaggccaccctggccaacatggcaaaacctggtgtctactaaaaatacaaaaattagctgggcgtggaggctgaagcaggagaatcgcttgaacccaggaggcgggggttgtggtgatctcagatcgcagcactgcactccagcctgggtgacaagagtgaaactctgtctcagaaaaaaaaaaaaaaattagccaggtctggtgacacatgcctgtagtcccagctgctagggaggctgaggcacacgattcatttgaacccaggagatggaggctgcagtgagctgagattgcaccactgcactccagcctgggcaacagaatgagactctggctcaaaaaaaaaaaaaaaaaccaaccaaccaaggatggcaccagggaccactttgtagggtgtaaacaacaaattgctcagcataagaaccattttgaaaacacaatgaaggaaaacctgagatcaccatgcttcactgggtctccagggcccagacagaggtgacgcaccaggtgtgcgtgacgacgtcaccctacaacctttagtccaccttcatgctccagccactgcctgcagctgcgcccagacagcacctgactgcagttgccgtgcctcactcactttccgccttcatatgcctcatacactgccagctcgtgggacgcccatggagactgacttagccatccggctcatacacaagcctgggggagcaaggcagctggctcagggggtcaggcttgactagggagaaccagtcttttgggcagatgcctttgaggcccattcgtcacagctccttggaaggtctgcagcagggtccacaccgggtagcttgttgaggtgaccagccgcacaatcagggacttccgggcatggctccatgtcttgataacatgccagtggctagaacactcctgagcaaaagtatcctgtcagcagatcacgtgttccctgagaaataaactgctgctgagaagctactattaataacagatggcggacagtttgctgtgatacctggactgagtacctcggtgcctctgctgtctctgggccatctggatttctaggtgtgactgtggcagacgtgtctcgggtgcagaggaaatggaaacaagatggtcctgcttctgaactcggcctcatgccctcatgccccaagtctgaagttcttttggtctcctcttctgtacttctggaagcttccactagtctcttaccatgctcacatgaactaaaagccagatgcctaaatgactaacatgataaaagattggcctgtaaggccacagtgacaaatgtcacctgaaagacgaaggggaaataatttgcattgaagggtgcgcttgcttatcctcaccccttggctcatccaagtagcagaagagtttgggttgcatgaagcttccaaccattcaatgcaggctgagctccacagcagtgcctaggggagcacagctcagattgtgctgagagccacctctcttgtctcacaggtcccatccctgggctgaggctctttatcgaggaaagaaagaaatgtcctgtctggcctcacacacctgaaagtcgagaagcagaagaatggccgggtgcagtggctcacacttgtaattccagcactttgggaggccgaggcaggtggattgcctgaggtcaggaggtccagaccagcctggcatggccaacatggtgaaaccccctctctactaaaaaatacaaaaattagccaggtgtggggccgggcgcggtggctcacgcctgtaatcccagcactttgggaggccaaggtgggtggatcaggaggtcaggagatccagaccatactgactaacacagtgaaactctgtctctactaaaaaatacaaaaaaattagccaggtgtggtgacacatgcctgtagtcccagctacccaggaggctaaggcaggagaattgcttgaacccgggaggcggaggttgtagtgagctgagatcccgccactgcactccagcctgggcaacagagcgagactttgtctcaaacaaaaaaaaaaaaaaaaaaaaagaagcagaagaacatgtctcatgcacacttgtgcttcctgccccctcccacacccaagggaggaggatggtgctcatgcagaagacatgtaatctcttcttccagagttttttgttttataccagcctatctcttacttcccttgttcggccagcaggataaaaatcaatggacatttctatcgccaacctgctgcagctgcttctcagaaccaccatccctttatgtagaggaagagagaggcaatttaaaatggaaaagggagaactgcgaagaggaaggaccaaaggtgacttctccctttatccttcctgaaggccaaaggttggagacagtaaaaggaaactttgctgggtttgtagaggcaaagagggatattatggacttgaaagaacttttcagatgcggttggttacaagaatgaaaatcaggcagcaatgagccaaggacactcagcaatgccatcagcagtacttaattccacaaatagagttatcaggtgactataaggtactcagagaaaaggttcatattttagatataaaaagatttatctcttgggtctaagaaactacatatttcaaagagaagaataatcagcttataactaagaagacagactcaagaaatatgagcagtgaagaagataaatggggaatactgaaagttttttgaatttgcatatttaagctggtgataagaaaataagaattgtgttatttcatcctttgacgaaagcgtccatgcatgaccactccttccataaggaagccctggtacacacagagcctagattatccactgataaccccacaccatctcaacgaagctaaataaagatggagaagaaggggctttccacctctcaccagctggcctcatccagtgtcttcaggaaaaccagcctcctaggctttgactggacttccccatttgtgagatgagggagaaaactcaatgacctctatatcctcttcccactctgcaatgtggtgactgaatcgcatgatggatgattacatggcctttacccaatcccctccttactgttactgtccatctatttcgtctttcctgcctcattgtggagatgctgcaatgtgccactgtggctgtctggactacatttcccagaatcccattctctccatgtctcccattgtggtgcactataaataagagaggttcttaggtgggatctggaagatgggctgaagcagccacccttcattctgcagcttacacaggctgttgtcatctacagcctgggcgttggcatcaggcaacagctgggcctgcagctgtgctgtgtcccctggcctttcctcaacatctctgacccagggccaggtgtgcttgtttagcaccctggtggggaaccctggcttctgcaagaccccagtaagcccagaggcaacaacagtgacacaagttccagcatcagggttgagattttcttgctctcccccacttcatatcaaccttctcttctccagagcctgccatgtggacttcaagctccagcatccaatgtgagacaacagccttataaacactgcttgatcagccctcacaattgcagaaggtcaaatccctataacaaagctgcttgtatatatgatcagacatatgtgggttggaaccttgaataaacctcttaaatggggattgtaattgtgaagatctcataggatcactgggtggtttaagggagatagtgaatgtaaagttggcatggaatgcacagtaaatactgtgttattattaactaaaaatcccagttaccctgctgagaaaatctctctcattttttcatagctgtagaatcaagcgaagtaggcattttgcctatgtcgtaccagggactaagctaacagaaccctggctccactctaaacctaagagaatctaatcctatttttattagagaccagaacatagtagctaacaagtacttaacctctccctccaaggaaatgatggcgaagccaaaaagaacgataccaaactggaaaccattgatttcagtaagatatttcactgtcactgaaggaaaacatcattttaatggtggagtttgatatccacattaaaagacagttaatcgagagacatcatacaatagagctatttgggtagagtacttggtgaactgaaagcctaatacataaattttcctctttcagctcttactaatgaaaaaagttattcaaagaagtatttgagatggacttaaatatcaaaaccatacttcttacttttttaaactacttaatacatatcgtgttccaaaaagatctaagtatacaaaattagagtttttctcatcagagaattaaatttaagtccatcaagaaacctcaggctttctgatctgtacagcactttttggtctttttatttcagtctcaaatattttgaaatggtattaagttgtgtccaaatgacacagtgggccagtggctgggggagggaggtgagacctgaatgccaagagcttggggaaccattgtttcccactctattctgatgtccaagctgacacccacagcccactgactgtctcacctccagtgtgccgtgtgagccacctggcacacacacacttcaaagccagatctcagtgtgatacctaaagagcaaacgtcatcttggtcctcagagccatgagcccttgcagattctctgccagtgtcatctttctttctcactgtcactcaattttaaaacactgccgccaagtgttgttcatctttccctgatggcactcagcaccatcaccgacgtccacaggtgcttccagacacatctccactgtgcctccagcctcctcaccaggttctcaccatcccacacctggacagcctgtgacacagccggtccggggtcaccaactcctgccccctttccatacattcattcacatatgatctagtcccctcccacatacacttcactatactatctttcactatataaacctttaatgtggccaggtgcggtggctcacagcactttggaaggccaaggtgggtggatcacttgaggtcaggagtttgagaccagcctggccaacatggtgaaaccctgtctctattaaaaatacaaaaatagtcaggcatggtggcgagcacctgtaatcccagctactcaggaggctgaggcaggaaaacagcttgaaccccaaaggtggatgttgcagtgagccaagatcacataattgcattccaacctgggcaatagagcgagactcagtctcgggggaaaaaaaagaaagaaaaaaacagtatagattaaaatgattgattgtagagaattctgctggtagaaaagtaaatttatacttgcatgagtaacttctacattctttgtaatggattttacataataggagcaggtattttgtgacagtaataggcccactcaagcagctggatatacagctaactctttatcactgttagggctgaaatgaaacttggtttacttcttacatggaaaaaaagtccttttcccaaatatcaaatatataaacttagattcatttagaaaagttgactcctcagtagataataaatgtctcagatgaaacaaatctctctctctctccttaaacacatacagaataggaaaggcttatacacatgcgtgcaaattctggctcctcgcaatgatcctgagtgtgttattttccatttaagccttggtttttctccttctaaaaatggaagcaatgatatctatgtgacaaagctgtagagaagattaaattagacataataagtgcctagcagaaaagagacactttagacgcaattgataaattgtagccataattatgtatatgaaatacttgtaactataagcccattttccatgttgtttattccttcaaggctacacttgtatttgaatgtctatctgccactgtcctggtttacagcaaaatcaccttataatgaagaaagaggctgccatgtttcgaaacctcctttaggtggaatccaatgggaaataacttataaatacatatttttattgtatatgtaacagtatatttttagatttatcttagtgatgttgtaatggctaattgtataaattctgaatcagcctcacttttccttttaactcagttcatatatcaactcttcagccaatggaaatctcctttatagggtgtggcataaccattaacctccctttgtgccccatgtaatttgactataataaatttcactatactgtcactgctttgtgcatagtagatgctcagtgaatattcagtgaatttaaacttggcaagtagtcaaagagaaagaaattattttaagtaactaaacttaacaaaacacctaactacgcttccggaaataggtaaaagaactaaagattacataaagtatcaggtgttagaagtctagaaaaacataattctccaaattgtgattgtcaaaatgtgagcccagagataaattcccatgcctttgcatatgagcaaattggctctacaatttttacaaaagaactatggctctgcactgttggactcaaacgccctttgtgctgcattttcattaattcaaaacacttagaatcattttgcagagcagctcattttgtgcagcagagggaggccatgaattatctgttgtgcctgaataaagctctgcaatgttgagccgtgtctttgctgagtctaggcgcctccacttcttacatgccatgcgaatgacacagtttgaaaaacacaaccaaatgtacacagtattccatcttctacgaaaagcataaggggggaggaggaaaagaggttggttaatggaagtgagtatagatagaaggaatatgttctagttttcaatagcacagcagaattcctatagttaacaatcatttattgtatatttcaaaatagctagaagatttgaaatgttcccaacacaaagaaattataaatgtttgaagtggtggatattctaaatgccctgatttggtcattacatgttgtatgcatgtaacaaaatatcacatgtacccataaataagtacaattgttatatgtctatttaaaaaaggaaaaaaacaccatttaaatagaaaacaacataaaaagaatgtatacatcctttacattgatgagatctctaaaccagttgtgttcagttccacctttgaaccctcagaacaagggatttgtgcttattgctacttacttgactctacctggtgttcagtctattgtgtacaagtctcctgtacatcttatccttatacccaactctataaattgtaagctccctgaagaacggagctttgtcctgtccttcctgacacaggcaacactcaacatttgatgtctatctagtctacgtaactatctcttccagcagaatcattttttttctttctttccttttttttttttttttttttttgagatggagtttctttcctttttctttttttttttttttttttttttgagatggagtttcgctcttgttgcccaggctggagtgcaatggtgcgatctcggttgactgcaacctctgcctcctgggttcaagcgattgtcctgcctcagcctcctgagtagctgggattacaggtgtgcaccaccacgcctggctaattttgtatttttagtagagatggggtttctccatgttggtcaggcttctttttagaacagtccataaactgccgcctttaagtgactgaatcctggaaataagtgtcaaaaaacctaatgtgtatccatgaaagtattacagtaaataacatgtaataatgtgtatatgagaaagaaattgtattattctgtaaggtaaaatgaggtttatgagaattggacagtagccgttaactgctgttttattatttatccttcatgtataggcaagatgctactgaaaatgatcattgtctaggtatgactgaaaaaacaagcatgttcattcattcgtttgctcatccatttattaaacaaatattttaatcatttcagcaacatgtttgtgttgctgccaaagagaaattagattctaacatgttcaacttaaaaagacttcagtggctccctgttgtctctgggagtaagtccaggtcttctgcgggatacgtaagttctttcctgatctggcctctccctgtttccctgtcttatctctcatcacgcccctacttccaccctttattgttactgtcttgtttcacaccctccatgcctctgtaaatcttgtctctgcaaggaatagttttcttctctctcctaactcctatatgaccttaaagacttacctgaggcaactctgtgccctggtaaatctttcatattattcaaatctagagcagctgttcctcctctaggtacccacagcatcctgggctttcctttgtcatagcatttgtcacacctcttcaaatctgtttctttatctctcttgtccactagactcttgcaggccgtatgatactcttatctgcatgcccagtgcctagcatggtacccagcaaattgtaggcaaccaatacatatttactgacgactgaataaatgtggagactggggcaactatgacaaagagaacagacaattaactggaattcaggagacccggacactgtcttcaaaggttgaaagacttttggaaaattaatctttttgtgcaactcctggcattagctaaggtggttgtccaaagcattccttagctctgtggctacctgacattttctaaaagtgacaaagttctaatgtgtctctagccgagaggaacagttacagttggcacttaaaaacattatttgtttgcttagggagacattctgtatcttaatttcagactacttatgacaggtctctgatacaatgtatggagtgtcaaatatatcatcttttctaggttttaataaaaagaaaaccttaccaaaaaaaaggttgccttgacaatatatctatagacaatatctgaattaataaactgaccatttattttcttttctagttaaggatgccatctagaacaaggacttggtcatgacaattggaaagccatccaatggttcatggctcatggcactcatattagcaaaggtgggttcctgtcatccctaccctgcccttctcagctcaggtgcacatctcctcccatcacaccaaacagccacaaacagcctttctcttttcttctttttttttttttttttggtgacagagtttcactctgttacccaggctggagtgcagtgcatgatatcggctcactgcaacctccacctcctgggttcaagcgattcttgtgcctcagcctcctgagtagctgggatcacaggcgcccgccaccacgcccagctaattttttgtatttttagtagagacggtgttttacatgttggccaggctggtcttgaactcccgacctcaggtgatccacccgcctcagactcctaaagtgctgggattacaggcgtgagccactgcgcccggcccaaacagccattcttactgcacgtctatatggtggagttaactccatttctcaggaagacggacggaatgagtattctcaacagataacagattttcataggctgtgaaaccttagtaatttgaacaatagaagaatgacctaagtcagtagagtctcttttcttacaatggcttaagtgctttcagacacaaagaactaaataaggcatgctaacaaatagattggctggtgaatccttatctttttcttaatgaatacacaatatgtaattgatatgctatctgtatataacttgaatgtattgaaagaagggccttaaatgtacctcaaaaactatgtttctctaggtatatttaatattatttcttaaatactattaattttattacttacataataaagatgttttaggttgggtgcagtggttcatgcctgtaatcccaacactttgggaggctgaggcagaaggactgcttgaggccgggagtttgagaacagcttgggcaatatagccagaccccatccttacaaaaaatttgaaaaactagccaggcatggtgttgaatgcctgtagtaccaacaactcagggaggttgtggcgagacgattgcttgaatccaggagttcaaactatgatcacacctctgtagtccagcctgggcaacacggcaagactctatctctaataataatagtaataaaaggtgttttaatatccctcctcccccaagctccaaaagataaattctaaactagtggagtttggatcagtgagggttgatggggaaaaatgtaaatatagcagtcttttcacttcaggccaggcctcgtgaaatccatatctttaaacttcattatgtttctaaatcccttttttcctttttttttttttgagacacagtttaactctgtcacccaggctggagtgctgtggtgtaatctcggctcactgcagcctccacctccctggttcaagcaattctagtgcctcagcctcccgaatatctgggattacaggcatgtgccaccacgcctggttaattttttttttttttttttattagtagagacgaggtttcaccacattggccaggctggtttcaaactcctgacctcaagtgatccgccctccttggcctcccaaagtgctgggattacaggtgtgagccaccgcgcccggccatgctcctaaaactctaacctgtgactctggaatatgtttacaaggaagctcaagattgaggacactgcaggccatctcaaaatgatgtcagagggcagaaccaacgcttacattaatagaattgctggggcactagttgccttgccggagtggcacccttgaagataagaaacaaaatgacagctcgcaccaagtattcacccttaggccacacagataaatgtgcagcaaacctcttcaggctccacttgtctggagaaggagacacatgatatattgatgtaatgtgggaaaaagacgaattaagtaattttaaaaattattttaataggtcatctatctagaaagaatggcaaagaggaagaccagggtgggtgggcaaaatgcaccattttgtttgttaagcaacatcttaaaaggtgcagttaaaatatatgtacacttcctcaaattaagcaaacatcatcattaggatatttcagatactgaaactgatgagaggcatcccacgcccctcttttttgagacaaggtctcttctgttgcccaagctggagtccagtggtgcgatcatgtctcactgcaaccttgaccttttgggctcaagcgaccctcctgtctcaacctctgaagtagctgagaccagaggtgtgcaccaccacacacagctactttttacattttttgtaaagatgaggtctcactatcttgcccaggctggtctgaaactcctgggctcaggccatttccccaacgcctcccaaaatgctgggattacagctgtgagccaccttgcctggctgaacagtacctcctgagatgaagcaaggtgtgggcaggcttcactaaagggcagcattacaacagggaaatagtcatgcgatatgtctaaagcaaattatcatgcctaataatatttctttcagttgaataattacaattcattatggctcatttcttatcattaatattttcatttaaaattataaatgagatgatcacataaaatgaaaaactgactttaaagttaaaataacacacgcttttcctcaggaaaagcgtgatcccagcattttatagaattggaaaatatttgggtgatgatcaaatccaatatcctcatttcacaaatacataagatactcaagagtctaaatgatatttcaattttatccaactagtttggaataaatccagcagaaccagtgtctctggatccccaacccagtgtttccagaacaatattctgtgttacataattttatatttatttggcaaactacattttaaagttaaaggatctaaatatagaaatagtttcgtatattatctttcttaatattaaaataaaatagaatatcttgtattgtatttggtggactgtttttgaagcatcaaatttatgtattaataactatggatcatgtattattattcctcaatggcgaatttggcaccctacagaaaatagtcttcatttctttttttttttttttttttttttgttggccggggggtgtttttttagacagagtcttgctctgtcacccaggctggagtgcaatggcatgatctcggctcactgcaacctctgcctcccgggttcaagcaattctcccgcctcagcctcctgagtaggtgggattacaggcgcccaccactatgcctggctaatttttggtattttgagtagagacggggtttcgccatgttgggcaggctggtcatcaacccccgacctcaggagatcttcctgcctcagcctcccagagtgccgggattacaggcatgagccaccgtgcctggcctatgttccttcctttcaaagaaacattcatatttgaatgacttgactacatagaaaccttgaagaaaattccaaaatgtaggaaaattacaggccatgataacataatttaaaacataatctaataaaagtataaccaagcaataggaagatagtttagtatttaaaccatttgaatataaaagccttttaacctttggtcaacagagaaaatccaattatatttaccattatctaaacgtaaattaagtgggaaaatacctacaatgtgaatgttgatacagctgaactcggaggatccgaacagctttcagatattgaaaggagagaagacataacctaaacttacccaatgtgggtaaacaggagggtgatggggcaagtgaagaaggacaaggctggaacatcatgctaattctaagtcagattacaaagtgtttcaatgccgtgcaaaagaaatctgaattatttttagatgacaaaaagagcacatcagaattttttaagaagcagagaaggacttcttggcaacacagctgactgaattgagaagggctcttcttcctgctccaggcagaactactggaaagagagacagagaggacacagagagagagagagagatcacaaaggcagagaggaaggcaggctgacgggaaactccaggggttggaaaggcagagggaaggccaacccggagtggtgagaacaccagctgactccgcatcagcctagggtcctggtcccagaccctgctgtcaaggctgaaggatggagctgagcatacttgctaatacgagacacgtgttttagggcctgcaagaggcagaaagctagatctgagaatctgtgcataagccatgaccctggaagacacacttggaaaaggggtttacaaaacttcacccaaataagtggcaatgaagcccagggctctgggaggataaaaacacacaaaaaatgttataataaaagtagtaactaaaacagtgacatactggcatagggaacagataatagatcaatggactggaatagaagccctacatagatatgacatcttggtgtacgacagatacagcattctgtattagtagggaaggatagagtcctatataaatgagacctaaatgtgaaaagcaaagtgttaacatttaagagagaaatataggagaatgctttgtaacattagtataggaaggctttattttaaaagttcatgaaaaaaagaactgatacatttgtccccactctatttaaagcatctgcacgtttagacaaactataacccaagtgaagacaagccacaaactggaagaagacaccactgataaaagattagtatccaaaatgagtaagaaaactgtagaaatcaatatgaaaattcaaaaaaaggcccaagggaaaaattgaggaaagacagaactaggcagggcacagaggaggtaacctgaagaaccactggccgtaaggaagatgctccacctcagcatgaatcagggaacgctgaggaacatggcaaggctgccccatcttatagccattttattgtggaaaaatctaagattccgaagatactaagggagaggaaaatgcagagcaatgagcacttccataaactgccagtggccacgtaggagtttatttgtatgaccagatagagagaaatgtgtaaagagctactaaggtttagtattcacatttcactggacctagcaacttcgtacctatgttctaggggcactattttcatatgttcaagtaaacacgtacaaggatttttaatgcagccttatttgtaattgcaaaaaatttggcaacatacaaaatgtttatcaacaggacaatgattacatgcattgtggtagtgtcataaaaaggcatggcatgcccctattaaaataagcatactagagcaatttttctcaaaatgttgttcaggaatagcagaatcagcatcacctggaaacgtattaaaatgtaaattcgcagaccccactcaagagctactgaatccgaaatgctggcagtgggacgcagcaatccgtgttttaacaagctcccttcccccatgtcaggttgagagcagttatactggatttacctgtgtccacatggataagcttcaaaaccaaaatctgagccacaaaagcaactatacaatacaattaacataaatcttaagaccataagtaatatatggacagaaaggatatatgccaactttaggagggatgaaggggtaatagaaatagaagggagaggatttcaaatgtacccataatatgtgatttacttgacaaaatgatatgaagcagatctggaaaactgtgagtatttgtcacatcagcgtgataagtatagaggtgtctgctagattattctctgcatttttcagttagttttgaatatttcacaagcatactggcacagccaagtcagtgtttctgtaggataaccacattgtaagggaaggtgtaaggcaggagagatgggaggcaggggcaacaagttcctatattgcttcagttacccagcaaaggaagggagctttaactgaggtctcagttttctaggacttgatcctccatttggtgctgggagtgaagaaaaggggcagccaaagaagattccaaaatgtgcagctatatggaatgaaatctgaatctgagaagaaaatgtatgtcctcattcaatagttggtatttgataatagagacagcaaatggtggtaaggcaagatgaaaatatcactgacaacagaacccttgggaaaataaagaggaagcaaaaaaaaaaaaaaaaaaaaaaggaatgcctttagaggtaggaagaaaaaaggaagcaaaagaatttctactgaagtcaagagagttttacaatggaaaggatcatgtggtagagaaatgtctagcaagctaaagactgagaagagacatgtgatactaggaagagaatttgattattacagtcctccctccagccccctgaaatgcttattttataagagatcttggagaaagtctatttcattatttgaaagattaaatgtgcgatatggaattggcaacagcaaatatggacttaccttctaagatgttctgagacaaaacataaacacaggggcagtaactggtgattaaagtttaggaagaggtgggataaaaatggaatcatgatcccgggtgaaagggtcagctttgggaaagatgaggaattcttgcttcgggagaagaggtaaggaggagatatcaatacagtgggaagagatgacgagatgagtttaggaaagttcaaggagcaaatagctccatccagcaccagcttggaggcaagagcacatcacaggtgccttcatgcccttaagcgcatcacagtggacttaaggggccgaggagaagagacaaggttggcactggagaatggaaaatggggtttgctaagaaaaggtcaaagaatcaccatcccatattttgaggaaattagggacaaaaatattttatataatgagtgagcatagttatttcaagtagcctgatggcagaacaggagagggtaaaaaagacctgggttcttctgaaagtgaagaatgagaaggcaagcactccaatatttgcattatctcaacatacaatgatctggaagatatgctagagccacctccaaaatatactgaatttccatccattcctctttcccctctagttcttcatgctatgatttctcacccagaacaagacagtagcagtaactattctcatttccactatgctggctccctaagactcattctccctagaagccagagtaacttctttgaaacgcaaatcgtatgatttcactcctatgcttaaaaccatccaatggcttctcactgtcctagaatgaaatccaaagatggaccctgggaagcagaaaagatgacaatcaagagttcttcctgtctctcaaaaaaagaaaagaaaaaaaattatatatatatacgcatattccttaaggttaaaaatacccagttcgctccttttgccagcaccatattgacagcctcaaattctattcaatgattttgaagaataaatgtttttataaaacttaagtaacaaaaagatctactacacaaattaaatcactgttaagtgtgaactaggtaaattaactgataggaacacatttacaaggtatgtataggatttatgaaagcctatactctacttttcctctaaaagactgatttttaattatattatttgagtgatcatttgatctatgtctgtctcccctgttggagtgtgagcttcaacaagacgaagatcacctctatctactttattcacaggattatccttggcattctgcacagatccgacatgctgtaggggctcagtcaatactggatggattaccgaataaatgttagttaaattactgaatactcaacgaagtagaacagaaaaggcttgggcagagtcccaggcaggatgaaggactgcagtccaaactctatgattaagaaagtatgagacttgctatattagtcaattttcatgctgctgataaagatatacccaagactgggcaatttacaaaagaaagtggtttaattggacttaacagttccacatggctgggaaagcctcagaatcatggcaggaggcaaaaggcacttcttacatggcagcggcaagagaaaatgaggaagatgcaaaagcggaaatccctgataaacccattagacctcctgagacttactcactactgtgagaacagtatgggggaaactgcccccatgattcaaattatctcccaccaggtccctcccacaacacatgggaattacaggagtacaaatcaagatgagatttgggtgggcacacagagccaaacaatatcacttgcttatgtcacattatctttctaagccttatttatcttgtttagcaaatgacataacatgatctgcaaaagcaaatgaaaacgctgtagtgtcccattatcataagctgtgatgactaacaattacatggaacttagagtcaatttgttttctgacacactaaaagtcctcagggttgaagaaagcaacagcatctgccatttcattttctgagaggcatcccacataaagcaaacaatgtcagtcacctgccatctctctaaagacccagtgtttgtaagccatgaggccccagggttaggggctctctttaaggcctctcagactctttaaggactttcaagcctaagcatttttacccagcagcatctcagaagcctctatctaatactagaaataagacagaagctatataagcccgggaggttgaggctgcagtgagccgtgattgcaccacttcactccagcctgggtgacacagcaagaccctgtctcaaaaaacaaaaaacaaaaaacaaacaaaaaacaaacaaaataaaggaagataaagtttctttacaaaaagaggcagagaagacttcatagagatatttgctattcaagtgagaatgctcagatcttctcatgagcacaaatccattatcaaaataactaagaatctaagaatgaggaaacaccactgacctcagtgacaagtcattaaacttcaaataaatactcatgatgctttgcagatatcattgttgtggccaataacaaataaaatttaacccagcagctttaatgtcacagcccttctattttttaagtgggtatttctacaaacatatccattaaaccccgagtttgcctcaaaattttaaaacacaattttaaaacatttactaccatcactgagttgttcctttccaacctggtatccattagggacccttttgtttggtttggcacagacagcccattctatacatactgattaagattttactataagaacatttcttacaggcaatccagtatatatgaccaaatttgtatattttatgttgccatattccctgaatatttaaatgaaaagcctcaacaaaaagaggatttgaaaaaatgtcaatatgctaaatttagctgatcttaaaaacaagcctatcttagaacattctctcaggtaaatcatgcataattcatagatttttcccaaaacattatatacacatccatgcatctcaaatcattaaaaaataaattagtttgaaagtgacaatagtcaaataccatcctgggatagaaaagttacagagatagcaaatgtcttacattacaaaggatgtacctttgctatccccagagcagtattttacgcagacactgctgtataaaaaagtcattagttgttttattacatcgttctgtttatttatttttaataaaaatggtgtaaatcattaaattattctgaatttgaaaggcaattcccactcctgctggaagctagctgaggactggatggccctgctgttcctgcttgcgtgaactatccctcctggtgaattatacaactagttaatatacaaaagaaaataggcaactcccatttggcatgtcattcttttatgcccgagagctcacttcacatgcaacaaatctccacagcagtactgaaagggcctaatgaaggaacacagtgatttaggtcagcccagaaaggctttgctttcttcagtgaagagtgtcttgacagaaagcattttctccgatgtaacattacagcttggaatctgccaaaacaacagtcggcacccaacaccgacacctctacgttcactaaatagacgtttttatttacttaatccaaaaccagagtggtccaaagcagttagataaagttgagtattttcctcttttgcaattgtaattgaaattctgttggttgaataaaaactggaacttgcctttctgaggaatgaattcatgccacagaacttgttcagaatttggaatgcattttccatatgatgatggcaggtgctttctcacgtgtgagagggcgacactcctaggtaagtctggccacgatcaaatctctgtattttcttggcatgcagcccttgtttagtggcctccttggccagctgcaccgaggaagcagggactgctctctggggagcagggtgaagacatccagctctgagccctccagggcctatttataatagaaaaacagcctctgttcccttttcaatgcaaagtactttctcatatcaccttaaaacttatttatactgcaggtcatgcacaatggctcacacctgtaatcccagcactttgggaggccgggcgagcagatcacttgaggtcaagagttcaagaccagcctgtccaacgtagtgaaaccctgtatctactaaaaatgcaaaaaattagccaggtgtggtggtatgcgcctgtaattccagctactcgggaggctgaggcaggagaatcgcttgatcccagaaagcagaggttgcggtgagccgagattgtgccactgcactccaccctgggcaatagagcgagactcagtctcaaaaacaaacaaacaaataaaaaaacaaaacatatatacatatatatatatacccactgaacaataaaattttcctacatttgggaagaaaagtaggtttcataaaggaaattttaatgaaacaaccatttataaagaccaatagcatactgttttccactaatattttttcatgattgagatcttaaagtttttctatagaaaataacccagtaattttacattttaattatgtccccttttatatgttttctttgtgtctgcctaatttaatattacttttttttttcttatcaggcctggaagctaccactctttggtattacttactaattgtgtttgtagcacttactgagatacattagctcaaattgaaatggcaacatgaaatgcaattatgcctacttatagacattctagatgtacatgtaccatattgccttaaagtgcagtttgttttacctgctagaaaaactgtgaaacaggaacacagacatgtacacagaactgtacagaatacaaaaaaaaatgtctacagtgttttcctttctcacagttttcatgtgatttagacattaaatgtcttatatgtaaattctgcaactgtagaaaatgtagataattaaaagggaataggaaatcagaatctaagccatcatttaggttctctatattgttcatggactattaataatacatgtatacgactaaagagatcatactaataaagcccatggtctggggagagtaagggactagtactcaccccagaccactctaaagaccaccatctcattcttgtattaagactccaaattggcatccctgcacctgagtctaaccagccccccatgatacgtgatctacagctttgtatagaaaaaaggacacaattctagtgagcactgtttcttgaaaactgcacttcacataaagagattttaatttttaataatttaaaagtaatggagattacactgaaaatgatgatgtctcaatgaaaataagcctcagctaatacaactcacatggagttgtatacaatggagagttatttgaagcacaacaccttatatttatgctgtgttagtgaaatagcacagaaaggttgatgaaaagtgttcactgcatgccaataagccaaacatcacaggaagtgtgtaaatggattaggattcttagacgaatctatctagcacagcaatatgtaacaaattaaagtggaagaatgaaaatgttactatcatcactttccttacagcttctccttactaaaaatgggttgtgtcatttcttattacaacaaaagattttcttgatggggatctgctaatatggtcatgggaggggtggaaatcaagcattaactatggaatttagcacaaagtatacctttactcacaaaaggggggaaaacattttagcatgaagattgcttggtgcttatgttgcactgctaactgcatattctagaaataattaatgctagtctcaattaccagcatgcaactcacattttcagctaaatcaataactgaaataacaacaagggagaattccccttatattatgaataggttctcagccttatttaagcatcagaatacctgggagtcacaatgttctttgcagttattgttatacctagtgtccgtcataggtgttactaattttgtcatgcataagtggcaacaatgttattacaaaaatcaaaattatgagcatgcacatccacaaaagcagtaagcaactgatctaagtatgactggctgcctctatgctgtactgtgatattcgtgtgtgctatctgcttgcttgctaattcctagctacactttattaacaaaggtaggtttaaaaacaattataggataaaaactttaaatttggaatatattatccatttacttatttttcctgaaaaatgagaaaacattgcaattattcaattatagtgataaaagatcagtctagcatacggtgctatgcacaacagtactaactgttggtcagacgtaatctttgccttcgaggtatttccagtctgttagggctggcacaaatcctaaacttttaaatatgtttctcatatagagcacagtagcactgacatgggctacttggctcactaaccattgaagatgaagaatgcttctcagggaaaattatacctgaagcagttattaaaacgagagcctgaaaggaaaggtggaaattatatccttggcagaggaagcagcatgaccaaggcaaggagacaaaaaaaggcattccagctgggcgtggtagctcatgcctataagcccagcactttgggaggtcgaggcaggcagatcacttgaggtgaggagttctagaccagcctggccaacatggtaaaacttcacctctactaaaaatacaaaaactagccaggcatggtggtgggtgcatgtaatcccaggtactccggaggctgaggtgggagagtcacttgaacccaggagggagaggttgcagtgagctaacaccactgcactccagcctgggcaacagagtgagattctgaagaaaagaaaagaaaagaaaagagggaaagaaagagagaaagaaggaaagagagagagaaagagaaggaagagagagacagagaaagaaggaaggaaaaaggcataccatgggcgggaagccaagtgatagcttttcatgactggactgtcaaagttcaagacgagtgactggagaaggtaactggacataaaccagacttagaggatggaatagcaattatgaattgggagacaaggcaaatgttgacaattttaggcatcaggtagtaaaactgtcctcattcttttgaaaattaacctcgctgggcacagtggctcatgcctgtaatcccagcactttgggaggctgaggcaggtggaccacttgaagtcaggagctcgagaccagcctggctaacatggtgaaaccccatctctactaaaaatacaaaaaatatggtgatgcgtgcctgtagtcccagctacgtgggaggctgaggcaggagaatcccttgaacctgtgaggtggaggttgcagtaagccaagattgcaccactgcactctagcttgggcgacacagcgagactccatctcaaaaaaaaagaaaaagaaaaagaaaattaacctaaaaactaaaataccaggaagaacaattgtgtttataataattccccaaactaattataaattttgcagtagacaaaaaaatataaaatatgaaaatagtaagtaaaatagggaaacatttcttaagactaatttcttctctttcaaaccctcttggttggttagtttttaccttccatcttgttgaaattgactttttttttttctgaaaaagtaaactgaatcaaattcaggctaagcttaatgctaccaatttattttcaaagacagataataaggtcacgtagggcagttgtggggaaaggttagaaaaagtgagtcgccctgtatgataaatgacaggctcaatgcatccgttccttccagaaaccctcaacacaactggctagcttttaatgtaatcagaagatatccacatggtctttctctctgtcctcttctcctcacttggtgattttaagaagcaaaagtctggccgtgatggctcaagtttccttgaacacagcacaaaaagataaatgccagtattgcacaggaggagaatatacagaacaagagttctcagttctggccaggcatggtggttcatgcctataatcccagcactttgggaggccaagatgggaggatcacttaagcccaggagtatgagaccagcctgggcagcagagtgagacccatctctataaaagaaaaaacaaaaacttttcagtcctgatgactaaaaccatcaaaaatgagactatattttagactaaaattagactaaaactataatttttctttaattaaatctattcatgtagtataagtggttaatagaaagtatttctgatttgtaatattatattgcagacattagattgatgtttaaaattgcaaaattgcaagagtgatatacaaaaaaaaggaattattctagacaactagagactctcctatatttaaaatttaaaagcatggtattgaatatcctatttaggaggcctttgacaactatttttactttttttttttttttgagatggagtttcactcttgtcacccagactggagtgcaatggtgtaatctcggatcactgcaacctccacctcccaggttaaagtgattctcctgtctcagcctcctgagtacctgggattacaagcatgcactaccacgcccagctaatttttgtatttttagtagaaacgggatttcaccatgttggccaggctggtcttgaactcctgacctcaggtgatccgcctgcctcagccttccagagtggtgggattataggcatgagccaccgcacctggtgacaacttattgttacttctaatggtttgggagaattcaaattatattagtaagtattttagaaataaaaagccatatagtcatgttaatatgctcataaaatcagaagaaatataaagttgataatcaagaaagggtatataagtattggtagatgtaagtgttggtaatataagtattggcaaagtattggtaagtattggtaaaactaatttctaacttcaatgttaagaaaagcaacagtctttgaaatgagttggttatcgggtacattgtagattctggttttacttattcaaatttttttttttacttgaatcagctttctcttcctatcccccatctctaattatgtctaaatgttcttttctgttcatggagttattaaacaaataaacaaactctctgggagcccttgaccctaggggataaagaagactgagttcttctttcttcctgaaaagtactagaaagttcctaaaggagctatgtctgtactactaataggctagggccgcatgtgactgtcaaaaagggtctctataagaggagtcccaggaacgccctgaagtatcaattaaaatgcagctgtttggtaccacttgttcctgcggaaacttagcagtggagggtgtttcttaccccagtaagctgcttctttgcgctaatgcagcgattgctgtgcctgagggcagccctccctcccagtcgccagttccgtctttgcactgcatgttctctctgatccttctctgatccttccctccttcacagctgatgactgaattcatctttgacgtgtggtccctcaactcaatgtaatcttgcatgaaagttcaatatctgccatctggccaggtgtccacttatcccactacccttgaactcccagctccttctccctaactcctctgctgagtgccttgctgtggccccagatgttgcaccatacacatctgcacacctatccaatgaagcagattaagtcccacccacttccactggacagaacagtagtctcttacatcagacttagctagattcctgtatcactactcggttatattatattatttgaaaacatttctggccaggtgtggtggctcacgccagtaatcccagcactttgggaggccgaggtgggcggatcacttgaggtcaggagttcaagaccaggctggccaacatggtgaaacactgtctctactaaaaatacaaaaattagctgagcatggtggtgcagcctataatcccagctactcaggaggctactcaggaggttgtggcatgagaatcacttgagttcgggaggtggagcttgcagtgagccgagatggcgccactgcactccagccggggcaacagagcgagactctaccatgaaaaaaaaaaaaaagaaagaaaagaaaagaaaaaagaaacatttcttattgaaacattcctcacttgcattcagtgaatgacatttatttgatgcctactatatagctggaattctgctgagcatagtagttaaagaaattgctcagatatacacttgcccttgaggagtaagcaaggcagtgactatctaaaaagtgaggcagaagtgtaaataaatggataaaagagaatgtcctatggtggaaatgcagtgaaaacaggaggtaattcctccttaatggcaaggttaaggatggaggggatgccaaggaggctctcaagaatacagatatcttcctggcttacatcaacagtttatacaaattgctgcattttagactcttgtggggagctttaaaactcttgatgtccaagctgcatcccaaagcagttaaatcagaatctctcggggtggggtgggggagggctggggtagaacccaggcattttttttttttttttgagacggagtcccgctctgtcgcccaggctggagtgcagtgacacaatctcggctcactgcaaggtctgtctcccgggttcaagccattctcttgcctcagccgccggagtagctgggactacaggcacccgccaccaggcccgactaatttgtttttttttttgtatttttagtagagacggggtttcaccacgttagccaggatggtctcgatctcctgaccttgtgatctgcccacttcggcctcccaaagtgctgggattacaggcgtgagcgactgcgcccggccaatatatttttttaattccctaaattaaaaattattccatcgagcagcaaagcctgagaaccagtgaactagatcattgcgtccttgataaaataatcttacactaatcttagttcaagagcctggcaagcaccatgcctactacatgttcttatgtgattttggcattgaatttaaaaaactgaatgaaggaatcattctggtaaactaaaatggacaaaaaaactgggttttatgttatctcaaaaattgtctacatcatatattatattaaccaacaatcttttagactttaatagtagaagctgtagttatgaatagatttatgtataccatgaaaaaaatgtacggtagttattctttcctcaattgtcattttaaacagagccatttatttattaatacacttagctggatgctataagtgaatacaattagtaaaagtgataaaactaagtttatgcacaactgtgaaaaatgtgtggtagttgttttaaaaacttgttttcataggtcaagagcttacaatgcattctccatgaaacagactattcattagtttgagaagataaaacaacacatttatggaacactcacatggtgagctaatcagttaacagtcttactacataaaaattacaagaattttcattaacaaaataatagaaaattaaaatgtaacattaatataagcacttatcattacattaagtagttctatatacacacacagacatccacacttatgtacacacaaatgcatacatttacctcactgctatttataattatttaacagtaggttagcatatttattgatatattttttgagacagaatctcaactgctgcccaggttggagtgctgtggcgcaatctcggctcactgcaacctctgcctcccaggttcaagtgattctcgtgcctcagcctcctgagttagctggtattacgggcgggtgccaccacgtatggctaatttttgtttttgtagtagagacagggttttaccatgttggccaggctggtctcgaactcctgacctcaagtgatccgcccaccttgggataccaaactgctgagactgcaggagggagccacaatacccggccagcaaatttaaataatgagaagcaaatagtcctctaatagtaactattgcatttagcatgtttcattctaactctaaactcacaagacatagacatgtaagtttagtaccctagaaaacacagctacataatttgaattattcacaacacttcatcacaacaaagaaattactaaatttgccatgtatgtgtatactacacatggagtagtttcacaaagcaccattgttacttacgttatttcatgttttaaattctgccttcatagcatggactttcagctatgcctcatttaaaacttactggctcgggggctcatgcctttaatcctagcactttaggaaaatataaaaattaaccaggtgtggtgacgcatgcctgtagtcccagctacttgggaggctgaggcaggagaatcgcttgaacccgggaggcggaagttgcagtgaaccgagatcgcaccattgcactccagcctgggcaacaagagcgaaactccgtctcaaaaaacaaacaaacaaaaacctactggcaataagggagggtcagtatttacgaagtgactcatttaaaatacggaataacttaaactagtacaagagtaggcatgctgtcggagtacagatgccagcgaattaaggctctgtgctgccttccatgttccaaaggtagcttgagcgctagtgtgtcaaatcaattgagcattcagggctctgggccagttactagtattagcctatgagggctcttggatagctttattttgggctttgtgtggtcaggaggtgccccagccacaaacactttgagaaacaggccctattcttaggtgatgcttagatgaagtgataatgtattattaatagttttgatattaacatatgtgagattttgtatgtgtgtgtatgcataaacatagttcagactgatataatactgacttctttctgaggccatggaattataaataaagaggcccacatgaaacaaacccatctcatttattctatttcccactgaataaatggcacttagtccaaatgcatttatttttaatatatctgatgcttaacccatgaccaaatggactcaggaaataaactgtcttccttgggtaagaagaagagatcctatgttttaaaggattttacattgtttttgctgtaatttcatatatgaaggaaatctaaaaactattcatgatttagattcattcatgattcacaaattgcattctgtgaatcaataaaataattgaagatatcaaaatatattcactcatgttaaaaaatacggctgatggttgagcacagtggctcatgcctgtaatcccaatgctttggaaggccaaggcaggaggactgcttgagaccaggagtttgagaccagcctggacaacatagtgagaccctcatctctacaaaaatatatatatatttttaaatatggcttagtgtggaagaacacatttttggatttgcaaatcagttaatgaaagccactgatcatttaccttccaaagaagaatcagacatttctaagacatctacactatggtacacttcactggctactattttagtttaaaaaattaacataaatttcattttattagctgatgtttttagtataagaaccagttgcactaaaaatcagtagcacttataatgaactctaagcattgtaaatggtgacttgacataatttagcattgagatgaattcagggaaacatttttcttttgctgtttgtttgtagcatctcagatctcccctcccaactcctctctgtccaccagttccctcttgcccaagtgctgctattctcttggtcactcataatcatttagcctgtgaaatttattctctatttacaactggctgctacatcactacttctgaacctcttgccaaatattattacaaaccaatgaatttacaaaatctgttcaaacacaaagatgggcaagagagactgtattgtcttacaattgcctctgtgttccttaagatttagtgtattttcttccctgggcacaaatttggtatttacttcactatttcaagtaattacttacttggttttgtcattcaaatttttaaatggaaagaaaatgtctaaggcccttagtttaaaaaaaaaaagattaagagtgtcagaattattctgatccaatgactttcgctaagcaaatctttttaaaacagctcaaatagtatgagcattttacaaatgagctttaaacatccttaatctaaattgttcttaacttctgaatacctagaaaactactatttgcagcttaaatataaacattcatgccagactaatgcagaaaaatctagggcaaatccatgattaatatttttttccagtttgcaatatccagctctatttaagaaagggccttaatgaatgctgctgtaataatttaaatagaaaattgatttcatttttgcattctcactgtcatttcaatcagaattgtcactatcactcacatcttctattcatcattttgatttctatctacactcatttcacaaatgaaaaatacatcattaaactcatcacattttccaaaactataagcaagcacatgaaatcctctcttctttgtaaagaactgccaacatgagagggcagactctagctagtaaagcaaaggatggatggttcaaatttatccttgtaagttatggctgcatttaaatttaattgtctataaactaaagggtgcttttctccctctggataaccttaaatatttcaccatggcttattcaaactactgtgaaaacttaaacatatattcctcatgattacatccattttggtctttagaagaaaaactagcagagcttaaatgtattataaccccttcttggacacacgatgttaaaaaactcagtttgttggaaaaaacatattactattctatacacacacaaactccatatagtaattccatatatttacattataagcatattatatatgtgtgtatgtgtataacgtacatatatataatgtatgtattatatgtatttatagtgtatatttatagttttgtcaaccaaatacttactgtttaaggaatatggtttaagcacaaaatattatatggttcaaattgttaaaaaatcacagcttacttaataaaagattaagaaaacctaagcaaattgatcataaatattaggggcaagtaagcatgaatagaattttaatttaacatctttattttgactcagtattattgttttcaaatcataggaggtttgacgcaatggaatatcaaactaagaaacacttagtgagattacttataaagatgtaactcactttttattcgatgtccccagttaatgcttattatcctcaacctgatagttttctttgagtaagaattatttagtgctagaatattaatacttgtatgatcaattacaattttattttattttgtttttttgagacaagctctggctctatcacccaggctagagtgtagtggggcaatctctgctgactgcaacctctgcctcccaggctcaagccatcctccaaactcagcctcccaagtagctgggactacaggctcagacaaccatgcccggctaatttttgtattttttgtagagatggggttttgccatggtgcccaggctggtctcgaacttgtgagcttcagtgattcgcccgcctcggcctcccaaagtgctgggattagtggcgtgagccactgcacccagccttacaatttgattttgatgacactagtcaacagtaaacacaacaatggctattggtctataccatcatgataaagcagattaaagaatatttggcttttgtttgctttgttaaactgtttctaataaagtgagcaagttttgttttaagtcacccattccaatgaatttgctacgtaggctgctggtcagcacaaaccatgatggggcaggtgaacaccttactccaagagctattaggtgagacacacctaacaacatcactgggtttttctcccatgctctaaagtctttctaacactaaccagaagtactacatctgttacacaataaatagtcctctgtcctataacactgtgagtcagatgaactgatcagaaaaaaaaaaaaaatcaatgtttacagagttataacttcagactaaacaacaacaaaaagaaggcatttcagttggaccatagagccttgaaaaatgtaaatgatttaccttcaaccctgaccattccagcaaataaccccaatcaactcttgctcctcaaattttccttcctcttctattttctgttgattctattaccagcatcgaaaccttggagtcatggctcatgccttcctgatacagtcacatccaagaagctctaaagcccaatggctcaactgtgttccctcctctccatttctgctgttacctaagttgagtgcttataaagtgatcagaggagcaatttagaattcatcaaattaggaatgactcttgatgacgaaattacagatgaggcagtgggaattcacaggagagtgggaattcacaggacagtgggagtcaagggagaccaaggacaaggagatgagttcatggcttgttgtttagatattagatgtgacgagctgaaagtctcaatggaagcgatggaaagtagaaatagtataaaagaaaccaagaaagaaaaactccattgggctaggtacagtggctcatgcctataatcccagctctttgggaggccgaagtgggtggatcacctgaggtcaggagtttctgagaccagcctggccaacatggtgaaactccgtctctactaaaaatacaaaaattagctgggtgtggtggcgcacacctgtaatcccagctacttgggaggctgaggcatgagaatcacttaaacccagaggcagaggttgcagtgagctgagatcgcaccactgtattccagcctgggtgacagagtaagactgtctcaaaaagaaaaaagaaaaaatccattggttattacaacagatttgtttatggggtcaaaaaatctatgaagtttggctgggcatagtggctcatgcgtataatcccagcacttcgggaggctgaggtgggaggattgcttcaggctaggagttcaagaccagcctgggcaacatagcaccaccccatctctaaaaagaaattatgtttaaaaaacaaaaaattatgaggatcaaaactataaggataaagaaaaggaagagtaaggatagtgtgagtgtgaataagcacaacggctagatttcaaagcaaatccagaatacgggctttgctggtgaccttggagaagttacttaacctttctgtgcccccgttataactcagatgtttaaaaaaaaagaaatggggttaacaaccctatatcctatggttcttttgaggattaaatgaaaaacaaatatgcttatgaagtactaaaatcacattattagtgaatttaaaaatcttttagccctaaaatttgattttctgtgtaggagctattgtaaccctggatatttttaatcaacatattttatgctacaatatacctaaggcgtcctgcttcaggatgaccacatccaataaatattcaacaagcatctgggattgcacttttaataaacgtctctgtgttgaaagagaattcttatcatttggaggagtcattttatttatttattggccttggaattacttcagactgttgataattctgattttggtaatagtcttgggtgagaaaattgttcaaggactaagagtgacctgtcatggtaacaacagtctgtgaattctataaaatataatgcatggaccttggtttggagaagagcaatttactttagggtgtattcatccataattctcttctcttgagcaactttcatttttatgtgaattctttacaaagtcaaaaacaactgatgcattgtcttagctacatacaattcatttaccagcacctaaactatggaactgcagtgacttaaagggctagcttaggaagactaactagtttgaggtaagtttgcaaactaaaacaacccactttttgatactacatcaaaaactgctttccaaatttttagtagaacttctcttttaagcagacagtataatcattttatgaaggtttttgtgtcctctaaaaagaattcttgtgttccaaactctcccaaggttataagactgaagtcaaaactatgtgatgtatactggccccatgtacacttttccatgtgaaatatcactgattcttcaaaatggaggttaaaatgtaagtgactgatctttcctcagagaattccagaaacaaatatgctttcctactctccaaagacaggaagatgagcaaagtgagaaataaaatgtcaactacttcgatcaaggatgacacctgagtgggaggccccagcccacacctgggctccaagcgccagttagtcctgcttagtcctagctctgcccctttctagctctgtgaccctgaggaactccctccaccaagaccactctgaccctctgtgtgtgtgtatttgttctctctgtaaaagaggaacaataacctcttgccaggtgctctctgacttcatctccagctgctgtcccctgggttcagctcactccagactcacgggccttcctgctgcccggtcctcccacccaacctcccctgagcctgaagggcctctgtacttctttcctccccctgaaatgctgggcccaggctggccacatcgctcactccctcagagaggccaggcttgatccaaatcccacctgccccgtgaggcgtggcctcatctaaagtcagaaattggctccatctcctcgactccctcccacaattccaatttcccattctgccttacatttctccttagcacttatggccaatacactatttaacgactgtgtgttctcttccttccttaattaaatgcagccccacgagtcagagattttggccaattttgttcacttcatatttttaggatccagtatagtgtctggcatgtagtaatgcttaaaaaaatctgtggaataaataaatgaatgactcttctccacaaggttgtcaaatgaatgagatgtcatcggttaaatcgctaagctgtaaaacatatgattcactatttatttttaaattgttaatttattattattctttggagacagggtctcactccattgcccaggctggagtgcaatggtgcaatcacggcccactgcagccccgacctcccaggctcaggtgattctcccacctctcagcttcagactacaggtgcaaaaccacacccagctaatttttatatttcttgtaaagctggggtttcactatgttgcctaggttggtcaaaatttctgaggctcaagcgatccgcctgccttggcctcccaaagtgcagggattacaggcatgagccactgcacccagccttttaatttattttaacattctgttcatgaaataaaatgtagatgacaaactatcggagtcaaggtaaaaataattaaatagaaattagttataagaactataatgcagaacctccacaaggctaagggaaaaaaaaaaacaactactacaaaatacttggtatcattagaagtaaaaaaaaaaaaaaatcagaaaacagtcaaaagcttaaaaatgaaccaaaggtggccgggcacggtgggtcacgcctgtaatcccagcactttgggaggccgaggcgggcagatcatgaggtcagaagttcaactccagcctggccaacatagtaaaaacccatctctactaaaaatacaaaaactagccgggcctggtggcgcatgcctgcagtcccagctactcaggaggctgaggcaggagaatcatttgaacccgggaggcggaggttgcagtgagccgagatcgcgctttaaaaaaaaaaaaaagtactgaaggtttgtggattaaaccagagctgtgacctctggaccaaagtaataaaagtccagcccatagcctggtagaagatagctagatggaagaaaaagaaaagctgcataagagaataacaacaggcccagagaggcctggagacagaggaaaacacagaggattagattttcagaagctgtggacttaagcaataaaaagtctatcaaagtgtaccttgttgatgtatggcacgtggctaataattcctaggttagccctttaagacacattgaaagatgggtcactccctaagtatgacatgatgaaatgaaactgtgtagaccatcaagcaccaggggaaaataacctgtgtgaggcttgagcttttctaagagagaaaacaagataaaaaaataaaaacaaagcccacaacacaaataaacaggatttactctacaaaacaaagctcacatttgcatatactaaggcttgttctctgcttaatcgaaggtaggaggagccagggtgattggctctctccctgagaacttgaactttgcttcagagggcagtttctagcaaggatgagcactgtttctgatctgaaaccgggataaaacataactgagtatccacagctcagagcaagaccgacaagcaagacgcatagttacagtgagtgtatgatagagctaatctgcattttaaattcgcacataacagtcttcgaaggtatgcaaaaaccgttttcaccaacaggaaaatccaaaataagtacattcgaggatttttttttccacaaaataaaatagttacaaaggttgaataaaaaattatctaagtgaaaatcacttcatactgggaatataaatctctggttctttggtaaataaaattaacaagaattattcaactagaactatcagcatataggtttctaggtttctagatgaacagtttactaactgggtcacgtataaaggtcaaaccagtttcttcgttacgactggttaaaactgatcgaataaaaaacaaatctgctatcagctgataaatactaactttaacaaaggctcagtacatgtagacatggtccatgtgtgttttaatttttaaaaggagtgaggagggaataggagaaagcaatatagctctcatcagcactttcttcccatcaggcgctttacatacagtcgctccttttaatctcatatccaccctgggaaggagaattaggacattacagttaagccacctgcccaaggccacattaacaagtgacaatggctggttctgctggatccagcctgggcctccttccaccaccaatctcagaggcatggcccaaagagacagctcagtcttcaggaacaatcaactgaatttaatatttactcagggccaggtgtggtggctcatgattgtaatcccagcactttgggaggtcgggggagggcgggggggcgggaggggtgcggggcggcgggtcacctgaggtcaggacttcaagaccagcctggctaacacggtgaaaccctgtttctactaaaaatacaaaaaattagccaggcgtggtggtgggtgcctgtaatcccagctacttgggaggctgaggcaggagaatcgcttgaacccgggaggtggaggttgcagtgagccgagattgtacctctgcactccagcctgggtgaagtgaaactccgtctcaaaagaaaaaaaaaaaaatttactcagataaaccaaacaggaagtacaaggcaggactcaagacaagttataatagaagagcaaagatcagtaagaaataaatataaataatagttacataatttacagaaaatagtcattaaactgcattcaagccaagatataaattacttagaagattctattcacaaaatattttaacttctccttgaaggttagtattgtcttatttagtgtaaatttaaagtatcatgtacgcaacaccacagaaaagatactgtctggaagctaagacattactaattaaatgcaaagagttgatatgaaaaggaagtaaaataacctagaagatggggcacggtggcaaggctgaggcagtcagattgattctacgagtcctgaagtttgaggttacagtgaactatgatcccacagcgccactgaactccagcctggatgacagagtgagatcctgtctctaattaaaacaaaacaaaacaaaacaaaacaaaaacctagaagagagtaacagcaccatactcagctttctcagctttttacttatttattttttttggagacggagtcttgatgtgtcgcccaggctggagtgcagtggcgtgatctcggctcactgcaacctccacctcctgggttcaagcaattctagtgccttagcctcccaagaagctggactgtcatgcaccatcacaccgagctaatttttgtattttcagtagagatggggtttcaccatgttggcctggctggtctcgaattcctgtcctcaagcaatctgcccacctcggtctcctcaagtgttgggattactggcatgagccactgtgccggtccatacttagctttttttagtgatacatttatactgattagtttaattctaacttgatgggaaaaaaattagtagttgggaatgaatgtataaaaatacttcattcaatagttacaattattcattacatttaaaatatccttacacctgaagggaactagaaaagcatgcctatatattctaaatttctttttctcctccacactctccaaattcccctgccaaaacagaatattgatattacaatggaaaattataaagacgatatactatgaaagttcttaatattcattcattctgagtttcttaaaatgtatagaaagatggcccaaacacctctgtgttctgcagcaggcaggtctatgcaacccacccgccaagttcgaggaagctgagctgacccatccagtctctcgaaaagaaacatttaatagggacttacggacagaagccatgtctcaggcagcagtgaggccagatagtggattcctgtgctgctacccaccacacccagggcttatataccctaggaaaggaatgtgtaggacaactgaagtccatccctagggaaaggcaagaatgctacatcaacctatgtaagggcagggtttatggtcaaggttgttttgacctaaggccaggatttatagcaacagtagataaagtaaaaatcttaagctgggcgtggtggctcatgcctgtaatcccagcactttgggaggccgaggcaggcagatcacccgaggtcgggagttcaagaccatccttaccaacatggagaaacccccgtctctactacaaatacaaaattagccgggcgtgatggcacatgtctgtaatcccagctactcaggaggctgaggtgggagaattgcttgaacctgggaggtggaggttgcagtgagccaagatcacgccattgcactccagcctgggcaacaagagcgaaactaactcagtctcaataaaaaaaaaaaaaaaaagtaaaaaagtagaggcattcccaggagttaattattagttaacatgattagcatccaagatggatttgcctggaaatggaagtgggatggggcggagaattatcttcatttgtatcacttgaggaatagctgagtgaaaacttgctgtaggcagctgggtactcaggttagactttgaagactcacttaggggctagatttagagaactgccgcttaatggctcatagtcagaagtcaaagccacattgaaattaaacagactgccataaaacagtgtggcctagttgaaagacaaagaatctgaagtgagaagttccgggttaaagtccgagacccaccattaccagccatttccttgggtgaatatttaaatctccagtctcagtttcctcgtctgcagaatgaagaacacagtctgcctccctgggagcagaaatacatctaccacttagggttgctgtgagaatgcagtgagaaaagcactggaaagcgtcttatgaagtccaagtcatgcatgagggatcgctattagcagcatgtttaatggaatatatgttctcaattcaaatgacagagactcgcatcctaaaatttaaagaaaagtaagttaaaaagtataagcctggcgcagtggctcacgcccataatcctggtactttgggaagccgaggtgggtggaatgcctgagctcaggaatttgagaccagcctgtgcaacatggtgaaaccctgtctctactaaaatacaaataattagcagggcatggccgcgtgtgcctgtggtcccagttacttggtagcctgaggcaggagaattgcttgaacccgggaggcggagattgcagtaaaccaagatcacaccactgcactccggcctgggtaacagagcaagactccatctccaaaaaaaaaaaaaaaaaaaaatgtacaggccaggcgtggtggttcacgcctgtaatcccagcactttgggaaaccgaggtgggtggatcacctgaggtcagtagtttcagagcagcctggccaaaccccatctctactaaacatacaaaaattagctgggggtggtggtacatgcctgtaatcccagctactcgggaggctgaggcaggagaatctcttgtgtaaccgtcaaggggttcaccttgctcgctgcctagacagagccgattcatcacaacaggggaattgcggaattgcaatagagaaagagtaattcacgcagagccggctgtgcgggagacctgagttttataattactcaaatcagtctccccaagcattcagggagcagagtgtttaaggataacttggtgggtggggggaagccagtgagccaggagtgctgattggccagagatgaaatcataggacccggagctgtcttcctgcattcagtcagttcctaggtgggagcacaagatcagataagccagttaatccatctgggtggggccagctgatccatcaagtgcagggtctgcaaatatctcaagcactgatcttagaggcagtttagggagggtcagaatcttgtaggctccagctgcatgactcctaaaccgtaatttctaatcttgtcgctaatggtagtcctacaaaggcaatctagtccccaggcaagaaggaggtctgctttgggaaagggatgttacaatcttgataaactgtctaagtcataattttgcaaaggtggtttcacttgaacccaggaggcagaggctgcagtgagccgagattgtgccactgcactccagtctgggcaacacagccagactctgactccaaaaaaaaaaaaaaaaaatgtaacaaaacttactttatctacatttggccacagtgttgtaaaccttctaacattctttacaacagcacctaaggcaacgacaggttcttagcgtcaaccacatcttcactttggcctacagcaaaatatatttcccctatttacccaaatggaagaagtttcccctgaattgtgtttttaaggtatctccccccaactcctctctccagatagcacaaatccaagtatgtccctagactcccaagagctgcttttatggactataaaactagcaacctagctttccacaaacatctttactgctattagtgaaaatatgcacttatgatatatgcacgcacacaagcatattcctgtcaccttacagagctaagtctacatcacggagacgtgagcacacatctcatagtgcacatcgttacacatccccccaggggctgacaggcaggggcttggttttatctttgcttcatctcttgcactttaagagtcccttgggtagtatcttttttgtgctcaggtttgatatttcttactcagtctttatgatgtctgactgaaagctcaatggctcaagatgtcctcgagggtgctaatgtttttatctctgtgtcctagcaccctgcccactctgttccctacaaatgttgagtgaattaacttccgtctgaattaataagaaatgtaaaccacttgtgataaaaaataatctatctcttccacacaaaaggtcagtgtaaatctggattctgaacacagactagattgaacaaagatttcttatctgtatcggaagcaaaactgagtatggtgttttgtacaaggaacaaaggaaatagctacacctctcctactgtagacgtcactgaaaaagtctgtttctctccctggggggatactgtaaactcagtagccagcactcaatactgttgccagaagcaggaactggaagtcatcattctaagtcgcctttaataaagcagaaaagatgcaataatgtcttggcaatgtcagttcccaaacactgacaacctaaactacatcttctggccctaggtgcttatcggctgtactgacgtgcttcacattttataatgttggtaaaatgagggaaggcctgtggctctcaaattcttgtatctgcttagctaattccaacccattattgtaagcagcaacaacagaggaaggacagtctctcaagactgagcactcatgttttacccagttacaatgctattgttctctgggtgaatcagttttaaagtaaatacatttatggctgggcgcggtggctcacgcctataatcccagcactttgggaggccaaggtgggtgggtcagttgaggtcaggagttcgagaccagcatggctgacatagtgaaaccctgtctctactataaatacaaaaaaaagttagcagggcatggtggcaggggcctgtaatcccagctacttggggagctgagacaggagaattgtttgaacccaggaggtggaggttgcagtgagccaagatcgcaccactgcactcaagcctgggtgacacagtgagactccgtctcaaaaaaagacaaaaaatccatcttcaatagaggcaatgtggtgcattacaaaggggatgagtgaaaacaggctggcttcaaatgcgggttttacactttaccaactcagtgatcttgcccaaaatactttgtctgagcatgtattttctatcttataaaaagagatatatgccgagcacacacctgtaatcccaacactttgggaggccgaggcgggcggatcacctgaggtcaggagttcgagatcagcctggccaacatggtaaaaccccatctccactaaaaatacaaaaattagccaaacacagtggcacacatctgtaatcccagttacttgggaggctgaggctggagaatcacttgaacccaggaggcagaggttgcagtgagccgagattgcaccaatgcactctggactgggtgacagagccagactccatctcaaaaaaaaaaaaaaaaaagagatatgaaggaggattaataagacaaatgtacataaaatatttcacacaggcccacatcatgaaatcccagatgttagtcatacatcatctgcctaagtctttgaatatttggggcatgcaaaacaaaccaaaaaggagttgcctattgaagaaaaggcaaatgtcttgacatgatgttcagatcttatgtgattcttcgccatcttacgctagcaggttgatgtctttgtcttcccccacagctctactccagttgaaccggggtaggcgtactctctaagctacttcatgtctctccacttccagaagcttcttcctgctggtacctctgtccccatctctcaggactccatctgccatgaccctttcatgattccactgagaagttacttttctttttcccttctttgaacatcgaaagcatgctgtgcctctttacggtagttcttttacaacttggcacggtgctttgcaatgtaatcacttgattacaagtttcattttcttcattagaccgcacactccttgaagtttatatggctttattttttgcacagagtagttattcaatatacactgactgaatatattttaaaacttcagggagtaattaaatcagccaaagtaaatttagtctacacatacatttatagaatgtacaccatctccagcctcagacaactgcactcaagttgcccctttcccgagccactttctggctaattgctaaacatgtttccaccagatctgcccctccagctgcctgcagctccagtagaggctgtgtggagaagagccatgcagactgcatctgtaaggtcctgcctgtgcactttccgcttcccaaatgaggacagagagcactcctgccagctaccaggcagggcccaatttctaaactctgccttgaccccctgccttcccatcagaggagaagcatccttacctaagaacactacttcttcaatgaccagtcttccttccccagttctcttccttccccagtcctcttccatccccagtcctcttccatccccagtcctcttccatccccagtcctcttcctgggggtatgagaaaaaactcttaacaggtgctggctaaagggaagcccagggtctccaagatctatatctcaccagagtccttcacagcagtgccagtcggagttggctgtgttcatgttccccaagctatcacttgctcggtctttctgcagctcagaggggatggctggactaccaatcctaatgggttgggacctttctgcaaactccagtctccccatctgccctggtcctgccttgttagacagttctcagtttgagttcagataacttttagagtccctggttcctattataatacttaatattttgtccaatgtctttcttcatcatatatatgcatatatatgtacatatatacctgaaaatacacacatatataatgacctcatgcaagatcatctgtctctcagagtacccatttcctatatatgaatagatggtgtgtgtgtgtctatatatatataaatcaaatgactgttttgtatttatcccactcaatcatccatattcataaataataatatttctctagcattccagaatcaaagttaaaatatggcatgaggaccaggctcactgcctcatgcctgtaatcccagcactttgggaggccgaggtgggcagatctcttgagctcaggagtttgagaccagcctggcaacatggagaaactccctttttaccaaaaatagaaaaaattagccgggcacggtggtacatgcctataatcccagctactcaggagactgagtaggaggattgcttgagcctgggaggcagaggttgcaatgaaccaagatcgcaccactgcactccaacctgggtgacagaatgagaccctgtctcaaaaaaaaaaaaaaagaatttggtctgagcctggtcagcactggtctgatgtactgaaaaccatctcctaaacttctctctccaacaacaattaagtaccttatttacacatcaaactatagcaaaaacatcaatgacaagtacaacatctgactgttccatgaagatggtaggactgttcccaaagctttctgcttacaacttaaggccaaaccaaagagccgtggttctcctgcactaaaatggtttcagcctatttccagtcatgctgctttactaacaaactataatgaactactgtaaaacatgtgtgctatacttcactcagcaatgccttcactataagatgttgaaaatctgtgtttctggatgcataaaaatgacaagcagaaggtgttattttctattctaagggtccagaacaaaagaatgtgctttcattgtgactaaggaagtattctgcacagaccaatataatcttctactcacaatgtttccagttcctttgggtacctggtgtcattttagctctgagttatgtattaaggtcacctgctttaaaaaaaataaagacaacacatggaactcagtagagaaagtgaagtttcttgctgcatctccttcgagccatcttccctgcttgtctgtagggattccactgtgctatctcacctacctacctactcctctcattgccatcgatgctgtgataccggcaaacttctttatggctaggccttgctgtcagtgagtttccttaatgatgaaggtctctgctacctgagcagaaaagctcaagctcagcttggtccatgacattcatatgtggagtgtcatgagtttacttttaaagaactgcaagaaatatgaataaacacatttttttgaagcctatgttcaattacagcacttcaaagatgctgtaggaaaagctgaagtataacacagcatgcaaagatgcattgatttctttctccaaatcacatgtaacatatgtaagtctatacatatatgcatacatatatatgtacaccaaagtttaagaaatagatggttgttgaccaattgtatgtttttaaagagttttctaacaattatattagatattttataacttttaaaaatttacttcgaaaagattctcataaatctcccagagaaggcttagaaggctggcttcaaactccagttgcctgaactaggtacagagaaggctgagatgacagcagtttctagccctggctgcacatcacagtcacctggggagctttcaaaactattaaacagcaaaatatctgacacacagtagctaatcaatacacggaaatttctctgttttcccttccaccctatatccaatcccatatttcccaaaatgcctacagagcatactctgccatctcactagcacctcactccgtagcctaaagcttccaacaagtatcaccacatgttcccgcttctttgctcaggcccagtgagttgccaggggtttccgcatcacctatattttatgcctgtttcttcctcgtgttccctgtcacctggcataatggtcttgaactgtcttcccactttaggcccacagtttcctccctgcagcctgggggatctctccacagtgcacgtgtgatcgcatctttcccactgccacctcctccaaggcaatctgccggcagggatctccctgtctctgtacttctgtctccatgttcccctttctgggaccctatattgcaggcaaacagaatcagacagaatgtgtgaaatagatgactcctgcaatcttgtcctgtccctatttctacatcagcttcctgtagatgtttcctctttcccatctcctgttctctccaccagcagtgtccatctccatgtcaactgttcccttcccaaggcccttgtcacttatgtgtatgtgggatgctttaatatttataggaagacttgtgttggtgaaaacacaagtcatcaggttcattgtgggatttattcaagggcttgccttctctcttaagtctacatttgtggattctcttcttaaactacattaccccaaacacccagtggacagctacgacattattgttttgttttgatactggtataaatatagtcatcttctcaactgaatatatctcttccataaaaattcatgtaagagcaaaatataatttcaaaagtcaaagttggaaatacccaaatacctcggcgggtgcggtggctcacgcctgtaatcccagcactttgagaggccaaggcgggtggatcacttgaggtcaggagtttcagaccagcctggccaacatggtgaaaacctgctctaccaaaaatacaaaaattagctgacatgatggcacaggcctgtaatccaagctacaaaggagactgaggcaggagaatagcttgaacctgggatgaggaggttgcactgagctgagattgtgtcactgcactgcagcctgggtgacagagccaaactctgtctctaaataaataaataaaattaaaaaaaagaaaagaagtatctaaatacctaaaggcaacacaacttaaaaaaccatcattattcatcatactaaaattacatgtcttcatgaaaaacaagtggcagaaagtttggtgtgctatgtggtgcagaaattcatccagtagtcagtcctgcccagactgattccatgtttttgtattttctcatagctgaaaatattaaatccagacagaatctctgaggcaacgaccgcgtgtgggaagtcagcctatttaacttgagatcaaccgatctacagagtatgcacatggctctcttgtaaagaggtgagaaaagatttcaaaaagcactgtcgtcagcagaaaggacctttacagccagatgaagctctggttgttttcagccactttcctctgctggggaaaaggcacattaaaaagacacagctgtctatttcagtgtacacatgcttggtagcatgggtgttatttactgataaaaagcacatgacagcaattttaaaacagggcttgtcctgtcagtcaaattagagaggcaggatgtcctctccaagtgattaccgtgggggcccacaatgtggcggcctgccaggtcaattacagcagggctgtgaggacacatgaagaaggatcgccttaattctaaacaggagcatcagtaaaatagaaaccaggggacatattaacacaatgaacaataccttaagactgtggctttggctagagctgtaaaatgtatttatattgagtgtttctccatgtaaacattttttttttaattaacgagaatgaatgtataggaatacaattgcaaaataacatttgtatatttctggagaaaaacatttctcaaaggaaaattgggatgctataattttcatctcatcaagaaaattagacacatgggtaaattagcatttggaaacctgaccaatgatatttcataattgttcatgtccctgatatgtcaatttgccttccatttctcctatactaagattaatttcagtttcaaatgtccttgtcattttttctcctctctattgcacctacagcttctttgtctacaggaaaaaatattaagagatcagcagcatcagttggaggatttacatcatcgactatctgaataccagggacacattcctttgttttacactcatattccaggagtctcatggaaatgcattaaacatcagacaaaaaaatgtaggctgcttgaatcgcagcttaattgtttaggaactagatcctgatagtgccccaataacagaagaaaatccctattcacatctacgtagagaaaatactgggctgctgacactgaattttgcagctatgcgaaatttaatgctgattagtaaactctcaaattaaacagtgaaagattataaagacacatgcaaaagatgtaaattaaacccaaaatatcagaaataccacagtcataatttcccacctacctaaagagttatttctcaaaaaaaaattgttgcgaatttattttattttgttttgttttgagatggagtctccctctgtcgcccaggctagagtgcaatggcctgatctcagctcactgcaacctccaggttcaagtggttctcctacctcaacctcccgagtagctgggattataggcgcccaccaccatgcccagctaatttttgtatttttagtacagacggggtttcaccaggttggccaagctgctctcgaactcctgacctcaggtgatccacccgccttggcctcccaaagtgctgggattacaggcgtgagccactgcacccagctgaatttattttattttttattttttattttttgagatagagtcttgctctgtcacacaggctgaagtgcaatggtgtgatctcagctcgctgcaatctctgcctcacgggttcaagcaattctcctgcctcagcctcctaagccaccatgcccggccatgaatttaaataaattcaaagatcccattaatgtttattacaaccccaataatataggtaggcagaatacaatcctgaaaaaggtgccaaaagttgaaacaatgtaagtcaactcagtttccccaagttaaaattataagagtatattaactggctgggcgtggtggctcatgtccgtaagcccagcactcagggaggctgaggcaggtgatcacctgaggtcaggagttcgagaccagcctggccaacatggttaaaccccgcctctactaaaaatataaaaattagctgggcatggtggtgggtgcctgtaatcccagctactctggaggctgaggcacgagaatcacttgaacccaggaggcagaggttgcagtgagccgagattgcgccattgcactccagcctgggtgacaagagtgaaactctggctcaaaaaaaaaaaaaaaaattaaaaatgatactaaagaccttagaatttctggacatatctgtccaagtatctgtcacgtgtcattctcactatacagaaaacaatctctaaagtcattgatgtctacatgtctaaacttttcaccatttttgacatcttaatacttttaaattacaatccaagttaaaagggcaatgtaggattagaatagaaagaggtgaggattcagaaatcctcacatcaatttcacaactccctgtacgatggaggcctctcttccctgattcttccttagggttttcaaacacggagtccctcctaggtgccagaggttgttctgggctcaggcagtacaatggtgtataaagctgccaaaacccttgccctcatgtggggagacagacacgaggctgagtaagccacacaatctgttaggatggtgatgagtgcgtggtgcatcatttcatatagggtgatcaggaaggcctcaagataaggtgacatttcaggaaggcctaaaagttgaggcatgcatcatgcagataactggggagagccatccagacagggagggcaaaggcaggggcacagggccaggggccagcaaagaggccagtgagaaaagggccatcctaggctctggactctactgctgctgggatggatggccctggggagttcttgcagaagaaacataagccaatcacccaaggtgactgttaaaatgaaaatccccaggcctctcaatctggacttctgattcagtaggtttgaggcccagggattaagatttcttagtttgcaggtagttcagctgagagtggcccaaagagcattctcagaaacacatttctgaatccctgatagtttggcatccctcctctatttccttatttttggtcagctgccctctacaacaagcagccatcattttgcagccgtttagcgttaaacaactaggagagagatgataagaaggaataccctaagtataagagttaaaaacgaagccacttagtttttgtctagcaagagagtctggccccaatatcttctgagctttgctgacattcagtgattggcttgtaactgacaaatggttgaattctatgagtatgggcgtcctatgactatcctggtcattgatttgactaatgattcctgtgcccttgggttgactaaaacgcaaggctgttgtgtttggtgagtttgttaaggtgaaggtcaagtcaaatattgactgcagaagtgatattacagatacccaagttcccaggttgcggaaggtaagagaattcagatgacagggattacaggtgcaaagaagtagtccaatgatcctaaatattttcagttcaagtgcttcttttagggatattacttagtatttcatctcttttcctttgatgtctagataggtattaaatattgcagcaatgaaaacaactgacatcaggtgcattctctctacattattttatttaatcctaaaatagccctgtgaggtaactactgtatgggttaaccaaagcccagagatgttacttgcccaagagtcacagggctattaacaggcagaattgagactctaacctatgtctgattaatccaacacccatgtcttaaccactaaaatatactgctccttaaatctataagaaacatacttgccataaatgttttacatacggcatttccacaagagagcttaatattgagatgctggttaattatcagagacagcgtgatgcatgaggaacactagttttggagcaaaacagatctgaggctcaaatcatttgaccactgaatagcaaatgacttaataggcctgagcccccaaaccttcattcatagagaacattatgtctctcagaaatttaagtgagaaaataagtgcaatgcatggggcatatagcacatagcatagatactaattccttccctactgacttggaagcaaacactgaccatcacctccacctccacctccacccggggcacagagcacagcactcgcgcaaacccccaacagagggtagagggtcatctcggttgggcttgggcttctgtagcggggggctcactgctccgccgagtgccctaaccactgatggacacctccagcccctctgagggttcttcctcctactgacccaatggtcgactccccccaggactgcttctctgaggcaacactgagcaaactgactgctctttcctagtgacagtgccactaataactgaagacagtcagttggtgtcccctggtctttctttctctaaattaaacatgtccacttcagtcagaagtccctctgatcacaatttccgaacaacacagtatcctaattttcctctgctgggaaaactctagtttttctgtgtcctttaatgccaggaccagggccaaaaattgagattgacatattaagccaagaatatgattggactattacataggctaatctagaaaactcaccttgataatcccaggcttcttggctaatcttagcgccttggcccagagcagtcacatcggcaaaaaattcccgcccacttctcctcccagttccacccctcacagcagctgctcacatctttcctcctcccttttttccctccgaggccctccctcagcctctgtttcatctcttcaggaatctcctcttcccagcccaatcctaaacccaggtagcctttgttctaaatttgtataagtgtgttctaagttcctcgcctccccagtcagccagtcagctcggcaaaacaaaaggaccttcccccaaaccagctctccttattaagtagaggaggagagagttctgtaatacttgtaattactcagaccctgtcacactttaagtaactcagcctaagaccattattatacctgtacttcataccgctggctgaccctgagcttgtggtcaaccctgagtcctagagctttcatcatcttaactcctgcccaggccaatagatagcctcaatcctgttattgcatacagtcatgttttggaaagctaaacaaacaaaaaaacatggcaaggtgcaggcccagcaaaggggccaatgagaagagagccgtcctaggccctggaccctctgaaaggtttctgactatgaaacctttactttcatcccaggtaagtccaattttggtttagcaaaatcaaaattcttcttgcagcttattgcaatcatttcatttttgcttctgttatctcttgtactctactagctctccttttcggatttgtaccttctgtgaatgtggtatgactttatgaggatcatggacaaaaatgttgagaagaaactaaccaaggaaaacttttgttgcatggataaatacatagatgcatataaaacaggcagtacataatggatacataagcatataagatgctcataaaataacacaaccctgaggacacacagagatgccaggtaacatcactgcactgagtctaatagtctttagcactcccacacgagcaaacctggctgcaaaatcatgttacacagcaacagaggaatgctcatagcacagaattaaatagagattctaagtcatgtgagggggcagccaggaaaaagggatgtttatgttatttaagtgacaatgaaagttaattatacagcacaggagactagaaaagctttatttgacgttgcagacttttagtgaccacagaagcagttgtaggtattaaaatttcatccatctcagtgtcatttatttactttgccagataatcagtgatcttgcatttttatcttctcactttaaatgtatgcacagaatgttctctcctatgcgatctcacatttattttattttttatttactttattgttgatttttttttttttttttttttttgagacagagtctcgctctgtcacccaagctggagagcagtggcgcgatgtcgactcacggcaacctccgcctcccgggttgaagccattctcctgcctcggcctcctgagtagctgggattacaggcatgtgccaccacgcctggatatttttgtatttttagtatagacagggtttcaccaggttggccaggctggtctccaactcctgacctcaggtgatccacccacctcagcctcccaaagcgctgggattacaggtgtgagccaccgcgcccggcctcaagttcattttaaaatctgaattgtcagctgggcatggtggctcacacctgtaatcccagcactttgggaggctgaggtggacgaatcgtgaggtcaggagttggagaccagcttggccaacatggtgaaaccctgtctctactaaaaatacaaaaaaaatgagctgggtgtagaggcaggagcctgtaatcccagctacttgggaggctgaggcaggaaaatcacttgaacccaggaggcggaggttgcagtgagccaagatcacgccactgcactccagcctgggcaacagagtgagactccgtctgagaaaataaaaataaaaaaatttaaaaaatatctgaattgtcctggtattccatccagtatcaggcttaagttgtcaagaagagataccagtcttgatttctgtgaactgccagaattacacagaaatttgctccacttcccggaaaaggcaaataaaacataccaggattttaggtggtgcaagtaagttgcttgccagagcagccatggctacatataatttgcccaattcccatcaggcatttggttatttaaattttaagcatgcttgatacagcggtcatattaaccttccttatatatgaggaaaacatttcaagttataattatgttaatggtattctaatagtatttttaaaaaattatataacatttattactccgaggaaattaatgtcagatgacactaaaataattaagtttgaattaatcacagattatatcactttgttctcttcaacttttaaacatgtttgataattataatctaacaaaggaaaaattaatagagaaaataagtctaaaaattttctcctccgaattggtaattgggggaacaaaagatgtgggcaattagcaaatgaatatggtgcttcaagactgaagaatttaggatatgtaacaggtgacttagttcagggttgttcctagaggtaagaagtatcaatagaatttaagagtctacactgttcattctatcagtatatcttctatggcacacaagaagcaatggttattcagttatcttaatttcttaagttataaaagttaaatttgagccaaaagcaattaccatgtaaaagtgtatgcagtttttttttttttttttttttgagacagagtctcactctgttgctcaggctggagtgcagtggcgtgatctcagctcactgcaacctctgtttcctgggttcaagcgatgctcctgccccagtctcccaagtacctggcattataggcgtgcgccaccaggcccagctaaatttgtatttttagtagaaacagggttttaccatgttggccaggctggtctcgaactcttgacctcaagtgatccgcctgcctcggtctcccaaagtgctgggattacaggcatgagctacagcaccaggtcggtgtgcagttttgaccttgttatttgaccaaggaaaatttagccatttgaaacaaactcttttttttttttaagactgagtttcactcttgacaccctggtgcgatctcggctcactgcaacctccccctcttgggttcaagctattctcctgcctcatcttcccaagtagctgggattacaggagtgtgccaccacgcccggctaatttttgtatttttagttgagatggggtttcaccatgctggccaggatggtctcgaactcctgacctcaggtgatccaccctcctcggcctcccaaaatactgggattacaggcgtgagccaccgcgcctggcccaacacacactatttcttacattaacttgatgtctcctttcacctaacagaagcaaaatacacgcctaattgaaagacagtcagtgtgtcagactgaaacaaccaccaccaaacaaccaaggcactgatcaggaaaacagcacttttcccttgattctgactttttttctcacatacctttatttgcattattcataggttttatcagaggtttatttccttgggttaataatgaaacatttttcatttgtttccaccaaggggcttgctattctactattgcttagagcttcgggtgtctccatatgacaaatgccaaacatatgccaatcacaacattcaactggtagcatatgctgaatttcccagacgccagatccagtcaggaactttctggtttaatgagtcttgcctattatgtttctggtacacatcattacagaatttttccccatctacttccaagaactagaataaaccagaagaacaaaacaaactacaacaaaaccataataaatcctctcttcgtttatcatctatatgtcacatacgaaattagttacactagcagcatttactgagggcatggcaagatttactaagtcttgtttctcatgttacagccaaattttatcaaagttgaaaataacaatattttacatccatatagttctttgtattatttatttcaaaggactttcagaacttttacctaattggatatttacaaaaacccgtcgattgaagtaggcagcaattctttctcccacttaatagaggagataaatgaagcccagataaattaagcagcgctcccaatgtcacagttagttattattattatattattttttgagaaggagtttcactcttgttgcccaggctggagtgcaatggcacaatctcagctcactgcaacctctgcctcctgggttcaggcgattctcctgcctcagcctcccaagtagctgggattacaggcacacaccaccacaatgggctaatttttgtatttttagtagagacgggggtttcaacatgttggccagggtggtcttgaactcctgacctcaggagatacatccactttagcctcccaaactgctgggattataggcatgagccaccgtgcctggccaacagttattaacagggccaagatccgataagaagttgccttgaacctcacatccactggtctcccactattcctcattaggctgtgccaaggacacaaagtcagcagggatcgagacaccattaacctccctcctgacactggaaggtggcccctacttcctctctgagttttttgtttttgtttttgtttttgttgagacggagtctcgctctgtcaccaggctcgtgtgcagtggcgcaattttggctcactgcaacctccacctcccaggttcaagtgattctcctgcctcagcctcctgagtagctaggactacaggtgcacgccactacgcccagctaatttttgtatttttagtagagatgggtttcaccatgttggccaggatgatctcaatctcttgacctcatgatccgcctgcctcagcctcccaaagcgctgaaattacaggcgtgagccaccgtgcctggtcctctctctgatagttttttaaacattcagaaaaatgtgaatgcatacttaggtttctgcctatatttcctgagagaaaatcatgcctcaacatcaaacgcaaagatcagtcttaaatctggacccaggaacaggaattctcctaattaagcacataatcccatttatctctctagaaacaactgacattcaaataatgcttcatttcgtttgtaaatactagttagatggattgtaatacaaaccaaagagacattaatacaattgtccatttcctttggaaggatggctatccttcctatttaagctaaaagacattttcatttgaaagccatttgagcttgagctgcaatgagctcaggtgcaaatttcttgatgaacgagtctaataatgacacaaaatttcaaaaagaccaagagctatttcatggattatttcctgtggcaatcatctcaagttaaataacttgacattttagaaatggcattgggtaaataactctcgggtgcttttttcactggtccgctcactccccttatcttcctgctgactaaggaaggtaaagggtatcctccacaggaggtgggaattcttggtcctttgaggtaaagggatttcccatcatatcgttccatctgaggctgttatggactcaatcttcccctcacatttatatgttgaaatcctgcccccccaagatgatggtattaggaggtagggcattcggagggttattagggcacaagggtagaaccctcatgagtgggattagagatcccagaagctagctctgcctccttcctcagtgtgaggacacccccagaagacggccatcttcaacccagaagacggccctccttcaaacccagaacttgcggacacctgacttccagcctgacttccagcctccagcagtgtgagaaatacagttctgctgtttataagccgtctatggtaatttgttacagaagcccaaactgaccaaaacacaggtttctatgaagtttgttttgagaaacagaaaaatgcttggtagttctgctattggttatcatttctcagacattataaaaattatgtcaacagcaccctcgacatgttatctctggacaaactgatgtgcttctagaattttgaatttatttacttaacttttattattagcgattagtttctacacacgtttgcaaagacggataaaatcagagccctaccattgagtagataacagcctagcaggggaggtagaaagacaaaactaatagtaatagaatgcgataatctttttttttttttttttttgaccgagtcttgctctgtggcccaggctgaagtgcagtggtgcaatctcgactcactgcaaccgctgcctcctgagttcaagtgattctcctgcctcagcctcccaagtagctgggactacaggcatatgacaccatgcctggctaatttttgtacttttagtagagacgaggtttcaccacgttggccaggctgtctccaactcctgccctcaggtgatcatctgcctcggcctcccaaagtgctgggattgcaggcgtgagccaccgcacccagccaataatctctttaatagggattaatgtaaaacaaaaagaaaaagccacacagtggatgatgaagctaaatatgtctcaccgtttgtctggtgttttatagaggtggtaaaatttcagttggtggttcctaataatatcaccttcacaatagaaaataaagatctatgtgcagataggttaaggttactccagtgatcaaggtagtgtaaaggataaagtaagaatgataataataatgagtatgtagctaaaagtcaaggattgtaaaatatcacagtagcttcggcctttaggtggaacgaagcctgtcttaggtaggatttcctagaagcagacactaagtggaagtgaattattaggaagggctgtcccaagggagaaagaaatagagcgtctgggggctagacagggaaaggaaggaagcccaacaagggtgtgtcattaggtaaattcttatgaagggttattttggctcattgctacaagagaactctagagacacttctcagagttgtcccgtttgggggatgggcagatgatgagagttgggagaaggaggagctgaagtaaacacccccatccttgtcagtctttggttaaagactctcctaggggtatgtaagtcaccaggcgaggctgggctctacagctacttggtaaagtttctgagcagtacagcatctgttacaggcccatttcagaggagttggttctagagtctattttattaatatctaagcatatgttaggttttaaacagaaagcgtcaagtctctggtggatgtgcaataacatcacaccatatttaagttcttacaaagatgtagaaggaagatgtgggtttcagaaatgttctggaaactagaaacacttccctgtgtgtcatgctgcgacggtgccatgtcacgcagcccactggagtggcgtgtgaggtaatgacattgacttcaggtcctggtgagaagactattgctaggaggcatctggctggctggtggctgctcatatcctacgcatacccacctgacagatctctaggattgaaacagagaatgtatgtatgactaagcataacagcaaattttcttctgtatgtaatttcaagacccttcttatcatctctcttagtgatctagtgatctgatgcttgtaataggccttcgtgaatattcctcacttcaaagtagtctgtgagacacacatacaaacgagattctattaacaggtctgccagtgaaacagcccaagtagcaaatttgatagagaacacgtacttgggcatacaaatcccaaaactatgtactaattccaccaggtataaatctcacccaccagaccaacgtctgaaaactatacccaatttccagtccataacaagttaaatggaatttaaggaggttcgttaaagtgttataaacttacaatataagagctacaaaagaatatcataaacaaataatgagaataactccttttctctaaatatacagttattcagagatttcttttgttcttagagaattgttgtcagtcttcctgattataaaaataaagtcttgttgcagaaaattaggcaagtacttcttagcatttttcccttttcctttttcttttggatatgccgttttattgaggtgcaaccatatataaaaacatacacaactcctaagtacatggttgagtttttataaagcaaagaaacctgtgtaagaaccacccagaagatggtttggtttctgttgagggcagagtaagttcatacagaagctccggcctcatcgttgtaacatgtatttgtgagctacttgaagaaacagaccatttcttctcttgtcctccacaatccttgaatatttcatttgttttggagattgacagatcaagttattcattcattaacaattattaatccctactatgtgctcagcagtcagtgtgtgatgatgagacttggagtctagtggaagacacaggtaatacagaagcaaatatacaaagtgttcactataaaatacaaaatgctagggaggaaataaaactgatactgtggtcaagaataactaggtatcctacctagaaaaaatggttagagaaataaatcagagatgagatttagatagaaacttgaataaaaagaacacagccatgagaagagagaaggaaaacacattccaaacaaagggaacactgtgaacaaagtacacaaatccggcttgttgcacaaatggaaaatcaggtgactaggcgttggtggccataggtgtgagtcggacagcaaagacagagaccaggccagtcatggctatactggccaggagagtgacttaaagtgctaagtgcaatgtagggggaaaaaacggggttttagcaggaaagtgaagggaccgatctacgttttaataagagtaccttgaacactgtatgagcgggtggcgagagacaaagcaaggtgccggcaggttatcgcggtggcaatggaagatgtactctggaggtatatcaaccatttctgtggatggattggatgtgggagtgtgggaggtgcagaatcaaaatccatcaagtctttttacttcggcaattatgtggaatgagttgtcattcactgagatggagaagattcatggagaaataagtttccatgaaaaaaagcaagagtttagttttgaacatattacatttcagatgtttgagaaacatccgcgtggagttgtcaggtaagtaatttggataaatgagacgggagtgctgagaggagagctgagctggagatataaatttgggagtcattagcatatagatggtttctaaagccatgggaatataactcaaggagaagatagagaggacgtggggccaagctctgaggaccttcaaccttcagaagttgttcaggttcaagccagaaaaggctcaaaacgctaagcagaaagaatcgtagatgtaggagaaaaaccaggtctcagaagccacgaaagcagagtttcaaccagagggggtggtccacagtgcccagtgctggagagaggctgcgtaagaacaaacgagaggagcatctaactgggcttggcattgcccaaagctgttggtgatgctgtctcaggggaggaaagattaaatgggaagggaaaatggggcaagaagtgaagtgagtggggtccaggtaagttctttaagaggcagacgctcttacaacacaatgtgcattggggaaatgagagaagacaataaaggagagaggggaccagccaaaggaacaacctctttgatgaggcagaggtgggtgtccagcacaagtggaggcctttgcatctaagaggagaaaggacgctttttctcaagaaatggaagacaagaaagtgagtgctcttggtgtcaccttcttaaattgcagtaacatataaggcaaagtgagcagccggaaagaaagaggcaggggagggtgggaggagtgggaggtcttattagaagcaagggatagatatagggggggtgctgtagagagtgggagctcatacctcaggaaaccgggtactgacaaggagggaagagccatctgctgatgtgaacttacagtgtcctcggtttacccaaatgtttactaccaaaaaaaaaaaaaaacaccctaaagcttcaagggaaagaaactaaaacacagaccaccacagtcatttaaagctatgcatttgctcaggaagtgcaataaaaagcgtgtgggtaactgggcgtggtggtgggcacctgtaatctcagctactcagaaggctgaggcaggagaatctcttgaacttggaggcggaggttgcagtgagacgagattgcatcactgtactccagtatgggcaacagagcaagaatccatctcaaaaaaaaaaaaaaaaaaaaaaaaaaaaaaaaaaaaaaaaaaaaaaagggtaaaagtgagtggggaaaaggcagctgaaagaacatgagtgaaatgatgaactttggaatctcaggtggataaagacaggagtcatggcaggagggctggggaaggagagaaagcggcgagggactcccgtggaggttaacacagcaagggctctgcaagcaccgcagctgtcgctggagacgcgaatgcttcattttgttattttggaggtgaagtaacatctagttcgactctgttacactgagagtgttcgatgagaatagagtagaagaaaatgtcactgaagatgagcagatcaatgaatgaagatacaggatactgaggggaccattcatgtaaataatgagttgccaagaaaacggacagaatggccaggcgcagtggctcacgcctgtaatcccagcactttgggaggctgaggcgggcggatcacctgaggtcgggagttcatgaccagcctgaccaacatcgagaaaccccatttctactaaaaatacaaaattagccgggcgtggtggtaatgcctgtaatcccagctacttgggaggctgaggcaggagaatcacttgaactcgggaggcagagtttgcagtgagccgagatcgccccattgcattccagcctgggcagcaagagcaaaactccatctctaaataaataaataaaaaagaaaagaaaacggacagaatttggagaactgggggtggcagacaggacagataaacatcctcagtgaggtggcggggggcaggaggttaacagatgacagtggcaacacggggtggggggagcacagcgcagcgcaatggcatgaagatcaggggcttttactagagccatgggaatggcagcttggctggtgttgaggaggaagcatctcatggccttgccggagccaggcgtacattgggacggcctccagagaaggcgaaagacccagccaaggccaggtcaccacagaaatgttctaaaatgagactgagaatttaacaatggggtttgtgattgtgggaaaaattccaaaagcagagtgtatcaactatcaagaaaaatgatgaaatatacttatttggggggctttatagaaaggaggaattctgtgctacacctattatatatctaactcaaaagtcacttattcagttccttttatacgcaatggactatgcttctaacagacttttcagccacatgcaacaaaaaaccaagtaggaagggcccataggttggtgcacaggtcagtatgtgataccccaacgcaaacacatggtaaatgactggcaaaagtcaataatggctatatatattatatatggaggcatttatacaaagaggaatatatagaaggaggaatttaaaatcatgtctagagtaatataatagatgttaacaatcatgataatagtatttcaaagtatattaaacaaaatggattcatttctaacccaaccagtaaaatattctttgaaccaagattttactaggatgccaaatttaaaagttaaaaaaattccagctttttgagtaatgagcaatttcagtcatcaataaaattaatgaaaatgagagagcaaattacactaatccattgggtaaagaaaaacttaaaacattacccaaatagaagctttcttttctattgcttttcatcagtaataggtatcaactacatttaacaaaaacactgttgctgagataactcaccctcttggtttttaaatacactcaagatatgtcatgtttcaataaatgatgtcagcgttacactgtgtgaaaaaaatacaaaaaaaaaatttaagtttcatctataaatattattccattgacatttcataattaaagtttctaaagaatgaattcaaggccggtggctcacggctgtaatcccagcactttgggaggccgaggcaggtggatcacctgaggtcagaagcttgaggccagcctggccaacatgataaaacccagtctctactaaaaatacaaaaactagctgggtgtggtggtgtatgcctgtaatcccagttacttgggaaggcgaggcaggagaatcgcttgaacctgggaggtggaggttgcggtgtgccgaaatggctccagcctgggcaacaagagcgaaactccatctcaaaaaaaaaaaaaaaaaagtgagaaaacattggagaacataacttgattgagtgagaaggaaatggcagcttagagcagaccctgaaagcagggaggcagctagctgggcctgatctcctgctgcagaaacaggcaatacatccgtactgtgtgaagcccctaagtttgtcactatttgtcatgcagaaacaggtaagtaagacatattataactcggaaaaaatctcaaacctgttgcacaagaagttatttaccattgtaagctctctgcgaaatgttttggaaacccaagttgagaacagctttgatcagaggcaactgaaggcgggcagaagaaaccaagcagtaactactcagctggtgtgtgtgtgtgtgtgtgtgtgtgtgtgtgtgtgtgtgtgtgtgtgtgtgtgtgtgtgtgtcagtttggcagacgccttctttttttttcccctctagtgcatcatgttgaaactgtagctaatgccgggcgcagtggttcacacctgtaatcccagcactttgggaggccgaggcggggggatcacgaaatcaggagatcgagatcatcctaaccaacacagtgaaaccccttctctactaaaaatacagaaattagccagatgcagtggcgtgcacctgtagtcccagctactcaggaggctgaggcaggagaatcgcctgaacccgggaagcagaggttgctgtgagccgagattgcaccactgcactccaaccaggtgacagagcgagactccatctcaaaaaaaaaaaaaaaaaagagaaaaggaagctgtagcttagaacaggagaatgcaagtgattattatcaggaattgcatctgtgagggaacctgaggactcaagccagcccagcagagggcaaggcagcacagggcatgagtcattctcctgatgctaccttcacaggatatcagacaaaggaaactgagcacctgccccatttgatgaaataaagcagataaaagataatacatttaaacaattagatgtgtatcttttatatccaagcaatattgtacagaaaggcaccacctctaccttatgacaagtgttactacccatactcaggaaaccccgatgttgccagcacagaagccaggacaacagaaagctgaacaattccttttgcccaatgtgaacatctccaataaggctccagtttggaagacttctgaaggcctttcaaattcataataaatgctatgaactgccacacttaatcccctgtattctggctgggccagctgttataatacaccaccccacagtcattgctgcttggtagtcgaacaaacacgctggagtcagaggccagagtccttcctcatgccaccagcttccctgagcctagtcccaacaccattccccccagggcactttgctgtggcctcactgggtgtgcccacgtggtcttgccctgaaccccaatctgtaatcagcaccagctcttcaggcgttgaccataaaaggcactgaatgatggtggtgtttttttgttttctgttttctgtttgtttgtttttttgagatagagtcttgctctgtctcccaggctggaatgcagtggcatgatctcactacaacctccacttcccaggttcaagtaattcttatgcctcagcctcccgagtagctgggattatcaggcgcccgccatcacacccagctaatttttgtatttttagtagagatgaggtttcaccatgttggcctggctggtctcgaactcctgacctcaagtgatccacctgcctcggcctcccagagtgctgggattacaggcgtgagccactatgctcggcggatggtgctgttaacaacagtatctatccttgacaatatagggcttcttctgaccacctcaaagatgctactgcatcaggctttaccaaattcttctcttgttacatgagtttcagctcaagaatcagatcatgggggaagcttcaagagcagcaaaacttgtaatttttgcccagttgccctacaagaaaataaagttttgactcttaggcataatcaccatggtgagaacctatatattaatatctacacacaagtatctatatctctccttttaaatatactctttagatggctgctccttacgacaaaggttttatttggtgatttgatgataaaaaaaatcacttttctttatggtgactattatgccatcatctttactaacaagtatattatcaggaatctcaaagaaagtggcattcatgttatagccttcattacttcaaactattccggattccccatattattttacatattttcactgacttttaagcaaatgctttaattttccctttttttttttttttttctgagacggagtttcgctcttcttgcccaggctggagtgcaatggcgccatctcggctcactgcaacctccgcctcctgggttcaagcgattctcctgcctcagcctcccaggtagctgggattacaggcatgcgccaccacacctggctaattttgtatttttagtagagatggggtttctccatgttggtcaggctggtcttgaactcccgatttcaggtgatctgcctgcctcagcctcccaaagtgctgggattacaggcatgagccactgtgcccagcaattttctacttttttttttttaatttcttagatggggtctcattctatcactcaggctggagtgcagtggagtgatcttagcccatcacagtctctgcctccaaggctcaagcgattcttctgcctcagcctcctctgtacctgggatgtgccacaggtatgtgccacacacccagctaatttttgtatttgtggtagagatggagttttgccatgttgcccaggctggtctcaagttccggagctcaagtgatctgcccacctcagcctcccgaagtgctaggattacagcatgagccaccgcgcccagccaacttttctactttaaaaaggcaattggtgaaacctcttctctactaaaaaatacaaaaaattagctgggcatggtgccaggtgcctgtagtcccagctacttgggaggctgaggcaggagaatggcgtgaacccaggaggcggagcttgtagtgagccaagatcgtgccactgcactcctgcctgggcgacagagcaagattccgtctcaaaaaaaaaaaaaaaaaggcaattggtaagttgtatgaacattttgaaactcaaacatttttgtgttaccaggaaattcactatagagagaatgaaaactacgactatttgtaaataatactatgacacagactgcgacaggccactaggctgatttgcaggtaaaatttttgttctatcaaaaccttaaaaaccacatggacacacacacagccttccccagcccctgccatcccatcacacacccttccccagcccctaacatcccatttgtggatgtaactgacatataggaagacagcccatagttatcatttaggttcaccttgtccctggaattgtgctacataaagaaactgagaagcatttctacaagaaagctacgggtcacttgtgaaaagccccaattcatcccagctgaggcatttatcttgttggaatcactggtaaaagggaaagccttgtctcttaaagactttcagttatagaggctacataaaaagcaatggccaccacaaagcttaaacagataaactatccattttgtgtcttctcctatacattagtaattacttttaaaaacatctccacctgtaccttagcctcttattcctcaccagtattccttaccaataagcaacacatatcctactgatattttgttgatggagatagaaattaaataggtggctaattcttcttcacatacgagaaaggaaagttatggaatgaaaatgatgtctctaaggtcctaaatttttcaaactagtgccacctaatctgtgaccatggctaaattctcttgtctcagctttcttccatataaaatgagttgtctaacaaacagtaagctcaattaacatctgataccattattattaaactttttctatttatatgtatttcattctcagttaatatgatgacagaaggggataaacataacttatcaacgacattaatatgacttctttcccctactacattcgttaataaagaggttataattaggtttcaaagacagcatttcattaaggtgatttcattcagatacaactatttgcatataagtgcaataaaaaccttagaagtttctatttgactatgttagcttcataagtagaaataatacacatgctttatgcttaggttaaaaatcagcctaacaatatattcatgattagttcaaaagagcagacatcaattacctataagtttataactgtcaacacataacaattacaaattagaaacagagtaatcaaagtcaggtcataatcaatgtccagaaggtcaaagacatgcagaggccaaatgcatcttctaagtgttgcctggatcaatgtcttatattttacaagtgtaaacatggaaaaatcaagttatttttaatacacttaagaaatgaagtgatttttaatacatcccatatagtaaaaacataaatttgaactaatgtcataacacccttctggtgtccttttcattaaaatgcactaccctaatcatgtttacaattgatatttctctgaagtataaattacagattgtgttaacaaatttgcaaaatgtggcaaaaatatccattgccaacatatattcattcaagtcaatcagtgtatacttaatgagtgtcttctttctccagaaactttactaagatggaaagaaggctttcaattaaagcccagagagagagaggcaaaaaaaaaaaaaacccaggtcattataaaacatgaaaatctgtgaagttataaagatgcccactgggtatgagggtgataacagagatcatttccaggtaacagaaaagactttataaaagggtcatgtctgagttgagccgtaactgaggagtatttgaccagatgggactgaggaaggaaagacgatttgcagcctaggcgatcaaaggagcagggcgacggggagaaatccatggagcgtgtccaactacagtcagtctggtgtgagatgctgcagtcccaagcgcatggagtgatgaagataaagctgaggtctccaggttgcggagagccttaagtattaaggggcttgggctttattctttgggcaatgatatttactaaacagtttcaagcacaggaatgccatggtcacatttttcattgtaaaagaacatgcttatagcagtggagtagatattgaagagaaagactgagcgaaagaagaaagccaatgactatctagtttttaaaagataatctagtgagatgcagacaagatggtagaatagaaagctccaccgttcgtcccccgaccccgcaaggacaccaagttaacagctaatctacataggaaaaacaccttcttaagaaccaaaaatcaggtgagcactcatggtacttgatttccacttcatatccctgaaagaggcactgaagtgatttaaaaaaacaaaaacaaaaacaaaaaaaacccgtcctgaatctgctgacaccacgcctcccttactgggggcgaagagcatctctgggcactaggggagggagaacacagcaattgtgaggcattaaattcagtgttgtcctgttacagcagaaaggaaaaccagaccaaactcagctgatgcctgcccatgccagggggaatgcagatccctgtggtcggaacttgagtgcctgcaaaccttgccacagagggctacagcactctgagtctccaggtcaatgtgaaaggcagtctaggccataaggactacaactattaggaaagtcctagtgctgaactaggcccagagacagtgaactgggggtgggagggcacgtgacatactgagacactagctgggacagacaagggagtgctggcatcactgctcccctaatcccaggctgcacagttctcagctccagaaaagaccccttccttccacttgaggagaggagatggaggagtagggaggactttgttttgtatcttggatactagcttagccacagcaggaaagggcaacagactgaattgtgaggcctctgttctaggccccagctaccagacaacatttctagacacactctggcccacaagggaacccactgccttgaaagaaaggagctggtgccagcagcattcatcacctgttaactgatgagcccttgggtcacgaataaccagcagcaatatccaggtaccacgtcgagggccttgggtgaggctctgggacatgctggcttcaggtaccagcacagctactggggtccaaaatgccaagtgtgctcttggggtccccagttccaggacttgacccttggatggcatttctggacctgccctgggccagtgggaagtccactgctctgaagggtgagtcccagaccaggtggcattcactacaagctgacttaagagcctttgggccttaagggaacatcagggctagtctggcagtactcctcatggtctggggtagtggtgattacagggtgaggctcctctgcctttggaaaggggagagaaaactgggaaggactgtattttgtgttttgagtgtcagctcagcagcaataccaggttgatgtctaagacttttgactctagttcctgacccccagatggcacctctggacctacccagagagcctggcagacctcactgccctgaaggggaaaaaacaggcctttatcacctactgattataaaaccccagggccttgagtgaacataggcagtagccagggagtggttacagcaggacttgggtgagactcagccctttgttggcttcatgtctgactcaacaaagtcatagtggtggtggccacaggggtgcttgtgtcactccacctcaagctttaggtggctcagaacagagagagagaaactctttgtttaagagaaagcaagagagccgggcgcagtggctcacgcctgtaatcccagcactctgggaggccgaggcgggcggatcatgaagtcaggagatcaagaccatcttggctaaagcagtgaaaccctgtctttactaaggaatacaaaaaaattagccagacgtagtggtgggcgcctgtagtcccagctactcgggaggctgaggcaggagaatggcgtgaacccaggaggcggagcttgcagtgagctgagatcgcgccactgcactccagcttcggcgacagagcgagactccatcttaaaaaacaaaaaacaaaaaaaaaaaaacaaaaaaagagaaagcaagagaagagaacaagactctctgtctggtaatcaagagaattatcacagatcttgtccaagaccatcaaagcagcacctctatgagtctgcaagaaccacagcattactgggcttggggttccccctaaagtagatacagcttagatcacaatacccaagtcctgttaaatatctagaaagcctttctgagaaagatggctacaaataagcccagacagtgaagactaaaataagtacccaactcttcaatgcccagacaccaaagaacatctgctagcatcaacaccatccaggaaaacatgatctcatcaaatgaactaaataaggcaccagggaccaatcctggataaatagagctatgtgacctttcagacagagaattcaaaatagctgtgctaagaaaacacaaagaaaattcatgataacacagagaagcaactcataatcctatcagatacatttaacaaagagaatgaaataattaaaaagaatcaagcagaaattctggagctgaaaaacacaattggcatactgaagaatgtatcagagtcttttaatagctgaactgatcaaggagaagtaagaattagtaagcttgaatacagactatttgaaaatacagagtctgaggagacaaaaaaaaaaaccacaataaattatgccttgcctacaggatctataaaatagccttaaaagggtaaatctaagagtaattgggctgggtgcggtggctcatgcctgtaatcccagcactttgggaggccgaggtgggtggatcacagagtcaggagatcgagaccatcctggccaacatggtgaaaccccgtctctacaaaaaatacaaaaattagccaggtgtggtggtgggtgcctgtaatcccagctagttgggaggctaaggcagaagaatcgcttgaatcagggaggcagaggttgcagtgagctgagataacaccactgcactccagcctggcaatagagcaagactccatctcaaaaaaaaaagaacaaaaacaaaaaaaacagtaattggcctattggccttaaagagaaaataaaggacaagataggggtagaaaatgtatttaaagggataataacagagaacttcccaaacctagagaaagatatcaatatacaactacaacaaggttacagaacaccaaggagatttaatgcaaagaaaactacatcaaggcatttaataatcaaactcccaaaggtcaaggataaagaaaggatcctaaaggcagcaaaaggaaagaaataaataacatacaatggagctccaaaacatctggcagcagacttttcagtggaaaccttacaggctaggagagaatggcatgacatatttaaagtgctgaaggaaaaatcttttatcttataatagtgtatctggcaaaactatcctttaaacatgaaggagaaataaagactttcccagacaaacaaaagctggagaatttcaccaatagcagacctgtcctacaggaaatgctaaaaggagtacttcaatcagaaaaaaaaaaaaaaaaattaatgagcaataaataatcacctgaaggtacaaaactcactggtaatagtaagtacacaggaaaacctagaatattataacagtgtaactgtggtgtgtaaactactcttaccctaagtaaaaagactaaacaatgaacgaatcaaaaataataactgaaataacttttcaaggcatagtgagtacaataagatataaatagacacaataaaaagttaaaatgccaggggataaagttaaggtatagagtttttattagttttctttttgtctctttgtttatgcaattggtgttaagttgttatgaggttaaaatgataatatcaaaccaaaacaacacacagtggagacacaaaaaagaaaaagcaagaaactaaaacgtatcaccagagaaaatcacctctgctagaggaagataggaagaaaagaaagaaggaagagaagacaacaaaacaacgagaaaacaaataacaaaatggaggagtaagtccttacttataaataataacattggccgggagcggtggctcaatgtgtataatcccggcactttggaaggctgaggtgggcgggtcacctgcctgggaggtcaggagttggagacaagcctggcaaacatggtgaaaccctatctctactaaaaatacaaaaattaaccaggcgtggtggtgtgtgcctgtaatcccagccactccaaaggctgaggcaagataattgcttgaacctgacaggcagaggttgcagtgagctgagatcgtgccattgcactccagcctgggtgacaagagtgaaactcagtctcaaaataaatacatacatacatacatacatacatacatacatacatacatataatgaatgtaaagggactaaactctgcaacaaaaagacacagactgggtgaatggatgaaaaaaacaagactcatttatatgttgcctacaagaaacacacttcactataaagatccacatagattgaaaataaagggatggaagaagatattctatgctaatggaaaacaaaaaatggcaggagttgctatacttatatcagaaaaaatagatttcaagacaaaaactataagaagatataaaaaggtcactatataatgataaaggggtcaattcagcaagacgatataagaactttaaatatatatgcacccaacactggagcacccagatatattaagataaagcacatggtattagagccaaagagagagataagcctcaatacaataataactagagacttcagtaccccactttcagaactggacaggtcttcaaatagaaaatcaacaaagaaacatcagacttaatcttcatgatagcccaaaaatcagcagcatttctatatgccaagaattagtagaagaaaataataataaagatcagagcagaaataaataaattgaaatgaaaaaaatacaaaagatcaataaaacaaaaagttggtttcttgaaaagtcaaacaaaatagacaaatctttagccaggctaacaaagaaaaaaagagagaagatccaaataaaaccataaatgaaaaacgaaacattgcaactgatactgcaaaagttcaaaggatcattagtggctactatgagcaactatatgtcaatatattggaaagtctagaagaagtggacaaattcctagatacatacaacctaccattattgaaccaggcaaaaaaatccaaaacccaaacagaccaataacaagtaacaagattaaagccataataaaaaatcttccagtaaagaaaagcccaggacctgatggcttcactgctgaattctaccaaacatttaaagaagaactaataccaaccctactcaaactattccaaaagacagaggaggagggaatacttccaaacttgttctacaaggccagtattactctgataccaaaaccacagacacatcaaaaaaagaaaactacaggccaatatttctgatgaatattgatgcaaaaatcctcaacaaaatactagcaaactgaattcaacattacatcagaaagtgggatttatccctgggatgcaaggatgattcaaaatattcaagtcaatcaatgtgatacatcatatcaacagaatgaaagataaaaatcatatgatgatttcaattgatgctgaaaaagcatttaataaaattcaacatccttcatgataaaaattctcaaaatactggggataaaaggaacacatctcaacatatggcttttattaaaagccataaatgacagacccacaggtagtatcatactacatggggaaaaactgaaagcctttcttctaagatcgggaacatgacaaggatgcctgatgtcaccactgttattcaacatagtactggaagtcctagctagagcaatcagaaaagagaaagaaataaaaggcatccaaattgtaaaggaagaagtcaaattatccttgtctgcagatgatatgatcttatatttggaaaaaccttaagattccacaagaaaccattagaactgatacccaaattcagtagagttgcaggacacaaaatctacatacaaaaatcagtagcatttctaaatgccaacagagaacaatgtgaaataaataaaagaaatttttaaaaattccatttacaatagccacacataaaattaaattcttaggaattacccaaagaagcaaaagatctctataatgaaaactataaaacactaatgaaataaatcaaagagaatgccaaaaaaggaaaaatattccatgttcatggataaaatccaatattgttaaaatgtccatactacacaaagcaatctacagtttcagtgcaatctctatcaaaatgccaatgacattcttctgggaaatagaaaaaagaatcctaaaagttacatggcaccacaaaagacccagaatagccaaagttatcctaagcaaaaggaacaaaactgaaggaatcacattacttgacttcaaattatactacagagctattgtaagcaaaacagcatggtactggcataaaaacagacacacagagcaatgaaacagaacagagagccaagaaacaaatccacacacctacagcaaactcatttttgacaaaagtgccaagaacatacactgggaaaaagagtttcttcagtaagtggtgctgagaagacaggatatcaataggcagaagaatgaaactagacttctatctctcaccatatataaaaatcaaagcaaaatcgatttaaaaattaaatagaaaacctcaaactatgaaattacttcaagaaaacattggggaaactctccaggacactggtctgtctgggtaaaaatttcttgagcaataccccacaagcacaagcaaccaaagcaaaaatggacaaaggggatcatatcaagtcaaaaagcttctgcacagtgaccaagaagcagcttctctgctccttctggaatctctgcctggttcaatccacttgcctctactcctgcctccaccatgtccatcagggtgacccagaagtcctataaggtgtccacctctatgggcagcagcagcttccgggggtggcctgggtggaggctctggtggggccggcggcatgggaggcatcaccgccgttgtggtcaaccagagactgctgagcctccttaacctggaggtggaccccaacatccaggccgtgcaggagcaggagaaggagaaggagcagatcaggaccctcaacaacaagtttgcctccttcataggcaaggtacggttcctggagcagcagaacaacatgctagagaccaagtggagcctcctgcagcagcagaagatggcttggagcaacatgggcaacatgttcaagagctacatcaacaaccctagggggcagccggacactctggtccaggagaagctgaagctagaggcagagcttggcaacatgcaggggctggtggaggactttaagaacaagtacaaggatgagatcaataagtgtacagagatggagaatgaatttatcctcatcaggaaggacatggatgatgcttacgtgaacaaggtagagctgtagtctcagctggaagggctggctgacgagatcaatttcctcaggcagctgtatgaagaggagaccttggagctgcagtcccagatctcggacacatctatggtgctgtccaggacaacagccacttcctggacatggacagcatcattgctgaggtcaaggcgtagtatgaggagatcacccaacctcagccgggctgaggctaagagcatgtaccagatcaagtataaggagctgcagatgcaaagactgagatctccaagatgaactggaacatcagccagccccaggctgagactgagggcctcaaaagccagagggcttccctggaggccaccatcgcagatgtcaagcagcgtggggagctggccattaaggatgccaacaccaagctgtccaagctggaggctgccctgcaacaggccatgcaggacatggcgtggcagctgcatgagtaccagaagctgaagaacatgaagctggccctggacatcgagattgccacctacaggaagctgctggagagtgaggagagccacctggagtctgggatgcagaacatgagtatccatacaaagaccaccagcgcctatgcagatggtctgagcttggcctatgggggtctcacaagccctggcctcagctatggcctgggctccagctttggctctgacatgggctccagctccttcagctgcaccagctccaccagggccatggttgtgaagaagatcaagacctgcgatgggaagctggtatccgagtcctctgatgtccttcctaagtgaacagctgcgacagcccctcccagcctgcccctctggtggctgccccagagcctgggagggaggctgctgtgcagcggagcacagggaatgggagacccacctgaggctcagccctagccctcagcccacccacgggggagtttactgcctggggaccaccttgcccatgccttcagctacaaaacaactcaactgcttttatttttttccccccaaaataaaacctcagctagccctgaaaaaaaggcttctgcacagtaaaaggatacaatcaacaaagtgaagagacaaccaaaataatgggagaacatatttgcaaaccctgccaggggattaataatcagaatatacaaggagctcaaacaatgctataggaaaaaaatatataataatctgatcattttaaataggcaaaagatttgaacagacatttctcaaaagaagacatacaaatggcaaacaggcatatgaaaaggtggtcaacatcactcatcatcagagaaaggcgaatcaaaactacaatgagctattatctcaccccaggtaaaatggcttgtatcccaaaagacaggcaataacaaatgctgtcaaggttgtggagaaaagggaaccctcatatactgttggtgaaaatgtaaattactacaaccactatggagaagattattttttagttttgaggttcctcaaaaactaaaaattaagctactatttgatcctgcaataccactgctgggtatatatccaaaagaaaggaaatcagtgtatacaagatatatctgcactcctatgtttgctaaagctctgtatataatagttaagatttggaagcaacctaagcatccatcaacagatgaataatgcataaggaaaacgtggtacacatgtacaatggagtactattcagccataaaaaagagtgagagccagtcatttgcaacaacctggatagaattggaaactattaaataagccaggcagagaaagacaaacatcacatgttctcacttatttgtggaatctagtaatcaaaacagttgaacccatggacatagagagtaggagaatagttatcagaggttgggaaggtagagggaggatgggagggaaaaaaatagaatgaataagacctactatttgatagcataacagggtgaccacagtcaataataacttaattgtgtattttaaaataacttaaagagtgtaattggattgtttgtaactcaaaggataaatgcttgaggggatggatactccattttccatgttgtgattatttcacattgcatgcctgtatcaaaatatctcatggctgggcacagtggctcatgcctataatgctagtactttaggaggctgaggcaggtggatcacctgaggtcaggagttcaaggccagcctagccaacatagtgaaacccctgtctctactaaaaatacaaaaattagatgggcgtggtggtggatacctgtaatctcagctacttgggaggctgagacaggagaatcgcttgaactcaggaggcagaggttgcagtgagccgagatcgtgccattgcactccagcctgggcaacagagaaaaactcatttcaaaaaaaaaaaaaaaagcaaaacaaatgaaaaaaagcaccttatgtatcctataaatatacacgcatactatgtacccacaaaaataataattaaaaaagataatctagtgaaaagatgattcaggactgatcagaggcaatagttaggcaaaaaaattaaaactgctttgacaaacttttggcagataaaatttgtgattggttgaatgtaggcactcagtgagaagggataaaacagaaaactctagtatggaggactgggtagatgtgacttccccacacgagaaaacagccattgatttaggggcagcaatgaagattttagctggatgtaaagtacccgtgggatgtccaagttgagggagccaggagcaaggtgcctgagctggcacttcagggagaagcctggcatggagctaggaggcaggcaacatatgctcaacgaggaaagagcccagaggtggcatacaggataaacagcaagagaaatatgaagagaactaggaaaatgcagataagtaactgcactatcaataaaatattaaaccacaaatgtgagactcattgccctgtcatgttatctgagaccaatacattcaaaagcaagtataataaaggtacagatgacctgagagcacagaaatgcttagacaaatttggaaaaaaaaacaaacagacattccagatgcaaacctaggattgaacaattagtgtatctttgactatcccccatctcattacccatccagcctgcatcctggcacctagacttgagctctggccctctattaccccctttaggtactgtctcacctgtcccaaatgtgtctttgaatgtccacgtaggttctgaaggtggccttcagtctgtcatgctgaatgagttaaattttccaggaaaatccatatcccaaattattgcttactatgatctcctgcataatgttaagtaacttgggttttactctacatgcttccatactgctacagaataaacactcagcactcgtgaaaaagaatttatggctacagaaaacatatccaagacttacacaagaagatttacagctaagccctgacattaattggctttgtaatccagcttagctcctcttgctccagctgtcatctgcagaatgaagataatggagcagtgaagttgtcacagcatccgaattactatcctgatgggccaggtgtagacagacatccttaagtctgtcactagagagagcaaaacgtcttcatgggggcaatatcattttacagtatttggggcactgaaatattcctttcagagtgtccttactttactacaaaatgtcctaccagggaaagaaaaatattatcaattctattgaaagaaagcattaaaggaatctcactagctctttcagtaaaatcaatcaggaaatcatgaatgataacacttattatgcagacatacattatccatccactcctttaaaaatatttatagaaaatttaggttcctgtggctgtgaaactattctcaaaaaactctgcgtaacctaaaaacaaacaaaaccccctggggctcttccctttgctccccagtaattctcctctgcatttttaatatctgtgtgtcaccccctgtcattaataaagctatcaacagtcagtaaaaggcaacagaagtgtttcattgaaatcttaattgccagacatacagaatatcttaaaaactgtcctttaaatgcccacatttctcaaaatcatctcttaattttatttacaattacatttttcactttctgggtgctccattttccatttttagaatgtcttatatatttgggtagattccaaacagaaaatgagttccaagccttggactgaatcactcattccaatgggtgatcctaaaactgaaatgcaggcttacctcaaaaactaagacctcccagccctcactctgtgcatgcaagcttccaccttttttcatgcaagctccccaaggaggacactgcctctcgtgcacaggcaggcccaggagctgatttggagatctttctggctctctgtcgtctgcagactttcagtgctcccatgcatagatattggtccccttcctgaggatcataacaccttcgagttcttccatcctttgaaacctcctcgttgtgacaacgttccagctagacccagcttgcttctactaagtctgttctgtttactgtctcttttgttataaaattatttactcattttattttagtgatgtgaattaaatgggtcatatatgcttttgctagtaatccaagtgatattgaggtttctacattttaataatgagtcacatcctctggtctaccaatgccacttccatcacccaccccttcctagttaaaaatttggctagcatctttccgtacttttctcttatttgtacaaacgtgaaatacatttacataagttcatttaaagggaatgtataacttattctgaattatgatttatatattctgaattgtgatcatttatgtaacacaaagctcgctgcttgcagagtagaattaacaagcgtgaggcctgttagaaagaaagtgactttattaaccaaaactagtcgtggggaagtggttggattcccatccaaagcaactacttcaaattttggtggggaaggaaagagtttaaaaagggagaacttgatacgaaaggcatgccagaactgtgctgaggacgatgcctgtgcatcttgttccagtggctatcttgggtcccagtccacctggtacatggtctggcatcatctcaacagtggcggggctgctgattagccctctgaggccatctctggaactctgcagctgggtctccaggcttggtctgtctgtctcaagattagcccccaaatcttcaaagaaggcacataattagatgctagcgtacagttagataaataagaagggagtatatctggagaaaaacggagggacgtggagtctattttaaggctaaaggaaacaggcttctgtagtttgcttcaaggttacatcttgaaacccaagagaaagaggaaaaaaaaaagttttaaaatgcattttgaggttatgctgcccagttacatttacatcatgatattcttaagccaaccatctttttaacgtctctttcatagtatggatattccggtttttattctaccatttcattactgatggatcttcacattgaatatttcgtcactagaagcaatactgctacttatttcaacgtgtatcttggacattcctgtagttttatttctgaaggctaaattctcaaaataggatggccgtttcataggaaatgcatatgtacattttgaagagatcataagattgctatcccccaaaatgttgaagtaatttattcctctatcaataagacatatagcccctatttcttcaacagcagtgaatgatactaagttgttttttttttttgctgatttgatagacaaaaagaggtattttgttgttttaatatgaacttgcttgattccagtgaggtcaaatggattggttgttttattttccattatgtacactagttgttctgagtggacttggcaacagtgtagttgagttttcccctttcacattttatagattagggatgttaatcctttgttttatgcttttcaaatattctctcccagtttatggtccatcttttatttctatttgttatttctttcaccatacataacatttcagtttttatgtaatcaaactcatcagtgttcttggtaatggctactaggtctcctctcctccttcagaaggcctcttctatgccatggagaaaatgaggctcgacgtccctcaaattccaggccatgcacctggatctgcatctatcttcatcttctgtcagtcttggagaaagcgatgtcttctggtagaaacagaactacctactgtgttcttcacctcttcattgcttcagacaaaagactgcaaaatgacctctgcatggtcacacccagtaaaccatttttaaccctgacctttattgctcattctacacaggtgacccctctgatgatttcataggctctcacttgtgaattcctgaagacatcctggctgtcctcctctccctccagcaattgtatctcagcttcctgagagcacatgccgcttttcctccgtattttcccttggtcttttttcatttaatgcagtcttacttgttgaccccctagctcccaggacttacagtttagtctctatgctgatacatgcagacttgacctccatgcttgcctctctagcacattcccagatttctcagctccagacccatttttatacagactacacatccacaactgagcctgtcatcaccatcagatatttggtgtctaaaagaatggccagggctacatcccagtcacacaggctataggtctcactgtctccatggactcctcaacactatttgtattataaataaacaccataggatttgtgccctctagacccatgacaccctatattccagaacaagagaacaatcggcctggaggttttgcttggatctcttgtacactcttgcaacagtcccccagcagcaactctccagtcattctccattcagttttgcattctgtagccataaaacctgggtcttgactgtgcctcttcccttggaaaaatcctatcttggttctattggtttataatgaagttcaatctccctgtaaggtttaggagaccacgcatggcttgaatcttacttctttcttcaaccttggttctcactctgcttccttctgcctcctcactctgaccatgtcctctcttcagaaaccatatcctgatttccagtttcctgtctactatgttctctctcacctatgtaccattgaacatgcagttccctctgctgactcagtcttaaagtatgatgggaaggctagagcatcacaaaaatgcctggacagttagacacaattattaataaaagtcaaatctcaaaaggcatgctgtctattaatacaaacactaaatgtaaacaagaaaatttcatattaggaagatgaaatcaacgctgcattaccactaacttgaacaaggggtgggcaatagacacagaaatgaaattacccagtgttgaacattcagattgactttggaatctcacaggctttcctaaaaaaacacttcttccctttaaaaaggtactactggcttggtgcagtggctcacgcctgtaattccagcactttgggaggccaaggtgggtggagtatttgaggtcaggagttcgagaccagcctgaccaacatggtgaaaccctgtctctactaaaaatacaaaaattagctgggcgtggtggcgcatgcctgtagtcccagctactcaggaggctgaggcaggataattacttgaacccagagaggcggaggttgcagtgagacaagatggtgctactgcactccagcatgggtgacagagtgagactccgtcaaaaaaaaaaaaaaaaaaaaaagggactacttattgtacattttgaataaaagacgaattgagagcgaggatttgatgcccctcacggcatcttagtgactaaagatttaccatcagggtgggctcagtttctttcaggtaaatgaaaaatggcaaaaataatgcctttcatttctaaacacgaccataaagataaaacataaaaaatgatgacagatttgacgaactaaatctttaaaatgtctgtatgccaaaacatacacaaaaacacacatatgcaaattaaaagataagtgagtaggtggagaaataatcataaccaaagagagttatatcttcaatctataaaaagctctgataaatatgaaaaagataaatacccccaataaataagcaaagatataaacagataacttaaaaaaagatgatcaataataggaaaaaaatcaatcaaatcacatggaaaagaataagataacagtttgaattctaaaactggcaaaaatgggccaggcacggtggctcgtgcctgtaatcccagcactttgggaggccgaggcacgtggatcacctaaggtcaggagttcgagaccagcctggccgacatggtgaaaccccgtctctactaaaaatacaaaaattattcaggtctgatggcaggcacctgtaatcccagctactcaggaggctgaggcaggagaattgcttgaacccgggaggcggggggtgcagtaagcggagatcacaccatggcactccagcctaggcaacagagcaagactctgtctcaaaataaataaataaaataaaataaaataaaatataattggcaaaaatgggccaggcacagtggctcacctataatcccagcactttgggaagccaagagagaaggattactcgagaccaggggtttgagatcagcctcagtaacatagtgaggatctgtctccactaaaactaaaaaatttagccaggcaagatggtgcatgcctgtagtcccagctacttgagaagctcaggtgagaggatcactggagcccaggaggtcaaggtttcagtgagctgggatcacaccagtgcagtccagcccaggcaatagagtgagactctgtctcaaaaacctataattaatttaaaaaattttgaaaactaaataaatacaattggcaaaaatgattgaaaggaagctaacttcaatattgatgagggtgtgcaaacatatgcactcgcaaccactgatgacgggaacataaaaacccattcaaaggctgatatatggatattctctcaaccagcaattcaactcataggggtttatcaagaggaaatatttggacaaattaaaataatatttagccactaaaaatagtaatccacaaccaaaatattaatggtactgagtgaaaaacatgtacaaaactatgtgatatatacaaacatatatatagtataagcctctgttttaattaaaaatatgaaaattaaatgtattaaatataatgtattaaaaatatgttataaaaggttatgtgtgtgcatatatgcgcatgcctaaaatggcctcagaggactttgcaacaaaagtttaacagtctggggccgggcatgtgaaattaattatcgtttttaaatgtttctagatctcatacatatttaaacaaacagcataaatatttcttataataaaacagcaatactattttaaatgtctgttttgaggacaatgtatttaggaaaattgtatatagaacaggaaaggagtacaagcatggaaaagagggaagtcagtgttaaattataaaacctgatcacacactctatttgttcatcatttagaatatacttttcaaatggtttcaatacaataaagccttaaatgttttgctctaagcattcttgatttgatttttcacacatagtatattttaagggctgttcatttgactgcatttggttcatttaaattcatctcatcaaaatgcaaaatttctaagagctattttatcttcaaaaaaatcccatttaagtctaacttatgtcatattttttcttagaaaaaggaaaacaaattttactaaaagtaaatgaacttaagttccaaaagttcaaggttgacacaaaagtaacttaaacaccataagacagaaaaacatactggccttcaattcttattcaaaaagtttatttacccacatatgtttctttagtcatcagtctacaaaacaatttgaaccaatttttcctatcttttaaaatcttatgttacatattcttctttgacatagcaaatgaatgttgagccttttcctggaaaaagaaatcaaagcctgtcattgccatgtgcccctctcctccaatcctgcgactcccagtccattgaatctatctgtcacttagtttcaagaatatgacattaaacatgctgattcctctacttagaatgacttttcaaatcttttatcttccatgcccagcaaatactcagacccaatactccttcaagacccaatctaatcaccttatctctagagactcctaatcactgtagtggagggtgcctcaacttccttcagtggacaaaatctacatgcaacaagttcatgcacacacacacacacacattcacacacagaaattgacacacccactttcacacacatatccagactcacacagatttacacacaaagttcacacacacagattcacacagattctcatacacactttcacacacatatccagattcacacacagatttacatacacaagttcacacgtgcacagattcacacacacagatacacacatacacacaaattcacacagatttacacaaattcacacacacagatacacacagattcacacacacatacataaacacacaaatttcacacacacaaaatcacacagattgaaacacacacattcacacacatttacaaacatataaaaattcaacacagatttatacacacgttcacacacacaattattgggcttatattgtaactatctgttgacatgtctttcttctctagcagactcagcttcttatggaatgccctgtttgcatgccgacatatacacagaacctccccagatgggtgataccccacaacacattccccacaagagtttgctgaattgattaaacatgacctatcatgaacgttatcattattttagattattttctcagtataatacaactccttttaagatccagtcccatagatgtgaagtgggctgaagagtttggagttcatatgacacaagacactggactttcggtgacaaggaaccatggtatcagatggtgctttgaaagtaacattggctgcacacagtggctcatgcctgcaatcccagcactttgggaggctgaggcaagcagacggcttgagcccaggagtttgagaccagcctgggtaacattgcggaaccctatctctaccaaaaaatacaaagattagccaggtgtggtggtgcatgcctgcagtcccggctacttggaaggctgaggtaggaggatcacatgagcccaggaaggtggagatttctttgaggagtgattgcaccactgcactccagcctgggctacaaagcaagaccctgtctcagaaaaaaaaaaaaaaaagtaaagaaaataacttcaaggagggactgagaattgggagcaatttaggtgtgaccaatctagcatggggtgacagggacctgtattaggaggataacaatggcaaacagagaaaaaaaaaaaaatctgtacgatgccccccagcaagtgtcaggaacaggcaagaaaatattttatgaaattcatctggatgtgagaaggtccatgaactgtgttggacaatacatcaagggaggcaattaggcaaggcccctttcccacagaaaccttgagctacactgtttatatgtggaagcacacaaacagcaaggagctgggcacaggttctcagcaggctgatcaatctgaggctccatcagtgctccctctgctgtagaatcctgagcgcttgctgagtatataacgcctttgccacttcttcagagattcctcccctcgccccaaagtgtaagacagacatcattcagtggcatgtactaaaaatacaatggaatgtctagcatacttgctgaattgagaaaacattaatatcccaggctcctcgggtaccagaatggagtcaatgctagaaaccactcttctgagaaagagtcaaaagtgccacagcaggttcaatgagggtgtcaccactaagttaagatgctgtcacaaggctaataaaaagattaaacgtattaaaaggagaactgatactaagacaaatttgatttcctttccccaaaagaataccaagcatctgagatataggaggttaagtgaaggtcaaaagagacagttagattcattcataagcaatttacttttcaggagagattttgaaagattatttaacttagaatgaatagtaaaatattcaaggtagttatatggcaattaatgaaaaagtggaaatgaatattaaattcctagctcaccagtgtcatggtctaacaagaaaaggaaaccaatttctaattttcccatggaatgacttacataaagaatttgtagatcttcatatacaaagacaaatatttaacttaggccaggtgcggtggctcacgcctgtaatcccggcactttgggagggaaaggcgggcggatcacctgaggtcaggagttcgggaccagcctggccaacatggcaaaatcccgtctctactaaaaatacaaaaattaaccaggcgtagtgacaggcgactgtaatcccagctacttgaggctgaggcaggagaatcacttgaacccaggaggcagagggtgcagtgagccaagatcacgccactgcactccagcctgggcaacaagagtgaaactctgtctcaaaatatatatatacttaacttagattttaagagtttttctcaactaatagagttaggtaaagtaaattacttaactgaactatctgcacattttcccctaatttatctttggaatatagttatgagaaggctggtcaaaaccaagacacaaaggtagaccccaaaaacccaacagggagagggggaatcatgttttccctcacatgacctctctcacaaagggctataaaagccaaaaatttaaacagacttagataaaaatttgaattatttccaaatgcagagtgctaaccactatagtcaagtcatttaaattccctgtggttaagtctcttatctgcaaaacatgaacatataaatctctttgatgacattattaagcatttcacacattacatatccatctgagaagacagcactgaagcagagaagtccaatattatgtatgcaaaggatgccttgcaggaggaaatcctgtcctccttcagttctcactgatttatagatcctaaaatgtataaaaacaagcattaagtatttttaaaatggaaaacaaaatacactggaatgagaatgtttatccatgtgactttgcacatatgaaagctgaataaatgttctgtatcatccagttatttcagtttcaggagttaaggatactgaggataaaatatcctgattatggtgcctgcatttttgtgttcacggagttatcctgtcatatagatagcctaagggtctctgaaagaaaagatggagttacgaatagaaatttatttctaggaccaaattcaagttcaaatttgcatgataatatctgcagtgctttattcctcttaaaacccaagttaccaagctcttaaactcagctctctttgcattttaatgaacagagtccaagtctgatgcttaaatggtttgtttttattttaagcttttgaatcccgcataagacctaccacagtgctaggtactcagtgggtctctaaaaaacttattggctgtttttaaactgtaccttacatgtctctgaattataacacatgatattaaattcagcagcaaggaaaataagcctttaagttcttactttgctatgcttccttgctatatggaaagacagtgtttatgaaaatgtgattgctatggcttacatgtctgtccccttcaaaactcatcttgaaatttggctgccattgtgacagtgataggaggtaggacttttaggaggagatagggcgataatccccaagcggatgggattaataccattataaaagggtaagttgtgtgcctttttatctcttggcccctttgcccctgccatttgaagcctctttgatcccctcgctcaggaggacaggacggcatacaaggtgccaccttggaagaagagaacgaccttaccagacacaaaacctgctggcaccttgaccttagacttcccagcctccagaagagtgggtcaatacatttctgttctttgcacattacctagtctgtgatattctgttatagcagcataaatgcactaagacaatgaccattctatgtggcaaaggctagaaagaggtatagggtttagagttagcttctgaagtgaccagctaggacagaaacactgcgagaaattctttgtgaatcatggctttttcattcctggagtcacttttccttcgataaacaaacaaaactccacctgtgaatataatagtctcatatccaaaagggctggctggtgctgggagaacaggatatatactcctgaagcctttccttaagtggtagaatcattcttcactgatgaatccaacaattattcctgagattgatgtgttgatttagcaatgctctatcactcagcatctctctgtttatgcttttcctctcccagagggcagccattctaaagagttatccctctctgcaagtagcgagactcataaactctacatgagcatatttaaggacttccaccattcaaatgaaaaaaattaccaaatagcaaatgatcctataaagaaaaaattttcaaatgaaaataaaacaaccctcagaaaagccatacaaaaatataacccaccactatcctctgaaacctttggaaatctctgctgtcttactgaagtacttggagttttaaatgcagtttactggctaagactgaaaatagctgggcgcggtggctcacgcctgtaatcccagcactttgggaggctgaggcgagcggatcacaaggtcaggagatcaagaccatcctggctaacacggtgaaaccccctctctactaaaaatacaaaaaattagccgggcgtggtggcagatgcctgtggtcccagctactggggaggctgaggcaggagaatggtgtgaacccaggaggcggagcttgcagtaagctgagattgcgtcactgcactccagcctgggcgacagagtgagactccgtctcaaaaaaaaaaaacaaaaaacaaaaaacaaaaaacaaaaaaaaaaaaaacactgactatatttacatatgcctggacagagaacatagaacactgtacacaaaacattatctgatatacctttaaagttattcttaaccaacatgagggaaaatctgtcattagtcaataaacaaagtcaattgctgagaggaacactctgtacattcagaaaaattagaattcctgccttgcccctaaaaagaatttaaacatagctgctactgattagagacagggtatttcaaagtccagccaggaaaaaataatcagaataattccccttgctcctagatccaggagtcagaaggtgaatcacaagcaaaaaattcattaatttatgcttgtatatcatgattttccagctctctaaattaagggaaaaaagccagccatacaatgaattgtgggcatatcctataaatggattttcagaaatattgtcaaagttcttcaaattaacttttcaagaccaattcaacaaatacctttctgggtttctttcttttctttctcttttcttttcctctcctctcctctcccctcccctcccctcccctcccctcccctcccctcccctgtcccatcccctcccctcccctgtcccatctcctcccctcccctcccctcccctcccctcccctcccctctcctcttctcttttcttttctttttgagatggagtctcactctgtcgcccaggctggagtgcaatggcttggctcactgcaacctccacctcctgggttcaagtgattctcctgcctcagcctcccgagtagctgagattacaggtgcctgccaccgtgccaagctaatttttgtatttttagtagagactgggtttcaccatcttggccaggctggtcttgaactcctgatctcatgatccacccacctcagcctcccaaagtgctggggttacaggcatgagccactgcacctggcctataaatacctttcttggactatattagaaattaactttcatttttatcgtaagtacttttaactctaaaataaaattaatatcaaatcacagtaaacatttaagcatatctaaaaatgagtggttatgggggccatgtcctccgacagcaaactaacttcccttacacaccacatttgtcccgttacccattggctgcatttagttcttctaactgcacccaattcctatattctggaaaattctctggctccattcatttattccatagatatttactccaattatctcaagggtaatgcagggcattagtgtttacaaacattcttcaaacctgtcataattctattcttctcttatttcctgttagcagttatttacatgcgtacatatgaatgattaaaagatataaaaaatgctcagtaaatgttggtaattatttttgattccacatttcagggcaaatatactgagtatttcatagacttacattattattattattattaatttatttatttgatatggagttttgctcttgtcgcccaagctggagtgcaatggtgtgatctcggctcactgcaacctccacctcctgggtcgaagccatctcctgcctcagcctcctgaatagctgggattacaggcgcgtgccaccatgcccggctaattttttttgtgtttttagtagaaacagggtttcaccatgttagccaggctggtcttgaactcctgacctcaagtgatccacccgcctcggcctcccaaagtgatgggattacaggcatgagccaccacgcccagccaatttacattatttaacacatcaacctgattaataacatctccaatattacaaaagcaaaagctgggtttccataggataagtaactacctcagtgtcaccaaggcacccaatagaggagccaggattcacccccatttagcctgaccctatgtgctgggtaataaggggaaagttgtatataagttcagtagacaaaattaaaaggaggtacctttgggaatgtcataataatgcaacgtacctccttctaactacgtgataaagcattataagtatctagatttgataatatcctgatattggcatctccgaagttattgtgtttcaatagttagcattaattcgaaactaaaatgtactctgctaatgctatctgtgagaaaccactaaaatgttctgctatgattgtcagaaatatgtctttatatgttcatggagagggcaaaggtacactatgaacactactgactgagacacattatcaccccattaccatgttctggttggtgagtaagtgtcctgggaatctcagaagagaaagaggtcctgtgccatcctctccaatatgactatgagttaaggtcatagcaatcaggacttgaaatctaccacgaggggctataagccggttcgtaatttgacagctgctgcatattaaatctaatatcaagagccaaacagtatttctaatcaagtaaatggatgactttttcccttgaaacagaaaaagaagttctgtaaacatgtgtttgaaggacacagaaaaagagagagagagacagaataaattaggccaaaagatatatgaactgttaaagcttgcaattaagacacttgttcttgattatttaaagaaatgagttcagttccatcaacactgaccgagtgccttacatgcccgtgataggcactgtggcaggtcctactaatgcagacacaatgcaggcatcagtgctctattagtccaatggtcatgtgaaaggtaagctatatagttaaaatcaccagatccaagtggaagaaggctgtgacttattcacctcgctattttaataaagaactacattttaacaaacatttaattaaaatgtttttataagaacataacataagcacacagtagcatttattcttatttttgcttttttgagatggagtctcactctgttacccacgctggagtacagtggcgcaatctcggctcattcaacctctgcctcctgggttcaggcaattctcctgcctcagcctcccaagtagctgggattacaggcatgcaccaccacattcagctaatttttgtgtttttagtagagacagggtttcactatgttggccaggctggtctcgaactcccaaccccaggtgatctgcccacctaggcctcccaaagcactgggattacaggtgtgagccaccacgcccagcccacagtagcatttattaaaacctggggttacagttgtcactgacataaagactagtctcacttcttgacctggtagcaactatcaaaaataaaacatagagtctcgggaacaaatggtagtccttcccccttacagaacaatggcaataaatatatttatgataatataatagtcataatgaaaataaacattactgtgttgttatgcaaagaataggttaatctgatgattatacatgcataatatgtgattaaatataagcataatagactatcagttaggttgcagtgatttacctttaagaatatcaaaataaacctccttgatgattacaaaatgactttcctcataaagaagcacagaaagaaagtaatcttgactagcaaaatgaaagctttactcatttgaattatcatgcagaataaagggagagaaaaatgtatctatgttgcaaggagattatacatctttcataacttggctctcaataatacaaataactagaaattttcatattttctttgggaaaaaagttacatatcaacataaccatacttgaactaagtgagtttttgagttttttttttttttttagatggagtctcaatctgtcacccaagctagagtgcagtggcactatcttggctcactgcaacctccgcttcctgggttcaagcaattctcctacctcagcctcccaagtatctgggattataggtgcatgccgccatccctaactaatttttgtatttttagtaaagacagggtttcaccatgttggccaggctggtcttgaactcctgacctcaagtgatctgcctgcctcagcctcccagagtgctgggattagaggtgtgcaccgcggcgcccaccggaacaaagtgagttttgctgtgagaaaggccaaatttcagtaagaaataggatgatcagaatgtaatattcctcacattaacaaaaaaaaaaagcaaacaatattaaactaggatttctaaaaaacaactgagtttcccaggaaatgggaacttcataacactgtccagccaggtgggcactatgtccaggcagtgtccctgtgctttgtgcggtcctgctttgctttattagagcagagctcatttttcttttttttggagacggagtctggctcagtcgcccaggctggagtgcagtggcgccatctcggctcactgcaacctccacctcccaggttcacaccattctcttgcctcagcctcccgagtagctgggactacaggcgcccgccaccacgcccgggtaattttttgtatttttagtagagactgggtttcaccgtgttagccaggatggtctcgatctcctgacctcgtgatccacctgcctcagcctcccaaagtgctgggattacaggcgtgagccaccgcgcccggcccagagctcatttttcatcaccattaacgtacagtgccataaagaaagcttctgggtggcacctggcacacggtgggtgcgcagtaagttgcagctgtcattaccgtcactatgagtgtggaccggatgaaagctgaggtcaccatcctctcactctcttccactcccaccagctctcctccccctgcaaagcaccccacctttgggcaccatggctcatcaatcttgtactgttatgctccagctgaaattctgggatttctgacaaactgtatgactgtgatgttttatcttattacaaattttagtgttctttacatagtcccttatgccataaagcaacacaaacacatacccttgagatagttcacatggggtcatacctacgcagattttaaaaataccaccactagacttttttgcctttttctcctttgtttcattgtaaatatcttcaatctctctctctctctcaaaaatacaaaaatgttacaagaaatttaaaaaaaataacactgatagctcctaccatccataaacagatatattcgtattttgctttctttcttcccagtatttttcttcctcattcacacttctgggaaaagaaaggatagtgactgtatgtttaaacagctgtactcataagtacactttttttttgtcttccctttttaaacatttaactttaaatttaacttttaaaatttaatatgtgttttttctgtgtttcagattatttgcaacgcattcaaaacacatcttttcatggtgtaaccgaataataatgaatgtggctctaagccttcccagatactcataacagcaacatttatattaaaagtagagatacacttaggcttattgttgatatttgcatttgtattctcaatactttcgaccattactagaaatctggtcttgcaactctgtttgttttctcactttaaaacctccctggccattataaacatatattcacatattgctttatgtttttgtttctgtcatggtaatactgtacttgacatttgtatctccaacagcatctggcacagtattgtgcacacagtaggcattaagtaagcactttaaaaactgaactcacttaagggatttcaataaaagggctaactcgttggaaattaaataatttgtgaatgagacaccaagtaaatgtattagtcactttctgacttgatataattttcacgtaagatgtgtgtgtgtgcatgtaaacacatgtgagcttatctccaaaagtgccagatgtctttatctttcttctcctttcctttaaaataaaatttatatgtttttaatagcaaagtaataaatgctcattatggaatttttcatatatatggacaaaaaaggacttttcattgttcatgtctaatagtaatatattttaggaataatactaaccttctgagaccataaaatttccattcagattatttttccaaatgaaaagaaagtatctgagagaaaaattttaaatacctgctgataaacatactaaacgaaaagcaaaagtaatgaccttaattccaactttgtatcaaccttaatctatctgcaaagttagccatctttcttttttttattaagatagtgaaccaataaagcagaaaacaagtggctagtacaacatatttcaaagcatccattgatcttgcggctttcttgccactttccatctgaatcttctgtccaccagtcttgaatgggattgcaacctaaatcagtttcactaaagcccacatcacacatagacagctggctctagtcttaatgaagactaatgaaaacaatgaaagccacaatgaaacccgtaagaaacactgacataacctacagactcatcaagctttcatcagtactctggaatacttttttattatgagtgaattggtgaaaaaacaaaacaaaaacaaaacaccgccatgacccggcacagacgcaacgtgtcacttaggagcacatactctgggcacacaacagcctcatgatgatcattctggcaacgtgggaatggctggccccacagactatcctctccaggcctcgtatcaactagcctctcagcttgggagctactctagttcaaagtcaccaggtctgatgatatcatagacacaggtggtcactgtctcatggggggccctcctctgaaggaacaggagccagattcctgaatggcgcactccttcccatcaggctgtgctcaagatgcatcaggctgagattaggctacaagccccagatggttgttaggaaaccattacaaatggctccaaatttaaggatagaggcaagggacagaggtaggcaaacacagctaggaatacacaggcagaatgatactttcttttttttttgtaagtgtcacatcagaactttgtttttctttataggtacatttttgttagtatcatctaaactggccacatgtcgtgttctgctttgctaagtgctgagtatcctcttcttaatttttttaaattaaatttaaaaaatttttcacggatacataatagttgtacatatttatggtgcccatgtgatatgttgttacgtgcattgaatgtgtaatgatgaagtcagggtatttaggacatctatcacatcaagtattcttaaacgatgcaattgtaagattattcttgtgaagaaaaaaatgactaaaaggaacatttaaatggactcatgttcatctcttctgtgtactctgaaaattttaataccaaatatcacctaatatataagcttttttttccacaatcaatacaatgggtgggagggggttcaccttgaggtattgaatacattaagaatttaggttaaacttcagttaagctaactcagcagtaatttaaaatgtttctacaatgaaggataacaattttgacaattatacagcaagtgtgaaataagtaagtaataataatcctttgtaataataataatcctttgtaataataatcaaaattagtgatattctgacccacattcaaattcctatgtactgaactgctagaaaaaaaaaaaaaggcatgttaggaaaaagaagagattccaataatagcagttagtatacagcttcacagtttacaaagagtcttcaaaaccagaacctcatttttttgtttgtttgtttgttttgagatgttgtctcaccctgtctctcaggctagagtgcaatggcaccatcctggctcactgcaacctccacctcccgggttcaagagattctcctgccttggcctcccgaatagctgggattacagacactcatcaccacgcccgggtaattttgtatttgcagtagagacgaggtttcaccatgttagccagctggtctcgaactcctgacctcaagtgatttgcccgccttggcctcccaaagattacaggtgtgagccactgcagctggcccaggacctcattcttgtaacagctctgtggaataggtaggctatttataatccaattagatgtatttatctttgaactcattaaacacaatttatgaatacttgtttcagggatgcattttctggcaacctcttcagattcagctttatgatgaatatctggttacttgtccccatttgggttctgtggggatttgtacagtccagcattgtgccgatcagtattggaactgctcatcatgtacctactgacttatcacctgcctgcttccaaacaccactgcttcagaatctgcaaagagtaaaacagacacaaccaaaagaggtgtgttcactttttgccctgtacattagataaccacagactggatatatggttatttgatggagaaataaaaccaagtaggtaccctagttctcttcaaccttgacacaacagctttatgtagatgtcaacaaaaattttaaaagattcagaaggatcaaaagagtgggacatagaaaaggatcaacattaattttaaaaatatactttattataagaaaaaaataatgtgtggtgtacaagctgtaaaaggatgaaatgtaatgcgatctcagaatgtatgtcaaagatacttccaaagtcagctaacacatcacgattacaaagcccacaggacataacctttaaatcctctgaacaatcacagacatgcaaggcagggaccatttacagaaggacactacgcgaaatgatgacaaccagaccaaggagagacaagtgctgctggatacgatgtcagctaaagcattaactcttctactgtctgaatgtggaaagcaattatatacgaaacagaattaggggttaattaggaagtataagagcacagcccaggaatatagaagtaaagtcagaaagacccagaggcaagtacaatcagcaaagctatcgagggcaattgggcatctttctagaacaactggttgcatatgaaagaaacagaaaaatttaggttcactaatcaatgacaggtgaaataaactgatcatatgcaactggatggcacgtctattttgtgcttttgaaaagaacctgagaagcccttggtggaatgctacatatctggaaaacaatctatcaatatcaataatgaaagccattccatcaaacttataaactttatttatatattcctcatgtgaaactatggcatcatctctctggactttacacagtacggtttatcactgaaatctcacaatacggttccactgggttcagcaaacaaagggcctattttgtttctggaccagatctcttgccttcaagttgcttgctgggggctagatgtatgaagataatgaggctatgaaagggtgtgtaccaggagccagcgggcccagaggaagggcaactggctcaaactcaagggcagtcacacccaaaggagagtcaggatagggcagggacaggaacagcttttagcagagaaaggaaaattttggtagatattaaaaaaggctaatgtcgcttttgttaagtgtgtttctagataatttattctagaataatctaaccattaaaacactcctttgggccaggcacggtggctcacgcctggcctaacactttgggaggccaaggcagtggatcacttgaggtcaggagttcgagcccagcctggccaacatggcaaaagcccgcctctactaaaaatacgaaaaattagcctagcgtggtggcgtgcgcctgtaatcccagctactaaggaggctgaggcaggagaatcacttgaacctaggaggtggaagttgcggtcagcagagattgtaccactgcactccagcctgggcaacagggcaagactctctcaaaaacaaacaaaaaaaaaactacccctttggaagagtagtcttaaacctttttgctcaaattcttcatgaaacaattctgagaaaatcacatgccctttgcatactttaagtacaattaacagtattttatcttacatataaataattacaaaaatgtagtttagatgtaaagactgcaaattctaaataaacattttagaatctcctaaatatatccaatggatctcaattcatgatatgatatccactattattaattttaaaaatacatgaacaagttccttttaaaagtctggacattttacagccttccccttcctcttttctgtttgaagtctacttctattggattttattgtaatatattttgattcttcaaaatctttcattgttcactccatatacatttctgcaacaaaaaaatatgtatgacttgcatggtaactgaattacataggctagtttattagctagaccacttagaggaatttagtatgaatgaaatgaatatgtcatccaagttcactgttagttacagaatgttcacatgctcaaattgttcctatgatgttaattctaaaaagtacagtggtcaaagcctgaaatacttcctgatgtgactgaacatgatattttttggatattatgtagaaatacttcctttgcttttcctgtgctatagttaagctcttcctttcttagagcttattttctctctgaataatctttcagaaaatcacctgagctgggcgcggtggctcacgcctgtaatcccagcactttgggaggctgaggtgagtagatcacgaggtcaggagatcaagaccatcctggctaacacggtgaaaccccatctctactaaaaatacaaaaaattagctgggcactgtggcgggtgcctgtagtcccagctacttgggaggctgaggcaggagaatggcgtgaacctgagaggcagagcttgcagggagctgagatcgtgccactgcactccagcctgggtaacagagcgagattctgtctcaaaaaagaaaatcacctgaaacataactatgatatccctcatggcaacaaaaaattgttcctgagttttctttttttctttttcttttttctttatttttttttgagactgagtttctatcacccaacctggagtgcagtggtgcaatcttggctcactgcaacctccgcctcccgggttcaagcaatcctcctgcctcagcctcccaagtagctgggactacagatatgtgccaccacacccggctagtttttgtatttttagtagagacgggttttctccatgttggccaagctggtcttgaacccttgacctcaggtgatccacctgccgcagcctcccaaagtgctgggattacaggcgtgagccactgcgcctggcttgttcctgatttttcttgaggtttggctctaacaattacagttattgtttttttttaaatatctttagtgttgctctatttgaataattttagtgttatttttaaatagaaataataatttcactgctaatccaaaagtaaataaaaatcacttttccaaagataaaaagtaaaggagttaaggttgaacatgtgttcctctctgaactagagttctaataacacctatattatcaagtctacttacttttaacaggctccatttgagttactaatgctaatgttaatgaataaataaaaagtttacaaatagattcatacttcatagcaaagaaaataagctcattgaatattaatgtcataatcaagttgtacaatgtatacttttaacttaatccaaaatgccttcacaatttctaacaagtttgctgtagaaactcagatacatctggtgaaaaaaaaaaattccaaatttaattgcctaacactgcttgtaataataagactgtaacaagatacaaagatatcaagaagtcaagactgtagacatctcaaagcaggtcaaataacaacatattaaaacccccttttaaaaatatgtggaattctaaataacttataggcataaaaccacttattatctgcccccttcccgtgaaatttttgaaatcataagacaatggtttatcaatttttctttttcttttttgtatttccacaagtgacaactcagcaacttgtaaatgtttcacaattatgcttcaatactttaaaggtaggctgcaaatacgaaatatttctttattattttctcgctaatcatgtccattgagtgaaaggaataattgttaccatgtgatgtttcttacttcatatttactataatttgataagtagatcaatattatatttcaagtatttccattaagtgtgcaacacagatgctcaaaaggtgaaaggcaataacttcctaggcattgaaataaagcaattgtcttctctgtgactcattctttatagaaactaaagcagaaagcatatgatcaatgttcctgtagtgtgaattttctaccataaaagaaaatgcacacattttatattaatggtggaaatcaggtatctgactatcctagaatagctacccaaatctacccttttcatagaacccaataggcatttaatcttaactacagtcatattgagaggcatggttttaaaattaggacagcagagaaagcttagattctcctggcgctaaagggtgaattatttctaccaggggcccagagaaagggactgacttcccaaggaaaggaagcttcatgcatggggaatccgatccccgccacctcctacatacaagagggtcacagaatattggtgcagaaagacactatactagttccgggtttcagacacacgtgaccttcaagaaatgcagggctcctcccaagtctaaatagttatcaaaaatctaactttaggaaatgttagtgaactagttctagtaactaaaaataaacgaaccattaaagcatgctttcttttatgctactacagtatttgtgttaatttaaacttgattttttctcttaacctctatggaaatggacaaaagatacaatgttaccttatatttatatgaaatgtacgaaagttaggcaatgcttccttatttttttagaatatgtggaaaaaaataaacagggctactaggcattttctcctaggccaaacctggcaagtcgtctattttcctattctccaggataatttaacagactttaaacttttctactattttagatgtattttacgaggtggaattaaaaatgaacattgaaaatggcataactgtttcatatccttaaatatttttcccaactcttctttgaaatggttaattatgcacataaagaatagttttgattcacagatttgactctgctgtgattatatatttgaagacctttcttattatgtgtctatattgtatgaattttgcttgtaatacagtaaatacagttttgtctaattgtttcatgcctaatgtttctgacacgctatttatctgttttgaaatgcaccctccaatcttgattcttactcccaacagacatagattgaacttttatcatatacaattttactctgcacaatcttgatcactattcagtaatatgtggcaatgttaaactccataataacaaaccagggcctggtcccccacagggtgacttccactaagtcctttcaggttacaaaggaactgtcattattcctgtgattataggtaaaaataacctgcaatagaattcattcctagataatgactagtattattttacaactgtctcttttcatccagacataattttcatctagaattataatatattgagcattttcaatggtattttacaaaaaacaagtttttatctgaattaaaattaacgagcctttatctgagttaaaatagaatcacgatggaaatgaattcatttcactgtgaattaaccaacatccactgagatcaaaatcaccatctgtgttgccaaaggaagtgtaatatttgtgcatcagcattttcattttaaattttaactttcttataaatttctgagaaattgttttaatcatatcatggaagtctactatttgaagtaacaaatatatgggccccttcaggaaaaaataggctcctatgcaatcgtttttatttcttaatctactgaaagaaaaaatcttgagtttccagatttttattcatttatatactatttcaaccagccattcaacaatatttgatctgagggtctagtacatgccaggcactcacaactgtgaatacagaagtgaaaaacacagaaaaattgctcctcatggagcttacattttagaggagcttttggaagatgaaaaagataataatagcaagtaaataataattagttctataaataacagaaaatatgaagcctaagaagttcatgaaatagaaagaagttgttgcaaggctgggcacggtggctcaagcctgtaaacccagaactttgggaggtcgaggcgggcggataacctgaggccaggagtttgagaccagcctggccaacatggtgaagccctgtctctactaaaaatacaaaaattagctgggtgtggtagtgcatgcctgtaatcccagttactcgggaggctgaggcatgagaattgcttgacccgtggagacggaagttgcagtgagctgacatcacgccactgcactccaacctgggtgaaagagtgagattctgtcaccaaaaaaaaaaaaaaaaagcaattgcagaataattaaatgattaaatattaaatgattaaatgcaggccaaaggactaatcatgtgcccttccctccagacaaattacagtacgttcaagaatgtaggtatcactccttccctttctactcctatactgaaagagctttgcaagtttcacatattattttatgaggtcccagtatacatcctaaaaatgtaaaaatcttttccagtttccatttctggacatatgatcaattaaactgtaatccttcctgctacaaaacaccagaaaagctggctcggtgataagaagcattttcaaatgttgaagtcatttataaaaagaaatccccaggcagttaagaaacaatgagtggacacaaaataagagctaacccagaagataatgacacttcccctaaattggctagtcccggcaaccagtaggcttgaaagctgtgccctcaaaaggctgtggccttgatggtggaccaggaaagtccacccgacctcacaagcaggacaggttgaatttgcgtgtcttttgtccagaatctgggcaagaaaaatgtctttccagataacagaatggggttcaaattgacatactttcaggtccagacatccttaaacagaaaaaataacaacaacaacaacaacaacaaaaagcagtctcaaccaaataatacgcccggcagaggcaaactcgaaagcatgctggagaaagatcctgtcaaggcaggctgcgtgggttattcagtgacagagcccaggtgaagatgggctcacaagtgaaaacgtcagggtacacgacagcacacgtggccattcttcccgaagatgtcaatcagaatatgggcagaactctgtcagcgtaaatatgaagcagaattcacgctcactgttttatgcttgatgcctaatttcaaccatcaacaacaatagtaacaacaaaacagaaatgatgaaaagtcttctagaatatttacaaagcatatacttcactagtttctaaaggtggaaatcctaagagtcctaaaattattaattcagttaataaattcatccttgaagaaaccatgtatccaaataccaggccaggtaacaaccaatttttaaaatctatttttaattgatgtttcatttatgtacagcaaaatgtacaattcctaagtgttcagcctaataatcttttatacatttatatacccatctcatcccaacacagatcaagatgaatgctttcatcaccccaatagcttccttgtgcctctttccagtaacagcgttccctaactctcagcagtaacccctttcctgacttctatcaccaaaacgtggtgtggcctattccttaacttcatgccatcacgtggtatactcgtgttcagttcctttcaaccagcatagggttttgagttcaaccatattattgtacatatcagtagtttattttttaattacagactaataacccatgatttgattgtgccacaaattgtttattctttcttttgttaatggacatatgagatgtttccaatttggggctattatgaataaagaagatgtgaacatttttgtacaagtctttttgtggacatacacacttacatctcttaagtgtatacgtaagagtactaagtcagatcccataccccaaaacgctgttctgatttattttaatcacagatggtgatgtggtttggatccgtgtgatttggatcacccaaatctcatgttgaaatgtaatccccaattttggaagtggggccagatgggaggtgcatagatcatgggggcagtttctaatggtttagcaccatcctctcagtgttgttctcatgacagtgagtgagttatcgtgagatctcattgtttaaaagtgtgtagcccctcccccttctcactcttcctcctgctatggccatttaagatgcacctgcttccccttcgccttccaccataattgtaagtttcctgaggcctcccaagaaagagaagcctctatgcttcctgtacaacttgcagaaccataagccaattaaacttcttttctttataaattacccagtatcagacatttctttatagtagcgtaagaatggataacatagctagtatcttagtacattttctgttgccataacacaataccgcagactgggtaaattataaattacagaagtttattgggatcccagttctagaagctgagaagtccaagaacaaggcaacggcacctggtgagggcctttttgctgcatcataagatggtgaagggcacacatgtcaagagggcaaaagcatgcgcgtcagcttgggcctctcttcttctaaagccgccagtcccatcatagtggccccaccccgatgaccttatctaatcctaattaccctcccaaaggtcccacctacagtcaatatatgaatttggggatttggtttccaaaacatgaacttttgggggacacattcaaaccacggtaaatgggttttgttttagaaattcatatgtataaaagtataaagtatgtaatatttgtttaaggcttctcttactccgcatgatgatttctgaggttcatccattgttgtgtgtataattagttcgttcctctatcttgctgctgatgggcagtcttgcacaagtacttccgtggacatatgttttcgtttcttttaggttagagaggggccatgtttccctttcctcgaaccctcttcccaactttctctcataagacaatgaatttaaaatgttttctgaagtatagctaggatcttatataaaaaacaattgtacttttcatatatgagcagtacatttttatatatgaggagtacatttttatatatgaggagtacatttttatatatgaggagtatatttaaagggtgaatgctcagaaaatattaataagacacccctagattttactatacatattgcatatttatcagattttcagggaagaattgtgattccatcagtgtcatttatgaatttatcgtatctttaacaaactgcaagttttgacaaggcagtgttccaatctatcatgtgttttctcacctgaagactcatttattcaacaaatatttatcaaacatctattttgtgccaaggattgggagtacaggaacacacaaactattcactccgtagttgaagagcagagggtgtggtacagctaatacagcaggcagtcacatacatccccatgtcataaatgctaggacgggtatccccgcatggtgcccagggagcgtgcaggagagagcacctccgcgtagtcccaaagagtcagaaaagaatccagggagaaacaacctctgggagcaccctgggtcctaaaggctttagccagatgaggtggcgttgagagggagagaagagagaagagaaggcaggtaagggttgtgggatggacaaggcagaatgtttcaggcaaacagagtgtcatgaattaaaagctgggaagcaaggggaggcatcaagtcagtaggagtggagagcagcattgaaggtgagggtaatgaggggaggccacagaggtgggtgaagccagaacactgtgtcttgcatgtggttttggagaattaagagtttgttgtgaaggctccaaagagccactgaggagttggggcagcccaaatgtgtgatttggaatcatcattctcactgcagtggggacacagagcggtgtgggacaaagcaggaacaaaaagacacaaagacacattaagagtccattgtaggtatctgggttagagaagttgttggtcctgagctatcatagaagtgggctagaaagtgaaaacccatgtctattcctttacctgtcttctacaacattttcacatgcaaacaaactaaaatgtatttaatcataagaaaatcaggtaagctcttttcaaaattaaaatataagcctcaaagcaccaatgggtctcaaaagcagagagtggccttttagaaagcaatgggggaacaaagttcgcagctaaattggtgttcttggcttggcgatgcagaaagtaagaggctgcaggacggcaaccatactaagtgtgtcacatcctctccgcctggggttcttggctgacattacccatcacaaggaccgcacagggttggtccaactcccaaaccccagaagctccaggatgcattgctattatgccaacttttagttttcacacaaaacaaaggattttttcttttggttcgtggggtgtttcttatgaatgaattgtgtataactcagggaagagttccctatctgagtatattactgttgagtgacagatttctcagttgtgaattattaaggttgcagagatacctctaaaagtggcaggtaacaactaaaaaacaacagtctgcgaattcctacatattttgctactaaatgacatcagctggagccatagtcctcaggccttaactaccaaaaaagttgaggaaatacatactcgctttctcttcagcttttcccctaagccagaggttggcaaactacagcctacaaaccagatgcagcctgctattggtttctgtagagctgtgctggaacccagtcccacccgttcatttacatgttgtctttgactgcctttgcatgagagcatctgacctgagtagatgggacaaagaaccttacggcccccaaagctgaaaatatttaccacgtatcccttaccaaaacacatgcaggtccctgctctaagcgatgctgaaaaataacatctaaagtatcctgttttctaaatttactgaaacgaataacaatgatcaaacattgaaattgcaaaagaaaagttttaaattccccaaagcaacttcccatatcttctttttactgagatgtataaaattcatgagctgcttgagagagtagagcacgctggaaaccacccgcacgtgccatccacagatgggaagggctgtcacatttctgaaagggatcctgcggaagctgattaaactgttagaaaaccatttaagggagatctgccagaccccaccaacagactcagattttagaggacagatatttcagaggagtttcatgaggcatttaaaagaagttcagatccttaacactgcgaggatggataccaagcagaggctcacgaacacttttcagcagagttattaaccaagtcaacacctccctctgttgcctgacttgaatgcagagacaggtgtgtgagttcgacctgaggaccacactgcaccgcagcaattgcacctgtctgaccacagcaacctttcctctcttaacagtaaagcttcatgtactccttgtacatggcaagtacctgctttcataaatcagggcaagaaatggcaaatctatcttaatttccacctcaaaaagaatcactgagcaccgttttaaagggtctcagcactgatccccttgggtattctctgaggcacctgtggtaatccttatttgtttcgcagcctgtgctgaatgaaaaccatccaagtcaaataccttgctttcccctgtagcttcccccactcagtttgccttccagggctaagacagcatgaagcacagaatattgattggaaaagcactgcagactcttcgtaaagccagccaaattatcatctaccatatatgttcccacatgtaataagaaacctgattgattcataaattttagagcatatttctagaaattaacaaaataaaatcttttctgggtccatgtttttcccccacactcatcccctacatatgaagtctctggtgtgtcagctcgtgtgtgacagacaaacaatagccttttccccacaggccctgtttctttctctctcctttttttttttttttttaacttagaccctgccattcattttcacctctgacagtaaaaccccaggacaagattgtcacaaaaaggattatctttcagatcaatggtgaaattgatttgaaaccccactatttatcagcctccagcaaaagtgcaactggttaggaaatatgtcctttcacactcatgttatgctcagttcacccaggcagcacttcacttcatttcacataaatgcaataacctggccttttacttaaaattaagtcattttccacatagatttctatttttttgttagaatatatgcaaaatgaggattcatactccaaaattacttgcatgtatttctaatcataaagtatatatcacttgccaaaagtgatcttttcattatccttttataggtgatagagaatcctttacttctagcttaatataatagaccaggtatagatgattttttcagttaaattttctaaccctgaatatgaaggctaaaatatagactaaatggaaagctccagtaagaatagagaagattaactaactactttcatcctacttctcaatatatttttggtctcccacattgattcccatattaattcccttaccccaaaacccaagagaaaatttattcaaattaccgacaatgttacttgcctaagagttattttaaccacagagtccaatagcagtgaaattttatcaatatcaactaggtaaaataaacccagaaaacccagggtatcaattccttggtataatttaaataaattaatttaaaactaaaattctagtctgtctattcagtaattcaaaacaccctaagaactcaaaatactaaagacaactgtgtaagtgatttttaataggttgatataattcattaagaaaccaattaccacaggtaaaagttaaagaaacagtgtaagagctcttttagcaagaaatgtttacctgtatacttatatagacatatatgtgaagtactagggtaatgatttattatacccaaacagcaaataaacagctaaaaagaaaacaaatatgtcaaaatgatatattcatatcacgtggccttgtacaaacattttacaatgtctagtgtacaaattttaagttccttaagccagaaataaaagtagacaaaaatttgccaatggcttctattttaagtattcatatttaagccaactatttagactaatatgtattttctcataaaatttgactatattcagtgacaaaaattttatgtaaccaaaatgccactgaattcaaatgcagagattcaaagtttattgttaatcttagattccaaggccatacagcaaaacctttcatccaagattagatttgcatttaaaaagatcaatgtgcctacaatgaacagaatgtttgaagaagaagcaaaatagatgtgaacaaacaaattcgtagattaaccactctatcatcttttgcctctcactgaattacagatgctccttaacctatgatagggttacatcccaataaacccaataaacaaatttaaaataccctaagttgaaagtgaatttaatacacataacttacaaaatattatagcttagcacagcctaccttaaacatgcttagagcgcttagattatagcccacagttggtcaaaattatctcacacaaatcctatcttataataaagtattgaatatcttatgtaatttattgaatacgatattgaaagtgaaaaacaggatggctgtatgggtacttgaagtaacgtttgaactgaaagtgtattgctttcacaccattgagaggtcataaacttgttaagtcaaaccattgtaaaagccagggactgtctgtagttcagtcaagaaaagatgattgattggactagggatagtgatggggaagatggagagtcacagatgggaggaaaaactgacaggacttggtgatagatttgatattgacatgaggaagagagaagttgcaaggcagattcccaggtgaacagttgagcagtatagttatttattattttttgagacagtctcactctgtcaccaaggctggggtgcagtggtgcaaccttgcttcactgcaacctctgcctcctgggttcaagtgattctcctgcctcagcctcccaagtagctgggattgcatatgtcatcacggctggctattttttgtatttttagtagagccaggttttcaccatataggccaggctggtctcaaactcctggcctcaagtgattcacctaccctggcctaccaaagtgctgagattataggtgtgagccatggtgcccagcccggttatttattgaaacaaaaacactggaagaagacccagcttgggagtgggtgggtgggagaagagatcctgattttaattttacacgggtggggtttgaggtgccttttgagacatccaaatgtagaagtcacagacacaaagagatctctgggtctagactagagattgattcatgaatcatttggatactgctagttatgaatgccatggacataaatgacattggtgagagaccatctagtgagcttccaaaaaagacaggaaaacacatggccagaaaagtagaagagcttgtgtcaccaaagcctgaagaaggatgatgctggtgctggatgttgctcaggtggcactggtaaacttggtagaagtgaatactgtggagataagaggttagacaacatactaatattaggtggagacaaagcaagtgagaccagaagcacaactttacccattccagaggtgttactgccaaggtgggaagagagtcagggttgtttccaaagagagagagaaattaaatgagtttttttttttaatgggggaaacctgggtctgtttaaaaacacatggaaaacatcccactgataagatgaggctgaatataaaagaaaagggaggataatcaatagagttaactttcttaataaactagaagtgatgggatacaaagcaaagcaccagtgggagatttgccttaggatgcaaggaagcttggatgggtttaggtaggtttatttgcttggtatcaggaagatgagggagtttccatatgttacttttcatttcccatgtaaagtaggagaagagttcatctgccaagactgagcaggagtctggaaaagagaagggaagaggtatgaaactgttgttgtgaagactgggaagaaaagctgatcagagatgcctagcaagagatgggacaagcagtgctgagagctcatttgaagctggtgttcaaacattaacatagagccaatttgtcctcttgggcgtctttctccaacatcttgtggctgcacaggttgaaaggccaaatagttgggttcttccaagttttgtgtttttacagaagacagcaatgcaaagattgaaaagcaaaggtagattctaggcctactctaacacagagcataaacaatggtgttattgaagttatggaccagggagtcaggtggagaaaagaaaaagggaagactgacgtatcgggagaaaatacaggagtcaatagactggaggtcctaatgtagtcccaaaacagtcccagtgacaggggttgaaagcgtaagctggagtatgttcactggaacaggtgaatataccgacaaagtcaggacgttaatgtaggaccctgtggctcaaggacaggaaaggaagcagtgagaagatgggaggtcaaggtgtcggatgctaaatctcccaggataatgggagaggttcgagtatagacagagattacaaacaaggtgtcaactcttctgtgagcaagaaagaatgtggtgatgacacaggagactaaaacttgaatgacataaacctcaaatgatcatgttttgcaaaaggttaaaggacaaatagtcaagaagcagaaattcagagtaaaaatgtcaccaatcccaattcttggccctgggttagttggatgagaatgtaaacattcatgacttgaagggacacttccaggaaatgggaaacctcagatgtgagccaggatccagctaagaataagagaggaagttaagaacatagggaggcatgctggttatggagtggaagtctcagtagaaaaatcatgcaaaacatgtgtgggtggtcagaagagagtacacagccctttaggactgaagggacaggagggtatctactggggcatgggacaggagggtatctactggggcatgggtcagtagcacaggggagaaagtctccacgtttcctgggagtggatgagcaaaggcctcgcctctctgccagtgaggctctcttcctgagaagagacagtgtgctggcagcaagcactggttctgcaccaccatctcagcttcttcacaaagaggaccaacttccagatagaagagaaaaagaagctagaaagaaacataaaggcaacctcatcaaacccctttcatgtacagaagataaagtgcaggcccagggagcttaactgaccttctcagggtcatgcatttaggaaaggggcaggactaacttgagctcaagtcttttggtacccagaccacaaaggtttctgatattccatctcttcctgacctcgccttagactgattcactgcagacctgaagaagtaacccacgaaagtgggaattaaactggacatttgactcaaaaatatttttataaattagaaattaaacagaaaagaatagcaacttcatatagtttataatcagaagaggagtttgtggcttttaaaaggtaaaaagagtttattttacttacgatgctaaatttactcctatagttatgattcttcattgtcctgaaagtcaaatatcactaacactgatatcaaattgactgtgcattggcctcaaactgcctttttaggtaatctctcattattgtaggatcaaaatcaacattttagccaagcttcaacacaaactttggatatttaaattcttatttttaaatttacattattctttatgaaaattgactactatatttaaaacacataaaatacattaaacaaaataaaactaatgctctacaatgattttattgccacagaaatcttatttatctttgtgtaatctatttcactaggttagtaccagtgattctggcaataccctaagacagaataaatggtaggcagctgtgacatatcacaactaagcgttcttaaacgcataacacagacattaagtaaaaaacaacattagggcgattatacattaattacatggatacgttttggaacaaaagtaatttaaattgcattttccatagtgatactttgaaaattcttaccatttcatgtatgttttgaaatcatttgagatggatgaaatgtaagagaaagaacgctcttacaacaacaacaaagctcatatttacatagcatgtactctgtcaggtactgttataaatgctctgcaaatatgaactcaacccttcttcacaacaaccctgtgtgctaagcactgttgtccccatttagtgacgacaaaactgagacccagagagggtatgtaaatcatccaaggtcacacagttggttagtggtagaggcaggatcagacctcaggaggactgcctccaaaatctaggctcttcaccacatgctatggttctgtcctaagcaggattttatttgtaaaaatagctctagaaatcttactcgctaataagtttataacgaatgtgctgctacgctgttagaggtcactattccaacatggaagcaaccatgtcctgctacgattcctcaccaggctcacatattgtataatattaacaagtaacgttaaactataaaaccatttatacacaaatgaaggatttcttgtggtataatagtaaccatagcaacaaagtaagatgggtttgcaaagtgaaaagtatcctaaggcatttgatgccctcacaaaaagctttctctcaatttacaagaagatgtaaccagtaacagcaaaataatagtaaattttcaaaacagattatattgctatctagattagcaatatttcatgttagcatttttatttctaaaagaacaaggggctatattcaaattgctcccatttacatctctatagcaggaatccttaattcattcgagattttatgataaattttgactaaggtaacattttttaaaaatcatgatatgtacataggttcaatgacaaaaatatgcaattagaataaagttgtaacaatatcacatgcatcctacataagtataatgagtagaaatatatacttagcatacaggagaatcataattatctttagatttatttccctaagaaatagattttattttttgtatatcagaactgattgtgaagaataggcctcactggagaaataatgtgttgaatccttttgtaatatctattggcaaaggaactatacaattgcttaagtaaataaatattaaagactgctagtaccatatatagaattaataaagaaagaaatattaagggagggctctgcttttgctacaggggtttctcgagccttgttctcttcaatgtatatcaatgaatggataaattaaagtagcttattgcttttcaaatatttggatgatagaataagaatacaaaattcagattgctacaatgtgctgatcttattaagctgaagtttaatagaagtaactgtgctagagtttcgaaaaacaacatacaactagcagaactaaggagatttggtattaactgacaacagcttccatacaaatcaacagcttataaccattcacagagtaaatattatcacaggtgtatcaagggtgcattacactcagaaggaaggagccgctaacctaccctacactatcacatcacacctccagtacaagggcattgtatttcaagaaggacacacacactgagggacatttacaagaaaagtgccaggatgatggtggattgttaaaataatttcatgtgaggtgtgtgtcacactgagaaaggtccagttccacttgagaagtttcctgaggtcagggactgaccacatcttagttttgtcatcaataccaagtatgcagtagactcaaggtaaatgtttgttgtacaagtgaagcgattaataaatctaaatgtgcagaaaaagatacttagttatgacaagagtgtgaaaatcttcaaatacttgaaggagtgtatataaagaaatgatacagcggggcgtggtggctcacgcctgtaatcccagcactttgggaggccaaggcgggcgtatcataaggtcaggagatcgagaccatcctggctaacacggtgaaaccccgtctctactaaaaatacgaaaaaaaaaaaaattagctgggcgtggtggcgggcgcctgtagtcccagctactcgggaggctgaggcaggagaatggcgtgaacccgggaggcggagcttgcagtgagctgagatcgcgccactgcactccagcctcggagacagagtgagactccatctcaaaaaaaaaaaaaaaaaaaaaagaaatgatacaaattatttataataatagaacttaaacagaacctccataatagaaccaggaccaaagtgtggaagccacgggaaaacaaatttcaattcaaaagaccatctagtcagggctgtcctaggatggaatgttgaggttcctcatcttggaagggatcaggccggacgaaggtttagacatgttaacactggggaaaatagctttctagcgcagtggaaaccaggggcagagacatcgcggtattgaaccagatttctctcgacaagttaagatgctgacttgctgaggctctgtttggtcctagggaccagatgcagtgagccgagatcgcgccattgcactccagcctgagcaacaagagtgaaactccatctcaaaaaaaaaaaaaaaaaaaaacagcaaaaaacaaaaccaaaccaaaacgttgccttaaactgaagcatacacatcaacagcataagttcttccaggatgatgatgaaaggacaaggcataaaatggttacagtgtccccagagttacgctttccagacgcagccctaagtggtgaaaaatcgtgctcctggagctccctagggagggtgcagcttccaggagagaggctgcacctgcttctggcccacagagggcaccttgctgctcacacatttttatactactggatcattcaattgtaggtttgcaactagtctcttcccaccaacctataaccccttggaagtaaaatgtttaaaatttccactaaccctgaaattttgttactatcaaatattggtttaaaagactaaaattaataccaacaagacataccaattaatcctgacatgttgcctatgagggagatactatcattattatttccactttacagattaataaaatgcaatttagaaatataaaataacttccccatggtctctcagtttgtagcatttggactaaagctgcaggatatccaactccaaaactcaaggttcagccatgatgataagatattccttgcacttagaagcactgacattaaattaagagagagaatgaataacagcagctttaaccaaccaaccaaagtaaacctgttttttagggaatagagaataagtcttgattttttaatttaagggaatttgtgtaatacccaatgagataaatttcaatcctgtattacaatcagtttgactcatattatcttgttgacaaaccatagatttgtaataattctagaaaaatgcctctgttgtgtttcaaactcactacgtcactttacaggcagccacaggtgcagttgtttaacggtgagctgcctgtagagtataaccaagacagctgaactctcattgcagtttactgtaagcttgaagataaataactcattttgcagcaaatgcttctacctcttcaccaacaattacaatcctttagtttttcaatgtacataaagagaactcccctaagaaaaaaatgaaaaaatatacacaaattttgaaagtcatccttcctgagtaggtatccattgtaaacagaatggctgataaaatgccttacagactgaaacgcaagatgaccaagcatgaagatttaagaaataggagtaacaaaaataaaaacaccatataactaatacagtcattatctcagaaataaatgtgtattgcttagcttgaagagtcactaccaaaaaggtcaagatcttaaaagaacaggtactgttgcaatcactgagagggttccaggaaatatacagctaatatgaagaaacaaaaagaagagaaaagtcctgaggttagcaggactagtggaataaatgacaattatttaagaattctgattatgtattctgtaaattatttcttgcatttataaatactgtatttgtaggagtcaaatgattctgacaatattacttttgtcttctcctatagtaatattttaatcataaactaacacctcctaaacatgtaagagatatctgaactttttaattaattaaatcacccagttagttactaggtgagttacctgagtgcctctagggactcaggagatggcggtggcaatggcataaatgagaagggtaagtcatgagggggaagttttgtgccataaacctgtaagtgcaaaatcaggcaaagggccacattgtctgctttacatgccattttagtgtctctctaaaaaatattttcattgcccttgtaaaataatttatatatgttaacttatacatacacttcaatatatttgtgcatcaaatttcaaaagctctagaaccctgaatatatttaatgtgtgcctttaaatttgcattacacctcaaatatataaatgtcaaatatgtacatgaatttttaaaacataaaaatatttttaaggatgccctgtggtctaaatcaaataaatgttcacgaagggaaaggaaggttaggcactagactctactaggccacaacacgtatctgagctttgcctatgaagttttgaatctacaaaaacaacttatctattttccagatttgtgaactctaattgatgaaaactcaagtctgtatttttttaaaaaagaaactgaaagataactagcatagaaagagccatatacacagtttagttggttttgctactgtttatattttgaaaagcaaagattataggcaatgctccacactgtaaataacaattactctatgtctaatccatttctatgcattgagaatagaacacacagtcaagatgtgtccatggtggctttttgctttattctcaccaattaacaggtgattggatatgacagtaattagacacctcagctggaagaagatcattatgtcttaatgagaggattaaaaacaataaaaatgtgcttattgcaaaatatgagcacataccttaagtagcaatagtacaatttattttgtctccaagtttattgtgctttgtcagcccatatcaaaaaaaatttcccaccaacatgtgacttagaaaattacgcaacctaagcatacaattaacaatttttggtgagtcagttctatgttttggcttattttttttgataatgttcactagtgcttctctgacaagttacagttgccacataatattataaatgttatactggtacatttcacattcacccaaaatttcagctatatactcagcagtatacctgctatgtagttcaagataccatctcaaatttaacttcctcaatttccatgagatggattttttttttagacctgcacacagacctatgtacacccttggcaggcactcacagatgcagagtgactggaaggagcacagaaggtctctgatgcaatgcacatgccaccccagcaaggtcaaaagtctcctagcaactcttcttcgggttagagttttgtttccctaaaactgatgtttaattgcatgtgccatctgtaaaggacagtattaatagctaacacctcctcttattccaccattaattaattatcaaatgtgccagcattgagatctgctttacaggaactgaaaaatacagtgtaaaatcaggacaggatagaagagagggacgaagaacgacttgcaaaaccctacttgtcaggggacatgtgggtaaaaagttttgttcattcactcacacactctttcagtcactcattcagaaggacttactgatcacctgttatccacattggcagagtatataaattaatatttaaccaaggtaatcattctttagtcctaaaccaagaagatgctctcataaacattatgtattattgccaatttggaagtaaaacaattctatacccgtatattcaaaaccatgagctgtcacccaggaacctcctaactcatggctcttaaacctataaatattagggtatccaaatgtatccttctctccttcatttaagagacagaatagggtttccctcttttatttaaggcccatttacccatatcctctggacactacccctgaccccactgccttctgaagactttgtgcattatcccatagtagttcatggtagagtatttatttgcttgatagtaagcccgctggggacaagggagcttgcctactttattcttatttctatctctagcatctaacacaccttggcacacaatattaagtcaatcaatccttgctgaataaatagacttagcaatgtgcacaacttctgccccaccccgttgctatcactgtaattaccccattaaatgccataaatattatttataaaaagaataaaacttacactgccttccagtggtaagcatataattgttgcatgacactctatacaatgatacccccccgtaatataactcactacacagtttttacactgaaactgtatccttcttgtattataaaggtgaaatggtatatagccaagcatatctgagcaatggtatggctttttcttgctatcttctatcaatcaatttatttgtacagcacaaaattgctactcctctgaattgaagcaggagaaagccttacataatataacactattctgatacatcttgacatatacattatgtaacagtacttttcctttgctatacttcgcaatataatcgagaaatgctcttttaaagtcagcaacatcagcaggaataagacttttaaatgaagctcctaggaagacagaattctcacacttaaaaacaaagtatttattccacaggaataaatattacatgttttctgaaattgatcaactgcagtgatcaggtaacacttgcattgttaagcagtaagaatgatttcttaaaaattattatttaatgtcatggcattttaagttagatcttaaaatttttaattgataataattgtacataattatgggtacaatgtgatattttgatatatgtatacattgtagaaagattaaatcaagctaattagcatatgcatcacctcaccctacttaccattttttgttgtgagaatatttaaaatctattcttttagcagtttagaaatatataatacattatgattaatattattttttgagacggagtcacactctgtcacccagcctgaagtgcagtggtgtgatctgggctcactgcaacaaacacttcccaggttcaagctattctcccacctcagccgcccaagtagctgggattacaggcacctgccagcacacctggctaatttttgtatttttggtagagacagggtttcaccatgttggccaggctggtcttgaactcccgacctcaagtgatctgcctgctttggcctcccacagtgctgggattacaggcatgagtcaccatgcctggccatataatacattattaactatgatcagcatcccatgcaattattccttctgtctagctagctagaactttgtaccctttgaccaacatctccctatttccttccactccagcctctgcttctatgatttcagcatttttagattccacatacaagtgaaattatgcagttatctgtctttctgtgcctgacttatttcacttagtataatttttatctgaaaaataatttttttttgttatggtcctatgatgaaatataaaaccatagtaataactaacaagtaatagtactaccaggagtactaatactacttaaagtttattgagcacttactatattcaggcactttcctaaggggtttcaatgtattagtgcatttaaaactcagagcagccccagtaacacaagaataatcattatcagtatttattcttccctaggaacctgaggtgcagagatttgaaggaattttcccaggacggcagctgataagtggtagactgagggtttaaacccatgctgttagtgttaaacattattctttctttagtgtctttatactttcatgtgaataaaaataaattactattacatgcctctttctgtctgaaactgaagtcattttttaaaactgtttggagcacatttcagaataggaatgatattcaggatcagccactcaaatttcaatattttaaggaaagggtcttatgaagtgtgtattcaatcttatcaatgcatggataatggtgagctatctggcaactgccaaaatcctactactgtatgacttagaaataaacaactattttaagcgctacttggtaactatgctgccaaccagtttctacactgcctttataggaaataatgtactgtgatcaccaatgactctgtttataataaatcaaatattttataaatttatacaattatatggaaatcccagacacatttctcctttagaaaggcaagcagaaacaaatctatcccgtgttcaggaaagtaaaggttttcttcgtgagtacgctctgaatctaaataagcctcagtccaaaaagagttttactgcagactgataatcccctaggtttataataaaaatgctgacagagctttagctacagcataacaaatgaaaggccataatgttcttctgtcagaaattcctatttatttccagtgtcctaacagatgggctttactgccttgaaactcccccccaaaagttaattgcttgtctatcaaaaagataaacatcttgttttaggctttggggatattacatgtgtagagaaaaaccaatactcgagcaacacattgtgtccgaaatgcattcgcagtaagagagccatactctctcagggcatcagagtaaggaacagctggatgactccaacttcttaaaaagtacaggattctctgcatagtgacactagcatctataatacctagattttagtataccaataaggattgatttactgccacataaatgactataataactttacaaaacaaacttcaaaatgaaggtgaaactcttttagactcttgaaatagtgcctcaagcaaaatgaaccttaaacatatctaatccagtatttttcctttttttttttttttttgagatggagtctctctctgtcgccaggctggagtgcagtggtgagatctctgctcactgcaacctctgcctcccaggttcaagcgattctcctgcctcggcctcccgagtagctgggactacaggcatgcaccaccacacccggctaatttttaatttttttttttagtagagatggggtttcaccatgttggctaggacggtctccatctcttgacctcgcaatccgcccgcctcggcctcccaaagtgctggaaaactatgcgtttactactttagctagtgtacaatagcatggggatctcattctccaaagagctggtttaaatggaaaatatgtagacagcctcttaactaatgattcgcattaaaaaggaaaattatgactttaacacatgcgtattggtgccactaccagattgcacgggaaatgaacctgactgaatctggacatttttgtgttcttagaatattttacttacaaatataacagttgtataaaaagtaataatacagaagtgttggtatctatcctttcactttttccactcacacacacacacacacacacactaccgcagataggcaagcaggccgactgaagcatgttgaataaatcatacttctattcttactgttctgctgcttttttcactaagcaatgtatgatggacatctttgataaaggcctcattcattctgacgaatggacagtttccattttatacatattctacaatgcactttattagttaatgagggtatcttctctctcacaatattttttataaacagaaaggtaatatttgcacatgcattaacatacatgacattgcaatctgatatgcttaaatacatattagacataccaaaatatatcaaatacatattatttcttaactgctttgcacgtgcattctgcttgtcttctatggaagataaagaattgagggatgttatacccattccctccttctttcctattctacctcctgacttctggcatttgtattttacttttatctcctcaacaggttatcatttataacttcaagtaatatatatttaagctgtcttgttgacttatcaaccttaagtcaacatctttttcagtgaaaatgaggaactgctgcgtagacacttgattccactttttccgtgttctgccaccttctggttattgttaattacattattttttttctaacatcaagagaataatttagtctccaatgctttgtgtaaaatttgattctaaaaattaaaactcaacataagcaacatttctagcattatgactactgaatactattcattgcaaaatgtagtagtgtaattagatccttagggaagggattttcatccaacactaatgtgctgctgcataagaaagagttttgaaagtttcaggccttcatgtattatctttttattcccttttagttctccatttagtttcagttttccctttaatttatattcagctatcacttctcctgtatatcatccttttactcattttttttgggttaacacccaacacatttgcatatagatattctttttaatttttaataaagatggggtctttctatgttgttcaggctggcctccaactcctggcattaagcaatcctcctgccttagccttccaaagtgttgggatgacaggcatgagccactgtgcccagatatatattttttaccaatctttgtatttccggtgtgtatgattaaaagttgggaatagaattctatatttaaattaattttctctcaggtctttgaagacactgctttgatagcttctcggatccagtgttgttgatggaaaacataatgttagcctggttttcattcctttgcagacaatctattttagtctcattggaagcttgtggcatcttctttattttgaaatttcatcaagatatctccacatatccagctttgatccagcccgcttgccagacttttacatctgtctattgatgcctatggtaaattgagagcagcaatggccccaatttgtgcctagctttggaagagcccttcccgggttctctgggtttggccacataatttgctttggcccatgggacagtactaaaggaaagtaagtagcgacttgaaaatgcccctgccttggaaattgcactcctgctgctcttaggaatcctgctgccaagagaacaagtcgaggttagcagggtgatgaaagacacatggctcagctcctcccatcaccacaaagatcacagataacggcatgtgagttcaccttctatgagctaatcccagccaatcttccactgaccagagaaacatgagtcagttcaggtggaaacagccacactgcccacatcagaagaatcaaccagccgaatcagacacaagctaaatgaatggtctttgttttaaatcactaagttttgaagtcatgtgttacataacaaatgttaattgacatagactatttcttgagcttataaaatgttgtcatgaaactttattttctgcctttcattgtcttattattttgtattaatcagatgttggacctactgactctattcactattgcccctaactctttaatgttccatttccttatctttctgttttaagtgttcagagttaatcttcaatttatttatttattttttatttactgagacagagtcttgctctgtggcccaggctggagggcagtggcaccatctcggcttactgcagcctccatctccgggttcaattgattctcctgtctcagccttccaaggagctgggactacaggtatatgccaccacgcctagctaattgtattttttagtagagacggggcttcaccatgttggccaggcttgtcttgaactcctaacctcaagtgattcgccctcctcagcctcacaaagtgctgggattacaggcttgagccaccgcacccagcctaatcttcactttaagttgaagaaaaaaacatgtttaggcatcaacagttccctttccattatttggtttaatacatttttactgtgataatcatacttttaatttcctggaaatttcttgttttgattgttcctttttcataacagcctttacagctattatttcctttcaaattctgtttttttttttgttttgtttttttttggtagcagagtctcgctctgctccccaggcgaatttttgcatttttagtagagacggggttttgcaatgttggccaggttggtctccaacacctcgcctcaggtcatctgcccaccttggcctttcaaagtgctaggattataggggtgagccaccgtgcctggccttcctctcaaattctgctgagggtattaattagacacctttttaaaagtttctggtaatccctgaattgtacatgaatcttctggtatcggttgcccttttcattcttctaaatacagtttttccctaaatatctgattgatgattcttggatctgataatcctagttacttttctaagtgaaaaatgacattgatttgtatgggtaattcatattgtttcatctgcactgtgaaatacatgatcccaaaaggcttcttcctggaatgaaagacatgtcaacactcagaacattctgtgggtttcatgagcggaaaagcaggcaggcaggctggtgacacccatgcctgccaagacagacaagttttattttacacgtgaaatgctttatgaacctcccttttttacacgtgaaatgctttatgaaccgccctcctgaacacctttcccacttttccccaatgctcaatgtaggatttcacttcagagaaacaaaacaaaacagaaaacaaaaacaaacaaaaaaaaccttttccattgttttaatgctaccatatgagaaaagagaattaagctagtgtgttgaacctgctgacttaaactggaaacccagtcattaggcttcagcctcaacctcttttttttggatcttgttcgttagcttcttcgggtcataaatgcctcatgctgataacagaattcactcggttttatttttgagagaatacattttgagaatgattcatgtagggaataatttatgtgtgaagaataaagtttccaatatagagatcttattttaaaaattggctttttttcttaatttcagagaattgatgacactttttaaaggatttctgaaatcagtgatcacttagatgaatgttgctattatctgcacacattgctacattaaacgctccagaatttaaagttcgtttgagctttctgacactaaataatatttcgttttatttccaaacttatgaaagcaacataggcccaaaaggacagcagtatattaaaataaaataaggttattttccaatgagaatagagataaatcattttcccaaggagagttcaccaaagctagagactggccgaagaaaagtagccctcagcttcaaagatcaagctaattttaaaacacaacctatctcctgcttcatttgtcttaaatcttaaggctgttgtccaacaggtcatggcagtcaaaagaactgtcatataaaatgtacatctagtaaggccctctctatttttattttaaaacagtgattttaaaaattttggtagaataacctaattatcaaataaaagcttatagaaacccacatacctacacatatataaaaaaactgaagtacagttgttttgcttgagaaggctgaaggtgggggcagagatgcttcacagcctagcttcattcagggtcctgagataccacaaagacaccgtttttctcaaacaaaactgaaatctgccaggcatggtgtctcacacctgtaatcccagcactttgggaggccgaggtgggcggatcacctgaggtcgggaggtcgagatcagcctggctaacatggtgaaaccctgtctctactaaatatacaaaattaactgggcatggtgccgcatccctgtagtcccagctactcgggaggctgaggcaggagaatcgcttgaacccaggaggcggaggttgcagtgagctgggatcatgccactgcactccagcctgggcaacagagtgagactctgtctccacaaaaaaaaaaaaacaaaaaccaaaaactgaaatctactcttctgttacgtgaggagaacaatctgtgtctcatatttaaaatttacaagtatagatacatttttcatgaatatttattaaaaacaattaaataaaaattattccattaactcatttgtttaacatttccatgtaaccacagcaatgcaaagcactttgagagctgcatgggaggtctaagacatggtttctaatatcggagttcaaatagaaatcacatcggaagctgaagccacattgtgtggtgctcacttccacagcagacttgtacagcttgaagtatttaagcagattaactgtaaaggaaaaggaaaaatgttacttagctgcatcttaaaagactcttgggattcaaacaatctataggaggaagacagctaacacaccagcggtagagaaaacacaaacatttttgtttgttcggttttttgtagagacagggtctcctcttgaactcctggcctcaagggctcctcctgccttagcctcccaaagtgctgggattacaggtgtgagacaccatgcccagcaaggacagattttcaagaagagaacacagcagggatgtggtaacaagaggacatctgtgtaactgaagtggaaaataacatatattggagcttgaagggaaataaaattaaatacctaagtgaggaaaatacaattagtgtttcaaccatctgctaccacttcctactatgcccttccttctgggaaggctctatttcccttcttcactcaggtaaggctcttgcataagtgacttgctttggccaatgaaatggaattagatgaaatcactgtgatgtctcttctctctgtcataaggctgaacgtgctccagatagaaccagctccatcagcttctgtcgtggagtgagggcaacttcagccgtgccactgcaaactcacgatgagcgtgtaactgagcgaggaataaatcagtgttgttgaagcccctggatcaattatcactgcagctcagacaatcctcactgatacaatgcttagtaccagatgaaggatgacgttaaagtgaggactgatgtctatctagtgtaggtttataaacagttttcatttccaaacatgccttttcactcagtgactttaacatggggatgggtgatgctgaacttggtcttgtctagccttagtttacatggcggcatggcagccagtgctcatgttcaggaacctaagatgagaaggcaagtgtcttcagggtttactcaatgtcactttctcattaagacttaaccatccatttcaaattgtaaatgagtcccttcctctttttttctactctgtatctccctcccttattgtctttctccacactacttcaccaccatttgcatgtgtgtgtgtatatgtatttatgtatgtgtgtgtatcatgtatatatatgtgtgtgtgtgtgtatatatatataaacttatgtttgcaaaaacatatctaaaacttatataaaatttatctagttgcaaaaacctgaaaattaatacacatctcatagttcctttctgaaaaattatgatctctacatccccatgaagaaagtaagacaaataaacaaagcactaggaaagttactccagttacttcattagcatgaatttgcaagaaagacttcagtctgctttctttaacagataaaatatatcacagttcaggcagaccttgacttacgctaactcgacatatcttgactaatgaatgacttatttacaactgggtagagactaggaaaatccccacatatgctgccaaatacaataggtatcgctggcaaccaaatcagaaccattcccctgcctcacaaaatgatacttaggttaagtgcaatcattgattagtgcaatatttctggtagatttggggttaatctggtttttgcatgctggatggggaatttaccactgttatgttctttcatgacaaaacaaatgtgatgttttaaacaaaaacattttctaatgcatttgtgtaatgtttccatttgaaaggtagagaatgactgtgctatatttgcaaaacacaagacctctcagggacagcataatacttgcacttccaaaaagcttttcccctcaaaggaagacactgtgcccttgagaatgactctcgaattaatcatagaggaagaactttcatttataaattactactcttacatttcacagatgaaagaaacagaatactttataatatttaaaaaaactatctggatatggtggctcaggccgggtatggtggctcaggcctgtaatctagcactttggaaagccgcggagggtggatcacttgaggtcaggagttcaaaatcagcctggccaacgtggtgaagccctctctactaaaaatacaaaaaaatagctgggcctggtagtgggcgcctgtaatcccagctactttggaggctgaggcaggagaattgcttgaaagcgggaggtggaggttgcagtgagccaagatcatgccactgcactccagcctggacaacacagcgagactctgtctccaaaaaaaaaaaaaaaatttaactgagcataagatgattaaaatatagtcccttcacatgtctttaactgcattatattcaataaaatattcattttaaaatgaaaacttgaaagtaactgaccattcaaattttgaacaagctgaagaagcttcaaatagcagataattaccaatgttttaaacgtagtatgtcctggagggaatccaacatcaggataaacaaggcaaagtctctgttctacagaattcaatgcagtgctggagactgagatgcaaccacataatcctatcatctcaaactgaacttcaaggagggagtaactaactatgccctgaaaatgatggacaatttctaagagggcttgatacttgggctctgtcttgaaggatgcaaggtccttccttatgaagaatctaccatacataatagtgcagaggtgaaaagaaagcacattcaggaaacagtctgtgatggcttcacccagaatagagggcattcaatgacctggaagatgttttaagaggttattcaaaaatatttactatcaactcaatgtttgtcataggaaatgattttgtatagaaattatttccccagattgtgaagagctctacgctgcctactttggagtttattttataggtaatgaggagttatcagtggcttgtaaacaggagactggtaggatcaatttctttttctttatttaaggaaggtaactggagttggaggcgagggagactggtgaccaagagattagttaataagcaactataatgactgaggtgagagatgatgaagggtaaaatggggcagttaggcagggtgaacgcaggtgaagaaattatcaccatacacaatggtgtggcgaaacaaataggtggagagacacaagaatctgcaataacttttaagaatttataacttaaggaactgtttgggcatattaaccaataacaatggagcaactagagatgatcagtgggcagttttgaatactaggagagatgtcaagagtcatcacaggacaggttgtagttgaggccaggtcaagagtctaagatgccactgtataggatatagcagtaaaagaaagaacaggaaaacaagagacctaagcagaggaaagggagacatcaaaccactcggtatcactcgagtgatagagccaatgaacatgggctacagggagtaggacacaatgtcatgaggtcgacagaagaaaatacataaggactataacagtctttagaggtagcaataaggaagtcattggaggaaaatttgagagtttgtggggttagaagccagactgtcatgaaatcaggaatgggaaataaggcagagaaaaaaggtcgtttctgaaagttttgatgatgaagacgcagaggaaacaaggacagttggttgagggtaaggtagagttgaaaattaaggtaaagggaacttaaacataactgtatgacctaaagatggatccagttaagaaatcaatgatagaagctataattgtgaggcaaagtaagacagaaataacctcggagatgaagaaaggaggccacccttttttgagcattcaatgtgtaccagatgttttgctgtacactttcagatgcatttcctaaattagctaaatattaccaataagtaggtatcagtatccctaatccatagtcaggaaatgatggagtagaaaggtttattaaaattggaatatctcagaagtgaagatctctatgtgaaataggagacaaatcatatgttccaacagcattaggaatcaagtagtgaaaatggcagagctcccatattgaatgagaaagtgattcttggcagataagacaagaaaaaaaatattcagagtgcatggtaattattgaataataacaaaaagttaacctggaatgattgcattattttcaagcactagctcaaccataagtgtattcttatatataaggtctaatgaatgctttaatgaacaatagcttttcattttgccaaagatacaggaatatggttcaaagtaatgttacctacattaatcctcactagagtttaaccttaacccagtgaaggttaataaggttccctatttctataaggaaactgtactaaaataatgtctcgtactattttacaattattttattatgtgaaaactccatgctgggaatcactaccaaagactaatttaaaactaattatttcagcattaatctggataatgatccataatgaatgaaaaatgaataatctgacatttcaggggttccctactgccccaattcatatacaagaaaatgcttttgctatgcctttcatacatagattaaaccacaatctaaaatatcccaaagtgttgagatacttacaaattatattttagttatttatagactagaatgcataaatctaagtttcaatgctgagttaattaaggaaagtccaattttataacattatttttgcatgtggaaaaataactaatacataatgcttgaccatatggtctgttagtccttttgctaattacctacaaatcactacacaggttttacagctgctatatattattaactgtagcatgttttccccaaagattttattcctctcttcatacatttttgttttaactatgtacaaaacaagttcgtatttttaaaagagtcaattgcagaagactgaatacacaacatatatatatttaaaggaatgatgctttacatttaaattaatgttaattaattgataaaagtttcagcagaccaaaatattgaataattttcttttagtcaacattttaaaattcttcattaaagtctggtagcctacgacacgcaatgctgcagtcaggcattaaaatgttgtaataacagtttctgatatagaaagcaattagctgtttaaaaaaatgatgtatttcatataagccatatctaatttgggacatgtgctttaaacaatgttagaattaaatctgaattttgtcacagaatctagaataattattatgttttaaaagtataatgactgaatagcatgtcagagaaaatggcagaaaattaaaattgaaattgaagtatataattcccaataaaatgcttgcttctatcctcctcagaatactttcattacattctacttctttatccaattggataaactacctagctgcagtgtaaaatcctactgggccaggattatgactgattcatcacatgcgtcaactgtgcacgatggtctgcacaagtaggtgctaaaggtgtttgctgaaataaaagatccatacttttcgaatcaaacaagttcttactcttacggtgcacacattgatttaccaccttagtcatacagtaatagtgtataaaagccaaaaagattactgagtatataaaataattggtatctgaaaggcccttttaactaccaactataaattcttccctaagctttatactgtcctgccaagctaacaggttttcttcgtactaatgctgcacagatcttcagaaaagctgctatcaattactttgatttcccaggctgcccaaactgctaatggaatttagtaattagagttcttttgaaacaatcccaaatctgagcattctgcctgattacaagcagccatcgacattaacatcaatcgttgacaacgtaatatacattggatgtgccagaggtaatcattatctaaaatcctgtttctagaacatgacttctatctagtgaagaacatgtaatggggatttaagattcttctacctccaataactgattctatcatgaatcttgtatacagcattcacaatcagaagcaaagatatctttatctgtaatatttccagtcaatttcatagaaaagagccttgaattctgtcaccattttaagaggccattttgtccacatcttccctttcaccaaaaatgtaatcagatatcaatacattgtaagcatgatactgtcttacacttgtatttggaagcaggttcccaagttgatgatgagcattcagaataataaactttgcaaccagaattgctaacttgtaaagccaaaaatcaacaggaagcaaaatgagtctgaaaagcacaaaaagtaaaaaattttatagaaccatttgcccacagatcaaaaggaattttgatcaaattgactagtataactcaggaaattacagttattagtccttaagcatttccggtagaattctcatcttttccaaagcttcactcaaatacaacaggtcataagacctcacaatcttctcggaacactaatggagctgccacagtatttgaaggacatggtcatctactgtgtacaatgtttctggaggaaaataaaacttttagagcagagtcatctgtattaggtatcaatgagatgtcaggccacctcaggaatgactgttccactacagtccatgtgcactcaaatatattaaatagtctataaattcaatgtcaaaattaaattgcaactgtcaataaacacaaatagaggactggtttattacttctgttatattaaccagcttttccaactaaaaactgcaatactaactctgcgttctgcctggaattccttataagaagggtgctttaagaattgatttttagtgatgctgagcattttttcataggtttgttggtagcttgcatgtattcttttgtgaagtgcctgttcatgtcctttgcccatttttaaattttttttattgtgttttgcttcttgatttgttagattccctataaattctggatattaggcctttgtcaaatgcatagtttgtaaatatcctctgccattctgtaggttgtctctttagtctgttgataatttcttttgctgtgcaagctcagtagtttaattcagtcccacttgtttatttttgttcttgttgcaattgcttttggggacttagccaaaaaatttttcccagagccaatgttgactagagtatttcctaagttgtctttcagaattatgatagtttgaggttttacatttaatctttggtccatttttagtttttttatatagggtgaaaggcatccaggttcagtcttctgcatacagccagttaatcaacagataaatgcaaatcaaaaccacaataagataccatcttataccagtcagaatggctattattaaaaagtaaaaaaaaaaaaaaaagatgtggcaaggctgcaaacaaaaggaaacgcttatacacttacacactgttggtgggaatgtaaattagtccagccactgtggaaagcagtctggagatttctcaaagaacttaaaacagagctatcatttaacccaacaatcccattactgggtatatactcacaggaaaacaaatcattctaccaaaaagacacatgcactcacctgttcatcgctacactattcacaatagcaaagacatggaataaactcaggtgtccatcaatagtagactggataaagaaaatgtggtacatatacaccatggaatactacatagccataagaaagaatgaaatcatgtcctttgcagcaacatggatgaagctagaggccataatcctaaatgaattaatacaggaacaaaaaaaagaaatactgcacgtttcacttataagtgggaactaaacattgaacacacctggacataacaatggacactggggactatgagaaggaggagggagggaggcatgggttgaaaaactacctatcggctactatgctcactacctgggtgataggatccataccctgaactatagcataacacaatattcccatgtaacaaacctacacatgtactcctgtatctaagataaaagctaaaattaaaaatataaattaaaaaaataaataaaaagaactcacttttgtgtaactgtaataagaaacagaagtaggtagaaaagacaaaaataaaacttgaaatgatacagaaaaatatgcccaagacaaaaatccagtttgttacaataatatagcaaatgtccttagatacaaatgtaattggtaattctaatataatacaaaataatcaggctaacttctccattacaagtatattttataatcattttcctgctggaaaacataagcaaagctgaaattcaaaggatttgttcagtacaatcccttgtgaaaatattttttcatttaaaatattaaatagtgttaagtttcaatacttgtcatatttaatttatactttatgcatgtattaattttgaatgtatctttagtacatatcttttaggattcattgctattccttacaacctagatgagctataaaatcaccaggctaaacctttaaaaaaaaaaatgtaggccgggtgcggtggctcatgccttaatcccagcactttgggaggccgaggtgggtggataacttgaggtaaggagttcgagaccagcctggccgacgtggtgaaaccccatctctactaaaaatacaaaaaattagccaggcatggtggtaggtgcctgtaagcccagttatttgggaggctgaggcaggagaatcagttgaatccaggaggcggaggttgcagtgagctgagatcacaccactgcattccagcctaggtgacagagcaagactgtctcaaaaaaaaaaaaaaaaaaaaaaaaaaggatccatttagtcactgggaagggaggacttataactcctaaaactccagtttctagagaaattcaattatgtataaaaccggatttccagaacttcacacatttggctgattttctagttgagaaatcatgtgaattcacacaaacctggaggttgcagattgcctgagttttgtcccacttgctgaatgcagaggcccagtgcaccccatgactggtgtccccagaacagtctctttccgtgggaccctgaatgtgcctgggatgacagaataacatgaggtgggggaggaagggaggagagtttgtgatgtgagggatggcaggatgaagcgagggagggaggaacgtgtgtagctagatgagctaaacaagagactaacgactggaaaactatttttcaacattgccctagacattctaggtgtgagggaatttaaataatgtttaaacattaatcacttctaaataattagaagtggaaaacagtaaaggagaaatgagacagttacagagactgctaagtacatgaaaaatataccacacggtcttgtgtcaacaaaactaaccagcattttacaaaagggctccagtggggatgccatttctttaaaatagtgactcccctgaaacaaaaaagccaaagttcccagaacagcctgtgcattcacctctccatacctgggctttggctgttctccagggttggaatgcatctgcaggtgtggacatctaccctcacaggcctccctgtctaacccaggggccagcaaacattgtctgcaaagggccaggtggtaaatgtttttggctctgtggcctcctgatgctgctggtttctccctcctcctcctcttccttccccacccttaaaaaatggaaaacccaggccaggcatggtagctcacacctgtaatcccagtgctttctccaaggcacaccctgaggactcaaaccacagctgctaggaagctccctgttctgctgtttctaccatagctgtgatcacttcccacagtaaggatacagtcccatacactctcctgcctctctcctccagcatgaatgcacacttcttcaggcagagctttgatgtcttatttagcttgtatcaccagccactagtgcaatggctgacacgagaagagtgatggacatttgctgttgttgctgttattgtttttaagacggagtctcgctctgtcaccaggctgagtgcagaggcgtgatctcagctcactgcaacctccgcctcccaggttcaagagagtctcctgcctcagtctcccaagtagctgggactaaaggcacacgccaccatggccagctaatttttctatttttagtagagacggggtttcaccatgttggccagcatggtctcgatctcttgacctcatgatccatcggccccggcctcccaaagtgctgggagacatatctttatttaattaaacattcttagactccagttttctcacctgtaatattaaacatttatgttccttttaatctctaaaattccctaatttcacttttgagaagttcaaatactgtatcttacctcaagtatttaaataatgagtttaattcttaattctgcctataccaaagaacaaagtatctttttacttgacttgatttcttcctttcatgcaggacagtcctgggtgctcacaagagtcaagtttcacacacaacagctcacggggtaacagccttttatatatttttcacatgtggaaaatgaacatagacatgggtcttgagaagggtaatcaactgcattctgagctaggcattcaatttccaaaataataaatttcctctatctttagtctctgttcccttcccctctttctcattctgggtattttaccagaaaattagaagtctttaaaatcaaatcagtgcaatgaaatgtttggcttttagggtgaaatcaccaatgtgattatatggcaggatcccacatactcaaaaggttcaaatttgactttgcttgattttatatgagactgttagtgtttctgatgccatttttaccctgaaattcaaatattctccaagagtagaccttatgtcgtagctttgttaacattatttcatcttgttattaagttttcttattttattataataatattattaattttcattactctaagaaattatttcttaatttggttgacatttaggtctttcaactgtcattatgatttaagagtttgttgattctcagtggtaatcatataaaaaacagttccaaggaaaacaatttggtgatgattaacagcctctgatgattccaccaataattgtacacaggcagatctgtcacttgacacaagtgagtgcctcagtcacatgattcgcttccggtttgggggcttggtagcctggtctattttgtgtgcactgctctcaaccataatggcacgaggcatgtttggagaaaaagcctcccaaatgaaaaccattatggcatgaggcacgtttggagaaaaaggcttccaaatgaaaataactacttacaaatcatccttgggttaaggaattctgtaaaaattaaaatggttctgttctcctgagtgctgtgactgaaaagtagtggaaattataaaaattaaatattctgaaggcacttgccaaatatcagcaacagctatatattacttacatagtaatataatttgcccacaaaaaagttaatgttaaattgctctaattttcatatactcttaatcttattattggacaatacatttgttttttcttttgcaacaagtcagtagaaaaaaaaaaaatcttagtgacataaatttttgctttaagcccaacatgaaataaatagcaccaaatgtttggctaaaaatagctttgaaatttttgagccatctccacctcctgtggagcaatgtgggggagaaataaaccaaccaataaataagatctagttctgtttctaaccttcccattttacaaatgaagaaacttggcacaaagagggtaaagagatgactgaaggtaacatgccttgttaagggcatcttaatggaatatattagatgaactcaggcaaatctatgttcctgctcaagatcactagagaagttttgtttctgttctccaagttttcacattaacaaccaagagacagtgacttgtgtaaacagtgacacaaaatgcagacatttggtgaatgaaacggaaatgaaataaacacccataaagaagcaaaacaactgggcatggtggctaacagctgtaatcccagaactttgggaggcggaggcagaaggatcccttgagtccaggagttcaagaccagcttgggcaacatacagagactcagtctcatctgggaatggtggcatgcacctgtagtaagtcgggaggccgaagtgggagggctgcttgagcccaggagctcaaggctgcagtgagccatgacagtgccactgcacatcagcctggcaacggagcgagattctgtcccaaaaaaaaaaagatgtggccaggcatggtggctcacgcctgtaatcccagcactttgggaggctgaggcgggcagatcacaatgtcaggagttcaagatgagcctgaccaacatagtgaaaccccatctctactaaaaaataaaaaaaaatagccgggcgtggtggcgggtgcctataatcccagctactcgggaggctgaggcaggagaattgcttgaacccgggaggcagaggttgcagtgggccgagatcacgccgctgcactccagccctggtgacagtgcaagactccgtctgccacctcctcccacccgcccccccccccaaaaaaaagcagcagcaaaataaagttagagacatccaccatcagattgagatttcaggaggtcaaacttgcaaatacacacactggtgcatacacacaactccagctgatgaggagcacaaccaaatattgcttaccattctaaaattctaaacagtagggagagatcaaagtcttacatgagaaacccctgagcacagctgacaggagctggacatacaggtcttcagccagtacggaagcagggctcgactttgaccttcactttgagtcccatggacattccttctatccacacagaatttctagcttgaaatcaggaagaagtaaaaactttgacctcatatttgacttctgtattctcttttccctattaactctgactatcataaaatacaattaaattaaaattatatcttaattaaaacaataattttaccaaatccttgtaaatttggatcattagatgaatgagaaacttgcttttcaccatttagtttcagaacttctttaaaagtcactatttcaaattacttattcctaaatttactttgttgatactgattttcatgcattcatttccaattatggttgaataacaggaaatacaaaaatttttctgcataaaactatggccctaaagcattgaacgccaatgaatgattgaagctccttgaagaaagcatctctaaaagccctcaactgtcaatcctacaatataacgaaggcagatgacattctcagattcctttatatagtttctttcatagtttcattttttaaaaaaataaaagaaatgctgaaatgtgaagttccttttcagcatgcaatttgttctaatgataatgtaattcctctatgtaaggagttccatattatttctttttctccacactgaactgtaagacaataatattatccctatgtttattactaccccttcaactttatgaagcacaaaatgcctcctttcctgttttcttgacgtacagaattttgcttcagtaagcctaagagtttttttccctagcctgtatacgcttgttctgtgccaactcattgtaaaggagccggtttgaaagcttatcaccattaattctgtgactttccaactctgtctccctggtaacagaagcctacaattacgagacaagaacacaaaggatttgccaaattatctaaattctaatactctaacattttatacccttccgcctcccatccatgcatctattgtttttcccaagtctaaagcaatggtcttcatgttagcttctctatcttcagttttcctctggccaagtcatctaaaacacgcattccagttgaatcttttggaaaccttaggactgtcattcttccataaaaaactttcactgcgccccaaaactctcagagcaaagtacaagtacttccgtttggtattctaggatctctatgactgctaactatcccttttttttttttttttttttttttggcagagttttgctcttgttgcccatgctggagtgcaatggcatgatctcggctcactgcaacctctgcctcccgggttcaagcgattctcctgcctcggcctcccaaatagttgggattacaggcacctgccaccacacccagctaattttttatatttttagtagagacggggtttcactatgttagccaggctggtctcaaactcctgacctcaggcgatccacccacccgcctttcatacatatctctatgcttctgtgactttggccactatacgagctaggtcaagtttgccagtcttcctgtgtcttgctacttcacattgctataaacattcttaagtaaacaaagctctgttttgaattaaacatttccaaagcaaagtatttcactagcttcctgattcaccgcatgcttatccctaacaagtatgcttattccttaggattctccacagtcaatggcgccatttccccagttgctcaggcctgttaaagtacgagtttcaacaaagcaaaatcatgattcctatgtaataaaaatcatgtctcttatgtaaataaaaaatgaatgtgtgtcaaagatcttatacacttagtaattaatgaggaagccagtaagatgttaaaaccagttgaaattaaaatttgaagaggtaggtgtttaaaggcaattttacaaagtaattttatggtaagatcacctggttagatatattaataaaatgggataatgtccaacagggcaataaactataatttttaaatcatcttttccaccagatagaaattatctgtatctctactagacaaaaatctgtacattcaccccttctcctacaaggttttacaacacccaaagcaacagaaaatcaaaggtaaaagcctacactgaacggaaaaacactcagtagttgctccatttttgtttcagaaaacttttctgatattctaccccttatgattataaataatcctcaaagattatctttaaagaaaaagtctagcctcattaggtttggtctaattattcacatggatgcaaggcaacaagagtcctaatcaaacacacaggcctcgagtttgatctgaaaatctagagccttatagtattgagcaactatgaaagattaagaattttctgggtagatttttcatcagaggtctcagatttgatttttattatagtcctcatatttttttatgctgagtgtaggagactcagcccaagacgttttctccagcagattttatatatacccataaatctgggtgaattcttctcttcttgatgacttccaaattctctaaggcctctgatctggtaagaaatcataccttctgtgaagctgatgctctgtaagccaagtaccaagtgccaagccagggttcttgggagactctgtaggcactgaatccatacataactagtcttgagaacaggcttccaactaagaacttgctctttaatagggggcttttcacagctgattaaatgagaatcattctcaaatgcgatattgcttgcacaattgatgtttccaattatgctctgataaaaagagagcaagattcttattgaatcttacccaaataactatattgccaagtcaagtcacaaatcttagtaacatagctgtttctgaattctaagggatgagtgagaatgagataccactaaaaatgtttcactgcagtttaccaaagcatagtctattaaactgaggcttagagacagcttgggaaaaaggagaaagggtttcctcatacaaccataaataagagagcattccaacaacagcaacatatctaaacaaataaccacaattaaattagtctcatcagttcatttagtccttagtaattaagttttattctgctggatactgctttcataaagtatgtctgctgctggactgaaagaagtcctggaaatccttagtcactgatacagtctgcaagttgtctaagcaatacctgtttgtaaggctgtgcttgacaattccctgaaggggcaatggttcataatgctggtacaggcctttccacaggttctgaactcccctttgctaaaggtataaactctagcctgaagcttatagcaaagtcaccaggcaaacatcagaagggaaaagagctcttgcttgatggtaagactcatggcgaaggtcatattccaggaacagtattatcacagcaggcaagagtaaatttcttttttgggatagaggacataactatttcataagggtttcccctgagagagaagacatatgatggatagcagaggcactgacaatttccagggtcttctcaaaatgtgtacactctataaaatatttaaaaaaatgaataacattttacttatacaaatttaacctagtgaaggttaagcatctttcctgatttgacaactatcttcatacagttctcacaatagtttgaggtaattaagacatatggaacccatgaaacaaacccaattatttctagtattcttttacttataaagtgaaagaataatctttatgaggccccctcaaaacacaaagatagcattagatgtaaaagacattttacactgaaattttttttttctaaatttgcaatcaaattgtagaaggcaaaaatcaaagtgttgtcagaggaaatttgctcactgaattaggatggaaccatgggggcatgagaaacagtatctggttacctatttaatcaacgtggcaaacagaagaaggcacacaagtaccaggaaacttcagttctttactagtgaggaactttggctcactgaacttcgtgtttgtttacatttatttatcttgttttgtttttgtaaataatcaaggacatgataaggtccacacaaagttgagatgcagaatccttgctacttaggcagattactctgcaggtaaagaatgatcttttgtcactccatccgccctctgttaactctaaggccaatttatcattttaacatagagaagtcattttctagttttgttttaatgtgaagtttggcagtaaagttttcatgagctccttttatttttttatatcttgtgaataattctatcaaaactgaacagaatttaccaaaaaattaacacgtttcattatttctttacagattcagatattataaaaacaaggcaaatacaatttgtttcctcaaacactctatagctagctctccacactcattattctcttcatatgctggaatacactaatacttttctttgggactagtcttgttttttatttgtttttgttttcttacacaaatgcacttacacagttgtgttccttgtcataattcctccttgtgataacagtagtcctaatttttagcagatattacaacttctatttcatagacaaagctgggtgggagataactgagaactgtcatagacagcattttagcagactagcaaagctcaaaaatacacaacacataccttcctaaagccacattcatcctttttgcacattcttaaagtgacaaaaaatgaacacgtttaatgatatgatccataaaataagaaccaaaaatattaaaaaattaacatttgcttaatgttagttcttataatgttctatcttagaaattattcagggatctaaaataatactgattaattagctcaatttaattttaatccaaattttgaagttactctgggccttgaaattatgtttaagctaacattctataaaacataatcactgttataaaatcattggtcaaaactgtaattcaatatatttgaaaacatttcataatctcaaacattatttagaagtaatattatctttttggttagcaaaccaatataagtatagtagtgtcgaaaactcagactaagtagttgcttcatgagaaaaatttaaatcttatgaagaatataatatagtatattatacttaaaattgaaatatcatagaaaagttatataacttttttcttaagaaaaatgattaaaccaatctaatcaaaaattcacctcatgtgaagtcttaaattgtttcttttttagtagtttctgtaagaatattttaagtctagtacaatattaggagatactctgaattttctaaatttcttatattgaacataatttaaatatgaatatttactgaattcattgtaagacatagtatgattgaagaatataggatatggtggattgcgacattttaaattatgggtttaaaagttttgtatatccttatctattttattttctaagacctaaatattaatgcactgacacaataactaatcagaaataaaagttgacatagacataaagacaccacgggtaataagaaagaacaagcagccgggcgcggtggctggcgcctgtaatcccagcactttgggaggctgaggtgggtggatcacctgaggtcaggagtttgagactagcctgggcaacatggtgaaaccccgtctctactaaaaatataaaaattaaccaggcatggtggcgcatgcctgtaatcccagctattcaggaggctgaggcaggagaattgcctgaacccaggaggtggaggttgcagtgagccaagatcatgccactgcattccagcctgggtgacagagcaagactctgcctcaaaaaaaaaaaaaaaaaagaaagaaagaacaacaagcatatttttcactatgtgtaattattttaaatgagctgtcacattttaaatttacctagaaattagaccatttgcaggcccatttcggcggggaggcagaacgacagaaaatcatacacattttccattaatggactcttgctgtgggaaagggtgagctgtcctgaagacctctatccagtgttcataagtttatcactcacctctaataaaaagcaatcactatgtgaatttatagaaaatattaatttcatgtttatttttagcctatgaatatagtggctttcattaatatacaatgtatttttatcatttctgaaaggtttttatccagtgttttgctgaagctttttgtcttctgaagtacactaaattttcaatttaataatttagttcagttaatactcattttacttcgtgtagtaataaattattcaacttattattaccttgtggacttccataatttttcaaattgtagtcagcaacactgtctgcagcagattattaagtaaaaccatatatagaaaacatacatttaatctttcttagatactgtttcatgtcttgctaaacagcagctttggggccaagcacagacggaaattctcccaagcccagctctacctcctctctgactccaagtaggttgaacgctcccactttcagcacattcagtcttttggcaatggagatgcacaagttgcctggaatcataaaaggctcctcggcttgcctatctttctagttcccaggaccctgcctgtgctcctcctcctcctgccacccagatatggctactaagccccaccctcacagtccacaccatcctccaggcagagtgcaccccccatggaaggctctgagctggagaagcacacaccaccagtccagaccacacttggcagtagcaatcagggtcaaaggttaacatgtacttgcaggataaaaatggattctgtcttatactcagtatctaaagatagggctggtgatcaccatcactggagccatcatcactgccagcccgcacagacctaatccctccctgggagaatatgtatctgcagcctaaagtctgaagccttttcccaaagccttaaccttccataaaaaataaccgttgaatattttcagaaaggcaggcactccccacaaaaaagaacaagattcccataaatacggtggtgtatcccctagctggccctaattatagagccccaattttcttagtaaacttgtagctagctaagtaccactaggcaatgctaacctgatgccatttatgaaaaataaatttcagagatttattctgtatgtgtgtatttaaaaatctgaaagcaatacggtatactgcaaagaatatggtttggaaatcctatagatttggttgaagtccctgcactgacactaaatagctgtatgttattggaaaactaccaaaagcttatctaagtaaggcttagaaaaaacagtcaagttattttcatgattaataagatgcatatagagaacttagcatagctcttagaatatagtaatagtcatagtttattgagcaattgctattaatattattgaataccatttcagtgtattcaacttttctttccgtggcttattaatagagtatctacttaactgcatattcaattccatgtctttatttttcatattataacattgtccatattaaaatggctttatttacaattttgttgactactattctattgaatactgacagcctaattttatgaaggtctgtgacctttgctatcttcctaacatgattctttacaggaaattacataaaatatcaaaaaaaaggaaaagaaatattgtaactattgcagcctcattcatggaaaagacagggtacccaaactaaaaatccaagggatgaaatcttcaaggacaccagctgatttttgtgcatcaagaagcaaacagtcactcagttatgcagctgagctatggcaaaccttacctgtcttacagaagacagctaagagctacaataaaagaggtcaattgcagctcttctttcatagagttttctctttcatagcatggaaaaaacaaagtcagggattccttaattatttctctgatcctataaattttttgctggcatagttgtttagctgtatgggccactacatgaaatgctaaggaagaaaaaaaaagtgctttttgaaatactcaaaaattgtcttttgaaaactaaattgtgctttcaaggaaaaagtattcacataaaagtaataatcaacaaatcggatataactgatgagattgtttgatagccaccttgcttctattcacgtactctacgtgtcttctcaaaagactcccaccaaaccccattcttgtcatttccagaatgaaaggagacaaattctgaccctgagccacagtgcataaactttctcttttttttttttttttttttttttgagacagagtcttgctctgtcgcccaggctggagtgcagtggcaagatctcagctcactgcaagctccacctcctgggttcatgccactctcctgcctcagcctccccagtagctgggacttcaggcgcctgccaccacgcctggctaattttttgtatttttagtagagacggtttcaccgtgttagccaggatggtctcgatctcctgacctcgtaaaccgcccgcctcggcctcccaaagtgctgggattacaggtgtgagccaccacacccggcctaaactttctaaagcagattccagttttcccaggtaaaatcacacaaagaaaccaaacatataaaataaataaaaggtttttaaaattaaaatacaaagtttttttttttattttttcatagacagagtctctctcttctgcccaggctagagtgcagtggtgtaatcatagctcactgtggccttgacaccctgggctccagggatcctcccacttcagcatcctgagtagctaggactacagatacatgtcaccatgcttggctaatttttttattataaaaatttttttgtagagatgcaggtctcgatatgttgcccaggctggtctcaaactcctggcctcaagcaattctcccactttggcctcccaaactgcttggattacaggcatgagccaccatgcccagctgaatttattgtttttaaatagaaagtacacttgtgtagcacttaacattgcagatacattctgagaaatgtgtcattaggtgatttcatcattgtgagtacgttatagagtgcacttgcacagacccagctggtatagcctactacacacctaggctgtatggtagagcctcctgctcctgggctacaagctgaacagcatgttactctactgcatactgtaggcaactgtaacacacggtaagtatttgtgtacctaaacatatctagacatggagaaggtacattaaaaacacagtcttataatctcacaggaccactgtcacatatgcagtctgtcattgaccaaaacattattatgtggcacatgattgtattataagaaagaaaacaaaaatggctcataagtccacagccaaggacaaaaaatacagaagtaaaacaaatttaactaggaagctgaaaccatacataaagatacaaaataaagagtaaaagcttcttccccttccctctgagccctctccacaaaggtaaacactgagcaatttctcatcattctctctcttctagagagaaagaataataatataaataataatgtaatataatataaagagagttctctttctagaataatgttgatatattaatccaaatacatgcatcttaaaggtagtattttgctaaataaatttataaattaaatttcaaaatatttatgtgcaataagtaaatcaatgagaacaaacaatctgtttttggagaaaaaacatattaggtcagatgtcatggagggctattttagacttaacaaatcttaacactcattttatttgggtattttaatttggttacttaatattacaaaattgtgattcaaacgcatgagcagatgcactatggaaaggtcttaacagccttaaaaatctaaaatccaggaatctaagtgagaggtagttaagaaagtttggctttaaagctgaattattaataatatatagaagctacctgaatcctttactcatacttatatgtcaaacaagaactattcagggctttctggaagtattaaggtcatgtttcaccttcactttttgtggtacaattaagaaagcatgccagagtttgtagtaattcctgccactcaccaaggaagcagaaagtttgtttctgagctcagtctgatcacaacctcacaattttccctactttatattccttttcttgtctctttcctctgtcaccactttatctatcactcctctattgcaaacaatgaagaagtactttctttctagctatataagatcatgttagagctcccagtgctaggtcctagaaccatctctatatgtccacagtgcaaaaaaaaaaaaaaaaaaaaaaaaaaaagtctacggggcaaaatttgttgagtactagaaaagttcctaaatattcccccacatcacccattcccaactaattacagaaaggtcacaatttattataaatcaacaaatatctgaggaaaggtgtaaaaagacgagcgatgtaaaatggcagtattatataactctactgtattaaatatcacatgtaactacttgacaaaggaaagacagacagccttctccagcaagcttcaaaatgctctgcctaaaaaatagattttataatcacgtttttgtaatatctctctgtactgtgattttacattatactaaatgggattccaatggtcactatgtgtttaaagcatggcagcattctttctatatgcaactcctctgaggtaattaaatccttggtgttctttctttttttatttttttaagatggagtcttgctctgtttcccaagctggagtgcagtggtgccatcttgactcactgcaacctccgcccgccgggttcaagtgattctcctgcctcagcctcccgagtagctgggattacaagcatgtgccaccacacctggctaatgtttgtatttttagtagagacggggtttcaccatgttggccaggttggtctcaaactcctgacctcaagtgatccacccgcctcagcctcccaaagtgctgggattacaggcgtgagccacgacagccggccagtgttctctcttttaaatgtcatcttgacagtttgtgagtaagctccttttaccaacaggcactgatctcatagagtgtgcacaaacatacagccttatatgttatgtgttaacttagctgggctctggtgctcagttaggtcaaacactcacctagatatggctgtggaggtattttgtagacataattaccatctgcaatcagttgactttaagtaaataagtttaccctaaaaaacttgggggtcctcatctaatcagttgaaggtcatatgagcaaaaaccacgtttcttgaagagaaggaattgtgcctcaagactgcaacacaggaaccctgtctgagcttccagtctgccagcctgccgcacaaatttcagccttgccagccgccacaaccatgagccaattccttaacatatatgtatataaacatttctttctctggagaaccttgacggatacacatactaaatctccgtcaatataataatcaacaagtatttattgagtgcatttacatgccaaacactgttctagatgcaggtaatataaccatcaatgaaacagacaaaaatctctattttcatggggcttatagtttagtggtactaagatgactagcaaattgttagttaaggtaaccatataattcatcatacaatccagagcacttttaagataagggtgaaataggatactggtaatgattttgccagggcagcatgtctaacccagagccatctcgacaaaccaggatggtacacatcatctaagtctctagtgaaactgaagcccatctcccccacacgaccatgcatctggctaactgtagaaagtcaaaggtgtatgtcattaatcaaagttgaggaacagacttgtagattcagagagatttgggttccaattctcggttacacattataaaaagtattaaacttttactccagcctgggcaacagtgcaatactctgtctcaaaaaaaaaaaagtattaaacttttatgagtctcaatcatgccatttagaaatccatctaatgtgagaactaatgatacacatatgtacagcatatacagaaagaactggaacctgccagcccttcagtaaagtgcatgtaaagtaagtgattaagccgagcagggctggggattaagtggtgcactgaaaactttggtacatgaatataagtctttctctactactttatttttttaacatatgtgaatgtatgtcattggttttaacatttttgaagaaaagacagaaatctgaacattctgcctgggaattagacagcaaagtgcaccagaaatgatgaaatgatggcaaggctataatttagagcacggacatacgtgactctcaagcggccatttatcactgttaagattgctaaaagtgactttaggtttacctttaaaaagtttcatattcattaaactgaattctacaccaatatataccgaagtagaagctgccttaaaagcaggtccaacaatccttctgccctgctggaaactgttgctaggagacgagagtgaagagaacacttcctctccagtgtgaccacaggagctgcaactgctgcacaccctccacaatgcttttgaagcaggtttgaaaactctctgccggccgggcgcggtggctcacgcctgtaatcccagcactttgggaggccgaggcgggcggatcacgaggtcaggagatcgagaccatcccggctaaaaacggtgaaaccccgtctctactaaaaatacaaaaaattagccgggcgtagtggcgggcgcctgtagtcccagctacttgggaggctgaggcaggagaatggcgtgaccccgggaggcggagcttgcagtgagccgagatcccgccactgcactccagcctgggcgacagagcgagactccgtctcaaaaaaaaaaaaaaaaaagaaaactctctgcctatggctgaaacctcagagagattttaacagtctacaaagtatacagatatccctaggtatgatctcaagagtgagaaaagcttccctttgtctcctaatgtttttctccattggcttatcctagagtccaataatctttgtccattctcttggagtcttcctaacaaagatataaaattaagggaactcacagtgaagatgatctattaattctgtgggaggaaggatgaggttactcacatgtaaggacagcatgggtgtgacaactgtttcagaaagcaaagtcccaaatgccccaaaattgtatttatgttcttttgtttgctggtggagagaatgtgagggaatgagaggtcgagaagatctaaggagaggaaagataagaaacacattgccttttctagataggataggccagagcaggagttcatactgaaatactttattatcctgtgagggttagtcaactgagagcaaccacaatatggctttgtttgtttgtttgtttgtttgtttaaactggaaagaaacactgtgtttccttctgattataaatgtaaggctcattacaaacctccattctcctggtacatttttcagaaaacagagaaagtgaaaatctctcaaatgacactgccactgactacattttgatgtacatcttcatcgatgttccctttgcatgatcacacatacacacgtgcacaccgtaacacacttacgtggaactctgtaagtctgaaaataagacaagttccctccatcactataactaatctatccttctgaaaaggagactccatctattcctgtcttcacttcaccagattaccaaatgctctctcaattattgcattttgaaggagaaagtagtttgaggagacacattaacctgaaacaacctcctccgtaccgaattggtaattatttcatactagttacacctcataaccacaaatattaactcctgtaaataagctttttaaggatcacttttagaaagttatactgtgctcacactgacaagatcctcaatatatgcccatgggaagaaggaaaaaagcaggcttctcaggttacgtaagtggatttagagagtgctctaactcaagcaactttaggcagtgctggtgctgacatatgtgaaaagtgtgaataaaattatttcatgataatgataaaaataatatttctaaattgctatcttttttgtatagttgattttcattcactaataaattaattgttataagtagatagttgacttttgcatctttatccctaaaatttcatatgcataatgtgggccacatacttttaaaaataatactcagatatttagcattaccttatgtcgagatttctcaccctcagtactactgacattttgggtcagacagttctttgtcattgaggtagtcctatgacttgtagaatgctcagcagcttaccagacttctgcccactggatgccagtagcacccctcaatgtaacagccccaaatttcttcagatatcatcaatgtccactggtggcaaaaccgccccagttgatctttatatttagggtcacctcatatttgggcatacgtggtgtctagcttgcctttacaaagctggatcctaaggacacaattttataacctgctcttccagctgactgatatgtcatagcgatcttctcagctcattatgtacatactttcagtgtgttcttaactgctgcactgtgcctcattaacaggttgtgtcacaagtgttgtatcagttaacaattgtttccaatttctcagtaccatagtctctatcatttcatatataaattcctttaaatatgttcaattagttccttatattttaagaccaatagtatccttagaattcattttaaatttagtttaaatatacctgaagtcaaaggattaaaaaaagcaatacaacacaatataaggtcaaaacaaatatattttagattgcttattatttatggtttctacccatgccactcttctattagaattgagaccagccaggtgtggtggctcatgcctataatcccagcactttgggaggctgaggtggaaagactgcttgagctcaggagttcaaaaccagcctgggcaacagctgactgacacttcctctttattaaaaaaaaataagaagaagaagaagaaaaaataaatacaaagaattgagaactaaccccccgataagatttattaaaaattccttctaaatgactaaaagctttgctttttcatcagtattctgagcatctttttcaaatacaaaagatataaaacaggcctttcagagatccatatgtaccaaaactgtatagcttctagcatcttttcctttagaaactctatgtgataattcaaaaccaaaaccaaaaatctagtcaatcaatgatttgaagatattttattactagctgtcataaacaattttaagtgaagtctttgggtttcttgctctagagaattctaactgagtttaaaagatttaaaaatcgatgattgcattgtttttggattcaggaaggatatacaaacagtttaatgagactggaaagaggtccaaagcagtttcaactgtacctatagaacttcttgaaagcatttgctaaagcaaatatgtcaagacatgaagactgattaattcagaatgggagtttgtgtttgtgtgtgtgtgtgtttgtgtgcgtgtctgtgtgtgtgtctctgtgtgtataagcacgttctttgaaatattttaaggatttttcataataattttttaaaaatcaactcataatttaataggatgttgcaaataatcttctcatagaaaatcttagaaaatttctctggaattagcgttaccttttcaatagacaaaatgggtaaataaacattattttggtaaattttgtgtatttggaatcttaggtgatagaatttgtttccagacaacctgggtctgatcctcaattccttacattcacattgaattatttatatggttatttaatttttttctgcctaagttttcccttgcataaaagacaaatcgttataatatctacttcacagtgctactgtgagaatagcagaggaaatgtttataaaaattaccttctaaaatataaagccacagtattctaactggttgccaacagtatctaaatattcttcatagtagttaaaacagattaagaattacagtgtattattcctcagtgttgagcatggccccttttttatcttagtatttataaaacaatttcaatgaataaccatttatacacatacaggcagaaacaaaaactgctttctttgttcaacaagtacctactcactggcactctttttgaaggcagagaggactttaggtacttcacataaagtaagtggttttgtatttcacattatttgagcctatcaaaaaccacatgctataggaaagaatgatcttactaaatctatttcagatataggaaaacagaagtgtcgaaagttaagagacttgtttaaagtagtgataggatcaagtctaacagtcgagcttccacatttgtgacaaactactttgctattattgtagctctccttctggcccactgtgaaaagccatgttcatacacatgtttttaacagttatcaagttatggattaagaaatatcatcctatgagatgcatattaccagtatccccatttcatacaaaggaaaactgagggatagagattaagttatttgcataaaatcacacagctgttaagtaacagtggcaggttttgaacccatgttacctgcctgaggagcccgagttcccaaccacgatttgtgccacacacattcaactggcattagataacaacaatctattttactgtatcagaatatgattaatttatctttcttcataatgataaaagattatccaatagcatcttctaaattgacatttatccttcaaaatttattttcaaatcttctgattcattcaagagaaaacaattttttaatgtttactgtattagtccattctcatgctgccagtggagacatacctgagactgggtaatttattaatgaaagatgtttgattgactcacagttccacatggctggggaggcctcaggaaacttacaatcatggcggaaggggaagcaaacacttctttctaaacaaggcggcacagcaaggagaagtgcagagtgaagtggggggggaaatccccctataaaaccataaggattatgggaactacaattcaagatgagatttggttcgggacacagccaaaccatatcatttacttaaaaaaaaaatcataatctttcaaacaaaaataatgctctagtctttttaattaaaccccaatatgattttctaacaattctgtatgcatagttataccaatgtcaattttaataattagaaaatgctattcatctttttcataaatttcatactttaattccacaaaaaataaaaatatacataatttattattacaatatattaatgattttggcattctgatctacaatatagttgttatgctttaaatatattatcacatttgtattgaataaaaccctgagctttatccgccatgaagtctataaaaaaggaaaatcacaattggattaacccatgagtatttaagaatttccttggtagttttttgattcgtaattgtattccaacactttcacaagtaaaccgtagggatttttgcctccagaaactttatctggcagcctagtataactgtgtggtcttccagaaacaatcgtgtctcctttatttttttaagcgtatatacaaagagagagtatatacaaattaacactaattagcaagtcagaaaagcatgtttttctccctagctcttatgagtgttcatatataatttgctccaaaagaaattttagtaagttacagtactgccagaattactttaatttgatggttttaacagggaaaaaaaggaattatggaaatcccctttggaattcaatcacagaaaggaaagattcaattacttggaaggtctttggcactgtgagatagatatacagaaaatgagagccacacttgggtcatcattaactgtaataccatatggcatttcctcctctgagcttctgctaccatctatttacataaaatatgagctgcaaaccaataattacaaacacacatacacacataaatgagagataactatgctgagtgaaatgtaaactgacttttaattattcattaatagtaatttagaatattaaggggcatgacacaatgttatcctcagggtccctatacaccaggaattcacctcatttcagattaacaacccagtataaaaaggcctattaggcccaaattatataaattattcttgaacagaataggtccaatatcaatctatatgattctaaatgctaatctacattcaaggactaaatggcacaaagtagagcgtacatttacaacagtaccaagcacataggtggcattcgctaacaagagcagttacagaaacattctctctactggcaacttttcagctacatatgtattaatttaagagcaagaactaattcgggatatagagaaacacaacccactctcagtacttttaagtcaaattgttgatcatcaaagattctacaatgagctttaagatccttctcaatctgtggccctacgcagccactaccaactgaatggagctggcaggcaagatggaagttatctgacattttatgatctgtgatctcatcttctcccagaaatcaggatgctagtgaatggcctcaccctccatcccattatttaagctaaaaggtgtatgtcatacttgaacctctctttcacatgtagtccacattcaatccgacaattgaattgcctttctaggcattgaatctatcccattagcactgtctctgccatagcacatgaatgcaagtctgtaattacctcctaccattctttcctgtcccctctaacccttgctcctcactgcaatgagagtattagttttgaagagcacatataatcttatgaccaccaccatcccaacacaatcctgaaacagctttacattcctcttgatcttgaacacagacctttatccttaacaagaccttccaacagctggccttccagatgtattccagcataagacatactccttccctctcccccttgacactccagccatactcctctcaatcccaggcacccaccctccaggtactctcctagcacaaagccttagttaggagctttcctcttctctctgctttgttaaacatctactttcagaactcagctacgctgtcccaggacttctactttacagatgcctgtcgtatcctgccaacttgccataagtttaattttactgacccttgaggacaggggctaaatatgtggtgggcttgttcatattatatgaacaccacctagtacatggcctagcaatggtagatgctaaacaaatcctgcttaaaagctagaatgaatgaatgaaaaaatgaatacattgatgcaattatccatagtagattattatatccttgacagagccagtgttacagaagagttggctcctaattaaacagacatattttgtatattatatatagtattctattcatttgatactattgcatttgttcagtattgcagataaattacaaattaactgcagtaataattacatgtgggtatgatcaaaatccccaaatctatattaacaaacttccttaaaatcaaagttgagtaaatttatatcaactttccatcaatatgtgttttattacattcatttaataattccaacaattactaaatttaaaaaaatacaggaaactaagcaacaaaaagttctcttaagagttttcaggacaaagaatacataatgtttcatctgctaaagtagcaccctggcatccaaaagttgtttttgccatattttcaatgataatttttaaaaattacacttggtaaattcaaatggctgaaagaaaacacctgtaataaatctttctcatggaaatccacactgaaaattagtggaagaccctccatattgtagtcagatgtgaacacccctgtcatgactcatgactgctgccatttcagtatggtctggtgtcagaatatagtagggacatgagggttccaggcctagcacaagcaccaaattactggcaaacactgtcactggaggcttgttggaggcttgtttctgcaactcaaaacctaaaatgacatctctgcctcagaggattataggaagaagatgacataggtattttagaattcttaaaaaatataatactataaaatgtcaccagaacaattctgagattttagagtcatttatgacaaggcatgcaaccagattgccaactcttgtggcaaaatcaaacctctgcatggtacaacatccccaaattccacataatttaaccagatgcacttaaaaatcactgcattgcattggtgccacagttttttgttcctatacatttcttacaatatattctactggtcttaaagaagtttgtactgagcaagcatcatatctattcaactttctttctgtagagtctagctctttatgcaaagacatacttaataaaatgcttgtgaagagtcatacaacgagataatatttactcaaaataagacaaataatattctgcactcatagccatagtaacctatgatataagaaagtgtgttagccgggcatggcggctcacgccagcactttgggagaccgacgcgggcagatcacctgaggtaaggagttcaagatcagcctagccaacatggtgaaaccccgtctctacaaatataaaaaaattagctgggcatgatggcgggtgactgtaatcccagctactagggaggctgaggcagaagaatcgcttgaacccgggaggcggaggttgcagtgagccgagacagtgccattgcactacagcctgggcgacagagtgagactctgtcaaaaaaaaaaaaaaagaaaaaaaaaagaaaaaagaaaaagaaaaagaaaacaaaagaaaaaaaaaagaaatagcctgaagatctgaacttaaatcatctacacatcccattctaagcactaactaggtacttacaatgccaatatcatataagtcatgtgaattgcaagtacaactcaagacaaactatattttaaagatatttaagaaggatttttaaatgggtgcatgtattttaaaatgttatgacatttaaaacaagtccacgtcttaccgattttttagtagtaaaaagaagaaataatacattctatcaatatatacctttggaaagaatcaagctgtaaaacactgaaaactcttcaattttcataggtaatagtggctttagggctttcaaagtataactttttatggattaatcatttgcaatctttcagactttgatcatatattatgaatgttaaatgttataatacctttcttagttacatgaattcaagcggctgttattctataattctaaatacaattcatttctggctatgcctaattttacactttatgccttttttcctttaacttaaatatgttgtttggccaacttccagctttggatttttaaggtttatattggaacaagtttcattccaatttgatttgtgacagataacattgtaagctacttttctatattgcctctgaaaaagagctatttccattcctacacagtatacagattaagaaagttaacataagtaatgtaccactataatttgaaaatattcatcttgttcacgttctctagctcttactaagagatttataatgccactgaaacaagaattgatgaattcatcactgtctgggacattttgatcataatcaataacataattttacccttaaataggatttcaattaatgcatatttttcaaagcaattttcctttaaaataaaatgggtttttgtaccatgagttattaacccattaggtgccaaaaagaaaattattctgtctctgaagttctacatcagaaaaaaaagaaatgaaaccaaactctgttctattatacatttcccacaggtacatttcataaaaaattacattattatattttcatcatggaaaatgaaaagtaatatactttcgtaaaatgatagaaccatgaaagttttattagataaaagtgaggacacccaaatgcattgctactgcttggacagagtatatttatcagcaaagaaaacattttcatctaaacaaaatttatttgtcatatcattatgaaacatcaagaacaatattaaaaaccctgtgaaacttatgccaggcatacaaaatacactctattttatgataatcctcctatcctagccatttcatccattattttcctgttctcactactagaatgttgaaagaacacagatttctctcacacacaatacaaaatagcttccttcaacaaaaataactcaaaattcaaaaattattttaaatgtatagtataatcattttattataaagaagtcaccctcatttttttaagcttcaaagcatgtcctctactttactactttctcagaaataagcctaagtattttaccccttgtttcaatcacaattagctggttcttgctaaatgattcagtccagctccttatgaaagcatgcaagaggctcacttctcacctttccttatgcagtgttctctagttctgcccactaaatctgtttcaccatcacactgtgtctttgtatgcaatttcctctgcatcttctccccttcccatgtagaaaatgtgaactgatccttcaaaataaaaaacacacactattttctcgtagagtcttctatgacccccttggataactgcttccttccctatgattccatagctatttatgcagacctctgagacagtgttcaatttgcattctaattatttatctacttgtttgtccttcctacaagagtaggaggctcctggaggtagaactcattggtccttctatcactagtaaccctcaagattcggtacctaagacattcaacaaagtaaagagatgggatgagtgattgctgtccacatggtctgttcattgatcttaaaaccgtcagccccaaagtagggacttgccaattatttagaaatgcctatctaatctttctactgtattcaacttgtgtaggagagttcaagttcctgggctgggtactcaagatgtttgattttcaaattaaagagatgaaatttatgacactaagaattctgggtgctgagcaacaacattcaactaagaaagaacaagggagggccgggtacggtgcctcacatctgtaatcctagcactttgggaggctgaggtgggcggatcacctgaggtcaggagttcaagataagcctgaccaacatggagaaaccccgtctctactaaaaatacaaaattagccaggagtggtggcgcatgcctgtagtcccagctactcaggaggctgaggcaggagaatggcttgaactcaggaggcaaaggttgcagtgagctgagatcacgccattgcactccagcctgggcaacaagaatgaaactctgtctaaaaaaaaaagaacaaggggtcagggagcaattggccaccactgacttcagtatctcaagttgagttaggaacttaaagaacaagtttctaatgtaatttctgtaaaaattctaatgcctaaaatgcagcaggaagatacagagattaaaatcaggttaaagcaaaactataaagacaagtagtaatgaggatatacaaggtgcaaagacatacagttcccacggacaatgaggttagtaggggttggtttgggagacctggcggtggccttattaggcagggtggggaaccctgagcacagaggtttctttactagaagtaaccaaacagattctaaactctgctctctaacacttgaaggttcctgtgtcctggaaatctttattcaccaaacgcagtttgttgctttgttaaatatgacagggttatggctgaagtaataatctacgcgtatctatgtatttaacatattctttagtccctcacacttttcttgaagcagaaaaaaaggcacagagaaacagttaaatgtgaggcagaaataattttttcttttaaaattaaattgtttattaaaatatatcgaggggatacaagtgcaggtttcttacatgcgtatactgtgtggcgctgaagtctgggcttttgatgtattcatcacttgaacagtgaccactgtacccagtaggtttttcaaccctcatcccctcccaccttttgtattccctaatatctattattccactatgtccatgtgtacatgtttagcccccatctgtgagaacatgcaagcttatatatatctgcaataaacatatgaatgaaggtatctttttttttttaataatttctttccctttgggtacatatccagtaatgggattgctggatcgaatgatagttctatttttagttcttacagaaatctccaaaaaggacaatctgaaacctgaaacggggcaacctgtttggaaaacagcatggagatttttttaatgaggttacttttttttttttttcttgttgagttgtttgagttccttgtagattctggatattagccctttgttggatgcatagcttgcaaattttttttccattctgtaagttgtctgtttacactgttgattgtttcttttgctgagaagaagctttttagtttaattaagttccatttatctatttttgtttatgttgcatttcattttgaagacatggtcataaattatttgcctaaacccatgtccagaagagtttttcccagtttttcttataggattttaatagtttcaggtcttacatttaaatcttcaatcaaccttgagttaatttttgcatatggtgaaaggtgtgagtccagttttcatccttctgcatatagctacccaattttcccagcaccatttattgaatagggtgtcctttctccaatgtatatctttgtcaactaggtcaaagatccattgcttataggtatgtggctttatttctggtttctctatcctgttccattaatctatgtgtgtatttttataccagtatgatgctgttttggttactatagctttgtggtataattgaaagtcaggtaatgtgatatgaggtaggaatgattctgttgcacactgtagagattttctgttccaaaggcttgggttgggggaaagggaggcagaagagcgattgaagctgaagggaaaggtgtgaaggaaccaagagccttgacaagatgaaggcagggggaagcatcttgcactgggagaacaagggagcagagtagaacccgacacccagctgctcccaaatatgcctccaccctacaaaacatcaacccattgcctgtgcacaacccaccagccgatggtcctacattccttatcagctaattcttagcagaaagccttttatatatcagggattgctcaaaaatagttcacatggattaattcttccaatgctcacaataaccctgtgaggcaggcaccattactatctcatttcacagaaaagtgtggcagggaagagttaatatcaaggccacagagactgacactcttctaagcaaggaggtgataacctgaccactgtatgtggggatgagcacgtaaggggagattttgtgctacccaggaagaaactgaacaggaaaaaaaaaaaaaggaaatttccctatgagttgggttagttgcagacatcactgtaaagtttagtaaaagccatcttgaaactgctgcatgtccagaggaaacaatcacaaaacgaagagcattttaaatattgttttaaaatgttttttaagacaggtgttaaaaattactatgattagattagaacttgcactggttccttgtagacagaaaataagtgtgtacttccaggaaaagagacgacaagaggagtaaagcaacaagttagattggggattaagtgggcttcagtttcctcacttataaaaaagagaagatagaattgaaacaaaaccaaaaacaacttctatctgaaacctacccccaactcccaagttacatgaaactaaaaagaaaagcccagactttggatggggagaatgtagctgaattcagttatttgctatactggtgaagccccacaatactttttttttcattttattttttgaatttttgaatattttatttcctctaaaaaaaaaaggtggggggatatgtgtgcagaacatgcaggtatacacgttctggtacataggtatatgtgtgccatggtggtttgctgcacctattgacctgtcctcgaagttccttcccctcaccctccaccctgcaacaggccctggtgtgtgttgttaccctgtgtccaggtgttctcaatgttcaactcccacctatgagtgggaacatgcagtgtttggttttctcttcctgtgttagtttgctgaggatgatggcttccagcttcatccatgtccctgcaaaggacacgatttcattcttttttatggctgcatagtattccatggtgtatacgtaccgcattttctttatccagtctatcactgataggtatttgggttggttccatgtctttgctattgtgaacagtgccgcaataaacatacgtgtacatatgtctttatagcagaatgatttatattcctttgggtatatacccagtaatgggattgctgggttaaatagtatttatggttctaggtccttgaggaatcaccatactgtcttccacaacggtcgaactaatttacattcctaccaccagtgtaaaagtgttcctatttctccatggcctggccagcatctattgtttcctgactttttaataattgccattctgactggcgtggcatggtatctcattgtggttttgatttgcatttctctggtgatcagtgatgttgagatttttttcatatgtttgttggctgtgaaaacttttgagaagtgtctgttcatatcctttgcccactttttgatgctgtttttttttcttgtaaatatgtttaagttccttgtaaattctgtatattagactttgtcagatgggtatactgcaaaaattttctcccattctctaggttgcctgtgcactctgatgatagtttcttttgctgtgcagaagctctttagtttaattagatcccatttgtcaatctggcttttgttgcaattgctaaaaccacatgattatctcaacagatgcagaaaaggcctttgataaaattcaacatcccctcatgttaaaaactctcaataaactagatatcgatggaacatatcttaaaataataagagctatttatgacaaacccacagccagcatcatattgaataggcaaaagctggaagcattccctttgacaaccagtacaagacaaggacgccccctctcaccactcctattcaacatagtattggaagttctggccagggcaatcaggcaagagaaagaaataaagggtattcaaatgggaagacaggaagtcaagttgtctctgtttgcagatgacatgattttatatttagaaaaccccattatctcagcccaaaaacttcttgaactgataagtaacttcagcaaagtctcaggatacaaaatcaatgtgcaaaaatcacaagaattcctttatactgacaacaggcaagcagagagacaaatcatgaatgaactcccattcacaatggctacaaagagaataaaatacctaggaacacagccaacaagggatgtgaaggacctcttcaaggggaactacaaatcactgctcagagaaataagataggacacaaacaaatggaaaaatattctaccctcatggataggaacaatcaatattgtgaaaatggccatacttcccaaagtaatttatagattcaatgctattcccataaaactgccattgacattcttcacagaattagaaaaaaactattttaaattatggaatcaaagaagaccctgtatagcctagacaatcctaagcaaaaggaacaaagttggagacatcatgctacctgacttcaaactatactacaagggtacagtaaccaaaacagcacggtactggtaccaaaatagacatacagactaatggagcagaacagagacctcagaaataacaccacacatctataaccatctgatcttcaacaaacctgacaaaaacaagcaatgggaaaaggatctcctattcagtaaatggtgctggaaaactggctcgacatatgcggaaaactgaaactggatcccttccttacacatcttatacaaaaattaattcgattgattaaagacttacttaaatttaaaacctcaaaccataaaaaccctagaagaaaatctaggcaataccattcaggacataggcatgggcaaagacttttaattattctcagtttattctcaatccagttttaagatgtctataagaaaagaggagggagtagtttttgtttctatcatgtgagatacactgtggttagaatgcggcatgctttataagtctgaggatcattataatggtatataaataacaatgagactagtgaataaatatcctggattttccactgatctggggaaaataagtaaatctgcaaagaagctataattccttggaaaacagatgtgaactaaaatatcattttttaaaaatggcattgtatatacaaatgctctgcaattacttttaagaaacaagttacaggactcaaatttcctatctccacagagcgctaagatattagtcctaggagagcgaaatgtcctggaagccaagaaaagcagagaaaataagaacataaattcaggaggtgaattaaggttgttcacatggagtaacattttataatgcttttatgtcaaaaataaatttgagattaatcattttcccacaaaaaatgttgtacaaactcccatttttaaattatgtcaaggtttaaaaatagaacactcatttttaggctatgttggtaattatgttaaagcactacagtacttcaggaaaataattaatacaatgaggtttcttggtactatgagctaccttggtatctataacctgcatattaaaatttaacaagtaagagcttataacaatcagagtttcaggacaagcaaattgactaattcttgtttccattataaacaaacattgaatttacaaggtggaatacagatgacgtattcaaatgagtttacaaagtacttaggattatgaatataaacctacattaataagaagactgaacacatcaggttactgctaaactctaattacttacaaattaatcaagtacaataaagaaaattatcatttgaaagacattcttgataatactactaagaactgtcaagcttcaattatccatgctaattcagaaagctggctaatcctaaacagtggataatttaacaattctttctattggcacagattatatttctgtgcgtgacaaatttaccttagcaatttgtttttcttagtttaatattaaaaacaagtcttgcttccttgctagatcagaatgcaaagccagccagaagattttttacaattttaaacgggttaattaccaagtatataatccacatatacagtatataaaatctaaatgctgtttaaaatattttagttaagctttcaaccacatttaataaatgcatgttaaggtatgtagattatgacaaaaatgataaaaaggatgcaaatttttttctatcactttgaaagtctgtcaaaatttaagtcatataaagtaccttgtgagttattatttcattttacagataaaactatagaaccttcaagaagtttcatgtggagtgactccattatggtaagtatattggtgtcctatatatatatttaaaatatctatcgcaaacatagatcttttgagttccctctttctcacttttctaacagaaaaatatagcatacacagggcatagtaaagaacatggatactggagcttgaatatctggattggaatctcgattcaccacttagagctgagtaaaaataggcaaattatttaacttcttagagcctcagtttcttcatctataagatggggttaatattagtacttatctcttagggttgttatgaagactaaattaaatgatacatgcaaagcagttggaacagaacctggcacatagtaaatactcaatgaatgttaggatttacatagcattaataagcacaattacttattttcaaatagataactcatagacaagagaggaaaaaaatctatttttctttaagagaagtgtcatatacatttctcaatttagcttataattatgttgattaaaacaataacaaaaatattctttgaaccattagagtaataattttcccctggtgtcaaggttaaagtaaggaagcagatatatcctcagtaaactcatcagagtatttcatcaagattttcacagttatatttagaaaatgaaaagctcataattgtaagattaaaatatgaaactttattataaaaagggcacagattttaaaagataagcagagagatttacatgagaaaagtgcagtatcacatctagtaatagtccaacatctactttaccttgtcattgttactctcccggtggaataaacagaaccatgtcacctcaggagttaatgctggccaagtgccaaaggccagcaatggcaagaaaggctgtggacagaggacctgggctatggctagaagagaatgccagagacggggaaaaactgacagggtaagagatgagacgatgaggacagaggtgctgggccagcagttgaaggagaggggagggagcaccataagtggctgtgtatgggggcgcagcagaaccatccacggtcagaccaacacagtgacaaacagccactcaagaagttcctaaagaactcaagcgttgacacaaaaggatgtgatgaacagcactcattcaggctcccactgtagcatcctgtggcctcgatgagtgggtgtggcacctggtcatgagaagtatctaataggtaggcccagggacataaagtaggaacaggaaggacagacctttcagctgtacttctttcctatatttaatggcacctgctttctaggcatttacttcattctgagagtggatgataatgatgatggtggtggccctggtggtggtggtaacgatgtatcttgacttacaatcatggtttccttcccattttgagatagacacaatgattcccgtttgagaatctgaagtaccaagacctagagaggttaaacaatttgcctaaatggcacaataagtaacaggaaagattgagttttgaaatcagtctctaaacctctaaaatccacagttttttttattataccatctactatttcccagtatacctcaccacagaaaagccaccatatcattgacctaaaagcctgaaacttctacttgtgaaacttaaaaagcatgaggacatcttttttttttaaaggaaacatgttcttatgctcttcacatctgaatagattaatagcaacaaattagaagtaaaatgattatacagacacaacatagttgaagacattaagtgttgtatcttcttgagtcacgattgcccccattaaaaaccactatgttttaaagaggactgtttatttagagatctggatggtaagctaaactttagaattaaggaattcagatttaaccctttgttacttgaatacgtttacatatatatttttaaaagcccttcctaattcaagaacgttaccccatttgcaatctctttgccagtctatgccatgacaagcctcatacacagtttccacttttatgtataccagtgactttctggatgccaataattcatacttccccaaaacagatacttgagaacatgaatcatcctagactattaaattaggagtgcactatcgatttaagaataactgacatgagctaatttgcagctattcctctggtatttggccctcagttggcactacaaagttagaatcctaaatattccaaggactggaattccataatctcttacaaatttccaatcttgtaagagattataggattgagggatggcatatttggcatcaatagaattcaaacgtctcaaatattttccaaattgaaaaagtgtccacttaaatactacacctggacaagaaattaataaatcaccaaggaaagcaaatatatcactttagaagcacatttgcaatttttaagttaaactaacagaaaccaaatttccttcctttgtgctgctaaacatttgacaaacctaaaagtatccttggtaaagtggctaataaactaacagaattaaatatcccttttgagtacaactgattacatgtatgcaagtacacactcagaactctatcaatttcaaactgctgtgaaaagtgctgaattccattctttcagggagatagaaaacatttataacagcaacagccctgcagtcacatctttttgtaactagctctaagaacgaaaaaaatctttatgacaataacaagaaaatgaattttcattttaaaaggcagtccctgtgccatcactggctgtcctgccacccagctcctctgaaggcattcagacccttcactggaatgtctcaaaaatcaatagcaatttattctctctttggaccccaagcaacaaaagtaaataatactgtcacctccagtctgcctgcagaacatggtcacaaaacagccttgccactaaaatacaaccttacgcagctctttatctatgctggcgctactgattgtattggctttcgtaggggacaaatacttcagcaaagccacacaaagaggtcaagctcttgtacctcagccagaaagaatgctgggacctgaattaaaaagaagacttgccaccacctaagcttcctgcttcaacaatgtgggttttatggaagaaaaacaagaatatttattttccaagattattaaaactaaggggaaaaatgtaagattaaatataccatatttacaattttttcctatagaatttaagaaaatcatcagatcactgaagcaattggttgaaccataatattttgcagctaaaatctataggtaggcaatttttatactgtctgataaaagtattaatccataagcaaactacgacttaagaattaaagttctactttgataatgtttaaccaagtaggtgatatcaataccattcgattgttgaagacattatatacactctggaatatataaaatggcattttgaagcaacagaaggaatactaggaataaccaagtataatcttatctatttagagaaaaaaggaaatcaagctctatatgtaacaccagaaaaccagttaatggaagaagcaggactacaatcccgtctaacattcttttcactatactgcttattgatgaaaaattacttataggcatactaaagaagagtcaggccaggcgtggtggctcatgcctgtaatcccagcactttgggaggccgaggcgggtggatcacaaggtcaggagatcgagaccatcctggccaacatggtgaaacctcgtctctactgaaaatacaaaaattagctgggtgtggtggcgcgcgcctgtagtcccagctactcacgaggctgaggcagaagaatggcttgaacccggaaggcggaggatgcagtgagccgagattgcgccactgcactccaggctggcaatagagcgagactctgtctcaaaaaaaaaaaaaaaaaagagtcaaagtcattttgatgacaataagccatcatccctcagggctacaaattactccttaagagaaaaagcaagtactttgaaacatttgtgcagtaatcaaaaattccgaaatcatagaagaatttaccagtcaatcataccagaagtatttactgaatatctgctgtgtacttctcactagtaggaaatacgaaaaatatacatacatgtttaggaaatattaaaatattgaatataaaactattaaataaaataaaatattaaatataaaaacaaaaatattaaaatattaaaaataatcagatgtcaaattgtacagtcaaagaataaatggaaatcaggcaggtgctgagaggaggagagaggggaggtaggttggatgagggacagggaggaagacaggtgacggaggcagacaccagggctgcagactgtgagtgctgggaggtgctgcggggaggatgggcctggcagagcagtggtgcccatgaagtaaagtgaagacagagagtggggccagacactggaagctccagaaatcaggcagaaggacttgaacttaatgtggtagagactccagataatatagaattaaccattttaacttggcaacatcactcctattgttttttggctcactcctagctcaaaaaaacaaaaaatacactaaagatgttgtcttattggtcagaaaaatatgacttaaaaatataacaattttttgaaccaaaaaggtgcttcctggaaatttcatttaaataacaaaaaacataccattgtgaaaaaacttcactcaaaacttacagttttctgataaaattaatatcattaagctaagggagaaaacaaatctctgaatccctcatttttattcggtaacattaaccactttggcaaaaaaaataaatgaacactaggattgggaattttgaaaaatcatgtttaacttttgtactttaaagaagatacaatgaagttgatatactctatcttctataaaactatgaggcatctaaggttaatcattaaaactgattaaatattatatttaaaaacaaatactcatttatgttttttcaaattttagaaagtttgtaaattctgtagtaaaccaaaattcttttctctttattttatgcattcattatagaaagttttgggggaaaagtgtgtgtgtgtgtgtgtgtgtgtgtgtgtgtgtatgcatgtgtatagatatacagacacacatgaataatcatgtgaaaacttatctgccagaggtctactctaatatttgttacaggcctctttctgattttaaaacaatctacagcagagatataaatattttacttatcactgtcaatacatatcaaatgtcttgaaatgactatgtcaaggtaacacagtaactacacttataagaatatatcttacagaaaagattgtggatgtggacagtggtctagcaacaggaatgttcaatgaaatattgctggaaagatgaaaatgggaaacaagtttaatagccaagagcaaagcattcaatatgtaagttataaacatattcatactttttcatttttatacatattaaatatagtcactgcccatccatttatttctcctattttcctaattttgaaaaagagttcccagaatatttgcaaattaatctgtaaacactgaatgatagtgcctgccctgaagcccacatgaggtgcttcgaggcagaaacggtgtgtagctggtgcccagaacaatgcccagaacagcacctgccacagaggacacggtcaacaagtacttaacggagtgaaaataaaaagttaactaaggatttgtaacttacactcactcactttgaaaaaaaacagaagcagtttacaacaaagtatgataaaatgtagttttcttttttaaaacagggtctggcttgcaatggcaggatcttggctcactgcaacctccacttcctgggctcacaccgtgctcccacttcagcctcccaagtagttggaactacaggcgcacaccatcatgcctagctaatttttgtattttttgtagagacagagtttcaccatgttgcccaggctgatctccaactcctgagttcaagcgatccacccacctcggcctcctaaagtgctgggattacaggcgtgagccaacacgcccagcctagattttttttaaatgtaaatcaaagtaagagaaaaaaccaaaacatccaaaccatacagaggaagatggaaaataacagaatcaggaacctgagctcatgccaacactcaatcatacgttcaaactttctgtcaagaaaggctacagcaggactgcaagtgtggcggaaggcggcagtgtttaaaatgtaaaacttcagatcaagccagcaggagtcaaagcctgatttcaccagttgttagcactgtaggactctggagaaatcaatgactttttctgggcctccttttcctcccatacagaatggagctcttatgagagcatcaccatagggttctgagattgacaccagccaatccgtgcacagtgctagttgcatggtgtcagaacacattaagagctcaatgtatgccaaatctgttatattcatcattacagctttgactgtatgcaaaagataccattcagttcttccaagctgcatttatttcatagattcaatatttattgagactaaatatttattttaaaacttggttggatgaagccccaccaatgtcttcaaaagcctaacatggaaatggaagaacagaaataccaacatataacagtgactcaggtgacatgcatagaatagagatgtactcaatgttccctgaagtaagaggaggaaatgatggattactgaggggtacggctgtggggcaatatcacattaaaagtgatgtaggaactaggacatgaaagaggagtcagagtacaaccaagtagggaataatggtattggaaagtcattccaggcagattggacaacataactaaggaaactgaggcatgggaggacacgagaagctgatggtggttgaacactgtgtgataggatgctcgtggaactgtgacagaaaacaaaatggcaacattctgttggggtcaatttttgaaggccctgttgtgcaatttggactttaacaagtaagcaaaggagagccagtttgggctgataatgacatcagtgttttagatactaggattatcatggaagacagattggatttagagagtgggaagaaagaatagaggctaaaacatcaatactccaggcaacaactaatgctaggtaataaataatacagactggaaacaagacaagacagtcgagttggaaagaaggaaacagatgccagcaatattgctgagggacagtcagaagaattagcacacaggaaagtcaaaaacgatttcatggttttgaccttatatggctagggcagtgacaaaattaattaaggatggtaacatagaggaagcacattttggggcggcagagaaagaagactttattttatttatttatttatttatttatttatttatttatgaaacggagtctggctctgttgcccggctggagtgcagtggcgcgatcttggctcactgcaacctctgcctcccaggttcaagcgaattctcctgcctcagcctccagagtagctgggattacaggcacgcaccaccacacgcctggctaatttttgtatttttagtagagatagggtttcacaacgttggccagaatggtctcgatctcttgacctcatgatcccccccgcctcggcctcccaaagtgccgggattacaggcataaaccaccacacccagcccatttttaaatagattgaatttgaggtagctctggaaaacaaggaggtgatgatattcaacagaaagatggaactaagacacagaagctcagaacgtggattgagaggtcatctgtgtaatagatgacaggcaaatttacaacaccagggaaaatttcaaggggacagcatttgaagtcagaaggaaaccaaagtaatgacacttactctatcactaaaaagtatgatatctaaaataaccagtatgcaggacttaaaacaactacaacctacactaaaagatagagagaaacactttaataaatgtagagagatactatgtgtctggatgggaagaataatttgtgtagtcatcaattctctaattaatctgtagatttaataaaattctaataaaaaactgtaatatacttttgggaagcttaatgaaattattctaaagtcatctggaaagagcatctgagaataactatttttaaaagagtaatatgaaaggcaaaactgacctagcagatattaaaacatattgtaaaaattcaataatggaatactgacttatacacaaaaagattactaggttagaaagtccagaaatagacaaaagtatgtgtaattattcaaagcataaaaacctgcaatttcaaatcagcaagaaaaaagataactttaatcttttagagaagcaacatgatgagaaagctttttcttctgagttgtgttaaggatgatggaggtcgtctaagcttttcatacttagagaggaagacactagtaacagaaatacaaaagaaagtgttcagttatcacaaagtcagaagtaaggaagttgtggattctagtgaatgtttactactggagggaatcatggaagaaaccaccaaccataatgaaatgatgccttcagaaaggaaagcgccaagaaggatgacttgacaacaatgctagagacagctcttaagaacagatgttttgatgagtttccatacccaatttattggaaatatcaaaaaaaaaatagcagaggtgaaaaaaataaaactttattgtcagagattgggcttgccaaatttaagatttctgagttgtcagttcagagaaatggcataataaatcagactgcagcagcagaaatgtctggccaggatttgggcaggtcaataacatagatttctgaagttgccaaaagaagtgcccaagaattaaggcagatggggacagggtattgaatgatagcttcctccattactgtggaggcatgacctgtggtaaacagagggagagaaaagaaagaaagagatttagctaaatattttgagcttcaactaaggtaaaaagttactgacaacagaatgtgaggctgagatatgtttttatttttctctccacagtgcctaacacacagtacacatattgtaaaagattatctaagaatggctggacgcggtggctcacgcctgtcatcccagcactttgggaggcaaggcaggtagatcattgaggccaggagtttgtgagcagcctggccaacatggtgaaaccccatctctactaaaaatacaaaagttagctgggcatggtggtgggtgcctgtaatcccagctacttgggaggctgaggcagaagaatcgcttgaacccgggaggcagaggtagcagtgggcagagacggtgcaactgcactccagcctggccaagagaggagacaacatctcaatcaaaaaaaaaaaaaaaaaaaatgacctaagaatcaatgcatgtggtaggaaatgctggaaaaaaaacactggagaacttaaagacaaccccaaattctgatcacagggcataggagataaagcagaatgagtagcagccacatgaaggcatcaaggtaagcagcatcaccaaaagaaagcctggctcagccaatgacgacaggtaaaaaggattaataaaaagacagacgggcaagggcagttcaaggaccataacagctgagctagtgatggaagacttccttttgcacctttcgaataaaattatttcattatctccacaaagattcacttccaggtacttggttattctggcctcccaccctctatatccattagtccccaccgtgaaaagcactgtggagaaaaaaaaaaaaaaaaaaaaaacactctttgcacctgaaattatcatatttaatagggaaaaaaatggaaaatattttccaactgttgtttatttctgaatttcagattttgttctcaattatactggcctggaactctgtcagaggtgaatatactcagacccatatgactgatttacactagaaagctagtctgtcgattgctagtatgtaatgcaattgtcaagctgacccacgtttgtataatacctgcatcaactcaggaggtgttggctagcttgcaaattttctttgaaaaagcgcttacctaggcaaaggacaacgtattttttgaaagctctattgaggtctgacacacaataaatcacatatatttaatgtgtacaatttgacatatttggacatatacatatacccataaaaccattacaacaatcgagataatgagtacatcacccccagtagattcttcctcccactttgtaatctcttccttctgcctctccctgacatcctcccaccctccactcacccatttgaattacagattagtttgcattttctggaatttatacaagtcaaatcacacagtttatattcttttgtctggtttctttccttccacacaatgattttgaaaatcatttcatgctgttgcatgtatcaataattcccttttattgttaaatagtattccattgtatagtatacaccaatttgtataaccattcacctgttgatggttattggagttattttcagtctttgtctattacaaataaagctgctatggatacttgtatgtgagtctttgcatgaacatatgttttcatttctttggggtaaatgtctaaaagtagaatggctatgtcataaggcagctgtatatttcactatataagacactgccatactttttcccaaagtggtttctccattttccattcccatctgtcatgtatgagatttccagttactctgtatcctcacccgtacttggcatctttcaaatttcagaattctaataggtgtataatagcatttcattgtggcttcaacttacatttccccaatgactaataatgttgggggtatctttgcatgtgtttacttgtcatctgtatactatctttggggaagtaactgttcagatctattgtctatgttttattgggttgttttagtatttattgagttttgagagttctttaaatagtctaaatataactccttttatcagatatgtaatttgcaaatatgtttctccaagtcctgacttgtcttttcattcttttatcaatgtggttttttactcgtttgttttttgagatggagtctctctccgtcacccaggctagaatgcagtggtgcgatcttggctcactgcaacctctgcctcctaaattcaagcaattctcctgcctcagcctcctgagtagctgggattagaggtgcccagcaccatgctcagttaaatttttgtatttttagtagagacagggtttcaccacgttggccaggctggtcttgaactcctgacctcaggtgacctgcctgccttggcctcccaaagtgcgggattacagacgtgagccactgtgcctggcctttatttatttatttatttatttatttatttatttatgaatgaatgagacagtttcgccctgttgcccaggctggagtgcaatggtgcaatctcgcctcactgcaacctccacctcccgggttcaagtgattctcctgcctcagcctcccgagcagctgggattacaggcaccctccaatgtgcctggataatttttttctgtacttttagtagagatgggatttcaccatattggccaggctggtcttggactcctgacctcaagtgatccgcccacctcggcctcccaaaatgctagaattacaggtgtgagccaatgcacacagcaaggtgttttgaagagccgaatttcttagtgttgatgaaatccagtttataaattgttttatttatgaatcctgctcttggtattatatctaagaaatctttgactatttcaaggtcatgaagattgtcatttggaagtcttatagttttaacatttaagtctattgtttgaaaaaggacattttttctaaatatgtcttaactgacatattactgacagaagtaagtaaccacacctattaatgaagttgcagcatcagcatctcaactattctgggagacaatgtaggccaaatgttccctgatattatgttgataataaccccttctcaaaagggcgaatactttacttcagtatcaataccaaggaaggaaaaactgtggtgtgagagttctgctccctgggtgccctctctattttgcctctgacccatgaaactttaaaaatgaagattatgaggaagaacaggccagtgaggtcagagtcatgggttaaagccttagggtcagcagtctgaggatcttcattttaaattttcccctactgtaactcccttgctcattgtttgggtatatttcctattcaatgttaatgttaaaatatcactgccatcttgttttttctctttttgtttctgatcctatttcctttcattaaaatgttattttctgttttcccaaaattattaaatacatataacacattttcttttcttcctcaaatattattaagtatagatacatatacacttaatatatacttaattaagcatatatatactaaataatatttgaggaagaaaagaaatatatgtttatatgtactatgtacatgtatgtgtgtatatacagatacatatatacttaatatatacttaattaagcatatatacttaatatttgaggaagaaaatacagatatatttatatgtactgtatgtgtgtgtatatatatatttaatatttgagaaacaaattaaaaaacatatatactatatatatgtacacacatacaggtcatgagatcaagattattgtcatagaatccaaatctagctagaaaacacaaaatttaattcccactgcaattttaaccccacagatgagccttgataaagtaatgagagagcaataagtagcttatcttttagaggtaccagatctgtttctagtcctaaggcatttcagtagaatgcttatttcaataaactcacttaatgcaaaagataagatcataaaggcttgtaaatcaattttttttaaaaactaaaacataaattcactagtggagctcactatttaggtaataactctattgaaaacacttttatagagtaaataatcactccttctcataaattcaggtttacatctgtaggctttctttaaagcaatcttcagtgaatcattttctgaccactgtgtccaaaataattttttaacactgcacaaaaggagatatttaatataaactgttttccgaattgtccttattattgttttcacagcagccacaatgtgattaatattggaaaaggcaccattatattcaagcctcactttcaagtagataatattttaaaacataagacacaaataaaacaaagttattgcaaaaagttggcaaaatatagaaaatctctcgtttggcctctcactttcacacgtgtttttgaaaaagattccaggaagactcctctgtgctcaacagcacagaacagcacatgcactctgtttccttttcttcatgaaaaatcgtaagaatgtggaagaaaaatagtttattagcaaaaaatgcagaaatgtaccaaagaaaaattcttttgtaggacttctaactctataagttattaaaatagatacaactcaggaaaaatttatcatgaaatcaaatatgacagaaattaaagaaaacttaaaggtgtgttggatgcctgaagttggtgttgggtgatgaaattgaggcaggagaatagagtctggaggcagggaacctaaagctgtttcacactgacttcctaaaactaaattgaaaggaaaaccctaactttccacacctaagtaacaaaaggaccagagactactccctttgcaaacccccaccttgtctgcatggtagatgggaaatttaaagttacataggagtgtgacctttgtaacttttcccttcagcccctgattactgtctacagccaatcaaaatgattgtgggccaagccttcatttgcatagaagtgcaactttgaaactttagcctctgattgattgcataaagcataaagcaatcaatcagatgtttgcacaggtgtgtgacctttgtaacttcatttcagcctctgaatggtcgttttccaaggtgaacaccaagtggccaatgggaaacctctagggggtatttggacccaagaatattctctatttgggtccaaatagacccaactcccacccgctcccaccctgtggagtgtaattttgttttcaataaatctctgcttttgttgcttcattctttcctttctttgtttgtgcattttgtccaattctttgctcaaaatgccaagaacctggacactcgccactggtaacaaaatgaatatttttatatgtgacagtattttagaaaataatgtgactatacatattcatatacatatacatagccttaaaatgttcataccctttgactcagtaaattttatttatctgaatctaccagagattttcaaaaacaatcctaaatttggaagaatttcagccatacaagtgcatatagtagtgctgtgttggattgcagcagtgaaaacatcccagctatgcaaccacagagaactggttaagaagatatggtattattatatatcccaaaggaatataaattgtcctaccataaagacacaggcactcataggttcatcgtagcacccttcacaatagcaaagacatggaatcaacctagatgcccatcaatggtagcctggataaagaaaatgtggcacatactatggaatattatgcagccataaaaaagaatgaaatcatgtcctttgaagcaacatgcatgcagctggaggccattatgttaagcaaattagtgcaaaaacagaaaaccaaataccacatgttttcacttataagaggaagctaaacattgaatacacatagacacaaagaggggaacaacaggtactggggcctacttgagggtggagagtgggaggactgtcaggactgaaaaactacttatcaggtactatgtccactacctgggtcatgaaattatttgtatatcagatcaacaggcaatcatgagtgcaccaaaccaacatgcaatttacccatgtaacaaactggcacatgtacaccttgaacctaaaataaaagttttaaaaattaaaaaagaagaaaaaaaagaacatatggtagattctattaatttggtagaccattatgtaggtaataagggtacatttgcaaacagaagaatcccaaaatgaaattttcagatacagaactatacaaataaggtatacagcttatattaaaaatgattcatagaattaaaatgactgtgagaatattcagtatcactaaaaattcaaacagtagttttattggagcaacgacattacaataattgttatttttactttcttgtattttgcaaatgttatttaatgaacacgcattattatgaatgcaaaacagctgctatttttaataagagagccaagaaatacaaatatgttcatgcttcttcaacagtgaagcggggaggactttatcttattctaggcctatgctgtccaaaagagtaatcactaaccacagacggctatttaaagtaattaaaattcaaactttagttcctcagtcatactaactacattttaagaggtcaattgccatagtctactagtatcagacagcagagagaacattttcatcgtcagaaaattctactgtgaacgagctgttctagataattggcatgggatcatagaagataacctacaaggaaaggataattcataagatgcaagactctgtagttagtctacactaaaccagcaaccttagtctattaagaaagcctgttctacaagatggactatgctatataaataagtgactcacagatcattagcaaagtaactataagtcattaggtttttggttagtttcctggggatgttattttggtatctgataaattcatacaaaaatcacgtctgttggaagtttatgaatgtaaaaaaactataattactctaagatggaacaattcctccaacatgcagccttcctacagagtaaacaaatttgtctttgtcttataataatcggttgtcttgaggaggcagaaacaggaaacaaaaagacaactttggaaataatactttttaaaacttttttcttttaaaaatttctgggaaaaaaaggcaagaaagaagaaagaaattcatttgaaaaactagctcttcaaaagcagtaccaaaatcacttaggtggataaatgtttaagagtgaaaaaacgtacacctttctttatttgagaaagtagaatagtatgaagaaataagaatgcaattcaccaagccattattaatgaagggcttatctactagagtattttgtgcagttggtattccattacatataatacatttcccattagaatgtttatttaattttcttgatttaccctcatcattgtacgaagatgttccaatccattttaaattaataggctgtcttcatttcaaacatgcaggctggattttactgacataatgtgaacactacaaaaagctgtttatctttgttgaagtatgccaagatcctctgattttttttttccagtgttttctacccttgagatttaaaactgaactcttcagccaggaaaatcaaggcagcagaaagtgtaactattaagatgtaagttgcacttaaaagtgtttcaatgccccatagctttccatacagttcaaaaattatgtctagtttttaagattattaaatgttacttagaggtgggaattttatcaccacagcaattaatatcagtggaaaaccctaatacagcataagttgaatgacaacctttacaatgtatccatttagagagggtgggaaactcaggaaaacaagctgagtatttggagtcagaagttttaggctgattgtcaatgttgctgattctcgaaacttctgtttccttatctacaaaatagagacactgagaatgcataatacatggggttactgttgtcttcatggtacaagttaggacacaaggagcaggttacttattttaaatctgttcactgttagtgaggtaaattattcaaaacaaaaccagaaaaaatgattatgattaaaaaacaaatcccagcaggccagcctccctttaaatatatttaataatatgaccaaacagatctgtaaaatatacaaataagggaataagtattcatttaactaaaaggtgttgttaaatagaacttcatcggacctttaaaatgtaacttaaaagtataatttaagcctagtgtttttcataaacatgtttacggtgtaaaaaagaaaatttgtaatttatatatattgcatctactgtattaagtctgcagcaggactggacatgttcctaaccatgtacaaaccagtcacactgcttaccagctatagaccttgggcaaattactttacacctctgagtattaatgctctaatctttaagatgttgatgatgaaacctacttcatagtgctgctgtgatgactaaattatgccacgaagcatgttgcacagatgtgtactgcaataaatcaatgtacgtttgcagtcatctttacagcacagctggtcatgaagactctcctgagtacatttttgactagagatatactgtgttttaaaacttctagttttaataaatttaaccattgagtagaactgtgctacttcttcaatattcagaaaagtatatatttttcatacaaaagtaaatatatatatataactattaatttcacattagaaatatgaaaagcactccaattcctggaaaatgtcgtagtacaaaggggaaaaattaagatagatgaaaaccagaagtattcctctacacctttaccaccgacattaaaaagtgaaaaatcaattcccttttcctctggtataagcaggtaacaaatggtaaacagtttagccagaaagaagaaaagccaaggaaatccacttactaaaagttaaattcagtgactaaaattatctttcgtatgctcaccactaccaaaatctatatttctagctatgttctttcctgagatccagatatatggacaacttccaagaatcaaactcaacatttctcaaacagagctgagtatttttggccagcagaccctcccctgccataatttgccttccctgtttttccctctcagtggatgtcaagtgtgaaggtcagtctgcgtgtgtctctcttcgcccatcattaacgtgtgcattcaatattataaacacaggaacctctgctttgcatgcaatagagggtaagcaagcctgtttatagcgaacgtccattctgaagggagagcgcacaaattattaaacagataggactcctttcaagccttttaagcactgtctgggttagggatgtggtggctacagcaacataaaaaaaagttaattttaaaatattaaacataatacaaaatggtgacatgatttttctctaaaatataggaagtgatcaatcaaatgaaaaactatattttaagtaaaacttcaccataaatgtcatgatttagccacagctgaaaacttaaagggtcagattcttccagctgaccctatggtgcccagctggctgaacattctgagaataatccagtgcagtggaaacactggacatttaataaatgataactcctgaggaagaacaaggaagtcatgtccacaccagaggtgggtggtgtaacggctgattttggaggagaagtttttgttttgttttgtttttcttttgtggggtgggggtttgttttgctttggcttgagacaaggtaggaaaacccatttggaaggctggaaatttgatatttgatataagagtctgtctggctagaaaataagttcttccagacatcaaaaaggaactaataaataatcagaataaacaaatattggccatgatatatatttaaaaggtagcctagctaggcatgatggctcgtgcctgtaatcctaccactttgggaagtcaagctgggtaaatcgcttgcacccaggagttcaagaccaacctggaaaacaggtatgtggagaaggactaacatatactcctgagaacatctcagaatacgcagagcatgtttttgttaactttttcaaagatcagctggcactccgtagatatatggctttatttctgggttctctattctgtttcattgatctatgtatctatttttatacaagtaccctgttgttttagttactgtagtcttacagtatagttcgaagtcaggaaatgtgatgcctgcagctttgtttttggttgttgttgttttgttttgcttaggctttgcttttttattttttatttttttggttccatatgaattttaggactgttttttctaattctgtgaaaaatgatgttggtattttgataggaattgcattgaatctgtacactgctttcggcaggatggtcgttttaacaatattaattcttctgatctatgattagagttaaaagagcctctttttctttttttttttttttgagacagagtttcactctgtcgtccaggctagagtgcagaggcacgatctcagctcactgcaagctctgcctcctgggttcacgccattctcctgcctcagcctcccgagtagctgggactacaggtgctcaccaccacacccggctaatttttgtatttttagtggagacggggtttcaccatgttagccaggatggtctcgatctcctgacctcgtgatccacccgccttggcctcccaaagtgctgggattaccgtcgtaagccaccgtgactggccacaaaagagtcttttatggagaaatagagaatggaataaagccagataaattcaatttactgctcataaatggccatgcttcttcttaacatggtccccttactgcagaggctatatatctaaaaatgagagaaaagcaatcacactgttgcttatgagcaatctacatgaaatacaaaaattccccttctgaaaaattataacaatttgttattgaagatgtgtatgtaaattttcccacctgtgttacttttttatacaagccaaacctagcaggaatctctaattatcataccatgaggatggcttaacaagggtgttgccagcccacaaatgcaatttgattctcagcatgaaggcaagactggcaatttacaaactccagcaacaagtaactatgaatattaagatcttaatttacacaatggagaactcattgctcttagaataaaaaaaggaacattttgaggatcctgttgctggatgtggagtaaaaaaaattatggtaatgattctgacaattgttgaagcacatacatacctgaatatcagggtactttttagaattattctgctcacaatggggaaatattttacttaaataagcagcctgaatttgaaatcaagtcataaggtaaatgtctcaattacaaatggtactgctttatatatggataaatctcatagacataacactgactgaaaaaaacagacataaaacataatgcatgattccatctatataacgttcaagaacagacaaaaataatctacagtgatagatgtcagatggtggtgactttcagtgaggatattgatgggagggtgcctgagggagtcttcatgacttagaaatattctacatattcatctagatggtgagaacatgggtgtatacatatggaatattatttaacctctacatgtaagatttgtacagttcaatatttgtgtgatatactgcaataaaaatttaaaaataggtcaattgtattagataactaacaaaattgaaaaacagatcaatagtactagataataaatatacaatagtctttatctttcctaaaacaaaatttaactgttactttagtgagtaccaagagtgcacacattcagaaggttttggaacccatctccttgtgtagcacagcattacatattttacatttcaacgtggctacaactcctaatcctcctgtcaagaatcccacatgagccaggctattgataaaacaattgcttctccagtaaagagttttatttgctctctcattgcctatcagcttaatacataggagaatatacttgaaaaggatcaagttctataaacaggactaaatgattatggagcaggcatctttataattgtgtttttacttttttccccccagttgtttctcaaggaatacagcagaaattgaaccataaagcttagcttgacagaaaggcattagcctaccatgctaaaccaaagataggagagacagttatttatgaagaaacactgttccctattatccttctgagattctaaaaaagggctaaatattgatgcatttcaaagtcaccttttcccccacttcttgtattaacaagcaggagtatgttttagatgctcctaatttgtcaagatcaggtgaacagaactgtcgtacagagcacactgctctcattcctacaagggctctgcaaccctgtgggttattaataattcatcggtctttcttagttcacaacaggggcattactcagagggcatcattcttactgaaagaagttaacagcgatgggcagataaacaatgcacaagtcaaagaagaagaagcctcttatgaatttgtgaacactgaagatctgttaaagagctccaactactataggaaaaaaaaaactgctaggtattctttacctaggcttctattgcctgttaggctaaattcagccatctttagaattatatcagttgtattaacacagaaattccttgaaaatcatttaactcttttgtgtgttaacacaggttatactactgggtacgattatgttgtctttattgaattagtttctccaaactaatctttttggcaggaaaatgatgtctacttttgggttccaacagtatttatttatcaaggaaatacatgaagcatcctaatgtcttaatgattgaaaacaagtctccaggaaaaggaacaccatcctttatggtcctcctcaatacacgtagaccctctgggtgaaatttaacacaggtattccaaaaaatttaaataacaggggcaacaggctcagaagcctaaaggcatgaatcacgcaagagtgtaaaacagtagagcgaggcagagtctgcagcctgtgactgcatgccctgcttaaagaaacttcaaaaacaaaccaaaaaccaaaaccaaatactgctaggccaaacatgcctatgtggggtgaccaatttcagacccatagcataaatcagaagtctttattctgaatatatgaggactcagaataggatgtattatgtcctctaaataaaagatattcatgtgggttaaataagagcattgatttattttcttgaagatatattgttattagaatgtactccattatttagaatgtactccattatttagaatgtactcgaatacaaattaagcctctgatttctgaatatcagtaacgagtaacctcgctttagctaaaaacagtaacataaaatttactgagcacttactaggtgccaagtactattctaagcactctgcatgcataaacagacttgaaattctcacaccgattctatggagaaaccaagcaggcacagaatgagaaagcaatctgcccacaaaaacacagctaatgaggctgctgttcaaactcaagcaacctgctttcagagtctctgtttccttgtttactgctcgcttcctcttagttaagagcacagctcatttactccacatgaatgcatcaagggaaagcggtagctttcactcattagcaagactgatataaaataaatagaaactcaccaccaaaatcactacatatactatacctcctaccttagctacaaagcagaggagtttcagggaccaagaaacaaaaggcttggagacaatgagtacagttcctgataacagtagataataaatatcactaggctgagaaagagttaagaggtcaaaaagaggaaaagatgattctataacaacatgccattttcctctcgtactagaaatggacatcttcagagtctttgcttcctttaagatactaactaggtcagatcagatgttcctctttttttcttttactaatggaatgccctaagacagaataaatatagaaattaaaggatctttgaaaaacccttgggtttttctttactgataatttcaaattttaaatgctacagattctataattacagtgacctcactcttggcactgaatgttatgccttcatgctacagtaaatacctttggttatgaaggatatgctgtcctaaaaaatggaatctttactagtaatgttgcaattttttatctgaggtgtttcccattcatctttttcaaaatagaatttcaccagaattaaagttaacatattatttattcatcatatctgataagcatccgatgatgataaggaatttttttcataaatacataaaaatttctttcaacaaatgcccctactatatctaaatatatagttggaaatgtaaagcaaaagcatttcaattagataattataaaagtaaacacattttttcaatttatgcacacttaaaacataaaatgttttagaacaaaatatttcaactaatttgttttaattagttaaaaatacattacaccatctcatagtagagacagctacataacatgctacataatggattagtgtcagaaaatgccaactttttgcataatttcaagaatatattccaaaaacacccccacttaccatcaagatttcaaaataataatagtcaatatttatatgtacctcccattctgtgtcccaccaattatctcattggatatccaaagaaaaaaaaggttctacatctcaagaagtttgaataacccttaaaggatcaaaatgtagtttattttatgaaaggctctgagaattcttgctttgaaaaaattaactttcggtgaaatatattgttttccagttaatgacatacttctcatactcatgcacgattctaatactttcataaacaaatacttagaaaaaagttccatcaaataaccagtgagaaataaattcaacctacatcactagagtcaacatgattcattggttagaaagggaaaggaagacatctctctcttactgaagcagcagtagcagcctggggtaaatctgtcacgcaaatacgttgggctatttcaatgttactcttgttagatcttgcttttatcaggctttcatgtaaataggtagtaaaattttcaaaaaggccatgtgtccatatgcacagattaaaaaaaaaaatcttttgttgtgcagaagctctttagtttaattagatcccatttgtcaattttgtcttttgttgccattgcttttggtgttttggacatgaagtccttgcccatgcctatgcctgcacaatgtgcacatgtaccctaaaacttaaagtataataaaaaaaaaagattagaaaattaaaaaaaaaaaaaatcatggttgtccagacagttgaactgggatttcatttccctgtgtatcaagagacttgtgcagtaaagggttaacttagcagtcttgaggttttcaaaccacacacattctaaagaaaagaaaagattggctcttgacaagctcctgggatataacctctaagtgcttggagtatcctgcctagtaagagtttgcttttctacctggggccttgggccacactagacagttttatgctaacaatgtgatttatggcaaacacccgttctagttcacccagggccctaggtcacactgtatcagaagtttgactacaggaggggctgcagactgagtaactaaagttacccacgtaggtgttccacacctacaagacagaccccccccaacaaaatccttgaccaccaaggctcagtgaccctccgggttgacaatactccatgtgtgctatcacacatcattgctgggagaattaggaactgtccacacaaatccaccaggacaggacaaccagaaactcattcctggtctctccctgactctgttctatgtcccttttacctttgttgatttgaatctgtatcattttgctatattaagccataactgtgtgtataatagctttttataatagattttatgatttctatgagtcctttcagcaaatcactgaacccgagagacaaactagattcttcccattggtatctaggattcaaccagccttattatctgactccttggtcatgaccagtctctgttcagacacctaatatctatcgaaccccttaagttaaatcagcctccagatttcagcagaaataaatgcacagaaaaaataagcccatataatttgctgtagaatgtaaaaagcaacttttgatatttaggccaattacagtaataaacattaaataaaagagactgaccaactgcaaactggactattttcaaacttgttgccaatgactatcctctaggtaagagatgaaggtgcctcacaaattcaactgtataagatgtatgtgcccagcagggtcgtgcctgaagtagccatcctgcctttctaacctatcttgtcccatctatcacctcacaacattggccactaatgctgcatcctcagtagagatgggatcgtgacctacccaaacattcattataaaggtgtaagaatcaaagaagcatgttgtcagctctgcttttggcaataaaggaaaggtttttctcaggttttcctcttcacatggttttgggctgacagtgagcagtgagcaagctgtacttaagagttgtccctaacagatgtgagggcggggacagcattgaatacaatcaccatctctgatggccccctctctaaatgcattaaaggaactcaaactggaaaaggagaattatccagccattaaatttcattctttatgagacaccaatagctacctttttttgctttcaagaaacttgggttatgggcacaaagatccttcaaaatattcaaattatccatcttgaatctcagacaatttttgtgcataataaaagttcaattgaagcctcttttaaagagtcacttgaagaggtacatagtgactaaaataatcattcaaacaggagataaacaggaataagtgaagctaattcaacctgcacatgcatatttaacatgatacacatatgttacaaagcatactataaatatctctgtgcctattgaccttgtgcagctctaggaataaatgctggaggaatttggtacttaaaatgttgaagaggtcaggcacggtggctcatgcctgtaatcccaacactttgggaggccgaggcgggcagatcatgaggtcaggagatcgagatcatcctggctaacacggtgaaaccccgtatctactaaaaatacaaaaaattagccaggcatggtggcgggcacctgtagtcccagctattcgggaggctgaggcaggagaatggtgtgaatctgggaggcggagcttgcagtgagccgagatcgtgccactgcactccagcctgggcaacagtgagacaaaaaaaaaaaaaaaaaaaaagaagaaatatggagtgctggtagacatttctgtcaatagcagcaatcagtagcttaacctctattgcttctctcattctacatggcagagatagcagtgataactgtggcaatccagcagaatgcgaggccttcagaagcagagctaaatatgaggagtagcacacacagtatgtgtctttatggcagctcttaggaaatctgtccatttgcacaggtgctcctagaggcaaatgagcagacataccttgaaccatagtgactctcttaaggttattcaaaattaaactgtgtcactcccaaagagacatcacaatcctggaagaattcagtcacctgtgactaacctgacaacaattaacatacttgaaaattgtataaaactcaaattaaattttaatctttcatacttaagaaagaatcagtaactgataaagaactgtttaactcaatttgaatgtgatttcatgaaaggatacattttttaaagttattcatctggatcacatattcaacagttagagttttccaaaataattccaaagcaggtttcatgctgacatttttaaatcgtaaaagctttagcacagtaggcattgtccttgcctggatgttctgtgtcggatctacattcgtgtttatactgtgctgctgaacaaaacttagcaccacaataattatgtgaatcaagttctagtcgactttgtcagtatgcttttcatctctaaagctttgaagtcaaatcccagtaaatgtcaatatgctcctatcatgtccacacctgtcatctgcagcacaagtcagtgtgatctgcagatagaaatgaggagaaattgaacatattttatggctgttctgcttgaggcaataagaataaagtaaatcaatacttcatgtcatttcctgaaaatactgtattctccaagacatttagccagcacttgcccatttaacaaggacaaaaacataaaaagaaagtttttaactcagaaaattagcacatcaatatttctgggtcacagaaattcaagatgtatcatgcattacttcaaaatctcagttaaatacactctcaaggttggttgctcacaggaagggtaagtatcattaagaaaatctaaaatttcaggaatgaaggctcatatttaatatcctattattcctactaaaatattactaaatttatagccccattaaaaaatgtcaagacatgactttctctgtaaaatgagacctgcaaaaacattatatatctttacttacatggtatatttttctaatttttctatcaatttctatcattttccatcattcatttttaaaaaactctttatactttactgttcaacactatttctgacctttggaaatggatatttcttgactatctacccatactgtatgtacacttaagtagaagaatgtacaagttcagggagcctctgcaatagtcttttgtaatttaagaaataatttccaaatctgagcaaaaataattgggccttggttggaaaatgtaagttacaagtatataacttaaagaatattgaaatcatatttgggaaaataaaaagtatcaatagtaaaatatggtagaactcttaagtacatagagtttggagtccgagaagctagagtccaaatattggctaacctcctattaactactgatcttggggcagttttcacttctctgagccgaagattcactgcttgtacaatgggaacgcacacaatgtacagctgctctgaaaagtaaacgagctctgactacagaaagtgcctggaacatggtactcagcaaatggtattttcttggaatcctataaacaaattggtaacaggaaacatactaaaaaagagagagaaaaacagtgaatacagggcaaaaatgaaaatcattaaaaaggcaaaaaatgtcccggtagcaatgatttctaagtatcataaaagaaaacaactaggaaaatataattagaatgctatatcactaaaatccgtttttgagaccaggatgttcaattcgaaatcctaagaatgatgtgcttccccctgcctgagaaagtgccacgctcaagaaaggaggaagggaaggaattccagtccttctttgcttgtgggttttctcttaaaacttctgtttagaggaggtaggtgtgttcctgtccccttgacttggcttcaaggactagagacagaaagtctactggaaaagcatgtatttgtttgtgaggaaattagatactggattcgatactggattcactacattgtttgttcaaatgatttgtgtcaggaaaaacttttttttttttttcttttttttgagatagggtcttactctgtcacccaggctggagtgcagtggtgcaatcttggctcactgcactcccaggctcaagccatcctcccaagcagcagggactacaggtgtgtgccaccatgcccagctaatttttttaaatcttttgtagagatggggtcttgccatgttgcataagctggtcttgaactcttgggctcgagggatccatctacctcggcctcccaaggtgttgggactagaggtatgagctaccgcacttagccaggaagaacttttaaaaaacaaattgttaacaaatccctgaggttacattactcatccataaatacatcagcatgtatctccaaaaaagtaaagttatttttaagcatactacaatataattaacatatctataaatattaacaatgcttccttaatagcaaattaatactcaaatatattccactgtctcataattttctttacagtttattcaattcagactccaaatatttgcttccaaataatctagttgctgagggataagagagtgggtaattgaggatatagatgaaaaaggtcacatataagtaaaattgttaaagttggatgactggtataacagagttcattaagttattctccctgcttctgtataaccttcaagttttcagtaagaaaaatgttttaagttttccgtaataaaaaattatacagacatacatcaatgaaaataaaaagatagcaataaatataactcacaggtttgagatttttttaaatgacattttaggtcaaaaaaatgctgaaactcagaccttcctagccctgtagcctcaataaacacaaagtaactgagagtagaaagttaatttactttagtaaaaaaagcaagttttaacagcatcaaaatatgagttgaataattaatttttaaaatcctgtattaatgtgtttatgtcaggttccaccagatataggcataaaacaaaccaggtgctgccttttttggagattataggctaacagactcagtgcctgccttctatatatgctatggcgtcaaaagttgggaagcatctgttcaaacaatagtttaggattttattgaaggtcaattaagacttaactgagaaattttaaaactattaaatacatttatggaaacaatttttgcatatctaaccatttttacattatcaataatttgaaaataccattttttagagcaggagtatttattaaaagtaaatatacctaggtctacttcattagtaaaaaaagtaaatattcctaggtctacttcttaacatattcaattggataagcaatgaataaggagtactgagttgaagaagtgaagtcctatctagacctcaggaggtatggagaatacagaaatgacagaatatacaccacactaagctgccttgcctgtttcccttacaaacagcaattagaggagactccttggggacttaacatatttactcctacatatgttaactaaaagcctatgctaatgtacaaaggatggatctcctcctgcctgaagatctcagcagatgtgacagcaggttctggaagaggatcagcatacaaaggcatacgtgtccactggcagatcctgctggttgcctagtctatcaatattgcttttcctttcctccttgctaacagaaccttggcattactgagggtggcaatgtgcctagattttaaccactacacttcccaacttctttcacagccaggactgaccacatgacacagtccttgttaatgaaatttaggtgggagtcactaggtggattgaaaatcctttataaggggacagtcaggctggtttgctactttttccttttacccttttcttcctctttgtcttcctccctatacctctatgtgctggctagagctcaagcaccatcacatgagcatgaggaccccaaggatggtggcttgcaaagtcaaaaggcttcattttcctctttccctggctggagagactgcaagtttctccccaggtgtgtggaccacaggtgctgcagttggccccaggctaaaagctgcagagataagaactgacttctacagctctccaccttttctcctccatgccagtatgcacacccaaccagcatctctgcttctcttcacaatccagtaccttcaagtagttgtttttgtgatatgtccaggtttttattttggagggacatgcattccagtagagcctaagtcccttagtttttagaaacaaaattatttaaatttcactactgagccccaaagaacttctaacatctagactattaataaatggcttcttgatcagagagtgatactcaaaaagccagacccaacaatagagttcacagaaacaacagtccttcaacattttctgaagagctcttcatttccattaaaagggttttgttaatcatttaaaaaatattgttaaattactgccatgtgtgactcatggattaggtgatagctggtactggctttatatagctacagaaacagaaacaagtctatgggtgtcttacatgtcaatatgctttagatcatttcaggtaaagtaattaagcagatacatattgactatttggtgcctaaccttatggtgatgagcaaagtgtggggaagctattgaagaatatgaaatcactcttgcctttctataatcttattgaaaagaaaaaaagactaacaagaaaaaattaatccaaatcaatatataatcaaatgctgaaatatggggaaaaggcaagccaaaaacatctaccaaattatgacaaaatatacaaggctaagactagattaactgaatccactcctcctagatatgctgaagctctgaatagataacatctggtaagctgtgaaacatgaaaagcatatacagttcactggaaatcaaaagagcttaagcttactatgtgagatataatcaagaatatgggttttaatctatgacccattgtttgccaggttctttttaaatttttcattcaaacatcatatattaaacaaaagctaattttaagaataaaagtgtctccaatattttaagtctcaatgactgaaagaatggtgaagcccttcttgggactctgaagacaataccccaaaatatggtgctttggcatactgaaccaaagcaggagccctagggtctctgtgaccttcctctcccggtctctcaatcatctgtctctcccaaaccagaggatgaggctgttctctgaagttctcttgtctacctagaaaccagacccaccaaagagaagtacgttacctttgatctcttcagtgaatttcattaacaagagaaaattaaaactcatatcctagaggaagagactgaaaattaaacaccacacctagaaccctgatgaacttcatcccaaaatgaatattgaatgaatattcaagcacttcacacaaataatcattgacgagctaacttctatcttccatgttcattaaaatcatttagtacaccccacaaaattgcctcatttccctcctctctcctttccctatgaagaagggtatacaagcatctggacctcgttgggttattgggtaatcattctcctgcaattgccccatgcttaggcatgttaaacaaatttgtaagtcttcttctcccattaatctgcttattgtcagttcattttcagcaaactttcagagggtagaaaagaagctttgtccccataccattaataaatatgagtaggaagaaaatgatctgagaagaaaagagatgaggagctatgttccgagcatgctcaatttgtgtgaacagcaagacaatccctcttgtgcccactgtttatagtatgatacaggtgaagtagcgaaggctttgataacacaaacacttcaacattcacatctcaactccacccacttcttagttggccttcagcaagactatgagatctagctcccaagactgcaaaattgggatcacaatatcaaactacaggaatacattttgagaattcagtgacatgattcagttaaaacacctaaccaataataggtattaagtgttaacatctttctttcttgtttctgcttgttctttttgaatgccaaatctgataagcttatgaatctctacttcaaattgacccatttcctaactatcctcaacatcatatgcttatatctatcgcacatcttttactcctattttctatttctctcaacttaaaaaagcactataaaagcacttttatagtattaaaaatactatacatccttcaagatccaattcaaggcctgtccttttggtacataagcaatcatttcaatctgcattaggttttcctttacctcatgacatactttgctattaattaatttacatacatgtcttgcctccccagataaaacataaacttttataaagcagaatctgtgtctaaaattggttttgtttgtaaaggctcggctctggactccctctgagatcaacaaaaacttgctgaataaaggaatcagtggtgctgaccattaaaatctgaggactaatgtctattcagatataccagtcaaagtcaaatttatgaaatgtgatttttgtctactgccaactgctaagaaaaccaaaattcaatgtgattataattgtaatgaacaacaacaaaaaagcagctgttgcttcggactaaaaagcaatgcttaaaagagataatgtaacgagggacttctgtaaaagaccttaaataactattgcacaagaagataagaattaaaattaaattaattaagataatcaattccactattaaaatggaaatgaacttttatcagaaccgtggtagaatcacaagtaagatgtttcaatagttaaaaagtagtttttaaaatttgagatgcattgcaaaaaaaaaaaattggctcatgggtcagcactggaattaaccctataacaacagtaatttacatgaactattaatcattttaaatgtgattaaaaaaatacaagtccagcacacctgttcaccaatcaaaatacctagggcttgagacaatgtagtaagacaacctgtaaagctaagggtcaacaagcttccaagattggagctttcttcactctcttttttttttgacatcagtgtacaactagactcaacattcaacatgtcaattatgtcatcatcactaatctttcagtattagcaaaagtataacttcaaaaactcatttccaataggaacacacacacacattcacatacatacacacacacacacacactcacatacatacatacacacacacacacacacacacccccccgacaaaatgaaaccaacagaagctcatgaaagcatatagggaatagtttcatttatgaataaaatgtttccctgtatcttctattaaaccaagggttttaaaaatcaaattaaatcaaaatacaaaaaacaatagtatattgtttttgtagaactaaacatctcctttaaattgatatgtctttaaaataggaggtgaaaactatcgtgacaattgttctacaagattaaattaggagaaataacttaaccaacattttatacattaacatttatttaaaatctgcatattaatgaacttcaagtattgcaaacttggcaggatgttgaaatcaatgttttcagatatctatcatgatatattgagtctctggtttacttgacgtttttcctttaaaaataattttaagtagttaagcaatgtaattcctcttattttcaaaaaaattcatattctacttccttcatagatggtcactgtaaagaagtttaaactctaattaacagctaataatatgcagatagcagatacacacaaaagcttccattaaacaaaacggacaaagaaaactaccatttcctgattttctccctcagccctccctacctactatcttgattctgcaaacagcagaataaattaaagttcctttcttctacatcaactcctttgtcctctcaaggttgcctaatcatattcatctcctaaaatgaagtaagaaacatttcaaaagctgtattcacattaaatcaactttctgattcgtgcattgcaggaataaagcaatgtaatcacatcttaaattggtttacagcaggctgtctaccttatcctacttctcaggattgatgaaatgaatagttttaaaatagcactttttgaaatgacaagagaattaatagtgcataattacctcagtgttgacaagtgagagatgtttaactccttaaatgagctctcctaatgaatcagtgtcagagaaaggctccactgcatgtacatggttgattgatatctaaggggattgatttaaccataaaggaataccgaaagccagtttttaaagttatttaggcaaaaaattaaatgaatcaatttttacttaatatttggaatatatttacttaagactttaccataagctttgatagtattctaggtgttgattactaggaaaatcttattttacattgtatgagtccactaaggaacatttaaccttttaatagagtggcaacaaaaaaaacttactttagtattggactccacactacataaaagtgaaaattaagctattggatttaaaaagtagtacagagagttcatttctgacatttatatttaaagactgtaatgaagacaactacaatacaatgacgtaaatctccattttaacgaaaacttttaatacatgtaaaatatgtataaaatattaccataccatgttgaacttttaatatttatatacattctctttctaattcttgtcaattaacatgtgatactgttccattctattttaaatcctgtgggtaaaaccaaaacagattgatatttctaaacacctggaattgagaaaactgaacacggtctcagcagtagagctgtgcagttgaaatgtaacacaagccggctccaacttactcttcatttttccatgtctttcacgtataccagctgcctagcttgagtgtgtgtcaggcacggggctaagaactttctatttaattctggagattcctaagaagtagatcatactatccccattttgtagatgaggaaggctgtgcacagggaggttcctgtcccacagtcacagagggtcgtgagtagagcctgattatgcactaagacaactggaatgcatagtccacacacacactggttggcaaatatatttccatgtagattatctttaccggattaccactgttttagctatcagtgaaggtgttagattgtgttgttattcctttatcagttcaatatatttgggagtcaactaaatgctagtactttcccaggtgctgagactacaagcgcatgacagagatgaggcccttctcacgtggagaccacagacagcatttgcagggagggggatttgctttgtaattaagcgccttagctaagagacacaggtgcaggagatgcacaatttggacacttagacaaacattcttgacctggtacccgctgagcctcagtgaaagagtgagggtaaagtgtgaggacaatggcagcctgagctcccagcactaacacaatagctggagctggccatgccctccacctgggcagcaggggactataccaccaggctcaggtggactgcgggggggttgtaggcagaatgtgcagcctgggagtgtggcactctatgggaacgtctgccttaaccttcctttaggaagccaaagcctctgtgctggcactcctccccaggtactaaccctgtcacctctcccccagactccttagaagattgagcaccagggatgaaaccaggtcatcaccaatcaaattcctggcttcactgttctatcttgggtttctttaaaaaataattagatacatgaatgcctcagtctgttctattaggtgtacttaaactatgtgtcaaagctcattggaatatttcactgatgccttaaaatgtctttagcagaaatgcatttgagttgcaaacatgcaccttaaatgtgacttcccagggacaatcagctaagaaattttagttaatgttacaatttataaatatttgtgaataaaaatgtgttctaaattaaaaaaccaagtcttcattgactcgtctaagaattagggatgatgaaaactacttcttaaggaatactgaatgagttattgtagctagatgggtccggtgggctctaacacacagcaggtgtgcccgaggatggtcacatctgaatcgtgaaacaaatggacttcggattttgtttatattataaaaatctacaagaaaaacagtatttttcttaatcagttttaaactaagtcaaataattttgctgcatttaccaagtgtgtagagatttatattttaaaaatataagaagtgtagcttcaatggtaaacatgtattttatatattacttcgtaggtaatgttcctttgcttttttaaaaaaaattgctatccttagctcagaaataaaaaatgttaaaatagtaagagactttagtaataactactaaaaactggctcttccaactttccaatatctatgatggaaacccttcacacctgcctgatgtgtcagacagacacaaattggttgtttgaggggtcagaccctttcttagactgcctctcccctcctcaccccttaaagtgatacccttgaaaatcccctttactgtttcagaagaacactgttttagaagcagctataccaccacatcatttacactcacaatgccatagatgtaaatgtgagacctcagggccaggccaaatactccgggcctgaaatcctactctttccatcaatatgcccttaatcaagaggaatctggtagagcttctgtgagaatacaagttcttaagtgtaaaatctagatgtcccattaagcaaacgataccagtcaaggaactggcttttttgagctcttcctaaaaataatgagatttggaggacagccatcagtcatggaaagacatcaaacactgcatgaagacctcttgaaacctggttccacaagaaaactagaaattaaaataatgcatttaatagctcataaagtttacaagattcttatctgctctgcaagacagaaagaatcaaatgattttcttggccagggagaattcaggttcaatttttaagcccctattctgtaaccctcagtcagccctgtaggaaggtaattatcagggctagagggatagttcctgctgtttcctataagtaaactcaggagctaaattaaggtacttagaggtaaactctcagggtgtgcagagcttggctgtttgactcccgtggattctggagcaaagcactaaacacttctatttattcagagagcaggtagagaatagggcagcagaaacacggctttctcagacacctccgccagcccctgctaatcaacgggagtcacacagctcacaatctcttgctatggttttaaaatgcaacttttaatgttatttcattgtggtgtccttgtactgaaaagcatttattatgtagtttcaaatttacctgaaggttaaaaaaaaaaaaaaaaaagaccacagcaggaaagctgccattgtgagaaagaaggacataaaattcaagcaatgaattaaagaggcaaatgaaggaactcttttcctctattagaaatagaagaaacagattgtgctcgtcttgcttagggccaacaggcgcactgcatggaactcagccagcttcagtcacaaagctcacttaggagttctggtctgtgaaaagaggaaaccagatgggctatttactttcaacaagataattctggaggaaattgttatatgtcaaagaaactttttagcttcatctgctattttagcctctaaactgattcaggaagcagaggggagggttctgttaggaaagaaataagagaattggggaaataaaagcaagcgcagtgcaaaaggctgggcggccatgtcgtccaagtgcataagcttcctggactcatatcctcactctaaccttggacaagcgatctgacctcttggtgcttcagtttcctcctgggtaacatggggaccacaatagtgtcactagaggttgtaaagattaagtggtataaatatcagtacttaaaatacaacacacacatgagcactcaataaccatcaggcattgtttttatctatttcattttctcttctatttgcaaaacataaagggaatgtatcatagatatagatcaatgactaaacaattcttaagaagacactaacagctaaatgttatattggtctactgattatattgaccatataccactgatggaatttgtttgaaaacaacttctcttttgtttggctaccacaaaaagtaaaataatccagataattttattcttggatcaaaaatttcaaagagattttcttacctcaaaattaagaaagatagcttttaagaaaagtagctgtagagtgaatatagaaaagttaattaaattctaagttaaatttctaatacatataaaggatgctttctaatgagaaaaaagcagagtttccccagcaaattgtaaataacttggaccaaaatcaagataattcttatatgaatatactgtggaaaaggtatctagcaacctcatttttaggatgtacaatatctaaatattagttattaagcaaaaactgaaagtattcaaattaagttatgtgaccattaggcatccaacttaacctacttttattttacacttgtactattgctaaataataactgatgattccaagagaataaacaatactctcagaacagagtaatacaaaatatgttcagtctactgtatttaccatggcaggaaaaaggacacacattgttagaaggattattcagcatgaaggactaaaataaaaaatagttgcctggttatctttgtattgattttaaaaatttcacaaatattctatttcattgtcacattagagaaacagcatcactattttttttttttttttccgagacacagtctggctgtcacccaggctgcagtgcagtggcacgatctcagttcactgcaacctccaactcccgggttcaagtgattctcacgcctcagcctcctgagtagctgggactacaggtgcaagccaccacgcctggctaatttttatatttttagtagagatggggtttcaccatgttggccaagctggtctcgatcaaactcctggcctcaagtgatccaccttgccttggcttcccaaagtgctgggattataggcataagccaccatacctggctaatatttgtatttttagtagagacagggcttcaccatgttggccaagttggtctcacactcctggcctcaagtgatctgcccaccttggcctcccaaagtgctgggattacaggcatgaatctgccaccactggattttcacttttttgtgtaacacattttctttctgtaaggggaaaataaacaaataattcattaatttaattttcaaaatttatttatggctctgataaacataaaagccaacagcatattttaaagctattttgaaaatataaaaagaatggttactatgtttgatttttcatatggctagtgactcaatccagctgtgccccaagaaaactgaatgaatgttgatgataaaaatatctgaaaactgtatgagaaaccacatagacatatatgctaggaacttacagattttatgtcccaattaaggcctgtgaataaacggagatgagtattcaagataatagaagtagaaatcatatctttgtcttaattaccatttataaagttaatataaaataaaatttccctaagtattgcagaaaagcaaacatagcaagacaattttacattgtcaataaactggaaatgggcaggaaagctgcttcctttgaaacaacctaacacggctttcatgacactgattcttaacagtgatgaaacattaaatgaaacatgaaattgattagcctctttctcttctatactccaaattttctcccactttgaaaatatctattatttcactaactcaaaggccaaaaatctaatagcgtttgttactcattttcgaccactggcctaaccccattccaggcaccttcagaaataacactgcctttctgccctgacatagagtcagagacctaaagagccttgttgggagagcagtcttccctgggcctacatatcttactgcaggggcccccaagccgcaggccataggggtccgtggcctgttaggaactgggccacacagcaggaggtgagtggtgggcaagcggagccagtaaaccttcctctgtatttacaggtgctccctatcacttgccttaccacctgagctccacctcctgtctgatcagcagaggtattagattctcaccggagcgtgaaccctattgtgaactctgcatgtgagggatctaggctgcaggctccttatgagaatctaatgcctgatgatctgtcactgtctcccatcacctccagatgggactgtccagttacagcaaaataaactcaggggccccactgattctacactatggcgaattgttatttcattgtaatatataattatttcattatatattacaatgtaataaagggcacaataaaggtaacgcacttgaattacacttgaaaccaccctcctcgccctgatccatggaaaaattgtcttatgaaaccgatccctggtgccaaaaaggttggagactactgtcttactgggtatgccaagacatcaagggtctgaacacttttttttttttttttaataacctgggctacttctcaggttgctttcgcaggtgagagatgaggcaacctctccccttggacaaacagcagactgacttactgcttgttataaaagcagtgaattccccaaactcagagttccttagttgcaatgcaaactcactcattcatagcatccatccggaccataggaattgaaagcaagggcaattgatgccaatatgctggtgctcatgctgcttattgtgccaagggtaataaaacgttttctttctgacccggaagtctcatgtcttctgccagtaaccatgaaacagtaactggctaaaatgtatgagaaacgatacacataccattagcttccaaatagggtaagatgatatctcagacctgacagttttggtgaaggaacatagctatctggagaaggaaggaaaagtgtccagagattgggtccaggaatataaaaaaatctccctggaatctgagagcgaatgctcttgcctaggaggtggacagtggggtgtggtgggtgggaataagggtccctactgtcctgtgtgctaatgaggctaagagaggcaagattgaaatgagtatgtaaacggaaccgtggatattgctcactcattctcctccacgggttggggtgttatcatgacaagggggcagcaagaaagacaatgtgggtgtggctgctgagccaggggtcctcaaagctgacacagtgtctcaataataatgacctttttacctgatataggtctttgtgcggaccatcaactttagaagtctggttaagcctcacataggctgctgcttgaaagccacagtaaatgtgccttgttgattaacacggagctgctgtccctctcatactacctgatccctcccttccctctattctgaactcagctgctttaaggagaaggatgactgggctgggtttaagatctccctatccccaggggacagaaagcccctggcaccccctacaaacacacacacacacacacacacacacacacacacacacacaactgtttggtatgatgaggaagaaaggaactcaactgttatgagtccaagttcccattcttcctggcccatggaagaaaggcacactgaactctactaatggggtttagtgcttcccagtgggaaaggggaggtgaactagccttgtaaaggtgccctctgggcttattcaatgtggtgttgtggtagcagctcccatattcaattctataataagaactgatgtattacacatttgcacggcctaatccctgaagtgtcagaagggcttttcatgttccagaactgctgcagaggcccctgcccactataatagcatcacctgtttgatggagctacaaagtactttaaaaaaaaacaaaaaagcagctgttatcctgcaactaagctcttgtggagaaaaatgaacagctgaaatcccattttcaggtgaatctccctaaagaggtgggaagggcctaagaggccttcctggtcaaatggaaatggtatattcaagggcacagtgcatccagccctagcatcacccagtattaaatgaaaataatggcagctacttctttggaggaaccatatcccccactccactactggaaacagagctgctggttcaagaaggctctcagaggttcccatcacggatggcctggttcactgacagtttgatgaagctaaaagccgatggtggtctctgaccagcagcagccaaaaggaccagtcagcacatttctctgtatgagagctctgacccttgtcagacaatgctcctaaagaccaggcatttcatattttacagactcttggactgctgtaaatgacttgtctgctttgccatttggaagactacagactggcagattaaagagcccctctgtaggactacacattttgaaaacaaatcttggctgctgattggtctgagtgtcactgatacagatgcctgcagtaagtgcttattctctgatgagaccaactggaatcaagctgttggtcaaaactgctatttaaaaaaaaaaaaaaaccaggaaaagtcatgtggacatggctggccctgaactattccgctgtgccgatgccaccaacagcatctcccaaacgtggcccttcccctcagacctgtgcaaacacagattgcttcaacactgttccaacctgacatacaaattcataggcttctcctgcctcccaagcagccgtagctaatgccatgtttagcaatctagattgcagcaactcagtgacactatgtggcttaatcaaaccagtgtaatgctgattccaatcaagtgtagcaacaaattccaaactagagtggcctgtgctctctatatgggggaaagtaggccacagaatgtctctccattaggcatgagggttgctttctgaaacagctattatcattgacaatgagacccaagaggggcaagtcattgcaaactttcttgcgcagatcatattaggtagcagacttgtcttgcaccgtctgaattaagacctactggtctccctctgggatttattcatagtaggctgaatcagagattctggtcggggaaggcagagagactggatgaagtcaatactgcaggttggcttcatcctgctgcttaggattttattgattgttgccctaattaaatgctggtatgagacaagttgactagtttggttccaacctctgttggtccgattaatcagagtgactacaggtggcctattcatgtaaaaatttaccaaaagccaagatggggatggatagagacagttttccttggtcttcttatactccctgcatgtcttgttgggataccaagactgcattgtcctgactgctcttttacctgggccatttctcaagactgcattgtcctgactgctcttttacctgggccacttctcaggactgtttatacatctgataaccttaaataatgaagtaatgtctaaccccagacaaagagcataggtactgcttgctataaaaatggaagattccctaagctcagcagtcatcatctgcaatgcaaacctactgcatgcacagcatccatctgggctgtatcacatcaccccgtgagattcaggggcaaaggaactagagtaaatatcatgacgcttatacaacttgccatactatgagtaataaagccccttaatctctgacccatgtctcatatcttttgccagtctccatgatataaacaggctaactcattagtttgtaagtagggtaaaaagcaaagcccagatccaacatgtttatctctggcttgcaccacatagggcatatgatagaaacctagttaagacaatcatccccatacttaatgtccaaacatgaagttacatagctgtcctaaagttgaacctgtcttctgagattatttcatggaagcaagagaaaactattaacatatgaatgtaaaaaccagggtcacttccccattttccaggcctaacaaacttatgaaacctccacataaaactagggttactcacttcagttccggttcctccagagtaaaacccctctgaaggggcactattaccaccacttcaccacactagagtgtggaggagaaatactaagtatatgagatgctgtaatattatagtttgaacggaagggtgatttgagatgtgaaagaaagtgaataagaagtgctactagacatgggcaatatactttttaaattccaaacttgatttcaaaaagtagaatcaatcagtcaaataaacaaaaaacctaccttcaaggaggtggaagaatggcaagaaactggtatttataaaattaggtctctttggccaggctcacgcctgtaatcccagcactttgggagaccgaggcgggcggatcacgaggtcagaagatcaagaccatcctggctaacacagtgaaaccccgtctctattaaaaatacaaaaaattagccacgcgtgctggcgggcgcctgtagtcccagctactcgggaggctgaggcaggagaatggcgtgaacccaggaggtggagcttgcaatgagccaagatcgcgccaccgcactccagcctgggcaacagagtgagactccacctcaaaaaaaaaaaaaaaaaaaaaattaggtctcttttgctacaagggagggaaggcagaaaaagtatgccagattcagggaataaaaagtgttaagaaatatcatagtgttatatcccattatcaaaaatcctacaattagggttcaaaattcaccttcagaaatttaataaaaagactcaaatgtcaccaagtgctttatgtatgattattggcaaaatatttgtctgttagctatacttatactgttttgtaaaagcaaaaaaaaagaacttaaaagacaggatgaaataaccattcagaagcagaattatagaagctaattattaaaataactcagcattatatccagacctctagctgagcagatatcaaaggcaaatcagtaaatattctaaaatgactgctctgtaatgtatatgattaaaacaaactgtgctaaaaattaagaaaattcacattgcttcagaaatttcacattcacttgtctccgtaattcaataaaaataaaataaatggtttttcagaacagccaccatcaggaatgtgacgtttgatcatttctccgccctgctgtgagcaatgaggtaaaggtagattttttattcacaccactctgcatcctcatgggtaagtgaggctgtcggcatgtcccgtgacttaattatgtggtggccctgctggaggtgtgcttgcttaccgtaaacagacgcaaatatctcaaaactacccctgatttacaagaaaaacgttcaagtttaagccagtctttaacacaaaagaacatctttagaacaattgtgaaaaaaatcagacttccttctttgctttgcgtcacggggcctttgtctaaccaggggctgaggagatgcagggacactggtgacagggagggaggggccctgagagcaggcactgaaacaaacctgctcttcccattttttaaaaaacccttcggaataatttaaatgagctcccacccaaattaaattgccttgaggttttccctccaaggcttttggcattataaataccccctgactttggcctgccatgtttcctccatcaatcacggagtagcctagaattaaattgaaatgattggatcaagaaaaatcaaatgttttaacatttagtttcagtaatgtgattacgaaccttttagtgatattgtaattactctgaagctttgagcatatgtttctactgagagcatttcatggagaaaagctgcattagggaaacaagtaaatacagaccccaatgaagcaaaagtgcatttgttgtaaagttaaaagctaaaggtggaaaagagacaaagcatctacgtaatttacaccctaaacctgctgcatagagtaaccacttttaaaaatctctacttcttccaaaattcaaataatttaagcacttccctctaagggcaagcattaaggaagcagtaagaagaaacaacagtaaaggacaagggaaaaaaagaagaaaggaaaaagtcatcgtccttgtgctaggtatttgcatggaaaagatgacagacaaagctctctctcttaaaattaatgaaccatctcctcagatacttaattttcaccaaagtcaaggcatatagttacttcccctatttgttaatttttttctcccatctcaacacctgatgggattctgctaggctaggagccccaaagataaatgaagtggggccccaccccaaaggttaatatcaaaagagactggattcctcaagggacatggaagaagacaaaccggaggcaaggacaaaggtcttctctcctttgaatcacactttcatttaggcaacaattatttattaagtatgagcacgcttattccctcaagaataaggcaggtaagtaaagatacactataaagatggaatgaaattcggtttttaaagtttagaggaaaataactctgtcaagacagtctgaagtacacaaaccttttgaagggtttgtttcttctgattatattaaagtacagctaattgccctaatagtttaaagatcctaagtgggaagctgtgtaatagctccaagtgcttaatttggctactggcaattttattttatatttcaaatttgaattcacatctcactttcagcgacaagacacagccacttcctactgccttagagttcctagcattaagattgagcggttcctcattactcagagcaaaacctgaattctccagtatggcatggaaaactgcactgagctggtcctgacaccctaatctatcatcacctcccactccatgctccctgtactccatcccgtcaactactcatccttcccaacacagcctctgctaacaagcctgccatcttgctggggccagcctctctgtttcaaacgcgctttctttcttggcctgctcaggagtccagtctgttgttaagatccagctcaaataaattccacctctgctgaaggttcccctgctttatcacacaatgaagcgtacctccatgataacatctattattgtcaatggttactttccatgtgtacacagcatcttcactaactgtgacttcctcatttagatacgcacgcctagtgcctatcataaatcctataatttaaggtgtcaataaatatttgccgaatttaacattttcttttttcagcaaaaaataaatgttttcttctttaaaaaccaaattctgcattcatctatttaaaaaatttattccatattagagtttctcctaactgtactaacaatgtataagggaatattttccaaatgtttctgttaaaactgcctcaagaaaccaaattctatgctgacatctgtgagaaattacaagatttcgctctttcgtccttctcaacttaataatttaaaattctaactgtataattttcaaccaacccatattagttattatttacaaaggacaggacaatgttaaactattccagggagcatgaagtgtctaacgctcatagggaactgtcaaatcagaaagcaatatacacataatggttatttgcttccactttgcctgatcatctgttatgtgaagtggtatctcctgtccaaagcataacaaaacttccccttctctacaggatacaaattagcaacctggtacatatcaaattacccagctgcaatgcactatgggagtccaggagaatattcacaccttcttttgccacctgagaaaactaccttgaaaagtgagttatgtccttggctagcttcatcaactagtccatacaccctacccgcctgcgcgcgcgcgcacgcacacacacacgcgcacacacacacacacacacacagactcctcatgtgtaacactactgcattacctttaagtgacctcacaataggcaaaaatcaagttgtagctctctgtcattcttccttcataaggaagtacctaaccatacgttcaaatggtgaagcattactggtaactgtggtggctgaataatgcctccttgtccctgaaacctacgactgtttcccgatatgacaaaagggactttgcagatgtgattaaggatctggagacgaagaggctatcctggtggctcctgaatgtaaccccatgtgttcttttaagaggaaggcagagcaagatttgatggcagtaaaggagaaggcaatgtgaccacagcagcagagactggagtgatgtggccaggagccaaggaatgccagcagcctccagaagtgaaagaggagtctccacaggagcttctattaatggaaggggctagcccagcgaacaccttgattttagtcccttttagtcactttggggctgggcacagtggctcacacctgtaatctgacaactttgggagactgaggtgggaagatgacttgagcccaagagttcaagactagtctgggcaacatagcaagatcctgtctctacaaaaaataaaaaataaaaaaattagccaggcaggttggcatgcacctatagtcccagctattcgggaagttgagcccaggaattcaaggttgcagtgagctgtgtttgtgccactgcactccagtctgagtgacagagggagatcttgtctcaaaaaaaaaaaaaaaaaaaagtcattttggactttgggcctccagaactgtaagaaaataaatttgtgtttaaaagtcactaaacttgtggtaattcgttacagcaacaacaggaactacacaaaaactaatacagtaatctggccatgccccgatagtgtataatattaaagaaagtgaaattatggttctaatgtttgttttcctgaaaacactacttttatgaccagaacatgagcatagtatgctaccattgaaaatttatctgacataatttgacacaaaagtagaatccgttttaaatgtattaccacaatgcatttgtcctgaagattgtgtttataacacattgcttttcagtatttccaaaacattatacgcttaacgctgaagatctgaaaaacacaatcataataaaagaaaacatcccacaacccaaagatataatttgccggtatacttcctgatatttttacatatacaaatggcccctaatgctatctagtttccagttatggtaactaaatggtcacattaacactttttaaaaaagatctttcccaattattaagaactcacacatatttgtccatcttagatcacttaatcatcctatcatcactgttttaagacaaaaaaaatcttattacttctaggaacttcatctcaaatagcatccccatcccctctctgactgactttacctgtataacttgcattctattaagcataagatgattaaattggctgcaaaagccagaagggacttttaatgaatttacacactaagaattgtgacaactatgtcttgatccaatatgaaagtttcttagatgttgaatctccattaaaaattattccagaggccaggcgcggtggctcatgcctgtaatctcagcactttgggaggccgagacaggtggatcacgaggtcaggagatcgagaccatcctgactaacacggtgataccccgtctatactaaaaatacaaaaaaaattagctgggcatggtggcaggcgcctgtagtcccagctactcgggaggctgaggcaggagaatggcgtgaacctgggaggcggagcttacagtgagccgcgatcacgccactgcactccagcctgggcaacacagcaagactccgtctcaaaaaaaaaaaaatttattccagaactgtcccccacaaaacaaaatagagttctaaaatgggcaacaatgcccagaaattgccagaacataaaaaacaagcacagagacttggtataaaactcaagacactgagaataagattatttggtgacttctttgaaatcaagatgatataaaagtcaatacctatgtcagaagctctgcatgtagtgagacacggcagatgccacacacacatacacacacacacacacgagaaagggacaatgaataatggagaaaactctagagagggacaaaaggaagaaattccaattccaatcataggttgagcatctcacagattcctaaatgaacaagagtggaaagcccacaacagatctctacgaaatatcactctctgtatcatatgattatgtctaaattgactgcccaataaaacacatatacttcccatctgatcctatgaattcagacatattcatgtaaaaacgtctttatatattgtcacatgtaattatacaaatttggtgaatatcaactggatcatgcagtctacatttgtctgtggtcaggagcccagagaagcagcacctcagagaacatgacctcacttgtgcttaaatctgtacctctcacactctgggaactcaccagagagctataaaggactttcaggagaaaggaggtcgaatttcaagggtggagagaagacccagggcacagggaatattattcttaaatctgtctaattctccaaggagcaaacctaacttgcccccatcctctagctgcccagagttcatcattcctcaattttgtttcaatggaaaaaaaaaattgtaatcaggactggatttgcctggaaggaaaatgcagagccagagactacaaagatttccattgcagacaattcccaatctagggaatgtctccagtaggagctgtggtgaagcctggtctgttccggtcaggccactcctgtgataaccctcagaaacattacaacccacagtcaagccctgtggcaacaagtaaggaagaaattcacctgttgttcagacaacagctgctcctttgagctgaagaatgaaatattaaattccagcttctgagaaaatcaaggaatgtgggtaagaaaaaaatgaggggacagaaaagagggagtgcaggtagatgtcaaaaaaaaaaaaaaaaaaaaaaaaactaaaggttgacctcagaaacacagatattacaaatgttccttcctatttctccattttattaatacgagcaagtttcaggtgtctacttcctatcatttcatgatctggaaaatggatctactctgcgggtacaataagctttaaaaatgactacgcagttacagagggcttcatcacaagatcttatttatgcactgaaactccaaaaatatctcacaataggagtaactggcgtattcaacaattatgtaaataaataataaaaagtctcaatcaggacaccaatattaactccctaatcaccaattttccccctcatttgatgagggtaggagtagagatgtgcaaaatgggtgaggctgctaactattgaacattctctcctccaaagttaagggctctcatgtgaaactttatgggggcctctgttcaggtcttacagtaaaagtaaattggagagaatcatcaagaagccatcaatactcttaaaaatacacacatctgtccatagatggtctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaggtgctgggattacaggcgtgagccaccgcgcccggcccatagatggtcttaatatgtgcctaggtatatgagtcatgcagatatctaagaggaagaaactattctgcactattctgggtgacacgatatccacagctctgatgacattgttctctccacacagagaagaaactataaatagaaccctaagcatcatgttccacatatcaaagaaggagatacaaactatttttggaatacaaataaagctttagtaacatgaaataaaacacctgtcaataagagacattaatctattctacaaaaataagaactttttaaaaagaaatatggcctttaatcagagatgatgtaatgacatatcaaatcaatgtcaacaccctgagaaaagccatctcctactgcacaattaccctgccattctcagtcgaagactgtcctctattaaacattatctggacttctttcctttgttttatggagtgagtttataaacgcttgttctccgtaactagtgatttcaagtattctgttttatctaagaagtacaatgaaggtcatgagaagtcctctattaacactttatctggacttgctggcactagtgtaactattttctacaacgttctatttcataactttctagtactgccacagacatctttctaaaatacaacctgttcataatgctcttttgtagataatggttcagtgactcctccctatcgccaactttaaacctacctccttgacaaagcttatctggtgtgcctgcagcctcaccagatacctttcattctattctcttctctcccctccatgcctgtctagaaggccgccttcacctagttaactcctacttgtcctgcaggaaaactggaatggctccactgggaaacagctggatcttccaagctctataggctgagttttccagtacttccttgtataaacctatattatgatacccacctttcaggtttgtaaatctttacttttctgtaccccttctagactatgaacaaggacctgatgaagggtagttactaaaatgttggctgactctaaaggaggtgctaattgcctcacactaaaaagagggtaagaggtgacatggaaaatttcacataaagttggtgccattggaactggatcttgagtgatgaacagtagttttgagatgttcaacagaaagaaagggcattcagatcaacgagaatcaaatgaacaaaagaaacatgaaaaatcacgtgttgcaggcatgtatgtgtgtgctgatatgtacatacatctttctaattactcttcttctgtggtggtgaaggtgcaatctataccaccaatataagcctaatcagcccaactaggccacaaacttattgggaagaaatggtcatttctatgtaccttccccacaggcaatatatagacaaatacaacctatgtgtacccatccctacccagcaccatctaatacatatggtataaagaaatgacactgaaataataatcataaatacctattcattcaaggaaaaaaggtttctatttggtgaaaaacagacatttgagttaatctgttaagagtcctaggtaattaggaaattactgggggaaaagaatcctattactgtaattccttttaaccaagattctatgctacaggatgaagtaaataagccagggaggtgagctgcaacataaatcagccgactgtcacatgagtctctttaatattacaaaattgagggagagaaaccattcagattactacgaagaaacatttaaaatgagctcattaaatgcaaattaaaacagaaacattgaataagcactgggctacaattaaaggctgcagaaacagcaggtaagaaacaattttcattgatcaaagaactaatagctaacagaataaagtattttgcattaaaactgctttcatgaatatgaagcatttcgaagtaagaactcttttttttgcatttttcaaagaaactttggaggtaggaatggatttacatatcttaatacaaagtactttcattgtatcattttcaggcaatgaaactatgaggtttcaaaaaatgcagacttcaaaaacatcctcagaaatagggccaaaattgtaaagggcaaagggtcattttagagcctttggacccaaggaagaactattatataattacataaaatcttctatgcaaaactttagtagagcctatttttgacacaattttacctcattataaacagaagctttggggtacttaggcatagagctggttttcatcaacttatcaaaatggcagggcaaagagcagtacacagtatattcaactagaaatataaattgagactttaaaattcactgcacacaagcttgaaaacaaatatgcagatgtgtagccaaatggtgaagtcggaatatacattcctgatggcaagggactttttctgttgtgttccctcgtttccctggcacctagagcagttaagggtacatagcaggtgctggaatcactggatctgcttttgcaaaactaacgcactataagatgagaatgagaagttttcttctaaattaatttgaaaagttaaaagatactgtttttcatctgtcaagacggcaaaaataaaaaatcttcgatggcacatgggaggaaatgggcactcttatacacactgaaagggagggcagggccaccaaggacagttgtgcagcttgtacactgaaaggcactacccctagggtgagagagaggtgggggaccggagatccaggaggcgttctgctagtgaaagctgagtcagtctcaggaaggacgtcttttggcaattttcagcccagaggggcagggcagctctttactaccatgttgtattagtggaggctttagataggcttgtaaaattgggcaacttattttggaaaaattttgaaatacctaggaaaatgtaaaatctacaaactctttaactcaaattgtcatacgatttttattttacatctatgcttacatgtgcaagtaaaaagatatggccacaaacacttctgacaacagttgtctgtaaacctaatgagtgcttatttattggtaaatattttcataattagtgtatcctataaaagactaggcaggaatcgctgtggagtggatctggacatgcagatatgtaaattctcaaagagatgctaagtgaaacaaggtatagaagagactatgttccaatgaatggtttttgtcaatcaaaaatcttcttaaaagtctaagacactgaatgtgtatttcaatactgacaacattgttgtatatataaccatgcactctaatatctgctgttactcaaatacctaaatccagttctacagaacatttagaacataccacaaatatccccactaacattccattttaaacacaaagaattgctcatttttaaaaaagtcaaaatatatttttaatagaggtaccaaaaattacatttttctaaattgaattcttttaagcttttctattctgctttatatcatcttgaagtccttctccacactttccacaaaggcacaatttttaaccgacttcaattaaattatgtttctgtagctgcctgggtcagggcattcaacacatcaatcacaatgcaggtgggaaatgtaagtacttttgaaacagtcctcatgccaataagggaatcttcggttttgagaaagtaaaaggaaggtacatgtcattagcagtgaggtcacagtcagtcctgtttactcctattctaccaggaaacccatctttacgtttctccttaaactaagccaggatttaaataaagtggcagaatattattcgcagtaaggttgaggcgggaaattaaagaacaataaaattaaaaagaaagagaaataagttttcctgttttaggctaacttgttccagaagcagcaacaggcacagcctagacccaggaaaagtcttgataatattatctaatatgctctggagactctctcagcactccctcaacacagggagaagaaaaacaaattttcctttgttttacagaatgagtttatagactcttgttctctgtaactagtgatttcaagtattctgttttatctaagtagtacaacgaaggtcataaaaagcctgagtaggcctgaactacagctgcctgggcaccacagagaaggttataggataagcctgtgcccaggcaaacctagaaaacgaacatctgggttgcttggcaatggtcatctgcaatcctgtctttgtcctgcctctgtatccctgctttcacgccactgtaagcttgcttcaagctagcccacctccgtttgtgaagtgtgtataaaagtcaagtactgtctttattctgggcccagtcttttggatgtgagtcagctgggcctgagtacactcaataaagattctcctgcttcaacctgaggtctccctcatactcccgaatcccgcaacaaggtgagtgtaatagttagagaaagcataggcctgaaaggagcaagctttgagaagcactcttacctttaacagaaaatcccagatacatactatttacattttagtgatcactggataaagtctataatgtctttcctggctctgaatttttgtcacaaaaacacaaaacccatcactccaaggcttccttttaatggttttcactttcacctacctttagcactgttcacgacacccaaatcccaaactgaccattcagatgtttactgaaatgtggctaatgaggctgggcgtggtggttcatgcctgtaatcccagcactttcagaggcgaatgcgggaggattgcttgagcccaggagtttgagaccagcctgggcaacattatgaaactccatctctacaaaaactataacaaaaaattggcaggcatggtggcacacacctgtagtcacagctactcaggaggctgagatgggaggatcacttgagcccaggagttggaggctgcagtgagctgtgatggtgccactgcactccggcctgggtgacagagacagaacctgtctcaaaaagaggaaaaaaaaaaaaaaaagacgtgtgtctaatttcagaattaggcaatgcaactagttgaatattttattgcacattgtccatgatcttatatgtaaggcacatttcctagggaaagcaggcatggatttaatcatttatgttgtactgcacacttatttgcactatgtaaaaccatggctggagtgagagaaataacacttttaaaaaccaaccttatattctccatgtcattaccagtaattgataactgtttaatcatcaactccaaagatatttcttccttattggaagaattccagataaaactaaacagaactgtccaaacacatttcatcctaataaagttatttatataatcacttattaggtcataacttataactgagtaatgttctttagatcttaagtgcttgtctttatatagctttacaataaatttgtttctcttaaaattatctgtgcactagattaagttaaattaaaataaaatgtatttaactgtcttcaaaataaggtataggctattttcttcctgtagactgacagcacagatattggaaaatctcttctacttggttttctgattcagttcaaacttgtgcttgcaagtgaatcttacgtaaatgtcacctaaaaagagctcaagaagactcataaaaaatatttttttcgtaatttgattaactttcaagtcattcaccaaaagtcagaccatgctagaaagggaagaaaagttggacaacattcttgttttaccacaaagaccatgccagttagctggcttgattctcccactgatggggagaatgtttacattttaacaataacttcacaaataaacagatgtaagaagtgttttcagtgcataaagatcatatactttataaatccacctctcatctttcttctggacagaccacatctgacttcgaacgtacttactgcaatcaaaagtgttttgtaaaggaccctcctcaggaataaacaagctcactaaaccctccatacataacctggagaaacctccacaataatgaaaccccatctagcactgtttttcaaacatatggtgcatttccattaattttcagggatagcccctaaagtaacttttggctcaacaaccctggaagagaggacctttgctcatcttacacatcaagtgttcatgaacaactctgatgccactaagtttcgttcacaaacttgcacctcggtcgttcttttacaaaaaaaaaaaagaaaggttattttgcaaaaggcaatagatttaatcttggctactatttactcttaatgtttctttcatctcagccctccaatgagaagtttaaaaggaaacatccgagggagcaagtttagatctatctggaggagtttctgtggagccagccaccctcaccaggtgccttccattagagtttaatgctttgctgcggtttcctgaaagagccccacagagagtgggtctcgatgggtcctgaaccgcaccacaaccggccagtgaggtgaggggcgaaggtgaggggcggcggcggggcgaaggtgaggggcggcggcggggagaaggcttcgggaccccacacggtccgggggaccgcgaacgaggagcgggggtgcggggccgcctggcgtccccgtcgaggcggtcttcatgagaacgctcagagcaggggcgggcaggcgagggcttcgaacgcacacactggggccccggacccgcgtcgctgagctggggagcccggcggcgcgggccggggacggcacgggcactttggccccgtcattgacagttggcaccgggggtcctggtcggccgaggcggggcgtggcgccataccggggcgtggggcggcgcagagaggctgtacctggcaggtacccacgtacctatcatggtcactgggtaggtggcggctgcgggccaggaacaggcccatgcgcgcagcggcgccagccgcgcctcccaccagcggctctcctgggttaaatcctccaggcctccccgcccccgcgcccggccctaggaatgcgcacgcgcggagggcgcggcccagggcctgctgggagtcgtagttctaacgcgtagtttctcctcacgcctcctgcccccagccccccaccgccgccctttccggcttcaggcccagcaatcttacgtcaccggggggcggggctatgcgcccgccgtgttgaccagtcgcttagcaaccgggaggcttacctttggaagcttgttgcagctctagccaaggtcctgccctcttcccgccccgcccctagggtccagctcccttcacctaggagctgccaaacatctggatcaacctgggcactacgaggggttgaatttctaccattatcgcgccttttgatatttttttccagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtaagtgatcttcctgaattaaatgcactcgctctgaatcaggggacacgagatttacagaggttggccagccttaggatggactctgagccatgtcctgggtggtctttgccaaaaaaggcagttacttggcaagtagcaaacggtgccccacagtgtgtggggggcaggctaggttgttagaatcttgggcaagtgatgtactctgcccatttataagcaccttcctgataacttatggtttctggaccgcccaaaattactcttaagctatttacacgaggaaaaaagatcccctttacttactaattcctaactagccccactcagcaaagggccttatagaaggtgagttcttagaaatcataaactcttgcaaaatttaacatgagctgatatacaaccgggaacataaactcatgaaataatctataatgagaaatttcttcacttcaacctaggaaattttagaatatcctagcatttgctctaacaacacttgtctcttacaaaatgatgtcatcttcttagagtactgaaagccaacttaatatgaacactgtttcctgacaggccttttaagatgatgtgctttaaacaatacaagctttagctcatatatctctgctactaatacaattcatatttcatctctattatttgtagtaataaaaataaaatattctaagtatcattagagaaaaaagattaaaaatatatacaaatattttagctgtctgcatgatagtatatattttttaaaccttcctatttgttaaatagctttacacttggtatgctaagacagattttgctactgagtaagcaactgtctgggaatgaggcattaaataataaatgcatctttcaaatttgtgtaatttacaccctgggaagatctgagttattacatggcaattcattatgttaaatgaatagtgttgttttccagtgtcacattatttcctttgcttataggttgcaaacctgataacttattcctaaacgacatacttaaaatacatgaatgaaacagattacctatagacctctaggccaggttcccatgtggctatgcaaaacgatatcctaattattgggaagtgtgtcaggtgatttacagtagttaaaattcttggaaatggactaaaattctgcttgttgtaactaattctttttcatggaatttcacataaattggttctcctaggagtcaagatgatgcatttatcagcaataccataaccattcaggttaatcatttagtttttcttctacacaatatttacaattttgatgttttttaatgttatactttaattttttttttactggttggggttcttttctgttttttcctaaacctgtattcataattcttgtatcatattaattctttaatataatcttacacctaaagagatagttctgcaaaatctgatgtttctgtattgccaaatgtaataagtatgcctacatgacttaaaaaaaacattgattatgaagcaggcttctttataaacaacttaattgagatccattatcttctctttttatgttctaaaggaaaatcttgtactagcaatacctctcttgccattggaaatcgtaattcttaaatgcaaacattatttatccattcatctatttattcagtcaacaactgtctctcttttttttttttttaatacccagtgtttgctaagcacagttctggggatttgggatcagcaaagcaaagtccctgcccttagtactccgaggaaaaccaaaataacaacattcaaatcttgataaaagaaggctggacaataccgtttatacaaaataacttcagtggtacaggaaataaaaattttcaatttcataaccaatatttacatttcaccatttttatctttagcagtatagacttctcagcattataaggtgaaaatgtcctcatctctttctgaaggtgtattttgattcaggacgtgtatgccaatttccagcttttcttaattgcaacctcatgctccaagagccaacaccctccaaaccacttttccagttagataagtcaacattccaatgctcttccacctaaaacatgaagaactgtatatatcataaggagttatacagagactcctgatatttctctgagtgcgatagtgatacaagtacataaacttgataataaatatgtttcatcaaatgggctgtgcaagcagaaatgcttatttaaacaatctggatatgagagtgcaagattattgaaaaaataatgataaatgtaaatggcaaaatttttaaaatctcaatgtcaaatatttttcttcaatagaaactagactttctttccatgaaatttttgttgcattctataagaaaacaagcatcacaaaagccctgcaatgaaataatattcaaattcacatttttatagtgcttgcctataaagagatatgagatacacaacttgaagatttcatagttcattttcctttaaaagtcttgtttggggtgtgatagagcccatgaccagaaactagtaacccagtattttgttgtctttatcttgtcagatactttctgtgctgaacaagcttatcacgaagcaagttagaaaatcgacccagggttatggtgacagagaagttgagttcagcctaagctttctattacagctttccttctcaaaagactatagatgctttatgctcaaagtttaggggaatggaataaataatttttttaatattaaaggttgagtattcctattccaaaagtctgaaacctgaagtggtccaaaatacaaaactttttgagtgttgacattacactcaaagaaaactcttttgagcattttggatttcagattttcagaactggcgtgaccatcagtatataatacagatatagtcagctctttgtacagattctgcctccatggattcaactaaccttggattgaaatgtttgggataaaaattttatctgtattgaacatgtacagacttttttttttgagtcattattccctaaacaatagagcatagcaactatttatggagcatttatattgttttagatattataagtaatatagacatgatttaaagtatataggtagaaatgtgtaggttacatacaaatactacgccatgttatatcagggacttgagcatctgaagattttggtatctgcaggaggtcctggaaacaattcctcatggagactgagggatgactgtattccaaatttgaacaaaaaacaaaaacaaatccaaaacacttctggtcccaagcatttcagataagggatagttcaacctatactttacatgtatagtgtgttttatatttaccaatcatgtgctcatttaacacgtagtggtaatcatcaatatttataaattatatattaaaatattaatttggcttctgtaacactgaccaaataacaatagcttaattaagatggaagttgtttctctcataatagaagttcaattttgtaggcaatcccaggaggttgggcagcattccccatgaggcaggtgcaggggcataggagcatgtttgttctttgcatcctgtaaaatgacacctgagacaaggggggctcgagaccaccagggtcaaatacctgccctcaagaaggaggaaagtggaagcagagagcttcccattatgtgcatgacccagacacagcaccccactttcattctcatccaactggccagaacctagtaataaatacacctacattttccctttttgcaaaagcctatgaaagcttgacccatgaagcaactcccaagcccacgtacctgtctcctcaggaaaaggatgaaggaagctatgtagttccaaaagggcatcatctccaacacctacttcaggtggaggagagaaaaatgggtatggagcaatctgcaagaatgaggcaggaagaaatgaagagcaaacagcttcactatgagggcatgtcccagaaacagcaatcctcactcctgctcaaatccattgccaaaacctagtcttatggccacagctagttgcaagagaggctgggacatgtagtctttaactggtagctctgtgtccggctcaaactcacaatgttttattactgtagccaaggaatattgggggataattagaagtgtctagctccagtgctaaatgtgctacattattagtgaagaaaaggagagagacaagtaaaataattacaatacaaataaacagatgtctctggcagagaagtactaatgatgaagggaccaagtggcgatgaactaatgggtgccctcatcaccttttgtctaggcttgtacaatatcatccacctatcaattggttgactccctcaatcaattatcagtacaattacactaatctttctggtacaatgttctgctcctatcactattcagagcttttggagcttcccaattcttatagaaaaaaagtcaagatacttccccagggccagcaaggtcttgtgtgatctaatcccattctgtgttctaaaatttcatctcccactgttctcatttgcttcagtcaatctgaaccaaggaaataaactcatattctttatttttgtgtttctgtttatgttgttccctttgctcgaacacccttctccctacatatctgcatatacaaattcattctatcatcaggtaacacatatctattgatcacagactatgtgcaaagcactgttttaaatgctaggaatttagcagtcagcaaaagacagaacacatgctgtcaagaagcttatatttttgtggccagcaaaatgccaactgctttaagaagacttctttaattctcccttcctgtcacccacatagaaagttatcctttattcattgtgttctactttgtattatggtcatttctgctcatgttttatctccttatgtaaattctccgtgagggcagtatccacatctaagtcactttttaatcttaaccagaacctaacagtgtattcaataaatatttgatgaatgaaggaaagcaattctaccctttcttcttatctcatattctcctactttcttattataattgttatttgtctctattttgaatttttttaagccatcctctctaattgtggagcccagaagctccctttaaaacttgagaaggccgaatcatggcattcgtcacctcaacccctcaggtggctccctgcctcactcagagtaaaagctaagcttcctctattgggaaggccctgtgtgatctgcccacccttgctgctttatgcaactctgctggccctgcctccggaactcagttagtgccacgcctttgcccttcctgtttcctctgcctgaaatgcattttaccctgtgtgtcctcatctcttgatgcttcaaatttctgtttaaaaattagctatttagtgagcctcttcctgaccactctattttaaacttcagacccttaacaatcccttccatccctgctccagcactcccatctcccttccctgttttatatttttccctctaatattaatttagttgagcctgtgtttttcttctaccagagagtaagccccagaagggcaggaatttgtttatttcacccattgctgcatcctcacctcaagaaaaatttatggcacatagtagctgccatttatcttattttgatcagttgaattaatgaaagactatattttatactataattagacaatcatcttcaaatcagtggctccaaagaaaatgccaatgatgttatatagatattaaatctagaaatgagaataatttgcagctgttttatgcagtatcataaaagttacacatgttcattgaaaaaagttaaagtggtttggcttagaaaagctttttcctgtctaagatgatgagaaaaaattcagtctttttttcctggattctgttttacttttaattttttattttgaaagtttgcttcaccttaagtcattttgattttggaaggtataaattttgacttattttccctaaatggccagagaattgttacattaccctttatatacttaaattaaattatatcaaacatcttcctatcaaatttaggaattcctatccaatttaaataatatatcagtgctgtttttattatttcaagtaactttattaataattgattacttaatgtcatatatttattctttcatatataatagggctagtgatcttcattccatttggcttttccaaccaatcttatgaaaaggcagagtagactgtgtttttccacttaatgtataaatctcaaacaatttactattttgtggttgtttagagatacttattaaaggatagagcaaggactggaacctagatttctaggtttttcttacaacagttctctcacatattgtaagtgaatcacttggtgaatatcaaaccaaacacactgatacaaccaacacccaaatccagaaacattgtcaacaccacagaaccccatctgtctctttgtagtcactacccaacattcccacatgctaaccttcttctgactttggccaacagactagtttcacctgtttttgtacttctatacatggaatcataaagtatgtaattgttttgtgtccagtttctttcatcaacattctgtttgtgagattcacccacattattgcatacaactatagttgtaagtaaatccttcatgtttatccctgtctagtattttcttggatataccataatttatttatccatcgcttcctcgatgggtatttgtgtgacctccaatttagaactgttacaaatagcactgctaggaaaatttttacactttttttggagaaagtatctacgcatgaccaaggacatatttctgggagtggaattgctggaccctaagtcatgcttgtttggctttagtaactaaactaaagctgttttcccaactgatttttcaaatttaaactctttccagtgctatatgagagtgctgtttgtgctacagtctcaccaataattaatattttctttattttgcattttaagtattccagtaggtatgtaatgttatatccttgtcatttgaatattaattttattgtgactaatgaagttaacaacttcttcatatatttactgtccatttggatatactctttattgaagtgtctttttaagacttttgactgtttttctcttggcttgatttggttttttatttatttgtagtacttttttccatctatattctaaatgatatgaggcacttgtctagtattgtatgtattgcaactacagttacccactctgtgagtttcctttccattctcaataatggcttttattgctctttttaaagttacatactttgtgaagaaaaatgtttacctcaaacatacttgtgtatttcttcataatgtttcctcaaccagtttcaactagctcacagtgaaatacatatacattaagacacatgacttggaaaataaattggagcgattggaaatgaaatagaataaacaacagagaaataataaaataaagtgtaattaaagtagaaagcttgggctcaagaaaagaagcatcaattttgtcattcataagagtcagtatatttatcaatggatgttcaaatttaattctgagcttcttggcatctgttgctgaaaggagaacattatacacatctcattatcacaaaaggagaagcccatcaatccctatagggaactgaagctttctctacactgaactctctgagaaattggtcatgtcacattttaaatacatgcaacataccatatctacatttttatcttttgcaagaaatgcagtgaaaatatcatccacaaaagatttcagtgagagctaagtacacgttattaaaatgtatcttggcaaattggattttgcctgatattaaattgttgtagtacatgtacgtagactttcggtggtccaatttgatctggaaatggaatttacagtgctcacagaaatgtgtagattgtatatattttagttattgttctcagttcatttcatgatgggagcaagatagctgcgtttttgtagttggcagggagaaaatgtgtaatatgataagagcacagagctgaacgacctgagagggtctgagtccaggaaagtttcctgaagggaatcatgtttggtgaaatataacagttgagaaggacctaggggagtgtgcaaaggctgagagagaccaggctcccagctactgtggttttcaatcttattttctgcctttttttttttgccataaataattatgttgtaagttctattcattatatacatgttaaaaattatttagattgcatatatattttatatattttgagagcatatagagtgtatatacctacctgtatgtttgtatagattgcaatgtacataattataataccttatatggaattttatggattccttctaatatgctaatattttacatgttgttgaaagctcataagcatttaaaaggcttcataaaattctatgctttgaatttgtcataatttactttgtctttcacttaggttgttttcaagtatttactattagtgtatacatagggttgaaattagtatctttctataaaaagttttttctgtattttacagtatttccttgaaatacaatttctgaagtagatgtactgggtcagagagcttatcaatcttaaaaccccaatcaaggttttattaatactgccacctgctgtgcttgaatgtgcctattctagctcctcctgtggcctgcctaaggggcttttgacttcccggaccttgcctgctgtctacctcctcatctgccagtgttgagggtcaggatctcagcacctctgaaacctattcatgatacaaatgagggggttgcaaacatctaaggctgtagttctcagattgcaaattgtaatcacttgaaagattcccatttaattcttctaagtgttctggggttgatttaattagtctttaattaggggttgagaacatctgggtacatagtatgatggggaagatctcagaaaactattttctagatggctactcaattttcccaaagacatttattatgtaatattttattccccattgctttgtgtgttctttttctttttgtgtgtttcataattctacataatagagatatttgagaggaatttttaacgaatgtccacagttttaattattgtggtaattaaaccacaacttggtaatatgttttagaaattggtggggctaatttatcctgttaattcccagaatgtttattttaaattttaacattttaccggtttaatcttccaaatgaccttttaataagatgtaaagtcgaacatcattttgagttggaaatgat

SEQ ID NO: 337 - DNA, 45679 bp, Homo sapiens
gcaggggaaagaaataattaaaacagcattacggtgtctcttgcgggatgcagtgacattcaaaagccacactgacaaaaagcctggggctggaacgttctgtgctgcctgcatggcatgtacaggaccgcggccccctggagctggtggagtggcccagccttgccctgctcacaggtggacctggagagggcactgtgccttcccagggattgggatttgaaaagaacagagcttggccaggtgcggtggctcacgcctgtaatcccagcactttgggaggctgaggcaggtggatcacttggggtcagaagttcgagaccagcctggccaacatggtgaaaccccatgtctactaaaaatacaaaaattagccatgcatggtatgtatgcctgtaatcccagctattcgggaggctgaggcaggagaattgcatgaacccaggaggtggaagttgcagtgagctgagatcatgccactgcactccagcctgagcaacagagtgagactctgtctcaaaaaaaaaaaagaaagaaaaaagaaaaagaaaagaacagagctgtgattttcagccaaaatgagcagccctggcccattctgtgtcatcagaggggagaggacggttactgtgggagggggcttcagcttctcagggaggtcctggcggcccccatctagtaaaccagtaaacccatgcctatcctcatgcccacgtcacactcttgtgggtttcaagtcgaacagtaaaaggaatcataagatctgtggggaagctacatgggcacttgtgtttcacaacagggacccttaaaggcgatgtttccagcaaaggatgtgattttttttttttttttttttgagataagttctcactgcgttgcccaggctggagtgcagtggtcattcacagacacacacatagcagactacagactacagccttgaactcctgggctcaagtgatccacccacttctgtatcctgagtccctggaacggcaggtgcacaccaccgcacccggcttggatgtgatcttttgtccacattcttttccaattggttcaaaggtgtaggtgtgccttttgcatacctgggaagggccccattaggctcgactcctcatttttctccattcaccatcagtttgagtctgaattcatagcatggcctggacagatgcagcaaggggccagttccaaggcagaattcagggtgaactcgattcctataggcttgggatgaatggctgctgggacatgaggcttgggtgtgagatgccccgtctgctgctgctcttggttcttagttcagagaaattctgggacccttcctcctcccggcaccacgttttcagtgaatggttctttgaagaggaaccctggtccataggaactgagtgaaagcaaggccaagtatgtccacccatggggacaaacgtcccagcacaaaggggtctcaggcctgcaaggcccaagtggacgctcggacaagggcaggaaggtatttgctgattctccttctccatgtgacgtgtctctcaacccacaccagctaggggagcctcccgcagcttcagttcccctttgacgcccacacagtgttatgcaagcaccgagcccagagtcccgctgggccgtggtgtcctaattgtcttggtgacaaagagcaattttattttaaagcaactgaatcctttccccctgttttgtgtgccagtattttactgtcttcttaattgttttaagcaatgtttactttggatttctggatgttatataaaagccacgaaaaccctggccatgctgtttgtcaggcccacctggctgagtgcaggaagcaagcgcttttcaggagctcactgcaacaccgggcaaacacttcttccgccagggatgcggttaggacaatgccacgtggcgtcacagtatgctgttatttattccaataaagacctcgtgagcatgggcctgtccaccgtctttgtttggctgctgttttaatctttcatgcatttagcagtcatggatggtgccagcgaaggaacaggtgccagggcgttgtgactccacccagcgctgcttcccgggaccttccaattggacaggagctgggggaagagctggttcacagccctttgtgggggatgggactttgggaaccccaaacttctgctgggaccacaaggagaagagggcagcagagtcacagctgcaggtgagtaataaaggctcatctgcccctctgcctgggtccagaccatacgtgcacaaagctagcggccaggagcacaggctgcatgacacatggaggtggtctccttacttttcatgatgtgacgtcactgggccttgcatgctgaccagtaagtgaccgctgttgactctgaaaggcaaggaacccctgtgtggcggagatggtggcctgccctccgtgctggccctgccataaactctccttggcacaggtcatagcaggtttcaggtgcgtcgaattttacgaaatgatgataaaattgtgactagtccaggatgggtagcctggagagaaaggcaaccacgctattaaaaaaaaataagctaaaaattataaactgtggatggaaggaatctgggctttggagaagtgcctgggtttgtgtccaggtttgtcactgtgtgaccgtgactgcggggagcgaagtaatccacaccttccagctgagggttctgagggacaaattcaacctccttctttcaaagtcagccattgtcagcagagagggaggttctgccccttgggggatctttggcaatgtctggagacagtttgggttctgggcaggtagctggtggggcccgggttacagcttaacatcccacagtgcacgggacaggctcccttctccccagcaaagaatcaccgggcccccctgtgcactgtgctgaggttgggaagccctgcagtagagtgccaggtccttgagctggcctgtcttcgcctgcacttttattgggtaggactcaactgttactattgatgaggataaaatattttccactgaaatgccgagttttcaaggccagcaatggtgcagaaccttctggggatcttccgattggttctgttcagcagtcgtttaccaagggtctggtttgtccaaggctggggcaagtggccagtgagaagagcgtcccctgcccttgagctggtggagtgagagaaaatgcccagaaaggaggggtgcgggtggggcaggggagtgagagggaactcccagaaaggaagggtgcaggtggggcaggggggtggttacctgtctggagagggacagctgaagcctggagatggtgtggtggaagccagtcttcgagaaggaacaggacctgagtgcttcaggtgcaccggagtagggactaatccaggtggctttaattctttgtctattataaaaattggttttgggctgagcctagtgggctctggctcatgcctgtaatcccagcactttgggaggccgaggtgggctgatcacttgaggctaggagttcaagaccagcctggccaacatgacaaaaccctgtctccgctaaaaacaaacaaacaaaaaaaaaaacccacaaaaaataaaaattagctgggcatggtggcgcacacctgtaatcccagctactcgggagtctaaggcatgagaatcacttgaacctgggaggcggaggttgcattgagccgagatcaccccactgcactccagcctgggtaacagagtgagactctgcctcaaaaacaaaaaagaaaagtgtaggtgatataggatggttctgaagatgctcttagcctgacctgattctccgacctttctcacttgttctcaaatataactgccgtccgggcacagtggcttatgcctgtcatcccagcactttgggagactgaggcaggtggatcacctgaggtcaggagttcaagaccagcctggctaacatggtgaaaccctatctctactaaatataaaaaaattagctgggcgtggtgccaggcacctgtaatcccagctactagggaggctgaggcaagagaatcacttgaacccaggaggcggaggtttcagtaagctgagactgcaccattgtattccagcctaggcaacaagagggaaactcggtctcaaaaacaaaaaacattgcttctgtcccattctttcaggccaatgcactggtgtgagctgcatgtccccagaaaggccccccaattcagccgtcacctccccagggggccgtggtggggagggggctctctgcttaggacagggcccctcctttcctggtggccagtctctgggggaactgacattgcacggccacttgccctcagatgtgacagaactggcagaatctgagaatctcgagaaggaagggaccttctgaggtcacctctgttcatccttacccaggcaggaatccccggccaccgcagggacgggcatctctgttccttccgcaaggacagtgccctggggttgggcagctcagaattagtgaggttttccgtggaaacccactctttggggtttaaatttgatttaatacaccatcatcatcttcaccagggtgaggctttgccctggggcagggggtggggaatccctgtgtccaacacagtaggacctggagcattcattgggtcagtgagtagtgggagcctgctgtgtgccgctgaggcgttgggtgtgggggggtgggggtgtgctagggcacaggaaccaggagagagtggagtggcaggtggacaacacagtgaggccgatgaagaaatgcagctgggggcaggtctgggacgaagatggagcagagggctgcatctgggcatagaggcgggtaaggaggtctctgacaccagggaaatggggcaaaggccacatattcttccagtccccagcccctcggatttaggtggccatgtggctggtcctaacagccgggacatggtcacaccggacagcttttaggaaagactgtcaccttaaagtatgcaacacctttgtggatgtttggtgtgttttcgaaacatccacacagggttctgatgttctcgatggctttggaatgtagtgctagatttcctcccacaatctcattcttaaaatgtattgccaaggtgagcctgaaacactgtgccggaaagcagggaagcacagttgtccctggtatcctctgtggagtgaatccgggaccctggaggataccaaaatctgaagatgctcaagtccctgatatcaaactgcacagtatttgcatataacctacgcacatcctcctgcatactttaaaccagctctaaattacttatgatacctaatacaatgtaaatgctatgtaaatagttgttacactgtatcacttagggaataatgacggagaaaaattctgtatgtgtctggtacagatgcaattttttcttgatatttttaattcgtggttggttaaatccatgaatgtgcaaccaaggatatggagggccaactgtactcaaggaatgatggggacatgtcaaaaggacagaggcacaaacagcgtccacattttggatacttcaagcatctgaaggagcaatgtggagtataacacattggattttttttttttaattcgtgcacttagagtgatattaaactaggatgagagcaaaggcttttttttttcttttaacattttacttttatatagtttcaaacccgcagaaaagttgcaggaatactacaaagagttcctatgtgtattaatccattctcatgctgctaaaagagacatacccaagactgggtaattttaaaaggaaaaaggtttagtggactcaccgttccacatggctggagaggcctcacaatgatggtggaaggcgaaggaggagcaaaggcatatcttacatggcggcaggcaaaagagtgtgtttaggtgaactgtcctttataaaaccaaccagtctcatgagacttattcaccatcatgagaacagcatggaaaaacccgtccccatgattcagttacctcccaccaggtccctctcatgacacgtggggattatgggagctacaattcaagatgagatttgggtggggacatagccaaaccatatcactatgtttacctggagactcatgaatgttaacatttttactttatcctcttcactctctttctgtccctgcctatctgcctctctcgatataataataatgatatatatttctttagacgcacacatttacctggtgatatatatattttctgaatctttgagggtaagttgcatgcattatatcctcttcacctctaaatacatcagtgtagcttcctaaaagtgaagacattctcttccataatctcagtatgtgtcataatcaggaaataacattgatacaatggcattgtctaatctacaaaccttaattgtgtttttttccaattgtctcaatgatgtcctttatgccaaaataagaggcaggacaaggcattgaatgagttgtcccatctctccagcctcctgtagtctggagtggcccttcagtctttccttatgtttcatagccttgattctttggagaatccaagccagttatgttccagaatgtcttgcagcttggattgatctagtattttcctcgttattagatccaggttatgcgttttcggtagaagtgatgtgttcctctcagcgcatcattaccaggagacatgtcatgttgattgttttactttcttatgatgttaattttgattacttagcatgtgagcacacgtctgtggtcccagttacccaggaggatcacttaagcccaggagttcaaagccgcagtgagccgtgatcacaccactgcactccagtctgacagagtgcactgtttctatttttaaaaaatatatattacttagttaatatagtgtttatcaaatttgtacactaaaaaatgtaactcttctttgtaatcgatcaatatttatgaggaaagaattttcacttttggagttacctttccatcaggaataactagaagcctccacaaaacacaggaaacagttacttcagacattggacatgcctttgctcccccttcaccttccaccatgactgtgaggccttcccagccatggtggaactgtgagtccattaaactgtctttctttataaattacccagtcttgggtatgtctgttttagcagcatggaaatggactaatacacataggaactctttgtactttcctgcagcttttctgtgagtttgaaactatataaaagtaaaatgttaagaggcgagtcagatctgtgatccccaagaaaagggtggcaagtgaggtgagccctaccctggtcttggctttctgcctggacataattcctggactgtgctgtagtgagggggacccagacagagccaggtctcactgatttaaggagacaaagatcagagcttgcagagattacgcttattaaaaacagacatcaaaagaatatttctgccagaaaaattccaacacttcttaaagaaatgcaacaaaattcagcacgcgacgacataaaaatttaatgtctagcattcaataaaacattattataaagaagcaggaaactgtgacccacaatcgggagaaaaatcagtccacagaagcagaccaggaaatgacagaagtgatagattctacaggacaactgacctggatgtttaaaaaatgttagtgtcgtgaaagattgttctagattacagggctctaaagagacatgaaaaccaaatgcaatcacatgtgctgtgtgatgcctgaatggatcttggattaaaaaaaatacagctgtaatagacattttttgaagccttggtgaagtttgaatgtggatgagatattagaaaaccttctatcaatgctaattttcttaggtatcataatggtactgtgttatgcaggagaatgtttttaggagaaacattctgaagtatttagagatatccctaaagtgatgtgatccctgcaatttatttattttttattaatttttaaaaattttagttgtggttaaaaatacacgtaacataaaatgtactgtcttaactatttttaagtatacagttcagtagtgtttggcatatttgcacaggtatatttcacaccgtgtctctgaaaaaaaaaaaggctggaataattcccttctatccatgcctttctcttaattggggtttgggggtgcttggacttatctccatgttactcttccaattcttagagtccctctcttcccctaaacaatgctctacacacaagaggctttgtgagttgtggatttagtctgttgtaactccacaccatacaggattagatttcgcatctgattcttacatcagccctgcagccccaagagatgagagatagctttgagggctatcagagaactccctgtattctgcacataccttgagctgagaatgtaaagccctgggactgtccttttcttgctttaaactctttggtgtgatgataacaagctcaccccacagtccttagataacctgtgctcgtattgcgtatggaagccacaactctgccaaagccacaatttaataggtacttcgttctgagtgatgacaggtaattattttgccatcacaggctacgatctattagaactccattctctaacagttactaggtccccactgcctttaaatcaaccagaacaagtaaccaatcccagttcccatcctggaggtcgtgttgcctgcaattgtttctggtaacaaatccgaagttaattgggattcagttgccgatgattagagtctcttcagttgtttggaggagaaaggaatctaacataggaagctgtgtgattctcaagctgttggaaggctggaggcagcgcctccagcaaggactcttggaagaatactgcagagctggctcctgaaggaagctgccgagtcaggctggccctagaagcatgctttctgggttgaatgctttaggttcacctctgcagatccactccccaccattttctctcctcacatctatgggccgcagcaggggacttcttttctctggcttctggctggatgtgggcaggggaggccctggcaggagggaggagagtgaggcttggtcattgattcctccagctgtgcccttctgctggttcaccatgagctggctgtgtccctctaccaaaggccacagctcctatcccgaggcccctcttagagcttcagtgattctgttcctgggctctgccacccactccctccttcaccctctaggttttgaagaagtaacagctccccatgttgctagcctggggtgtagcactgtctcttctgggttcctttaaccctgccccagctgtccctttattaaacagtcttcagttagcacatgggaatataccgtctctttgctgctgggactgtgactgctgctacatctatgtggctgtgatccagagtcagaagccaccaccagaaccactgtgtccagagctgggctgagcctgctacacacgccccagcaaaataggtcctgcacggtggcttctctccccacctgttacaagccccagtctagcacgggcacttcagaatggcagggactgactcatgtgcctcagtgtcttcctctgtaatatgggggtgatgattgtacctacctcacaaggaagtttccagtaaaatgaaagcccttaaaattatgtttgtttcatcaccaatgactccataaatattagcaacaataccagtactaagttttgtcattttttattaacttcttgtaaacgaccctactttcctgctctcacacactccttacacctgcatcccacctgatttagccactttctgcctaacctgtcagaaagggtagatagcttcccagtcacctgttgctagggaaactcaccatttcagcccggatggtgaagattccagcttgagagaccagctcgggtctgaagtgtttctctatctactgtgctgagatctctccttctcgaaccctgctatgcctttgcatacgctgttttctccacctgccacgttctcaccccttcttcttccactgcaaactcctatgcagccgtcaaggccccattctcctctggaaagccttcccgatccccttggcaacaaccaccaccaatatttattcactgagcccactttgtgccaagcattgttctagacacgggtatgtaaccgcgattgagagagacagaccacgcacagcctggattttattttaagagctattgggtgccgttggtgggtttgagtgagtggggtcaggaagtgactcactcctccgagggcttgtgggagcctcagctcaggggcgggcagggggcgtggggaagtctgcagccgagagtccaggtaggagtctcctgcgtggtcccgggagaggaaggggcctggcccggggcggggtgtggaggtgggaggacggcggtgcgggatggagggtggaggccaggctgacagggtgctggtggtgggttgcgggggtcgaccccaggctctggcctatgtagctgccattttggaggtgaacagcctgcggggaaactggcatggtttggggaaggcggggagagggggagaaatgaaagcattgagtttaagtggcctgcagaaccccgggggcccaggcggcacggcgggcgctggggctccgggcagagctttctggaggtttgtggcagcttcactttcacggcatccacccccctcgggccctgccgcagagaggaggaagctcctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggtgagttctggcatcggggccaccatacttgagtgttgggggtcacggagggaggggcccagacaccacctgggaaggatcccagagtgcagtcccagcccaggccacccggggaagggagtcggtaaagtgggaccttgagtccccacggcccctccggctgcccctgctcagaggctgctcggcgtcctccctccctgttctactgaggagttgccgcctctgaacttcagccaacccctccgtctccaggtgaagaaactgaggccctggggccaggaaggggcttgcccaggctgctgatccctttgggcagcatcgagtccaggccctccttgtaaccatgcatcaggaccagagagggcagggggtttgcccaacgtcacacagcctgagtgaggaggagctggcctgggacccaggcttcctgacgcccaggccaggctctttcgttttctctggccatggccctcagcttggatattaaggggctgggagtcagttgtgtccccaccacctccatgctacagggcaggatggagtctggcatcccccgccccaggctggctgctggtgtgacatgggtggctccagtcgagtgaatgcctccgtctcccacagctcagggggctccctgctctggccaccaacttctgccatgtgactcccctacctcaatgtctgattgagtttgaaaacactgagaagacccaggggctgaaaagggaggaagagggaggccagaaggcgccagccgagccagcgaagccttcacaggagaggaagtgggccaggggaacaggaaggagggctgggctggcctctgggtctgcccctgtcccgggcatgtggtgagcccagccttctgcctgtaatgaggaggaggaagatgaacagtgcctctgtcaaccctggcccttccggtttatgggatgggagatgtcaccattccacgtatccacctcagccagccccacacaggccgaccggggaggtttcccttgagctcaacctgacaagctctgaggagtgagctgtacctactttgtcctgtctgggatagggtggggggtccctgggtagggggctgggggctgcaggagcacggtgggcggccgctctgcacctgcctgaggaaggaccacttcctccgccaagcctttgcttggctgtgcccgccctcagcttctgtgcctttttctaacccgtcaccccgcaagggttggctcaagggctctttctcacagggcccgtaccccctgcctaggctggcatgctgacgtgtccccagaacctggcttctaccctccttctgtgcctccaggtctagagaaaatgaggggctcagtgagtttggggcttctcagaccgtgacgccctctcctgcctcctctgtgcaggcttgggaggcgatggagccggagttcttgtacgacctgctgcagctccccaagggggtggagcccccagcggaggaggagctctcaaaaggtgtgtgcccacgcaggtctgagggtggagggtgaaggtctgtgtggcaagagtgagcctggccatgcctgggacttgcagcaccttcccagctgtcagctgagcgcccaattctgctcacccctgcctccaccttctgctttatgcttgacctaactcctcctcctgggaccttctacagagctagaacctcttctctccagatgagagacggtgtggattacgatggtgaatactgattgctctcatcctgtgagccttctgagtgcccctactgcaccagcacctcttaccaatagcaactcatttattctcaagggcgggcatcagtgcctgctttatacagatgaggaaactgaggcacaaggggtgacgtgccacagtaacaggaaactcttagcaagtggtggacctgggttctgagcccaaggagggtggtcccagaactgaggttccacacggaccacgcagcgatgcccaccatggagtgatactttgcagggtgtggggctcctgacgtgctcccctcacacgtgtgggtccctttcaaaagtggggtgagcataggatggagcaattcaacgactataggtcgccctttcagtaaagctctgtgtcatgagccctttggggggttggcggccacagttcctgcaacctcccttctaggagatggctcaaaagaaggacatgggcaggtacccagagctgtcaccctctctgtgttctctgaaagaaacaaatgaacaacagcttgcaaggaagcagcgagatgtcccagtggggaagggctttaggtgaactcattggaatttatgtaaccacaaaaacataaatgtgctgacaaagaaaatgtgtgaaataatttaagggaagggagcagaatgcggctttctccagctcctgtgaataccgccttttaatgtttatttatttatttttttcttgagacaaaaatctcactgtgtcacccaggctggagtgcagtgccaggatctcggctcactgcagcctctgcctcccaggtttaagagattctcctgcctcagcctcccaagtagctgggcttataggcacctgccaccacacctggctaatttttgtatttttagtagtgacggggtttcaccatgttggccagctcggcctcaaactcctgacctcaagtgatccacccgcctcggcctcccaaaagtgctgggattacaggcgtgagccactgcacccagccctgaatgccgccttttaagtaggtgttatggagcgagaactccagtgccaacagggtccctggcacggcagatgagaccccagaagggacaagcttggtccagagtcacctggctgtctttgtcaccatctggtattctgtgtttaaaacattgaagattagaaagtgtcctgaggaaagttgctgagttagaatagtaggacttagttactaccaaacaaaacaaacaaaaaaacccattaattttttgttttacaactgatttaaattactaaaagttctggcaagcagagctgggacattggatgattcaagcggcaagaagtctgctccaggaaggagcagcaccatatccattcactcattccttcattccttcctttcttcattcattcattcgcctgctcacccgcccaagtgtttgctgagagcctgccctgtgctgggcacaacagcccatgacgctgttgccttccctttcatcagaagacatgggtctgggtagtacttgaaggttttcagaatacctaggaaaagcctttattggggtcacatgagagatgatgcattttgtgaatttaggcaagacagtcgccactgctgactcagtatccccccatgtaccttggaactagttgatctcagaggtccttcttggccctgacattttgtgggttctgtgagtctaaaatgtgggcagatgctggccatggccttggggaaggggagctgctgggcctctgagggccaccccggggagtctgactacgagaggggccatggaggggcctggcagacctggggtaagtcccaccttagccccttagagcctggtgagcctgggcacctcctcccctctctggctggggtttcactttacctaaataggtagggttgccagatatatcaaacataggatacccagttaactttgaatgtcaagtaatcaagaaataacttccgagtttatgtctcaaagtataaatgctgcagtgtctgaggatgagctggtgttcgtgagggaaatgagggaaagcacgctggggcggaagtggcaggaccggtgcccctgggtctgcggtgctgaaatctgtgggtgacctgcagggagtgtggccaagcgccccacagggtccccatgcgcttgtcatacccactctgcttccaggaggaaagaagaaatacctgccacccacttcccggaaggaccccaaatttgaagaactgcagaaggtacagcagcctccacagccctgacttccctgggtgcctcttggcagaccaggcagcggcctccacggggcggggacagcaggctgtccccactccttggcctcaggctggggggtggcgacccccgaagacccctggaaggcctgttgaatggagcaagtcacccacagagcctgcatgaacaaacatctattgagcaccaactgtgtgccttcacatacaccatcccagcaaccccatgggatttgaggggaatctattatcccttacatcccggggacaggacagacagcaaggcttagacaggtgacctcatctgtcaggggcacgcagctgcccgtaacggagctgtggtttgacacgagctgccagcccctaagcccgtgctcctccccagcttgtctgcccaaggtgtaggagaactggtgaggtggtggtggtgggcctgggtcacccattcttagttctctccttggtcatgggtctgctgctatggccactggaccagctcggcacaggtgggctccaggcctctgtttccctcagcgtctgtgtctccagtctccacatggcctctctgttgcctcctccagggaggcctcctggcctacaccatcttccatacccagaggctttgtgggccatttcccatcctccttcctattccctcactccatccatccacctttcccacctttgaccagcacacctggcccagccctgtgactggcactggggacaccatctgtggtcttgcccggaagacctggtgaggtgctgacatgtcgtctcagctcggtctcctccacaggctgatccagagacaaggatttggatgccagtagttgagttgggaggttatcccaggggtcatgggagggaaggggccaacacatggttagtgatggagctggtcatggttctgggggctcaagcctgctgggtaccctggagccagcatagagcaagttcagtgcattcctgcccaaggggcgatggagctggggtatttatacaccaccacccctgccccgacaacctcctgacaacctttagtgaacagctgctccctgagaaagggctgggccttgattccctggcactctgaccttttgagcacagcagagtggggacagtttcgagcagagctgcaggtgggagctgggccagtaggcaacagtcaaggagtgggcagggtaccagcagcccccgcattagcttcctagggctactgtaacatgtgaccacagactgaatggcttaaaccacagaaacctactgtcttacagtgctgcaggccagaggccctcaaccaaggggtcggcaggcttggctccttctggaggctctcaggggacccctgtcttctccctttcccccagctgtgatggctgcagcatcctggtctcccagatctgtggatgcatcactgcagtccccacctccatcttcacgtccaatgtcatgtccctcatttcctcctaggacctcagaaggggcacctttaacatccatatttctactgaccacctcttcagggcaatctaggctttttctatcaagtgctcattgtccaattctttccattccccaagccatttccccatttttgggtatttgctatggtagtaccccacttcctggtactaaaacctcacacatgataatgacagccccacactgctcaggtttgtgatggagagaagcagggagtctgcaggaacctggggcaggcccctaacagcctgggagatcaaggagggcttcccagtggaggtgacatttgaccaggccttgaaagatgggtaggagttggcaggcgagaggcaggcattctgagccaggtggagggccaggtgagaagtctccatccccccaaaagttgtccccttggagcctgcaggtgttgatggagtggatcaatgccactcttctccccgagcacattgtggtccgcagcctggaggaggacatgttcgacgggctcatcctacaccacctattccgtaagtggctgtttctggggctgcctgggcctcggccccatccccctgacctggcccctccagggcccacaggtaggctctctccttcagtccccacaatggtcccgggtttagggacacctgtctcactttctagatgggcctgggctggggagatggaggcgctgtccacagcccatgagtgagggggccgagctggggctcagggtggggctctgacgccagggttggtgctctttctaccacaccacactgcctctctaacacttattgagtgcctgctgttttgaggtgctgggaggtaacaaaagaacccatgatccctgccctcgggctgccctaggctgctagagagaaaacgggcagtcctgggtggctgggggcagggctgggctcctgtctccgtgttcctcctcagtctggaaagctccaaggggctttgcaggggatgtgcattctcagggcctcctcctggtcccgggcaagtgttccccacaagccccagagtcaccctctcctttgtccttgtatggtcatgtctggtctacgcatctcttctgcacacaactgtggtctcggaggccacagataggcccaattccatgtcctcagcacttcgcctgaggccagcctctgcagtgttcgccgagctctttggagatgggctgcacaatcccactcatgcggctagcacttccgggcatgtcccatgtagcaggtgcagttcatcctcagaatagccctgtgctgttactgtccccatttcacagatgaggaaagggagcctctgagaggcctcataatttctccaaggtcttatggttagggaagcaggggggtcaggatagaagcctaggagtgtaggctttaaccactaggccacactgccctgcagagatgaagtggacacagctgtgcagaagggcaggggctgcaggcacaggctgatcaaggtgaggtgggctctctcaaccagctcagggggctgaggcttgctcacatcatgtggcctgcatggcccaccaatcctgttctgtgtagatgagggtctcctggaagctggagggcatacccgattgaggctgtgagtgtggcccacggtccaacaccaagaatgggctctccagacccatgttccctgaagcaccaggcaggctcagcctcctggagggtccctgaggtgctctctggtctgtccccggccaggggtcctcaccaccctctcctgcctccagagaggctggcggcgctcaagctggaagcagaggacatcgccctgacagccacaagccagaagcacaagctcacagtggtgctggaggccgtgaaccggagtctgcagctggaggagtggcaggccaagtggagcgtggagagtacgtgggccacaacctggctacccctggggagtgtggggccgctggggtccttctgcttcaggcttctcacccaccaggaaggcgcactcatccttctcccagcaggggtacaacctgggagtcaggaaggaggtagaagcctcaggcagccacagtcaggcatctggctgagcagccaacagcccagcacacatctgtgccctagagggtgttactgctgcaaagtgcagcccaaggatagcaaacagtctctgtttgctatctgaatgacagccactgttgagttccaagtaccgtggtccgcccatccacactctcatttcattaaagtattggaatatctgcagggcctgcttatacaaaaaatgagtgtgcctggtcgggtgtggtgtctcacacctgtaatcccagcactttgggaggccgaggcgggtggatcacctgaggtcaggagtttgagaccagcctggtcaacatggtgaaaccccatctctactaaaaatacaaaaattagctgggcgtggtggccggtgcctgtaatcccagctactcaggaggctgaggcaggagaatcgcttgaacctgggaggcagaggttgcagtgagcccagattgcaccacttcactccagtctgggctacaagagtgagactccttatcaaagaaacacaaaaaccaagagagcgtgccaaacacctagacttccccaccccacctggttcacagtttggtatagatttccttcccttcaattctccatatccccccaccccacccagatgagaaaactgaggctgaaagaaattatgcagcttctccaaggttgggcggtgaggatttaacagagtccgttttcaaacccaggttttgttgggtcccatgcgcctgcattcgcagcctgtaaggtctcacaatcagtaattgatgttgatgaaatcaaccctgaattaagtcacatgcagctgaaatctaatgatcgttcagccagtgccttcccagaggtcacttggttgtttccgattgtaaacagtgctgcagtaaacatctttgtgtctagagccccttccacaaggtagatcatacccctgggctatattctaagaagtgagatgatggggtgaagtgtgatgatttttaggttctgaacacgtatctccagatctctgctctccagaaggctggacacagacctccttggtctgcagatggttgttctgacagtgaggaagcctccatttggctgcacgttttggcggcctcctgggctctgacctgtctccactctcttcccaggcatcttcaacaaggacctgttgtctaccctgcacctccttgtggccctggccaagcgcttccagcccgacctctccctcccaaccaacgtccaggtggaggtcatcactatcgaggtagcagcctgggccccagggatttgtaagcagaagctgagcctcttgggcccccattgccgtaccctgcatgggtggagctggctggggcggggctgacccagggtgagtttcagggaaccctgagaaatagaatccagccaggatggccagggggtgctgtctggagctggggacgggctggtaagggtctagtggggctggcggaggcctgggggcatgaggaggtccacggctggccagctccacttgacctcagcagagggcatctggctggcagaggctgaggccaggggctgtcaggccatatccctgagccatgcgtggccgtccgttcattgccacggggagccttcacgccctgagcaaaaccaatgctctcaccatgagggtactgtctcctgtgagattaccgatggctgtgacagtgccctgttctctttctaggaaccttgccgggtttccccaccctcagatgttctgtctagcatgcggcctgcctgtgctgcggttaatacccaggaatccacgacttccctctccagacagactctgagcatcacaatagggggccccaccagctctttgcttctcatgaccgcccccaccccaccccagcctcgggtccctcatgcataggggctttgtgtgtgagggcttgcctctgactcgccccaagagaataagccaagtttggccacacccagtcagagtcatttctatttttttttttttttttttttttttttgagatggcgtcttgctctattgctcaggctggaatgcagtggtacaatcttggctcactgcaacttctgcctctccagctcaagtgatcctcccacctcagcctcccaagtagctgggactacagatttgagacactgtgcctggctaattttttgtatttttggcagagatggggtttcaccgtgttgcccaggctggtcttgaactcctgagctcaagccatccacctgtcttagtctcctaaagtgctgggattacaggcgtgagccaccacacccggctttctactgttttttaaaaccattgattataattccctaccaagcagttgtgtggcttggtctatactgccaacataaatcagaagtgacttcattgattcactccttcaccattcatttgttcatagtcacatgctcattgatactgccctcctcccactgtgagactctggggatgccttggggagtgaggcagacacatccccaacctcaagactcctggggaagaaagacaattaagccagaggctgtcctgaggagggatgatacagagcaaacggatcactggggcttctttgggccccagagttttctggattatttaatttcttccccctttatttttcttagagcaccaaaagtggtctgaagtcagagaagttggtggaacagctcactgaatacaggtgagggaaggatgagggcccatgggtggggctggggctcacagcggtggatgggggcagggtgggggccagggcagatctgcctgacctttgtgggaagggccctcacattctgtggctttctctcagacccgaaaatgctgcgctgacctctcaatcccacggcagcacacaggacccctttctagcctccaaccaggtccctgcctggcccctcccagccaccctgctttgttttctagggtgggggcccctgggtttggggtacagggcccagtgaatctgtctctctagtgtgagcaggatgttcctctttccttgcaaagctgtaagagttagaggcccctgcatggccaggggctggccgtcttgctgcctgcccactttagggtgtgactgtcttgttccccgcccactttgggggtgtggctgtcttactccccacccactggggggtgtggccatcctgctccctgcccactggggcatggccatcctgttccctgccctctggggagtggccatcctacctcctgcccactgggcatggccacctgctccccacctactggggttgaccatcctgctccctgcccactggggctggccatactgctccctgcccaccgggggtgtggccatcctgctccctgcccactggggctggccatactgttccccacccactagggctggccatcttgctccccgcccactgggagcatggctgtcctgctccccatggagcagaacaggtggggcctggagagggatgggcccaggggctgcacaggctgccaacaggtccaccgttgctggcttctgtgtggcgctaactcacgatctctcacagggatgcagccaagatgctggccaggtggggctgccatcctctgaaggcttggctggggctggagctgtgtggacagcacatggtgtctgtctctcctggcagccttggcctctgtgctgagcccaggtctctgtcacaggctgctgggctctgccccgtgggccccagctttcttctggagggctgtggttagagagacttggcctgccctggacctacagaacttctcttctatggggtagaggtggatctaaaaacgtgaccaaaaaaaaaagaagaagaaaaattgttcaaaaacaataaaaatggagtgaaagaagccagacccaaaagaggacacgcagtatggtttcatttccatgaacttccaggacaggcaaaaccaacagatggcaagagaaatcgcagctgtggtcagcgtagggagggagaggatggaagggagaacacggggggtgctgggaggttctgcagcatgtaagtgggggtgatcacacaggtgtgtatgtgtaaaacgcacaagctgtgagcttacgatttgtgcactttatgatgtgtgtgatgtatctccctcagaacagaacacgaacaacaaaaccagcaaagtccaaatgtttctaggtgtggaagcctcagggaagggcatgaacctgtttctgccctttgcttcccacaaagaccttctctgctatctgccctacctacaaagctgccaggaaaaccacaagcatgccagtttctttgcaaccttgccagcactgaggcttgtcatattgagaaattgtaggtttgcggggtgttttttttttaaccatttgtttgctttttccacccactgcacagcacagacaaggacgagcctccaagtgagtactttcatcatttttggaaatctgttcctatctgatgcgtgttaatgcagacaagtcttaatgcagggttaattgctgagcattctctcatttccctgtcacttgctgtttgtatctcaagcctcattcttattcatttgtccctctttctgtctgtccatccatggagctggctgctccttctcatgatactgttcctgtggggagagagatttataattcacatgggcagtgatggtggagtctgttaaatgtgtgggctctggagtcagtggcctgggttcaaacaccagtgttcccactcattagccacttaagtttgggcaagtatcttaacttgtccgtgcctcagtttcctcatctataaaagggcactcaccttttaaactggcagtgagggttaaaggagataatgtatgagtgtgttcagcatgtgggcagtgctcaatagtgagtgggcaataatgtggcttctgctcttctgacagagctgttcaccaatcagttgattgttctagttgttacttctttcatgcatccattcctttgtcactggtctggccagctcttccccttcccatccattaatctatttatccatctattgatccatcctttcttccattcatctatctacttacccacttatccacccacccacctatccatccatccattcatacacccatgcatccatcaacccattcttccattcatctatccacccacccatccatttatccatccctccatccatccattcatgcctccattcatccatccacctacccatccatcacctgtccatccatccatccacctatccatccatcaacctatccatccatccatccatccatccacccacccacctatccacgcattcatccatccatccatccctccatccatccattcatgcttccattcatccatccgcctacccatccatcatctatccatccatccatccatacacccacctatccatatattcatccatccatccatccatctatccatccatccacccacacacctatccatccatccattcatctatccacctacccacctattcatccacccattcatctatctacccatccaaccacctatgtattcacccatatccatccatcctaacactatttttcctccctataccctccccacttagacacatagctatgtgggcagggatgctatgaggggcaccttccctgcagaggtagagataataacctgccaggagcttctgagaatgggggctgaggaaggcggagtttggggagaaaggagaaaggaggggcaaggagggctggctgaggatctgtgtatgtagcaggaggggcagcctgaggacatgaggggttgcccagggagcagtattttgggcagggggcagcatgagaagtgggtgtcagagggtgaagaaaggacacagagcaggggcattttaacgtgcatgatgctatttggtgctacttttcccccttcactaacaagggaactgaaacagagagaggtgctgtgacttgcttagagtcacacagctgctgagtggcagaagccacagcaaactcaggccagtctgtgtatttggtgcccaaggaccagtgtccccatgggaggtatgttagctgcaaatagcaggaatccagctagtgcacaaagggcattagcctgaggacatgggcacccgaggctggaccccagggcctgagccgctgttcccagaccccaagggagtgactgagttgctgaagagctggccttttgcaggcagcaggttcagacactcttgggggcggggggaggcagcagggagcagtcctcactcagccaatttaaaaccaaggggaggagactcatggaccctgatcacccacctgtggcagctcccgtggccctggggagtggagtagggccctgggaggagggagtgccagctggcagataaagggatgcagctgtgcagatgtagtaacaggtgtcagctgcaggaagagtggctgtttatgaagtcctactgtgtgcccagtcactgtgccatggggccatgtgtgttatctgctatggaattccatctctgcaacaaccccagctagggaggcacagagagagacggtgactcccctggggccacacggccaggagagcagtgactcaaatccaggtctgttttatttgagaaccatgatgtaaaacgacagctccctctggactggttattctaagaaacttttgtgaaaaaaaaaattccctgtttggcacaaagataatagcatcgtaatgaggtgtttattggatctgtgtctgcagaggacgtctttgatgaattatttaagctggctccggagaaagtgaacgcagtgaaagaggtaggagagatcaaagctctcagcggctctcaggctgcccaccccacccactgcccacctgcgctgtaggagggaatcacgggtcctcccatcacacctgctgtgtgctaggcccttgttcttccctggttaggccatcgtgaactttgtcaaccagaagctggaccgcctgggcctgtctgtgcagaatctggacacccaggtagggactgagctgcggcgtccccaggcagggcagggccactggccgtaggaaggaaagagggttctgcaggccctgggaacctgctgtgtggtgggggttgcatcacctcttggagccttagggtccccctccccggtgggactgttgctggcaggcagcagtggtcaccagggacatggtgggatcccgggggtggaggtgtgggaacacttcacaaagctggagtcacctcggctgtcactgcttctcattgttataattttattttataattaatctcagactagctgatgccaagacttgaagcatatgagtcttccctgcgtggttgtgttcgcccaaacagaatttattagatttgtcccatgtgccaggcgtaggtgacagcgcagcccagccgtctgcaggctccatgtctctcacaagcaccctgaggagcccagcccctcccccggctgacttaagtcgaattttcccaggagcaggagcagaatctcagggggtcagcacccaccatgggctgtggctttccacagtgaagctgtgtccctgtaggcttcccacactgcaggggagcagggggtgcacagtagcagaccggctgccagcccggggcctgcagagtgggcatggagtctgctggatgccagtggcctgaatgggacatgacgtaggcatctggccacctgggttctgctgggtgctggggtctggggtggggagggagtctggtcccagatggaccagttggctcatgaagatcgtagccagagctgctgacctctcagagagactctggatgggcattggctggggagggaggggttaatgtactcccatgcctagtagctaaaaccaataaagccctcactatgtgccagtcccagggcaaaatgctttccatgttaactcattgaatcctctccataatcctctgaagtgggaactgtactaccccacttacagaggaggatgttaaggcacagagaggttaattaacttgtctaaagtcacacagtgataagtagtggacctgggatttgaacccaggcagctggggccagagttagtgcttataaccacctcacatggtggccacgtgagaagtttgtgtgtgatatggtgtggcagcatggcagggtggaagtatcacgctctgtagccagacagacacacatttccctcctgcctccaccacttatgggccctggggtctgctgagaaccctccacatttgctgtgtgaccttgggtgagttactggacttctctgaacctcaggctcttcttcttataaagtgggtacaagatagcaacttggtagaattgtgagtgatacatgagctggtgagccccacgtgtttggtatattacctggcacgctgccggcatgaaataagtgagagatttgtagttttattatattttatgtgggtataaacaggatgatttctgagatttacattctacctgttctatctgtatctctcccttggtaaaataatgggtttcagagactcatggcatgtgcaaaggtggtatttagagactgttcaataaaatggggtaaggaagtcccttgcatttcagttgtattaccaaggaatagcagcagaaaagatttcaggcccaaactaataacatcgaagcagacttaatatgaggaaattccattaagggcttcgaatggcagttccttccaatatcccatcctgtgttttgtatctttgaagagtctcaataggattatattaacatatgatatgctggtggcagggacgacagctttatctctgaacatacagacagaacagacagaaatattaatgtggcagccagcgagatgagcctggtgtgctgctctctgcctttctctgatggaataattttacacttaactctgttttcccctgtgtttctgtagcttgtggaagagcgtgctgtttaaaaactgatatgaggcttttctgcagtaagtttagaaagcactcttttcactgagcatgtactatataccaggcagcctgaaaccactttttacctgcaaccctgtgaggtcaggcatgtcttccccacttctcatcaaggcaccagaggctcagagaagttgtatgacttccttagggccacacagcctgtaaaagacagagtgggcttcgccaggcttcttccatgtgattgtctccagttccttcctttgtagtttgcagatggggtcatcttactcttgctgattggacaacttgaaggcttcttcctgcacttaaaggaattctacctcactcccaactctcctgcagaaatggtaagttttccaaggatttttctttatggtctacctctaggtgaacagatatacagaactggcatgaccagtctgtttattcacttccaggtgaagtgaagggtgtaggggaagcttatttgtctatatgtctgcctatccatccatccatccatccatccacctattcacctatccatccatctacccatccatccatctacccatccatccatccacccacccatccatccatccatccatccatccatccatccatccatccatcatctacctatctatccatccccatctacccattatctacctacctgaccgcctattagccctcctgttcacctaccaagccacccaccatctatgcacccatccatttaactgcctacctgtccatccacctaactgcctacctgtccatccacctacctgcctgtccatgcacctatcttcctgtctgtttattcatctacccagtccatccatccatccatccacccacctacctgcctgcctgtctacccacccataggaagtttatctatatgtctgtctgtccatccattcattcatccatccacttgcctaccggtccattcacctgcttgtcctgtcatgcatccatctgtttgtccttcaatccatcttcctgttctgtttattgatccacccaatttacccatacacttgcctgcccatccacccacctgctcatccacccatcccctacccacacgcctgttcccccattccctgagggcctgtttagtgccaggccctgaactgcatgggatgttaagttgatccaacatagctcttgctttcagggagctctcagtctgtgcccactgttctcctagtgacgtgtggtcttgcagggccacagtgaaacgtgttggttcagatgcctgggtcagaggaggggcctggaagaatgagggcttagaataatctcaaggagtcaggaagggcattgcatcagaggggagccgggaagttgatcagggattggtttgcagagttatcaaggaagggcttgcagaggggagggaatagcatcagcaaaggctcagaatgtggcaagaacaggaatgggtcagggaggtgtaggtgcttcactctggctagaggggctggaagggtggggcctgacctggggggatcagcagttcccacgtggaccctagaggctggtggactggctgggagctggctgcctgcttccaggcatgagggctgtggcttgacctggggaagagggatgaagagagtgatggaggtggggtgagagggcaggtgagcctgcaaagatgcagctcccaccgcctcttccccaggtacagccttcagtgcccgctggctagtcctgcctccgcccccgccaggcccctgtggtgtgtgccaccacttcctccagctccctgggctctcccatctctgggctttgccacaagctgttcccttcccaggagcacccttcctaccaggtaggcctggcccatgagaagggattttactactttccaaataaggaaagagaggtccacgggcagccaaggcttaccccgggtcactgccaggcaagaggcctgagtcttgtgctcttcgccaccagctccctgcctgcctggacctcaggttttctgtctctgaaaatgggctgacaatccctgccccctactcaggccacacaggtagtaagaaagagtttggagaaccatcgaggagaaagcattgagggacatgtggtccctagtatccccaggcttgcctctcacaggaggtgacattggaggcgtgcatcccaaaggacaggctggagtgttggtggctggtggcgtgcccaggatcccgggcagccagcttatctccatccatgccagggttcccgtggcctggggcaggaggacctctttatctctctgcagcagtagctttttctaaagaggtgaagcaggaggcagggccacatgccccgtcccagggccagcctctggggctgtttctgggagagacaaaggcttccatccctttcacatgctcagggcgtccttggccctggatcaggcctcttggcctatctggggcccagtagcaggtgaggtcccccctggacccctaccagactccccctccacctaggcccttcttctaggccgctccccttaaccttcctggacacccacccttgtgcctctcccctgcttcaagtggagcacccaactgccaagccccatctgcctccccgaccacgtcccctcctcccttcctgccgactcccagccacagccacagccacagccacatgacctctggcccccttccagctctccagggcctggtcctcccccattccctcacatccacgcaggctgtgctctcagcccagcctaccctggctttgcttcccacctgcttccctgggcgggcggccagctctgcccaccttctcagctcctctgcagtccctcggcgctctgtggggccctgtaccacagtccacactcccttggggttagctccctgcactttgcctctcctggccctctccccactcaccctccctccttgcccctgtgagagcggggcagggctgcatctccattttacagaggggagcccagggcccgagaggcttacccagtaccacccagctgctcaatggcagcctcacaccagcacagcctgccgcccgcagcctgccatgtccctcgcccccacggggatgcatcttgagtgggtgtggcctccaccttccctggaggccaggtgctctggacttggttcccaagagctgggatgttgggtcagagcaacgaggccggggcagtcagtgtctacggtcctggtggttgtggcaggcacggtgcctgctgcttcctaggttcttccattcggaggagctgcatcagccagccattgccacaaacgtgctgcttaacaaaccacccgaaaacctaggggctgaaaaccatgctcatttcttcccacagaccggcaggtcggctgagtttagctgctagaggctcagctaggctttgtcactcctccgaggactggatagggatcaggctgtcgtggctgggtggctcggctctgtgccacagcctgccatgttccttctgggaccagcagctggcccgggcacgctttcctcctggcaatggcagacacatgagagaccaggcagaaggcatgaggccctggctcagaatgggcaggctgccacttccatcgaagcaggccctgtggccttgacagtgacatgggacagccctgcaaagtgtgtgggtgcagaattgggccgatggtgggatctcccacgggcagtgtggacgaatgtgctagcaaatcctcatgttgggtcttggagttaggaactcttcccatccccacttccacagaggaaacagttgagagaggcacagaagtctggcccagagcacacagtgagttagggtcctccctgtttccctcctgtggagccaatgtgagtctctgggagatggaggggtggcagggctcagtggggttgaagccaaggctgagactggggtcagagcctgcctcgggaaggcaaggcactgaaatgtgagcggtgaggagagaaggcggaggaagggggcaggcaggaccacctgcgggctgagggcctggggctcggaacccagctcagagccactctggggtgcccctgggctgcagggcctctgctcaatctgttgcaccatccaagccccagttacaagacgggaacaaacgtgcagacttccatgttgctgtgtgcagccgctttgctgaatccactgattttagaacttacttctgaatatgagtcagattagatgtgggggaaaagcagcagcctcttagctcagactccaagaatgaatttttacagcatattgtgggcaatctctgctgcaggaatgtgtaatcaaaatgctgaagaggtcgtcagctgaggagggcgggaacaccagcccttgctgaaggtgggcctctgcggaattgttatcttggcagagtagcctcttgaaattggatttctcattatcagaccctctttgctgatggtgtttatgtgagatagttattcattgtgggcacggaagttaaggatggagggagagaggatcattcgctcccagaaataaaatccccggagccaggaatccttggcgtccttccacgttaaattactttccccaggaggatttgcacgtatcctcccgggttgtaaccttctctcagctccgtggaaggtggtagttttatcttcatctcaagccacacgcggaagaaaaatctctggacagagcatcatgagatagctctggagccagggtcagctcttactgggggatgatcttttgttcagattgagtgtcattgaggaagagtgtgacaaacagaagcagatgtcataattttcagtgtcgatagcaattcccaaagcataagctctatgagggcaggaggtctggtctgttttgagcactggttgtatggctagcacatagtagatgacaagtatttttttaaataagtgaatgaacgaagtgtttccaaaacattggtcccaggaggtgttctgtgacaaatgggttctatgaataaataacttggggaaacatgtctagtcttgaaggttcatgcggcccaccaacacattcaaggctctaataagtcctgcagtgaaggacttccatagtattttatttaatccaacaatttctaaaaacgtttggccacagatatcccctttcctgtccatcttagatcacagtttgggagatgctggctcgctgaatgtatcaaaggcggagctttgaggcaggagagcacagtgcggagtctggaacctcaggttcctcagggtcttgttctcactccgacatttactctccatgtaactgcaaataatattcgtgatgagaatgcgaacaatagcaacaattgcaaccctagtttcccagaatattccagtctaggaggaagaactggggacacagtgatgggaacttccggtgatgctctggtctgtccactcggagcttcccatccatcttggtctggacagtctcagagtttcaccccgcattggcccctgcagcatgctgcaacattggtgccgtgtgatagcctttgtttcgctcttgtcacccaggatggagtgcagtggtgcaatcttggctcactgcaacctccgcctcctgggttcaagcaattctcctgcctcagcctcccaagtagctgggattacaggcacgtgccaccacacccagctaatttttgtatttttagtagagacagggtttcaccatgttggccaggctggtctcgaactcctgacctcaggtgatctgcccactttggcctctcaaagtgctgggattacaggaatgagccaccgtgcctagcctgtttcttcttgttggctgactacagaggagcggccctgctgctgctgctgggcaccctgcccatacactcctttccatctgggacccgccctccatcttcatgtccccacgtggagaaggactctgctcacccacttccagctcctatgccttcatcatcctcaccttcaaatcttgctttgtggcttcaattctgtgtccgtcatcacattggacgcacatggcagccttggagaggaaggcagacaggtgtatcatccccgtgacacagatgaggcacctgaggcccagccaggatgtgtgacttgtccgaggtcagacacttagtggcagggatgggggtggcagtacacagacatccaagctagatcccaagagtcctcttgctcgggccatccagcaggtggctggaggtggcctgggccaggctggcgtttctggatgagtcttgcctggccttgctcatccaccgctcggccaacctggcctcttggcccctggcgggttgccatgggaactgccctgtcctggtggggctggtgtggccaggcagatagggagggaacgggaccagcacagctgacccccgggctgggatgtccaccccgtctagtggatctacgggtggctaagacattgaagggaggacctgtttgaggtcacagtgaaccaggagttcatccctcttcacccacaccaggctgctgccctaaggcaaagggctgggacctactctgcttgtagacgaggcccaagggagaagctagaatggaaagggaggggacctactgtgggagggccggcaggctcctgggctctcaccatatcctgtagcaaggcacaggggaactgtggtgagcccactttgcaggggagcaaggggaggccctgggcagggactaagctgagctctgaatcactgggggacttgactgatgcccgggcgctctccaccctaaagggagccatctctgagactgcaccccaggcaaggggtggcggaaaggacagccacctgggtggggaccgctccagtctctagcctgctttgcatgagcattggagcggacagacctggtttgagcgctttctgtctcgtgagctccagtgagccccttggctcctctgagccttgatttcctcactgtgctttgccctgggaaacagctgttctcaaaggtgctctgccaccccaggcccttgctcctttccctgggtagttctccctgcctggcgggactcaccaccaggcttcacctccaccaggaagccttccctgatccctattgggtatcctccttggcgattgcctttttcacgggcagtggcccctggacgcaagcgtgtgcccagtgtggtatagcacctgctcagagtggggcctgtgagtggctgaggaatgagacatggattgcttgtgtgacagagtgagctgtagggagatgctggatgaccacggattgtggtcgtggtcagggatgcccaccttggatgggagtttaggctcatgatggacatcacagacaacaggaagggcttggcacttgggacccaaggcctggcctggggctgctgcttgtgcccacatctgatagggccttgtcatcatagctgcacaacgtcaccctggcgctggagctgctgaaggacgagggcctgctcagctgccctgtcagccctgaaggtgagtgcaaggcagatgcccacacggtggccagccctgggtggcagccttgtgcgagagccacagaacagggtgcagggcattgggggatgagcacgcattggcagagtcctcttgcctggcaggggtggagaatgggcgcttgccaaggtttcttgggagggggcactgcagccccaggggaagaggttctggggagggggagaccaaggtctctggggacaggttgtccagagaagccagaccttgaggagttgctgtgttgggggcaccacaggagcattcagaggaggactggccaggaggaggaggcagtcacgcagcaggcgcgggacccaggcctggagtgaccagctgtcctggcttccagggattctcctgggattagcactgaaatcctgaatgccaggaaaccttgaccacatcgggacagtcggtcactgccacccaggcctgactggctgccctgccctcctttggcccgcagatatcgtgaacaaggatgccaagagcacactgagggtgctctatggtctgttctgcaagcacacgcagaaggcacacagggacaggacgccccatggagccccgaattgaccctcactgcctccaaagcccagagcctgcctgtcagcccagctggagggcccgaggctgcagggtgtcctcccacagtcccgctgtttcctgtgcattcgtgacccgcttccctcccaccctgtctcctgtctccatcgttggattatctttgaacccccttgtgtggatcattttgagccgcctggccttgctcagtttattttaataaaagtatttctgggagggattctgggaacttgacagggtcctgaggagggcccttaaacctgcagcctccctcccatggggtgagtgtgtgtcacatcagtctctcatctctgggcccaggctagtgaccgcccagagaggtggcatcactcagggctggggactctcagggacagggcccacagccccagaccccaccttttccagcccagctccccacacccacctgcttctcactcgggaggatgggccccagagtcaccctccagggcaggagcccgaatggctccatagccatgcccccacccaccgggagaagtggattcagtgactgtcaaagcaacccgggctgtgtcctgcagctgccctcgtgagttttgcccaaaagtcacaaagaagcaatcttcgtggttgattagtgggttcaggtcatctccagtctgtcctcgggagctgtgggttcccactcgctccagtgagacttggcattttctgcacataaagaagagtcgtgtgggagaattgcacatagtcagtccagggcatccagagtggggcagagctgatggctgatgggaaccggggaggaggctggcggggaggggtgagattggtggggagggctggggctggccgggaggggtgggactgatggggaggggtgaggctggcggggaggggtgaggctggcggggaggggtgggactggtggggaggagtgaggctagtgggcgggtgaggctggcggggaggggagggtttgtggggacgggtgaggctggcggggaggggtgaggctggtggggagggctggggcctggtggggaggagtgggacttgtggggaggagtgggacttgtggggaggggtgaggctggggagaagggcaaccacagccccaggctgctgctcctccctggaccctgaagaggcctctgggtctggggttttcacagtttgacagctgaggccttggggaggggctttagatgggggttaggggctaggtcatcattgacacccactgggggcgcctaggcagatgtccttcgggggagcaagatgggagccagggacgcagtgccaggtcagccctgggagctggtgtctgggtgtgagaaggccttgaggggtcttcccttcacctagcctcccatctgcctgcccttctcagctcccaattcacagggcaaacccaagcccataagcgtgttccacgtgagcactcagatgcacccctcttcatggatacccaccctacttcccggctgcctctgggaaacgtgcatcctcccacaccaggtacctggagcccagctccttccacctgctcaggtgccccctccattgcgatgccccctccagcacctcaaatcctctcctggagcttctggggacacaggctcagcctctctcagctggcttcatcccaaaagcctgaaatccagccccacttcctggggcctttgagtcctcacttgcttgggccccatccgctgcaggctggctctgcctggctgttccacgtcctcactcttgttctatttgacagcaattaaaaaaaaagtgacttatttaattactgtagctttattgaaaaataacttcccagtttgaagtgtacaatttgatgagttttgacaaatgcatgcagtcatataaccaccaccatcgttatccagacatgggacattcccatcaccatgcaagtttctgcatctgtctgcagccagttcccttctcccagcccctggccctggggaccactgatctgttttctgtcaccatcatttagacttgtctagaatttcttataaactgtatcctatggtatgttgctttttgtgtctgatttctttcacttagcataatgctattgagagtatctccattgtttcttgtatcaacaactcatgtccttagtacattcaaaaataagtcctccaattttgttcttcatttcaaaaattattttggtttttctaggtctttttaattcttttggtttctacataaaatttagaatcagtttgtcattttctgcaaaaaagcctgctgaaattttgactggaattgtgttctttagatcaaactggggaaaactgacatcttaaaaatattggggagctaagatcactgatttgagaatatttttcttttatataaatatttaatgctggatttttttttctaagcacagctttagctgcatcccacagatactaatatgttgtgttttcaccttcatgaagttcaaaatatcttctagtttcaaatgtgacttcctctttcactcatgggttatttagaagtgtataatttccaaatattttgggattttttttccagctatcttttggcattgggttttgttgtggtcagagaacatgctttgtatgatttaaatcacttaaaatgcattatgacttgttttatgtactggattatggtctatcttggtaaatattctgtatgcacttgaaaaagaatgtgtgctctgctgttgttggacaaaatgtttcataaatgtcaattaggtcaagtgggttgattatgttgttcagatcttctatatccttgctaattttctctctactacttctgtcaattaccaagacagaagtgttaaaatcttcaactgtaactgtacatttcactatttcccctttcagttctatcaatttttgtttcatacctcatataagattataatgtccttttgtctcatttatcccttgtaatatctcttactctgaaatctgctttgtctgatattaatatagccactcaaactttctgttagtattagcatggtatatgtttttctatatttttaaactgcgtctgtttaaagtaggtttcttatagacacaaataattgtgtctttttgtacaatctggaaacctctgccttttaattagagggtttagtccacttacattttttattgtggcaaaatatacatagcacaaaattaaccgttttagccattttaagtgtacaattcagtggcattaagtacattcatactgttgtgcaaccatcacctccatccatctccagaactttttcatcgacccaaactgagactctgcacccaggaaatactaactctccattctcccctccctcaggccatggtaaccactatttctcccctccctcagaccacggtaaccactattctacttgctgtctctgtgaatttgactattctaggtacctctagtccatttacatttaatggaattattaatgccatcttgctgtttgccttgttcatatgtttttcttattccttttggattgaagactttttagcgatgtgaatttatttccattattggcttaccaactgtatttcgttattttcatttcctaggggttgctctagactttatatacacatctgcattcatatcctgtcattgctgtaacaaattaccacaaacttcttggcttaaaacagcagaaatttattctcccacaattctggaggctagatgtctgaaattaaggtgttggaagggtcacgttccctctggaggttctagagggaaagctgtatcttgactcttcaagctcctggtggctaccagcatctctgggcttgtggatgcatcactttaatatctaccttcacagtcactttgcttctttctcctttctctgtctatccctcctctgtgtctctcttataagggcgcttgtcatgagatttaggacccacctagataatccacgattatgtaatctcaagatccttaatttaattatatctgcaaaaacttttttccatgattatctaatctcaagatccttaatttaattgtatctgcaaaaacctttttcccaaagaagttaacattcacaggttctggggattagcatgtggacaaatccttttggtcaccatttaatctactataacatcttaacttattacagtctacctttaagtaatattacttccattttactcttctgtgtcctattgttgtcatgtgtctcatttctatagaataaatttcacaatatattatttttgcttaaaaatgtcaattgtcttcttttgagacagggtctcactctgtcacccagactgcagtgctcactgcagcctcgacctcccgggctcaattgatcctcccacctcagccttctcagttgctggggctacaggcatgcaccaccacacttggctaacttttttagaattttttttttttttttttttgtagagatgaggtctccttatgttgtccaggctggtttccagctcctggcctcaagtgatccacttgccttggcctcccagtatgctaggattacaggcatgagtcacagtgtccagccacatcgattgccttttaaagagttttttttttttaattgagaagaaagtcttttatatttacccacatacttattactcctggtgctcatcgtttcttcttccatttggtatcattttcttcctgcctaaaagactttctttatcattttgtgtagtgttggttatatgttagtgagcttgtgtacctacagaaatagattcagtattggtccttcccactccaaacagctttcctggcgatgccttctgcttctaaaattcctgtccctcctccctaagggtcactctccaatctccactgcagctctagccctgagctccagacccacatttctttcttttttcttttctttttttttttgtgtgtggtaaaatacacataacacaaaatgtaccatcttactatttttaagtgtattcagcagtattaagtacattcctattattgtgcaactgtcaccaccctccaaccacaaaactctttgcatcttgcaaaactgaaactctgtatccattaaacaataactacccccatcttcctcccctagcccctagcccctaacaaccactattctactttctgacctaatctatattttgaacttcccagggcatagctgtgcctggggtgcccaccccaagctcaccacatccaagtcagagcttgccccgttccctaatcttcactctggaactttccagctggcctccctttcgcaagaaagggacttctttcttgtgacttcacttctgcaccagcagccagagtgcttttgtcctcggaacccagtctcactaccatcctgctctaaccttcccaggccccaacctccgggcagcgtctggactctgggtgctctggtgctgctggctttgtggtcctcctgctcactgtgttctgtctccgtccctgcctcaacctttccacactgcttccagttatatccctgacatctctgcgatctttccaagtctttctgatgctgttccctctgcccaagatgccctcatcccacctgccccaggaacttgtcattcagaaaaggagtggggacattctttgagaagagagtggggaagagggttcaccgtgggacaaggtggatgcctgggggccctgggtgcctgggggtgggtggaagaagtggttcccacaaagaagtctgagacgaagcaggatcagggagccctttcctccccttatttcactatccatggccttcgctctttttctctcttcctccatcccaagaaatctgactccagtagaagttgcagccgaagttggaagcaggataattatagcaagctgaacaggaaggcgtccagggccagagaaggagctggcagcttgggctgggtgtgcaaacagcttcgaagcgaagggaaatgcctcgaaggctggggtgcctcggagttgagctgcttcccaaaataatccagagggcagctgtcttggagtctgaaactgggtctggccgcctgagctgcaggaagccccaggactcacaccagctccactctgggaacagatggaactaagatttttttttttctttttaccaaagtcagctggtaagcgaacagcttgtctagagaaaagtgtgttcctgcccccatatcttctggcaatggatcaaagctgccagtgccatcccaacccccatccctgccccaccagccttctttccttgtaagacttgggcagtggtgagcagaggggcatcatggacctagagacacatgggatccccaccccctgggggtgtagcccagggagtgtcctgggcccctaggtcaatgggggactgggctgaggggcctggctggtaagaaagtagatgatgaagatgttccagaaatgattcttccaagaagagtcagccaatggacctgggctggccaacaattgcatgaattcatttatttatccacaagcatttcatatgggttggtttattattacctagaaaggtgatgcattaatacctaggtgggtttttacaaaggtacaaaatcatagtgcacacaccattcataagagaacttctccacctactgtgtgcaggcccagggcacagagctgggtataaagagagtgctcagaccgaggctctatcccagaggaggtgtagcccagggtggaaggggctgggtagtgcagtggttagagtgtgatgcttgagtcagaccctggggtgtgaatcctgggcaaatcctcacctcactctgtgaccccaggcaaatcacttacctccctaagcctcagtttccttctatgtcaaatggaggcaataaggaatctattcttcacagggctatttaaaaagttgagtatctggagagcttgaagcttgctggacacataacattcaataaatgtcagatgacatcatgggtgtcatcatcaccatcaccaccactgtcaccatcatcactatcacatcatcatcacctccatcattatcaccatcatcaccaccactgtcaccatcatcaccatcacggcatcatcatcaccattatcatcctcatcacctccactgtcaccatcatcaccatcacatcatcatcacctccatcattatcaccatcatcacctccactgtcaccatcatcaccatcacatcatcatcatcaccatcatcctcatcgtcacctccactgtcaccatcatcaccatgacatcatcaccaccatcatcatcaacatcaccatcatcaccaccactgtcaccatcatcaccatcacatcatcatcacctccatcatcatcatcatcacctccacatcatcaacatcaccatcatcaccaccactgtcaccatcatcatcatcagatcgtcatcaccatcattatgaccatcatcaccaccatcacaccactgtcaccatcatcaccatcactgttactatcatcaccatcacatcatcatcactatcatcaccatcatcactaccatcatcattgtcaccatcaccatcattgtcaccatcatcaccactgctgtcactatcatcaccatcacatcatcatcatcatcatcattatcatcatcatcactacaggcacaaaaacagtgctggaagtccctcctccataggtcctagtgaggatgcagtgacatgaggtacgtgaggttagaggcctggcacgcctttggcactcagagttaggcactaaaaggccagctcatcaggtgagtcctacctggattttgtgtccctgcttctaggctttgcttgttggagacccacagcagcacctagccctgggtaaatacttgtggactgacccactaacgtgacctcttaactctcctgggtgagtcagatccagacctgctgcttcaacttgcagcccacccagctggccaccccagcatcccaggatgccagcattcaagcggggcttagctctgacttgaacccatcttcttggcccctgtgctgggccagtaggctcaccagctcagctgaaaacacagggacaaatggaggacctctggctccatgatccctctcctttacccggttgtctggagtaagaggcaggagtgtgatatgggaagtcctggctccagtcttactgggccccttagcagctgtgtagtcttggacaggtcactacccctttttgaacctgagtttcctcatctgtaaaatggaatgatcctgcctgcttagttcaacccccacgatggtaatccatcttaaggatgaactgcaataatggtgggcagggttttgaaaagtcctatcagctaaacaatggccaaggctagcactgactgggatctccacctttcttcagcagccatggcccagatggcctggccacctaccaagcccatctgctcttcctgctgggcacgcagctggactgcatgccccaccttctttgcaacccaacgtggtcaataataaaatgtgaatcaagtaaaacacaacattgctgagcctggtcctcaaacccagtcccctgcatgacctgatactcctgtactccccgatgctctggtgatgctgactagcctggtgagattgcaagccgtgtgctgagatgctggagccacagacggagtcaccctgggaggagagctgcctgccagtcaggaacactcgttttgaacagtatatgagcaagaaatatttgaactcctactcatttggtgtgtgttacagtagcggtggaacaaacactatagcacttgactaaaacagctgcatcaactctatttaatcattcattttatttcaattagatatttttttttcatttctagaagttttatttgcttctttttcaaaatatcttggcctttgtatagtctgttgttctttattcatattattcgtatttttgaacccttcctctaattctttctatggattatctttattttctgttctgtgtctgatgacgctaacatccaaacctttgcagtttcactgtgctgtctgttgtttaccttgacgcttgctcatggtgctttttcccttgtgggtctttgtgggttttgattgtggtcctttcaacttaattgtggagaattcttcaaggcctaggttgaaaatgggaacctccagagattattcacatctgcttctgccggatgtgtagggtcactccaatttggctcttttatgtgaaaatcctagtctaaggatttggggtccacacagctagtgtacaacccatattatggctgtggttatgagccctggctaagcccatctggcttatggttatgactctttaggggaggtttttattcattttttactcatgtccaagattgatatagacaagtgtccttgctttccctttcttcagccccacttccccatcttattccaatagtgaaagcatagtcctttgggggataccagctttatgtggggtttcctgatttttttttttttttgagacagagtctcacactgtcgcccaggctggagtgcagtggcgttatctcggctcactgcaacttccacctcctgggttcaagcgattttcctgcctcagcctcccgagtagctgggactacaggcgcctgccaccacgcccagctaatttttgtattttagtagagatgggtttcaccaagttggtcaggctgcactcgaactcctgatctcaagtgatctgcctaccttggcctcccaaagtgctgggattacaggcgtgagccactgcaccctgccaggtttcctgatttcctttgatgggtgggccctggctttcctcccatcctcagggccaaatgcggtcatcacaaaggaagatcagataaccaggcatggctgaggtcccccaggcaaagtcagctttggcaactgctcacctcttgggatttcactttcacttgaagttctccggtttgtattttccttgttcttgcttgctcagtgtggcacattttaacacatacattatagatctctatgtatatatgcacatataaaatacattcatatacatacatacatatacattatattttccgttactttgcagtgggactcttgttcagtgattaagtctgccatactgtggaaaatagaagcattctctggtagcacatagtagatttttaataagcagcaaaaagtatctttaaaatcctccctctccatctcgagtccccacatggaggca

SEQ ID NO: 338 - DNA, 320472 bp, Homo sapiens
tagaagtttagatgaaataatccaaagacacgggattctgatttttcaggtgatctgttaatccctgaagtgcatctggaggttagcccatcggttctgcaaatcttcataatttccatagttactgtagtaaccatggttagtatctttcctttgtccagcaggtgggaatttcggtcttttactgctctctgtcagctgtcatgacatgccacatgagttgagtttattcacaggttttccatgtgacccaaagtacattttgtaggttaatttcttggaattcttaccttttgttgggcggtttcctcattcagtcagaatctgcttacatctccacagacacttcaatctttcttatatacctgctcattgacaagcctacatttgccaatatctggttattctattcataaaacaggtttttcatttcactcttacatttgccatgacagtcatgattgatcaactaattccttgcctgtgtactcacagtcatgtgatcagtcactctttatcaaacatctaagtgccaggttcattgctcagtactgtacatatattatctctaattttctcagcaaaacagtataataagtgctgtttcctccatatacagattaaaaaatagtttcagaaagcttaagttatttgcccaaagccacacagcaaataaataatgaagtctagattaaaatacaggtgagcctgagtctaaactggtttcgtcacactctcctattactatttggcaatttgcatcattacaatcacaattttgcatttgcacaacaacattattgatccctcctagatgttataagcattgatttcagattatgttatgtccatactttttatttgaaaaagaaatggcaacaaattaacccatgttccagtaaggtctctttagattgcaagaaagagaaactcacttaaagtagcttaaataaaaaataagtgaaaatgttcagggacaagaaacccacctgggccccatggggaccaaggcaaggaacatggaggatgggagccatgagccagaaacatctcccagggccacagtgtctgtctccaacttgttctctggttgagccttcctgactcacagctacacagcacaccagcctcctctggttagaagaacactcccaactgcaagaaacagcctttttgtgtccaagtggaaagggccccactgtgaaaagcctccttttccacagcccacccaaacctgctgaagagaccacagtccctaatgagaagaagtgagacacagaagtgttttaacttttagcagactcgatccttgcttcattaaaatattataaaacccagcaccagagagctatggaggaatatctggtcctgtggtccttcacccctgggtctaaatatctgcatttgattcttgctggggttctcccacaaaaccatgacttttcaagcaggagaattctggcccaagtttcaagatattgttgtaaaattaatgtcttattgccttctttctcaatagttgatggcccccaactggttatcttgaccttagatttgtataatgaatcagaagtttgtgaaagagagatgcttaggcagctgaaatgttcatgaaactatacttgttatgctttcagatctacaggttccaagcatatcctcctaaatgttgtagccctcacaactggtcattctagaacacttctgcttaattgttttgaacatagccgagtgtgaccacctggccaactgtacacaactcttcaggtctgaaacctggcatcagtcaaatttccctctgtgttttctaatccaattatgggaagaccaagcctggtccttccttgcgtctgtctccatccctagtcaattacctgtgtctatgggcatgtttaacaaaatcccttaaaacgctgtttgttagaagccatgcaaacttgaatatttaattcagtcaacaatcattcattcatacataaaatgagcatttactcaaggtatattaatctcaacaaaaaaattacatagacctggaccctgccatgaaatcctgtggacttatgcaaggcgggaagtgacatggggtcatggaacaaacacatgtttggtagtacaaaaaagtgaactgggagaattatgtacaataagtgcatgtcagtgttaacactgaatctagaagcagacttgaaggggtccaatgtaaaaactcctttttcttttttttaatttgtaatatttatggagtaaatgagaaatttggttacatgtatatagtgcatagtggaaattttgttttcaagcatagtagttggttccatttctatgttacgagaccaccaagatgcatatttgaatagtgtattgctgttcccagtatcaatatgtcaaatgcctaactgcagagatgagtatctggtatcacagatgaaacaggctgctatagataaatgatgtttatatcaatttttcattaaaagaagtctaaacacatgaggataaagacatctcaaaaatgtctcatacacttctctgccttctaaaacatgacacattaaatatttgaaaactgagagtcaatgtgcaaaaaattgtaccttgctaaattaaaatgatgacctcaagggaaataaagaatttgctccttcactgggtttgttgttactattgttctttttaaaatggtttctatgcctttccttttgttgggagttgtaactttcttgctgctttcattgtctttatgcagttactagatttgcctctttccacttacaactggctgcttctaatctgctaagggtggaaattaggtcatagggactgttacaaacatgagtaaagtgagggataaaagactcagaattaggaactctgtgttctcttgtaaattaaaggcaggagatttagataataaacattctcatatctactgtggatattcaaaatgccttttgtatgctcattacaagtttccaactgtgttccagctagaaggtgtgaggtacgtgatagctgtactactaaggatttgccatgaagtacagtgatctataaaagaatattccagacaagcagttccttacatccacctccatgcctgaagaagggatgttagtccatagctcttagagctgcagccttgtggagaggacagtgcgggcagtgagggggatcccttcccattgcaagggggctctgttcctcctgccccaaggcaaggcagcggtgtgagcttctctcaagattcagggagatggcatcgcatgcctgagttgcagtctggtcgtgcagcagatctgtcacttacttactagagctgggaaagaacagaattggagagagatgagaggacagaagggcagtctccctcccactggttgctgtgtcagcaagaagcagatttcctatcagtcaagtggacagtaaagaaagtaactggtctacaagaaggctgccgcctgcagtgtacagctaccagtggcaagatctgagcaggtacagagaaactgagctgggcagggagccctgtgtgaaggacaacacagcaggggagacgtagaccatgtggtggacaacaagggccagtcagtactagcagcagaagtattttttcttgaacacgcactgatttttttattcagatcttcaaaccctttgtttttaaataagaaacaaatccacatggttttaaatttaaaagtttataaagggaatagtatgaaaaataagccctgccttctaccccatccccaaccatccagttccccaagccccctctcaataggcaaatactgtcactaacttcttgtgcatcttttcagaaatattcaaaacatcctcaagcatatgcataatataagtaagtatgtggatatgggggagtctgtattttttaccagtggtagcatacttcacacatgtttagtactttgcattttttcatttaaagcaacatcttgtcaacctttatgtatcagaaatgacataatatcccattttatgggtatgccataatttatttaatcagctctccattgatgggtatttgggtcatttccagtcttgaattatgacaaacaatgctgccatgtataaccttgacgtgataggctgaaaaatgatcccccaaagataatagtcccgatccctggatcctatgaatgttactggatatgacaaagattttgcagttgtgattaaattaaggttcttgaggtgaggcaattactctatattacccaggttggccctatgcaatcacatgtatccttataagagagagacagaggggaatacatggaagaagaagatgtgggagcagagtgagaagagatttgaagatgctattgcctcaagaccacagatgccagaaacccccagaagtgggaagaggcaaggcacagattctcccctagagtctccagatgacgtgtggccatgctgacaccttggttttgacccagtgatgctaatttcagacttccatttcattccatttcattcaaatatccatttgcatccattgccatttgtctgttgtggttttgatactttgtctaatcaatttacaggaatggtcatgtgttcaggtaactaactctttgcatcttagttgcaatttgttttttgtttgtttggtgtctttttttttttgagacgaagcttccctctcatttcccaagctggaatgcagtggcatgatctcggctcaccacaacatccacctcccgggttcaagagattcacctgcctcagcctctcaagtatctgagattacaggtgtccacgacaacgccagcgaactttttgtatttttagtagaaatggggtttcaccatgttggccaggctggtctcgaactcctgaccacaggtgatccacccacctcggcctcccaaagtgctgggattacaggacaatttgtttttatttatcatttggcttttgactttgcttgtcataatttttaccacacaagattttaaaatttttatgtagttaaattaatacttcatagctgctagctgtggggtcatgatttgaaagtcttccctacatcaagattttaagtattttttcctaattattcatgttttcagttttcatatttaaacctttgatgctttgaaaattcattttggtgtaagatgtaagaggtgaattaaatgtaattgtttttccactcatctatcctggtatcctaatactattcaaaatgattcatctttttaacctttttatgtatgaaatgtgtatatgtatttggatctatttctagactttctctttggccaaagggatctttctgtctacacgttttcaaataataaaataaatcatgctgtaaaacgtgaattctgagttcctgtgtgctactctcacagaaaggaaacaaaagaactagtgaacactgactctgcagctgatcatctgagaaaccatgtcgggatccatcaaggcagtgggggacacagcagagaggagccacgccgggcagcagcttgtatgagctcagcacagagtgaggagaatttctccgaatgagtgagtgagtgagtgactgagtgagtgagtgagtgaatgagtgcccctgggggatgcgtgctctccacggggactagtgcaagactgggaatgggagaatcccctggcccttccacagcccccaccaccacacggcttctagactgaggcagagagccacctagacattgtgcgggggtaactctcaagacaaaaagggacctctacaagccttgggccccacagcagaccagcaccagcaccaagccccaatagaggtcacagtcatggtacccgggagcagtagggttgctctaccacccctcactgaacagggcttactgccaggcttctggtccagcaatcctgcttctgcctgaactcagccagcagctgcagcttcctgctgtcctgggaagtatccggatgtcaaagcaggtgactccacccacccctgtcactgacagccagacaggcaatgcctgctagcgttgctggtccaaccgtcccacttctacctgaactcaactggcaggcacagcctctgttgtcctggaaaacacctagacagcaggaaagaccaccacacccaccctcagcactggcagccaggagcacaatgcctgctagagcttccagcccagcagtcctctttcttcctgagtttgctaagggatgtagcctcctgttgccccagaaacaccaggatggcagggcaggtaaccccacccaccccacctctcttagccagataggcaacacctactagagccttaagcccaggggtcccacttctgcctgaactctgcagcaggtgcaaccccatgttcccttgggaagcattcagacagtagattaggaccaacctggctaggatacagcctgtctgccaactacactccttgcctgaggaagccttgtggcccagaacacccaacaaaagaaacatgggcacagagacagtaattgaatggggcaccttcaagacccaggagcagactagaataaaagccagttgagtgaacccaccttataccacaatcaaatccccaaggacatccaaaacaataaaagcaaaaaaacaatccaaaagacagcaacttcaaagactgaaggaacatcagcccacacagatgagaaagaaccagtgcaagaagtcaaggaattcaaaaagccagagagtcttcttatttccaaacaaccacacttgttcccagcaatggtccttaaccaagctgaaatgttagaaacagaattcagattatggataggaataaagatcattaacattcaggagaaagttgaaacccaatccaaggaatctaaggggtacaataaaatgacacaagagataaaagataaaatggccattttaagaaagaaccagattaaaccaagagagctgaaaaattaactgagagttgaaaaattcactttaagagtttcataatacattgcaagtattaacagcaaaactggtgaagctgaggaaataatctcagagcttgaagactggtctccaaaataactaagtcagaaaaaataaaataaaataataaagaagaatgaacaaaacctctgagaaatatgggattatgtgaaaagaccaaatttatgactcactggtgttattgagagggagagaaagcaagcaacttggaaagcatatttgaagatattatacatgaaaatttccccaatctcactagagaggccaacatttaaattcaggaaatgcaaataacccctgtaagatactacacaagacgaccatccccaagacaaatagtcctcagatcctccaaggtcaaaatgaaagaaaaattgttaaaggcagctagagagaagggtttggtcacctataaaaggaatcttatcaggctaacagcagatctttcagcagaaactctacaagctggaagaaatttggggcctatactcagtatttgtaaggaaaagaaattccaaccaagaatttcatatctagacaaactaagcttcataaggaaagagtaataaaattctttttagaaaagcaaatgctaagagaatttgttaccacctgactgccttacaagaagtccttaagggagtgctgaatgtggaaaggaatgattgataccagtaactgcaaaaacatacttaaatacatatagcattgacaccataaacacacacacacacacacacacaataaaatcatccaaataaccagctaagaacatgaagacaggatcaaacccacacatatcaatattaaccttgaacataaatgggctaaattcccccaattaaaaggcaagtttgataaagaagcaagacccaactgtatgctctctagaagagactcgtctcacacatatggatatgaatgatatccataggttcaaagtaaagagatggagaaaaatctaccaagtaaatggaaatcaaaaagaagcagggttttctcttctaatttcagacaaaacagactttaagccaataagattgataaagacaaagaagggcattacataatggtaaagagttcaattcaataagaagatctaactatcctaaatatatatccacccaacactacagcacccagattcagaaagcaaattcttaagagacctacaaagagacttagataaccacataataatagtgagagacttcagcactcaactgataatacgaggcagatcatcaaggcagaaaactgatgaagatattcaggacatgagctcaacattttaccaaatgagcccaacagatatctacagaattctccaccccaaaacaaaagaatatacattcttctcatctgcacatggcacatactataaaatagaccacacaatcggccataaaacaatcctcagcaaactccaaaaaactaaaatcataccaaactcactctcagaccacagtacaacacaaatagaaatcaataccaagaaaatcactcaaaaccatacaagtaaataaaaattaaacaacctgctcctgaatgacttttgggtaagcaataaaattaaggtagaaatcaagaaattctttgaaattaataagaataacaatgatacaacataccagaatctctgggacacagataaagaatgttatgaggaaagttcatagtgctaaaggcccacatcaaaaagttagaaaggtctcaatttaacaacctaatgtcacatctagaggaaccagaaaaataagagcaaaccaactgaaagctagtgaaagaaaagaaataaccaaaatcaaggcttaactgaaggaaactgagatgtcaaaaaccatacaaaagatcaacaaatccaggatatgaatcttttaaagaataaataagattgacaggctgctagctagactaataaagaataaaagaggctgggcatggtggctcatgcatgtaatcccagcactttgggaggccgaggtgggtggatcacaagatcaggagttcaagaccagtctagccaatatggtgaaaccccatctctactaaaaatacaaaaattagctggacatggtggcacatgcctgtagtcccagctacttggaaggctgaggcaggaggatcacttgaacccgggaggcagaggttgcagtgtgccaagattgcgccactgcactccagcctgggtgacagagcaagactccttctcaaaaacaaacaaacaaaccaacaataaaagagagaatatccaaataaacgcaatcagaaacaacaaaggggacattactattgacacaatagaaatacaaaaaaaaaaaaaacttcagaaactactctgaacacctctatgcatgtgaactggaaaacccagaaaaaatggataaattcctggaaacatacagtcttccaagattgaaccagaaaatactgaatacccgaacagaccaataacaagttctgaaactgaatcagtaataaaaagcttgccagacagaaaaagcccagaaccagacagatttacagccatattttaccagatatataaaaaggagttggtacaatttctactgaaaccattcccaaaaattaaggagcggagtctcctccttaacttattatataagaccagcatcatcctgataccaaaacctggcagagacacaacaaaaaaagaaaacttcaggccaatatccttgataaacatagatgcaaaaatcctcaaaaaacactaccgaatcaaatccagcaacacattgaaaagctaatccaccaccatcatgtaggctttatcactgggatgcaaggttggttcaacatatgaaaatcaataaatgtgattcaccacataaacagaactataaacaaaggccaataaccatctcaatagattcagaaaaagattttgataaaattcaacatcccttcatactaaaaatcctcagcaaactaggcattgaaggaacatgcttcaaaataataagagccatctatgaaaaatccacagccaacatcatactgaatgggcaaaatctggaagcattccccttgagaacaggaataagacaaggatgcccactctcaccactcctatttaacatagtactggtagtcctaaccagagcaaccaggtaagagaaagaaataaaagaagaaatgaaaagaatccaaataggaagggaggaagtcgaactatctctatttgcatgtgatatgattctatacctagaaaaccccatagtctgcctgaaagctcctagaagtgataaacaacttaagatttcaggatacaaaatcaatgtacaaaaaacagtagcatttctatacattaacaacgttcaagctgagagccaaatcaagaatttaaccccattcacaatagccacaaaaagaataaaataaccaggaatatagctagccagggaggttaaaggtctctacaacaagaactgcaaaacactgctcaaagaaatcagagatcgggcgtagtgtcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaatcagagatgacagaaacaaataaaaaaaatttcatgctcatagataggaagaatcaagatttttaaaatggccacattacccaaagcaatttacagatttagtgctattcctatcaaactaccaatgacattcctcacagaattagaaaaaaaaaactattttaaaaatcacatggaaccaaaaaaggcttgaatagttaaggtaattctaagccaaaaaaaaaaaaaaaacaaagctggaagaatcatgttacccaacttcaaactatcttacaaggctatagtaatcaaaacagcatggtactggtgcaaaaacactcacatagaccaatggaaaagaatagagaacccagaaataaacctgcacacctacaatcttctgatctttgtcaaagttgaccaaaaagaacaatggggaaatgattttctattcaacaaatggtgctggagtaactggctagccatatgcagaagactgaagctagacctcttccttacaccataaacaaaaactaactcaagatcaattaaagacttaaatgtaaaacctgaaactataaaaccctggaagataacctaggagcctagcaaagatttaatgacaaatacaccaaaagcaattatgacaaagacaaaaattgacaaagaggacctaattaaactaaagagcttctgcacagtttaaaagaaactaccaagaaaataaacagacaacatacagaatgggagaaaacattcacaaactatgcatctgacaaaggtctaatatccagtatctatacggaacttaaacaaattaacaagcaaaaatcaaacaaccccattaaaaagtgggcaaagcacatgaacacacaattttcaaaaaaaagaaaaaaacaggctggatgtggtggctcgtgccttcaatcccaacactttgggaggccagggtgggcagatcacaaggtcaggagttccggaccagcctgaccaacatgctgaaaccccgtttctactaaaaatacaaaaattaaccaggcatggtggcatgcacctgtaatcccagctactcaggaggctgaggcaggagaatcgcttgaactgggaaagtggaggttacagtgagccaagatgataccactgcagtccagcctgggtgacaaagcgagaccctgtctcagaaaaaaagaaagaaaagaagaaaagaaaagaaagaaaagaaagaaactaccatcagagtgaacaggcaacctacagaatggaagaaaatgtttgcaatctacccatctgacaaagggctaatatccagaatctacaaagaacttaaataaatatacaagaaaaaatcaaacaaccccatcaaaaagtgggcaaaggatataaacagacacttctcaaaagaagacatttatgccgccaacagacacatcaaaaaatgctcatcatcactggtcatcagagaaatgcaaatcaaaaccacagtgagataccatctcacaccagttagaatggcgatcattaaaaagtcaggaaacaacgggtgctggagaggatgtggagaaataggaacacttttacactgttggtgggactgtaaactagttcaaccattgtggaagtcagtgtggcaattcctcagggatctagaactagaaataccatttgacccagcaatcccattactgggtatatacccaaaggattataaatcatgctcctacaaagacacatgcacccctatgtttattgcagcactattcacaatagtaaagacttggaaccaactcaaatgtccatcaatgatagactggattaagaaaatgtggcacatatacaccatggaatactatgcaggcataaaaaaggatgtttcatgtcctttgtagggatgtggatgaagctggaaaccatcattctgagcaaactatcacaaggacagaaaaccaaacactgcatgctctcactcataggtgggaattgaacaatgagaacacttggacacagggcagggaacatcacacactggagcctgtggtggggtggggggaaaggggaaggatagcattgggagaaatacctaatgtaaatgacaagttaatgggtgcagtaaaccaatatggcacatgtatacatatgtagcaaacctgcaagtactgcacatgtaccctagaacttaaagtataataattaaaataaataaataaaaattaaaagaacagaagtaccactcaacccagcaatcccattactgagaatatacccagaggaatataaatcattctaccataaagacacatgcatgtatgtgttcatcacagcactacacaatagcaaagtcagggaatcaacctaaatgctcatcaagagcagactggataaagaatatgtggcacatatacgtcatggaatactacacagccataaaaatgaatgagatcatgatctttgcagaggcatggatggagctggaggtcataatcctaagtcaactaacataggaacaggaaatcaagcacggcatgttctcacttgtgagatggagctaaacactgagtacacatgaacacaaagaagagaacaacagacatctggatctacttgagggtggagggtgagaggagggagaagatcaaaaactacctatcaggtactatgcttatcaccttggtgattaaatgatccgtacaccaaacccccatgacccgcaatttacctatataaaaaacctacctgcacatgcacctctgaacctaaaataaaagtgttttttaaaaaaatgaatctggtgctcccctccgcagcacatatactaaaattggaacgttacagagaagattagcatggcccctgcgcaaggatgacatgcaaattcgtgaagcgttccatatttttgacaccacctgcagcctctgtaaactttaaagggcctgcagagaatgccatgcttctggaagatgattggtggtcttgtcttcagatgaaaagtatttgtgttgtgataagggtgttggggtaagggactctgtgtgctgtgcttttctctagccaagtggtactataatgagtctaggaggagaaacatcagcattaacaggagacttgctataagaagctaattcatggactcttttcaaacctgcaaaattttattacagtgaggcctagaatatcaaataatttatatgcacattgaagcttgagaggcagagcttagctaagtgactctcagcccagtcttccaataggatcacatggacaatttgaagataaatcatcacctgtgccctccccacaaatcctgtttattgttctgggtggaaacacttctgttttttaaattaagctcctcgcatattacagtgaggccaaggtcaagcatgaggacttccagatactttaatgagaggaactattaacattcaaggacgtggccatagaattctctgcagaagagtggaaatacctggaccgtgcccagaagaattgatatagagatgtgacgttgcagaactacagaaacctgggtgttactgtctgtaacccagacctggtcacctgtctggagcaaagaaaagagccctacaatgtgaagatatatgagacagtagccaaacccccaggtaggtgacagtgaatgaaatagaggacacaggcaaggggactaaggtcaaggaggaagccaggccttaaaatgtagtttgggaagctctgctccaatgaaaataatttctgaaaaggctgcatttttttctcatatacaccaatggggcatcttctgtctcatgctgttaaatcttctaagtatcctcttttttctttagtgatctcccttcaaggttacagggaaaaccaatgtccgctttaccatttgtaaggggctgcatgatctgactgtggttccattgcttttggagacacaggaatatttgtatattgaggagctctatgtcgaagtattttttttcaaatattcgttttggatgatgtctaaaatgtgtaaggtgagtagtggacatattggaatttggttcagaaatcccgggaacactagggacagatgttgtacctcttctgctttgtgatttttactcctatagaggttacaaatataattctacaaaaattcttactcggcaattttatcagaacaataaacgtttttctaaatattaaaaaatgtactgttatttcaaaatgttattgttttagtataaactgagatttgtgatttaaactctgtaggtgcaaattctcaaattaaatatagtataaagcacaggtttccaatgttttggcttccctgggccacattggaagaagaattgtcttgagccacacataaaatacactaacactaataatagctgataagcttaaaacgaagtttcatgaataatttttgtgatatacgccaccatagataagcaaaaaagtccttgcattcaaagggttggtcaccggtttaaagtatctactcaccttctagatttcttaagtgcagtatgtcattaaccagcttagaacattgctaagtgtatattatgctctcaatcattaccgtatttcttaataactattatcttataattttgtcttatttagtaggaagcctaactgagattctgtcatcgagatatatctatctatatctgtataaaaatggctgtcacacacacacctatatgttatatatgtgtatagtaaattcttaacattgttgatagattcttggaaactgtaagtgaagcaatatataattaaagaaaactaattttagggctgggcacggtggcttacgcctgtaatcccagcactttgggaggccaaggtgggcggatcaggaggtcaggagttcaagaccagcctggccaacatggcaaagtcctgtctctactaaaaatacaaaaaattagccgggcatggtggtgggcacctgtaatccagctactcgggaggctgatgcagaagaatcacttgaaccccgatactgacatagtagttaaagtgtttgcagaaaagaatgcagggaatagtttaattacaacttcagcaggggggtagaggttgtagtgagccgagatcgcaccattgcactccagtctgggtgacgagtgaaactctgcctcaaaaaaaaaaaaaaaaaaaaaaaaaagaaagaaaaaagtaaactagttttaccagcgtttaattgatacaaacaagagttacgtttagtgtatagcaatattgtttcatttaaagttgcagttttcaagaacctcttttgaacattaggtgaggacttactggacatctgtgtttgtgtgatatgatttttctgataaataaaagttgcataactatacaaaaaaaagtaaatctggttcatgtgtccactgagtctcctggctccaggccagaggtgaaggacattgtgggaactgtagccttggaaccccacaacagaagccccacactacactgtaacacccatctcctgctcctgtctgtcttccatgtgaggttaaaacacaactggggggcctgttagtgggggcaactaaaagacaccccactagaaccagggaataagacttccattgaagggctcaggaggaagacatatcaggacaatgcagggcacttgcgatggaaatgaataaaaaccatcacgtttttgccaaaatggttatgtagatgcaaagttacagttgggctggtgacccagaacaagcacagctgcaggatgtctcaggaatcctctaagcttcccatcacagaaaccgtgaaatctctgaagccgtccagggagtgaaaaataagctggcacatagggtcacgagcacccagcatcaaagacaggaattgtgttcagaacagcagcagacgcactgcccccttcttcccacagatccaaacatgagagaggagatgtaaagaattttatctgacatatccctttcctgtgattattcacaaattttgccacatttgcatgctgtgtgcagcactcttaaagtatttgcatctttgtttattcatttctttaaacctttttaaatgcaccaccagcaggtcttccagttctaaaaaataaaataaagtcagtgaagtagatgccagtggcaggcaagagcagaaaggccagagaggccagcttttctctcatcatattcgtggtagaagaagttcctgtcaatcaacattgtgatagcatcagtcttaagcattgcctcagacaccagaggctccacacagagatatccaggtgttgcaggacctgtgcaggctgaaaaaccttcagagctcataagcagaaagtcgtctacccttctagttattctagatgggcccccatctcagggggagccccagcagcagaaagccttattaaaattaaaattagctaagaaggaaacaaaagataaacttttcctccttcttcctctttaaagcagaatgagttatccactggattcggaatggtacagctcccaaggaactgtgtgacaggaaggtctgcctgtggccggctgagggaggaggaagaaagcaatgagaaaagctagatcgagaccacagatgctgcagctgaggctcatccagtcaagtctcagacctagcaagagcaacttcccacagtaacatttttaatccctggcagcacttcacattgagctagtaactcttcctttaagagattatataggttttgataaagatgtgaggaatgtgagctggagggctttggacacctggaataaaagctgcaggcaagatgggaaactctacaacttgtaatctgaaaatagtcctagtgatgtgttcctacatgtacatgtgcatatatggagagtgccttttctccactctgtatcttgcataaacaagaactgattgagttggagagtacttttcaattacaatccattccatttaagaattctgagctgtcgggccttcttttcttttaatggagcaaagataagtcatatcctttcacaggaagatgaagaaaaaagtgtgaagataacatcaaagcataataaaatgtccaaagcactgatacatctacacattcaatcttgcagactttgattattaggaaaaatgatcaaggtaacagagaaacgaagaaacttactaagtgtttctcataggtacagattccttcttatctagctgtattaccagacacaatgcaatttgcttttatttactgatctctcttttaagcatcacacgttaaaactgcaagaggtaaagatgaaataacaggtactggatttatttttctgcttaaaacaacccccaaaaggtaaaatttgttgaacaatgattttcaaaatattggacatcaggcaatgaaggacagtgacccctgagagatgagggaaaaaaaagtcacctctacaataacctcagctactaccttgagagagttcccatccttggcagagtaataaagaaccaaggtagaggccagcagacttcctcagtttaaaggatggagttgagggcctgggaaggacaaggcaacagagttctcaggacagagtaccaaagaggagagagatctgcagagggtctcactcaaatattcagcaaagtaccaataagcacatacatgagatttcctgaggccagggaaagaagcattccaaaaggtgtaaagggaaaaggactcaaggccaggaatagtgcctttcccccagccagacgttccagtctcataatttataactacctcataatttatgtgttttctgttcacaaagaaataaattagaaatcaataagagaaagatattgagaaaaataagtatttggaatctaaataataaagaaaatcaatgataataaaattagaaatcaataagagaaagatattgataaaatacttaaatatttggaatctaaacaataaagaaaatcattctgtagtgtgctcaggaggattttgcattggtcatggagaaaaattaactgttcttgtcttgcctaacaaattttaaaagtaagatgcaaaagaataaaagtatttccaagtaaatgaactgcatcctagaaaaaacagctcaagaaaatgtgtagaaataaaaaatacctatcataaaaccagataatgcctgacatccaatcaatgataacaagccatggataaatcgtggaaaatataatctataacaaagagagaaaaatcaatcaattgaaagtgacccagacctgacccaatgctaaaattagcatttgagaacaacaaaacaattattataatggtatttcatatgttcagagatgaagtaaagacatagaaattttttttaaccccagtccaattttctggggacaaaaactataatatctgagataaaaaatacactggatggaattaatggcagattagaccttgcagaagaaaagactgataaacttgaaaacatagcaatagaagctatccaaaataaaagaaagaaaaaatcaattttctcatattctgttgggtagaagcaagtcataagtttcacctgcactcataggatggcatcatacaagggcatgacaatgggggtctccttgggtgggtcaatcacaccatttaaaaaaacagatgtgggccgggcatggtggctcacgcctgtaatcccagcactttgggaggcagaggtgggcggaccatgaggtcaggagatcgagaccatcctggctaacacggtgaaacctgtctctactaaaaatacaaaaaattagccaggcgtggtggcaggcacctgtagtcccagctgtttgggaggctgaggcaggagaatggcgtgaacccgggaggcggagcttgcagtgagcagagatcgtgccaccgcactccagcctggacgacagagcgagactccgtctcaaaaaaacaaaacaaaacaaacaaacaaaaaaacagatgtggcctgattaatataagacaaagtagatctcaaagccaagaatattatcagagataaaaatggtcaggtcataatgtcaagaggatcaattagtcaaagagatatgacaatcctatacatttatgcacttgcttttcgtcatatttattgacatataatttaaatacagtaaaattcacctgttggtatacagttttatgagttttgacaaatgcataacatcatataacataactatcaccacaatggagatttttaaaagttcatgaccccataaattcccttgtacccctctgtaatcagctcctttccccacaccagtccctggaaccagtaatctggtttctgttcttacacttttgctttctccaggggtgcaatataaacgaaatcacacattatggagccttttttgtctagctcttttcacttagcatgatgatttgagatatagccaagctgtttcatgcatcagtagttcattcctttttatttttcattcattctttctttctttctgccatatccacttaagacctctcctactacaatagcaagtgaaagcagaaaatgtgaacatccatgttctgatcttcatcttgaaaggaaaatttccaggccttcaccagacaggctgatgtctgctgtaggtttttggtatagatacgtctctaactgattaaagaagtttcctctattgctactttggaaagtgtttttgtttgtttgtttgtttttaatcatgaatacttgatgtataaaagactttaaaatgagtaaaaggattagtgggatcctgacttccttattcatctgggttaatctccacctttcctcatctttgagttatttcacaattctgaagttgtagaaaactgataataatgtgaatcgtttttacccatgaaatacaaattgagttccagggaatgtaactgattattgccctgggaatgtaagtgatattggccagttttgcatttggttgtaaatttatttcagtatttttcatttaactataaatgtgtttgaactagttgtagcatgttaccagatcctcaataattagtgagttaaatttttgacaggtgctcatttttatctgtataaggatcattttatccttttttaaaattattccttaacaggacatttaaacagtgcttggccagtaataaataataaatattagctcttactacattaattgtattaatatttaaaatgactcttgagtcacactttaagttcatctggggaaggtgtgctctgaggatacactcaagtgtccagtcatctcaagtgttcatccagtcattactgagcacttcccaggaataagacagtgctcactgttagaaatacaagaaaataatcatttctctccccattttctcttccactgtgtggaatgctggttcctgaaaatatctccaaaacaatctgttgaaaagataaacctcagtttatccttctgcagtaagtgaaagcactactttgagagtcatactagcacttcacagaggggcagggcaaaatagggatacttaggagattttgaagtctggtttaaggtgtgtctttcaatggggttggtggttgtaggcttggttaggaatgggcaataatcatgtcaaaatcacttaggattcatgaatttgtgatgatgtgttcaaagacttggggtataaactgtaaggtggtgctttctactgaagaggtgatagatctttcaggaagtttctggaatgaccaatcaagttatttgcaacttcctgggcaagagttgcctagaagagtgatggcatattgttgaagatagtggaatagtgaagctgcattgaggtagacattaagctgtatgggtaaggacagttcgggtctcagatgccatctttcttctgtacttctcatcaagcatctacatttattgtcttattttgattgttatatttctggtgcaagtgtctaaataataatataatgacatgaacaataacaacaactacagcaaatgttgtgtgtattttaggcttacttgagtcacgtcccatcctaatctttcagaaataacctctgtaattccaaaagcagccctataggataggactcattatctccactttatagatgaggaaattggggttcaaagagggtaacttgtgagtcctgccccccaggccacttacatcctcaaggcaattgccaatcctgaaaacagagctgatgatccgaaatgcactactgacaacctcatcaggttaggagaatgcatgccaaggtcctgggcctgtcaaggtaacccccctggtttcggtctaagattccaggagtcagggtgaaatgaaagtaaactagctctgacatagactgcagactgctataactcttctgggtaatccaggaaattccagaccctaaagctggattaagattatccctgattactagtacctataggtacctagaaaaatccatggaaaatctttggagaaaaaaataagttctatactgtaagttatttctacaaataatttttaaaatgcaatatccagcacatagtcaaagacagataaacaaatacacaaaaagacaagacactataagtaaagatcagcagaaacaataaacaggaataagcaaaaatacatgaaaattgaagaaagcgatcaatgtgtgggtaattctaagtaacaattgactgtataagacagtaatgatgataatattatttgtaataatattatgtacatcataaagaatcaagtgagagcaatgaaactgtccttcaactctagagttacatgttgaatcatatggtagatactacaggaccaaggggcagccagccacggtccatgagccacgtctggcctgtggcctgctcttttttatgtcaagcaagctaagagtgtgtgtgtttttttacatttttcaaggcttattttacaaaaaagaaagaaaaatatgtgatagactttatatgttctgtaaagacatatgcatttactttctggtcctttacagagaaagtgtggcccttgctatggagaaatgacaatgaatgaactgcagtgacacacaacaacaacatggatggaccttcaacacatatcactgagccaaaaagagcaagatcaaaagaaaaatctctaatatgattccactggcataagttttgaaagcagacaaaattatagtttgaggatccactctttggtggtgaaactataaaagaaaacaaggaaatggttaccataaatatcaggagaatggcacatctaggtgagagaagggaatgtaattggggaaggggcaggtggagaagtgagctttagagtagtggcaatgatctatgttttaatctgcatggctgttacttcagtgcttacaataatttgttaaaatgtatatttatattttgtgcattctttctgtatctgtattccatttcaaaataagaggggtttaaaaggtaaactttatacaattattttttaaagtggaggaaaagagggaaggaaggagggaagaagggaaggagggagggcaggaggggaggaggggggaagtactgtaaaatttggtccaccaggcaagatctatgttcttcatctaagtgaaaagtaaaagatgttaagcaatattttcaacgacctcttgatttgataggtaattttacaagaactgactgcccatttgtatgtttttaaagcacttggcttaaagaaaaggtcaacgttcttactgtgaataaaatatttatgaaagtagctgtggcttttctttctttgtttccccacctgtgcccagacaccccaccttgcaatgtgttaatgacctaccttgcccatgctggtcttagtgcctttcaggggtattttcaccacatcctctctcaaagaattgagccttttttccacggttgtcaaggctttcattctttttctatctcctctttttctctgaaaatattccacttaccttttcttccctaacaggtggtaagtatagtgaatgacaattttttagaacatgtgtcacaaaaattgtggagctgccatattgcacagctccagcaggagcattcacatcatggcaacttcctctagttgtggagtgcccagaccatataaaacaggcagcagcctggccagcactgcttgaaggagttgggattcagatttctacgggtttagggtaaaagggaatgggttaagtccattgcatagaggattcaagttaaacaacaaattaacttcttgctctaaaaagaaggagcagggcatttgcagtgctgttcataatgcaaagctacatctgattcgtgtatctcctaaacttccatatagattgttggagttgattttcacacttaaatctaatagcagtaaccacagtaacttacgtttacataaactgcattagatctaggtttaggttgagactctgactcttactgatgtgtgagcttcagcaagttgcttaacctccttgagcctcatattcttcatcctggaaaaaaagtgatgatgataatgataagggtaagtacctatcatacagaatgaagtgagaaatacacttaatgcacagtgcctggaacattagataatgttcttattatttgttctctgaccattcctgcttccctccgaaaatatgtcctgcaatcatccagtcctccagttcagaccccaggagtgaccctctgcaccttctaatccctcagactccccacacccatctctgccctatccaccaagtcccatccaagaaccttaattcccacatatttgtattagctctcctcagactctcccaaacctcttgtgggacacttaccgcctttactgtcccctctatttactcatccattgattcattccttcccccactgttatattgagtgcagagtagctggagaagacttcttggaaaaggtgacatctgagcacctgggtcagctgaaggaacaagcatggagatttccagagaaaaactattctaggaagagaaaatgatgtgcacaaaggccctgagacagatgagtttgaggaccagaaaggaagcagagaatccttgttgagtactaggagatgtggttctatgtaacaggccttctctgggttccatgaggagccattgacaggtttgagcagaagtgtgacatttttggagcatcacactctggaggcaagattgaaagcaaaaagacaaggtaaaagagcattgcatgggtccaggtagtgaagactaggatggtaacaggtggtcattctaagacacgattctgatcaggtcactctccctacctggcccatgcacacaccacacatacacacacttaaaaccagccagaattttccctcgcctgtggaataaagtccagactctggacccctctcccaactcgtgtcctacatgcagtcatgattctgtgccttcacacctctgttccctccccctggaatgctcttccctcccttgtctttccacttattcttcaaaactctactcttatttgagctccccttagaagccatccttgatcccattctctctgctcttcccaaaagactgaactgctttctcctctgagctgtctttgccctctgtgccataaaactattatcacaattatcactgtgtcctgtaataagccaccttcatttccaacctttcatcctgtaggttgtgagcattcttatgtgaagtattcccagattttaagtttttctatcttgggccctttgcacaataactggcgtagggtatgtgttgaacttgtaactaatttaatgccattgtaagtagaatcttctttctggttaattttttcaagtaaagcagattacctcaggttgatttgctacatctttgctaggatgtcaaaaatgtctgttgacatctcttttgatacttttatctcaccgttcatgtgtcaactgccagttgctatgtgagctctgattctgaatttagcaataaatgctcttcacattacttttctctccaccgtctatctcttctgggctttgagttcaattcgagcagtgaactttgagttctctgacatcagacttcttgacctccagtcaatcatagagtaactcctccctctcaatcaaaaccaaataaaagttatataccctagttgagtcaacttgactgcagccttaagaaaatctcaccaaatgcagccttacatgttctgacttgaaatacatcatgtgtttcccttcggtccttcagcaggggtttgttctatttcagtgggcactaaaatactgtctttcacagatatttcgccttggaaatttcatggaaagttagtagagtgatgctaccaactgtgtgatatggtttggttttggccttgccacaattcttaaggcctgatgtgaatttcatttcctattgcttatcctgtgtgtgttaactttctgcttggtaaaattgcaagttcccaatgaaagcattctacaattgattagacctgggccacctggcaatttctttctaatctcttttattgtgctttccataaaaatgacagccctggtataaatcctagtttaaatcaataccagtaagtgctaatctcttcacagcactggagatgaaaatgtcaaatggtacctgctgggcattagaactcctactgtaaatcatcaaaaattaaagcaacaccaaattgattttattttcctcttttaaaacatcattttagattcattattttttacagttaagttattcttttttctttttgcttatgctctggttagatgagattgatgaactgaatttggcatggcaaatgtgttgatgtcccatgacacaatatacaagatccatacctgaattaggaagagcctgaggatgaagttgatattttagagtgtgatgtatatatttaagtgacattttaatccttcttcatgtgataacaccacgataacatggaatcttggttgaagaagctaaaccacaagaaggtatctagtaaaactacagtcatggaatagaatttctagtcctttgtagcccctccttgagactattgtcaaaactaccacaagctacactaaaggatgctctcagtaggagttagctgcctggaatctgagcatcttaacaacaagatatagaaaaaaatgcatagataaattgctaagttttcaagtgatcctggaagaattgggcaatagtttttaaatccaggaaaaacttaactaagaatcttgcccagcttcctacactagttattttatcaaataagaaaccaaaaccttgggaaatttagtgacagtcatggtcacaggtttaaaggcaatgcagtagatctctagatatttaattagggtttcttcttgtttcatcacagagaaaatacaaggactacacccacattgagcatgggacatggaaaaatctgatgtgtgtgtgtatgtgtgtgttttcataaaaatagttaatactcagagaataaagtcttaatatgtgctaataaaatggaggagtgacaggaagaaacaaatgttacaaagtgaagacttaatttaactatagatgcttcatgacttatgatggggttatagccagataaatgcatctcaggttgaaaatgcgtttaatacacctaacctaccaaacatcatagcttaactagacttaaacatgctcagaacacttacattagcctatggttgagcaaaatcattgaacacaaagcctgttttataataaagtatcatatatctcatgtaatttattgaacactgtgctgaaagtaaaaacagaattgttgaatgagtatttgaagtatgatttctgctgaaggcatatcactttctcaccattataaattcaaccatcgtaagtcagggactgtctgtagttagtttcagatttacttctagacaaaatactttttatgttgtgtggttctcttccatctctcatagaggatgctaattggcaaggaaatgcttaagaaatatgtaagccaaaggagtggcagaaaaagactcattcagttatacaaggtagtcatcaagcaaggagcccacctttgcataatggagaattcgggacagtttcatgaactgacaacaaagatttctccaatccttgcttagttcatcaagttattcatcagtttaagttcattaacagtactaactaaagtgcaaggccctcaaaattacttgtctttcctccatcagtttaagtcttgcaaggccaagcagataacagaaatgagcaatgtggactcagtagagactggcaaattgtgaagcatatggaaaggaaatagcctctgcctagctcttacaagctgggagcaggggagaatgaagacacaatgtaactagctgagctcacttttgcagagatgccagaaatccaaaaattgatgcaaattataaatttataaatttgacaattcaaaatcatggaaacacatctggggctgctaatgtgagagctttaactaagaacgagaaaccactttagggtttaataaacaggaaagggtaaaccatggaaggttaccagtttcagggacacctgtagtttctcttaacagtttccacttaccagtgagcaaatggtcactgatttcagaggtatgtgtcatatagaagaatgaatttacatcagaaacagagaggtcagcgtctgattgcaggttctgaagagaatgctacagtcagtgggatgaacaatgataggggaatcagactggagttgccactagttaagctatagaaacctaagtgaatcactcaacctctcgtgaagagtctttctcatttgtgaattttagattaaaaaatacctgatttacctgatccacagctttatcataatagacagtgaacaggaaataaaaataaaagtttcattacagaagtgcgtaagagaattcacatcctgatcccctccagaactgaggtccaaaattcagaaggaattagaacttcagtgtgcattctgagaagaaacacaaaggcatagaggatggaaataagaatactgaggaatggtgaagtggacaatgtccgagctctctgcccagagccctcgggaacccgtttttatcatttctgtgtgccgcttcccagcttttgtgtccttttacttctaaaagctgcagtggtgccgcttacggtgactgctccaacggtatgagagctgctttgcttatacagggaacctggggtttgtactcccatgatttggtccttagccaatggcagctccctcagaacaaaattctaggatgtaattggacactctagagccgccctacaggaccaggctgaagtgaggatttttcctgaaatcacaacaattgctttacttctttcctttccttgtcctgctttctccactcccttatcagagtttgtgggagcactcattcataaatcacgtgtgaatccttctctttcggtgtgcttctaagagtctgtactaaaacatccacacatttatcgaaactggcttactttattaagaactatgtttccattaaaaaataaagcatgtctactgtaagcagcaaaaaaagaaaaaaaaaagggaaaaagctacatttttcctgcaaaaatttaagacatttttacaaataaaacaaacgtttgtttcagagctgaggatttggggggtggtgtgtgtaagagttacacttcaaaagctacataagaaatagttgcatccttcatgacatatccaactaaacagtaatgaatggtgtaaatctcactgtgcaactagctgtatttaggcattagacaggatataatggccaagagacaaaacagaacaaaaactgtttcaactaagacattaagggtgagatgttactatgtaaatcaagatctatcatttcttgtatttggggatcagatatgttacttcttacaaacaaagagataaatagggtaacatttacaattgtgttattttcccatatcccaaaattaaaaaaaaaattctttaacatcacaagctacatcaattaacaaattccactgtaatttacaaatgcacagatacataattgggctaacagatatttatgaagctacttgtaacagaaacagtactaaaatcataacacatttttcaaaaataacttagttgagttctttatatccggtgatatttcagatacatttggtaatgagtgcaaaaatcagtaagtaaattaaatctcaggagtttctactttgtgcttaagcactgcgggctatttgttttattttagtgatctgttcactaaaataaaaatggaggtatatcagaactgaaaacagtattctcatagataatgtaattttaagtcttttttattcgaagacagtataaataggaagaatattgaaaagtgaaaattatcttaggctgttgaagaatatcttagcatgctgaaggactttggcaagtcatattgtaggtaacttccctcaattatggtaaacaactgattttctaaggccatttttaaaatacaagtaatttagtaaatatgagcccaagttttgtatcataggaaaacttttgcctaaaaatctagtaagaagatggaatatcattttgaaacttaaaacctagatgcttatatccaataaaactaaaatttaattgcaaaacaaaatatcagtattctcaggtacatgaggtctcagggagaatagcatgctacaaaagcactgagacattctccagaagagagaaattaatccgacagaaggcaacggtctatgggaagaaagactgtgcaatgtttatttctaattaaaaggtaataaatgagtatatctctaagaatattcgatcaaaattccaaataatcccaatgtggctggaggtgaagtgaggaacaaaacaagaaattgctattcttcttttttcctccagagcaatgacacagttattgacagcttcagacattgatggagacaaatcagctgggttggtcttaacatgttaggagaaagcccctaaagaataaaaatagtgctgcactttcaaatcaatagcatagcattaaaattatttttataaaagaaaaaagttcaaatacaagactattcgatatatggatttaaatcctttatttcataacaatgagcattagctgaagtatgtgctggtcaccttgattttcaagacatttaaaactatttcatcttaatttgttattttcaactattatcttggggtatgtttcataatatatataatgtattactacatatatatcgtatacatacaccgtaggcacaagtcaaagtattttacagatagaaaatgtgatcaagaaaacatagtgtacaggataaaggccaactttctctccttggcatttacagccccttcatattctggccaaaaatccatttccagcctgatgaccctctatttcattcactgacacctcagttctaactgagacatctccttgggcatcttattgccctgcattgatattccctgcatcaatcttctcacgtctggggcctttcttcccttcctggctcctatcaaggtttccctcgctcaggaagccttccctgccctgccatgcattagtaacacactaggccactgaatattcagtgtctaggtttcagggagggtcttgtgatacattcgtgatttgcaaaggtatgattcatgattgcaaaagcaatgtcttctctgcgctgatttaatctacagcactttcaaatttcagccaatggttaccttgtcatgtatccaaactttctcctcccagctaaatattgagctcccaggggtatggacagaccatggctgatgcccttctgagtgctttccccatgcggaaagagacacactacagaaccataaataaatatttgttaatgaaaaactgacttgtggtcagtttatttatccagaggatgtaatgagcctcatccttcacttttcccatgagtgtattgctgactacaccctacggaaattggggctttaaggcaaaacctaatataagagtttggagatctggagaccttgttttgagtcatagtctgttgctgttaaagtccacaaagcctgttttctcaccaacaaatgagataataatgaccaacgcatgcagttgtaaggattaaatgagaaaaataatataataaagatgcttaagatgtctttgttgttactctatgttcatctccaaagcagcttctgttaccaatctttaaccaaaactcaagataacaatggtttgcatgctatcaatttcctggagattagagagcaattctaattggaaggtgtccagcagacctaaatggttctagagagaaggtccctctgtcactatgaaaagtaaaccgtaagtcccttatgccccctagttagtagcttttgtattctaatgagaaaagtgaagtttagggtctcaatccaattctacaatcatttgttgagcaattacaaaatttagaaatcactggttttgcctttacctctcctccaagccaggcaacccacactctctcctctgcctccctttaaattctatcccacattcgattaaagtacttgcttttctacctgccaattaacagcagcttttgggcttgacctcctctgaaggcattactaggtcctcctgttttcctcctacagcatccagtggaagtgccaatccagtacagaccaccacgtggtccatgctaaacctcatgcaaaggcaggggcaatgtggatgggagagaagaagctttaaggggaagaagggcgttaaagttgactttcctcaattttcagattccattatgaggattccatccacatagtggagaggagtttccactgctggaaaaatagaaggatggaaaccatagtattgaaaaaatgattcattatttaaaggaaaagcaaccggccttgatttaagccatgctgagggatgctcagcctcaaggcaaactttctgctgttcagtttgtgtccactgatcatgaacccagaagcctcagattgcatatttgtttaagcctttctttttcattttccctcccttgatctgaaaagctttggtgattatacagattgagacagaattctgtcaccagaaagaattgtgttctttgttctgtggcttctcttcattagatgtgtgtgttgcctttataaatcccaaagattgtttagcaacctgagactgtgatccgagtgggtgatgcatgtcatgtgctttattaccatcaaactcaaggacgacagaaaaaagaacagtcacaatctgtttgttggaactgttgccttccccttacccagagccaacacgtagcttctcctgtcttccatgctaacacaggcaaccaactcacagccaacgagacaggaataatgcagggtggatgcaggagaatagaaaactccaggcagcagtttcacatgactagcaaaaggaaactattgaaataggttcagaagctagggactgataagaccctgaaaaaccagggtgtaggccaaaccggctaagacaaactggatgcaccatggcactggatttgatataggacctcattatatgcttgtgaacatattgaatcacatacccaccagtgcggtaaagatacaagcccgaaaacctgcagcgtgactcactctcttgatattcaagtgcatgctaccctttactgagtgtgtacttttactttgctataaatctcagttctttcactattttcaggcgtatcttgaattccttctcacctaagagcctggacaccagctaaggttgaggttgcactgacattcggggacctcgtccagcccatcggtatcatcagaatgctcttttcccagtggtaccaatgtagtgatatgaaaaagcaactttcctgccctgccatgcattagtaacccactaggccactgaatattcagtgtctaggtttcagggagggtcctgtggtacactcgtgatttgcaaaggtaactatggatggtagattttcaaaggagttgcctttaccaaagaaatataataaagaaaattccattaaaaaaggatacaataggacacagggagaaagtgaaaagcaaaaaagatgagtttctccaataacagcctttcttgtcttcttaagggaagctggaatgcttgagggccatctgcaggaaaatttattccaattaagcaagtcttttttagcatctttatgcttgtgtctgcgagcaaaacctttgaatggtggtataattctctgcccataggtgttttaatttaatagcacctagcttaattctaagctcataggcactcaaaaaataagtaaatgattgattcaaaagaattgtatcacttggacttaaaagaactctcagagaaactgatgcttaaagaggttaagtaaccatctcaagggcatataactgggaagttatggaatccagatttgaatccaagtgtgtttaagaagcacacgctctttctcctgattgtggagataggactaataggggcacaatatcatggtcaagagcgcgggctcaagggagtgttcggtgtggcagactccatgcatttgaattctgggttcacaacttagtagctcagtgatcttgctcaggaaaacaacctaatctctttgtgccttaattttagcatatgtaaaatggggataagaaaagtatctacttcaaagcctcatttcaagtattaaaggagttaacatgtgtaaggaactaaaacagtgcctgatatatagtgagtactcagtggatcacttcagctattttacatgattattgaagtcagggaatacatttcatccagtaataaaaccttcaatttacattataagttgttacgtgctggatctcttgaaaacataatgcacgatgagagagtagaggacagtgactgaaaatcatcacaatcttcctttgcacaagaatgatgcattactatcatctccatcaccacctcattttcattatcttcaccaccaattccatttcataacacatttgcttcatgtctcacttacagtcacaaacttctttgatagacaagaaagggacccatgttgagatctacattctcaaatcaggttaagagggacagcgatgcttatttcactgtctatgtgtttatacctgattctttcaaccagggagacagcctgacccatggagaaagcacgagtcaaaggtcaaatgcatccacctgcaggtcctgtcactgaccacttagcatcccacaatatcactgaacctcagtttgctcatacgtaaaataaaattttaaaaaatagaaaatgtaggtagcgtgtctagctcagatggctctagtcccttactgtgacccaaccatttctaatttggcacaagttacaataaaaaacaagcgtgatacttacctggcagggcaaataccatcatcacaaaggtggttttcccagggtaagccttatccattgcactctggatgtacaaactcctgcaatttccccaaatatgggaaactcgactgcatcatttgttgtcatggggactgcatttgcactttcccctaattttaaaaaaagaagacaagcacaattcagataagtaaaatagaattaattaaatgcacgaaagagaggaataaccaaatactttgagagctgagctagttcctataattaggcaatattcatgactctgagcctcctggaagtgagggcaaaaatggaaataaaagagtttccccaaaaggaagaagcataccaatgcttcaaaagaaataaagtctaaactgacaacaggtaacgagatatttctcatgtaaaaccttataagggtaacattgagtgccatgatagataggtcttctgacatcagtttcatttaaaaaatgcaggccagatttttacttggatgctttaaaaaggaacttggataacaactgagaggttaacatcaaaatccatttcagttcaagtgattctggaggggattaagctgatatggtctcagaatgatgcctgacagtaattaaacataatacaagtgcagaatcaggaaagcataaccactctgagtgctatggaataagaaattttttataggaattcaactttacacaattgtggaaggtgctagagaataagggtccaaaaatgggagttggagaatcaggggaaggtcatcagccaggcctcctggagcactgacaccaatggacacatcagaggtcccaggagaacttagaagccaagcatgcctaacaaccagagtgggcccctagccgagctggtggaggagtttatggaagttcttgccacttcacacatagtgcctttgtgagtttgcagccaagaatccagtggtcagcctggagttgctcttggtcaacagggctaggagttaatagggagagttggacatgaggttgggagaggcagtggtaaaacagaacccacctgtgcacctgtctctctctgcaaacgacaaccatgaccttcagacattgtaactgtgtcctcgcattgcttcttcaaaccaccacaaagttctctttggccaactgcagtctagaaacacacaaagaaaaggattctggcaaacttagtaacaggtgagccaagtgtttcctgaacaaaaaccatgcagaactgcattccagccagcgaaaaggagaaagagaaaaaatggagaaataagctaagggtgacttcctcccttctcataggattgtttttgtaagctgctcgtggcatttcttccctcatttcaatggccagcagttaaatcattctgtggccatatatcatcctggttttcaggtaaaattccaggacgtggcaaagaagacccagataactgcgtgctttaatgcttgacctaaccaaaacctctggactgcattgaaactgattcaccttccatggcctgtctggatctagccaagtcaaaagatatacttgaataaaagtgactaacacaatggcaacccagcccaaaatgaggcttctaatgagagggtgataatactaggtggggctgaaaaacttggtcttctagtcagtaatatgattatgcttataataatatgataattttactgaggattcactctatacaaggcactgtgtatgttttatcctatttaattcccacaatactaaaagggttcacaaaagactatatggagtcaccataagtttaaaatcttgctctaagtcacacctagattgctaacaaggaccaatctaggttttgaactctgacctgactgactctatcacactcaccctcattttccttgtctcctcccacactgatgtttagaaaagcaacagagcgaagtgctcagcatgaaggagaggcattatgcaaattttaactcttaaaggtattcgcaatttgcccaactatatcatgagtactggcttttacctggtgtgtagctataatgtgcaagttgcatattaactccattccagagatgatctcatggctcaagattgctgctctggctccagccatcagcagtagctctcagctaatgcaggtggcatcaccctccccacttcctcacccttccagggttgcataatagtaagatgagtaatttgcttagagctcccacacactttgcaaataacatcctgagtttcagaattcatgtcagtttgcctgtgaggctaaacacttgaagtgctcctccttcaaagtcacataaaccataaacccagtcctgagagttggtcttttggccaggaccttatatacctattgatctagccacttaaagacatctttgttaatatattgttcctaatgctgttgggtaattgaggtctttgtttttcaaatgtttatttatttattattttaatagacaaattgaaactttaattgacaaagtacaattgtatatattttatatcatttttgaaatatgtgtgtaatgtagaataattaaatctagctacttaacagatgcattacctcacataattaccatttttgcatgtgttgagagtgcttaaaatctactcatttaacaattttcacaaaggacatgaacagatacttttcaaaacaaaacatatatgcagccaatgagcatataaaaaagctcaatatcattgattgttagagaaacgcaagtaaaaccacaaagaggtacgatctcataccagtcagaatgactatgactacaaatttttaaataacagatgctggtgaggttgtggaaaaaaaggaacacttatacactgttggttggagtataaatcagttgaaccattatggaagacagtgtggcaattcctcaaagacctaaaaacagaactaccattggacccagtaatctcattactggatatatacccaaaggaatataaatcattctattatgaagacacatacgtgtgtatgttaattgcagcactattcaccgtagcaaaaacatggactcaacctaaatgcccatcaatgatagacaggacaaagaaaatgtggcatatatacaccaaggaatacaagcagccaaaaataaaaccacaaaatcaacaacaacaacaacaacaaaaaagattatgtcctttgcaggaacatggatggagctgctggagggagctggaggccattatctttagcaaactaatgccggaacagaaatccaaatgtcacatgttctcacttacaagtgggagctaaagagaacacatgacacagaggggaactacacacactgggacccactggaggttggagggtgagaggagggagaggatcaggaaacataactaatgagtattaggcttaatacctaggtgatcaaataatttgtacaacgaacccccatgacaggagtttgcctatataacaaacctgcacatgtacccctgaacttaaaagtttaaaagaaggatacaacatgattaattatagtcaccatattgtacaatagatctcctgaacttattcctcctatctaactaaaattttgtaccttaaggtctgttcaagtattaggctctggtgaacaggtagaatttttttttttttttttttttttttgagatggagtcttgctttgtcacccaggctgaagtgtaatggcacaatcctggctcactgcaacctccgcctcccatgttcaaacgattctcctgcctcagcctcctgagtagctgggattataggcgtgtgccaccacgcccagctaatttttgtatttttagtagagacagggtttcaccatgttggtcaggctggtctcgaactcctgacctcatgatctgcccactttggcctcccaaagtactaggattacagccatgagccactacgctcagcctagaattttttcctgattgtgaaaatatagcctctttttctactaatgggttcaaactaccaatgatctggtctgaagcaggttaaaagagtcacagtttttgttttgcatcctccatagcaccattatccaaaaatgatgaccaaaatcatcaaaatagacccttagcaaagattccaagaactcctaaagacagaccaattttcaaaataaaatctgtcagatgcattttgctttattttgtttatgagtaaagaagtatctaataagtcaaacttctggtaggggaggggcatctgttggctaaaagcaacatatatgttaagtccaaagcctgtgccaggtgctttgaacctacttttgctttaaaatatctgatgaatatttaaggatggctacatcacaggtttgttctagttcacctctactatatgaacaaaccatcacagagacggaataattctatctctagtcttccatgttttttccctctaacatttcactaaactataccaattaatatttataccacattatttgaatgtggcctgtgtattacaagtatttattttgggaccactttaaggaaatttccatagttacattgttgtgtggtctatttattgatgctcattaaaaccaatgtaactggaaaagtatttttactttctataactaactcacctgctttccctaaagagtgcctcctactaactccagagcaaaagtactcctgagtatctttatgggtttgatatgtaggtttgggactggaaatttgagggggccttgagttccacgtctcagttaatgaaattctttccagactagccaatcagcacacagaaagcccagcaataaaggcaagtaaaactgagtaatctccagaaactttcagatgccatggggaggattaagatttctccaggccaagcccagttagggtttggaacaactcaattcgggtcccaaggactttaataaaatcttctgatctctgggtcctttttatttatacatatattcatgcatgcttatttaaaacccaaaataaccctgtggaccagatagctcatgtattatttttgataaaaatctgggtaccaaaaggttttgcagttcatctatcaccattttgataagggcgacaatctgtgtcccaagatcctttaatattcttgtcatcgaacccagagacttttccaaaatcagaatatgaaaaacaagaggtagaacacaaggtgaatttcaagtgcttgcatttccaagtgatgattgttggaaatgtgattgtaagtctgtactgtgctttttaataacttgattgtgaagctggaaagacacttcctgcctctgcttggtggtctcattagattaccattctcctcaatgttggcaatttattgcagtttccctttcctatctttacaccattcattccaatgcagggaaaagatttcaaaaaccactgcaatgctcccattagtattaaatcttacactttaaatttaagttatttaatatcaaagctgtgaaactgccagatggatagatttttcttattgattatacatttaataattttatgagaaactacatatttatttctgttaagaatgattggattgaagatagcttaaagaaaaaaacagcccaaattccaccactattcaatacattcatgtaacgaacttgcacatgtacccctgaatccatgaaaataaaaaataagacatttttaaagacctatttctttggttagtgttcttataatcacagagtaaaaccttatttttaagttgtgatttcttccacacgtaaaaaaaaattctttgttgtatcagctaatttattctcatcctattcattttaataattttttctcatacttggaacatatcattacataaaataatcaccttttgcccaggataaagtaataaaagaattagaagaaacttagcccaaaatttatgcacagacatttggagtatttccatcttgtgaacttcagatttattttcatcctggcctcttattttgaaattgcttctcagagtcatcacatttgtgcctgtcttcatggtaaattgtttttagcatagcaatattctcagatcaattgctggtggtagtaatgttagtatcaatcatgtacaaacacgtaatagctgggagacaaatgagatctacctctccttcttcttttagccaggtacaatttgctcttctgaaagatgtctttactacaaagtaatatcctgggaagtctgaaaacacatcagttaggcactaagaattctttcagcccacctggtctgcagaggcaggaaggttcatctctgtgaattggccaaaaccatggacagatcctccatactactgtaccagatggtggttctgagtgctgccatggagaagggtcctataacttctatcctgccttcctaagccttcatatttttctccttcagtaagtccttctcctcttcctcctcctccttgttctcctcctcctcctcttccaccttttccttttttgtaatttcctagcccttagatattaggatttcctggttgttcacaatttgaattctagttgtttggccctgaggacttttcccaaaattgctaatggattttgcaattttttccttgcctcttaatatgactttcctttgtattatttcttttgcccaaatatatgtcacatttttgttcttctaagttgtgttcttctgttttgttttgttttgttaatgttggctactgtgttcacccagccagcctctcagaaggctgtttttgttatattcattacaaatgctatacttaaatatgtcataatttgaatgtaaatgtatcccttgtatagcatgtgtcatattttacataggtgatatgtcagtcaggatgtcagtatgaaagagttggtttacacagatggagtaattgaggagagtctgttgagggactacttacaaatgtatggaagaataaagcaaatgaagcatagtgaagtccatgggactagcaacagattggagtcattatcctgctaggcctaaagagacaagggaatggcaaggttaatggaatctggagagggctccctgatgggagctacagcatttgggacaggaatgaagttagtatgtaatgagccagcaggaagggagcctggaaaatgaaaatcctgagatgactctcccacccaactctccaagtttttaaatgcacttcctgttggctgaatccagtgggaggccataaagcaatgaatctcattgatgtggtccataaaagccaatctccaggcacagcacacagtggagaaccatggagaggagatctgaagggaaaacagaaataaccagacacatatagtatgcattgttggatctacaaaataatgttgaaaaaattgcagaggcattataaacccaatatgatctatattgtagaacccaatttatccatattgaccacttggtacttatagcaagtgactgatcttcaggggtatcttgctcagatactttgtcctctcttgaggattaaagccaattattcatcatgagattcctcactcaatgccactcaccactcaaaacattagacaaacatgaataggtaatcgtcattgcctaacactagcatagcttggaaaaaccttcaggtgaatatattcagccatacgtgaaaaagtaacatcatgttctaccaaatttttttcctcaatttatttgatgatttataacagctttcaaaactccccttgattgaggttgaacataacccttaaaatctgaaaacagccacagtgctgtggtttttgacgaatcaccccagctaaaagtcgcaagctcatgcttcttatttattcatctgttcttgccaaggaaatttgccagttcctcctggtgcaagtctcctgggaaaaatgagaggagaaataataagggcaccttgaagaaacaatgtaattatacataaagtactgtaggcaatgatgaaagtttagacgattttgccatctcatggaattaagaacaagggccctcctttccctgacagtagaaaaaagatatgaagacacattctggcacagatatgaatctttttaaatatttacttttaatcaccattttaatcctggcatttatatacagctacatggtaaaatgactgacttccctcatgaaggctgaacccattatttggctatgtcacccccatactctagtaagctgagtcaacccatcatcaacaagtcaccagatacaaattagtgacatgttgatgctattggctaatagttaacattgctgttgggcccaaatggatgaaacgtccttcttaacatctacaaataaataaccaattcatcaaatgtcactctctccacctggcacttagaggatacgttagtatagcaccgtaccgtttacaacattttagctttctagttaacacctttcaatatactcctgcttcataaattgtccctcaccctaacgcattgttcattttgatgaacagatattgtaatagacatctgttgtttttatctgtccaacatcctcgcacctttctctggaaaagagcccccatattttcctctgtataataaaaacttctcctttcttagtccacgtggtttagcttagtctaacatcccatgtcagctccagaaggcacaacacacaggcctggccaggtagctgatttcaatacttgaacccaattgggaaagaattggtcacatgctacaagccaaattaatgaactgctattccaaaattttataaacattacaggggaaaagaaactttcctttggggttaagccatcaaagagggtaatggactgtacaagtgaagatggtgaaagctctgcatccagccatacctgaatctgtagccacctctggacccttgaaagatgtgaaaccagaaattttcttcattgctaaagccagttagagttgtagttctatcccttataaccaaaagaaagaattctgattaatgcaagcaggaaactacaatctggaatgtgtccaaaaatctaaggataacataactaaattctgttacctatactcagggcttcatatgtttgtattatagttgagtctgagctgatccaattttgaaaaagataagccttccttctgttgtcatcaccttgaacattgccatttgtgtcagattcagcccccagcaatgcttacctagccattcttaagaaaatatccaaaagcacgcccactctaatcctccagtactctagggggagggtggttcatttttccacgcacaaatgagattattaaaagtttttttctcaacattttagaacaagactccccacgtgtattacagatattaatcttaaaaaatcaaccctttaaaatggttcctgagccaattgtttaaattatactaacttgtgaaaatacactttttaataaaaatatctgtagatggcggacctttcttggtatgtagtttagattactgttcagcaaatattctcttccttcaccctccctataaacagtgttgtgcttggccatgtgatttgctttggccaatacattagtaaacatgatgcaataaaagccttattgtttttgcatggcttggcttggattttaagctccagtattaagccatgataagagcacgtcttgggtaggtagctgctaccactttagcctgggctacagaaaaaaatatgtgtggaacagacaaaaaccaaactcagcctggaacctaagctgagccaacctgtagcatgaagtaaaactactcagccaatcccattctagatcagccaaaccacagaaaactgtaatgtgagaataaaatacttattgtaagctattacagttaagatgattttttccacagcactacaggggcactatgtgactgctatactttgtataaatgcacttccatgtttcatgtgctattgtataactcatgcagccagtattccttaagagataggagatgcacaagagaagtgggtccttgatctaaaatattatcattgaatgtcagcccttaatttgatctcagacacagtctaagcaaataatccccatcccaatttacgttgagaccaagagggtaaaatggcttccttcaggtcacatgactaaaatgacctagagccgacgtcaaacaaaagaatctttacttccagcctcacgatcttcccataatgccactctaacctttcttgggcatttatagataaattcctactttactttaacatctcactgtccttgcattgataatgctgtttcctctaaggactagcttatagcaaaatacagaacataaaaactaatgatattggacgtttgcaaaggttttcactaccagagaagggaggtaatgccaatttgtctattccttgtcctcagaggtaggcaaagagtagctttggccaagactgcttccatttcttgcaagtctgtattctgaaagtctgagtttattttttcatctatgctaataattatttagagaatatacttctattttcatctttttgaatgtgttctattaaatacattatttttagaagaaaaaagaactattggatactaggtttaatactttggtgatgaaataatctgtacagcaaacctccatgacactagtttacctatacaacaaactttcacatgtaccccgaacctgaaataaaagttaaaataaaataataacaataactgaaaaaaatcgctatagcaaaatgagctgagaccctgtagatcgtttaaaccagaagtcataaactcagatgactttagggtgaaaaaaaaatctctatagcaaaatgaactgagacactgtagattgtttaaaccagaagtcataaactcagatgactttagggtgaaaaaaaaatctctatagcaaaatgaactgagacactgtagattgtttaaaccagaagtcataaactcagatgactttagggtgagaaaagtaaaacacatgagtcaggaggcgggatgaggattcttgtgaactgagcatatcaggccttgttacatggggtggggagaacaacagctactaactagctaattgtgaccaagttgccaaatctttggttattccaaaagaagtcacatctctgaatttttatgggaaataataatttttaaaggattgtgactatttttattgacaccacatttcctataaaacatacctgtgaactggatgtcactggtatgtaacttctggcataaattaatgtacagggaataacactgcaataaacatggatgttcagatgtctcctcaacatactagtttcattttctttgaaaacatataaccaataattggatttgtggatcacagggacattttatttttaatattttggggaacgtccacattgttttccataatagctgtactaatttacattcccaccaacaatgtatatgagtattcgtttctctacatccttgctagcaattgttattttttgtctttttgacatttaccattctcactgggataaggtggtattttgtcatggttttaatttgcatttctctgatgttcatgttgttgagcagtttttcatacatctgttggccatatatatgtcttcttttgagaaatgtctgttcagtccttttgtccatttttaaattagtttatttgattttttgctattgagttgagttccttatatattcagaatattaaccctttgtcagacacatagtttgaaaatattttctcccattctgtaggttgtttcttcactctattgtttcttttgctgggcagaagctttttagttcaatgtaatttttttgtctgtttttgcttttgttgcctgtgcttctgagtttttatttaaaaacttcttgtctagcccaatttcaagatgcattccacctatattttcttctagtagtttcaggtcttacaattacatctttaatacatgtagagttgatttttttagatgctgagagattggagactagtttcattcttctgtatgtggatatccagttttcccagcatcgtttattgaagaaactatcgtttccccaacgtgtgttcttggcaccttcataaaaaatgatttggctataaatgcatgaatttatttctgggttctgtattctgttccattggtctatgtgtatgttttatgtccatcaacaggttagtggacagacaaacggttagtgctatcggtcatgcgatgaatactaaccaacaataaaaaggaataaaatattgttacacattacaccatggaaaatttcaaaataactgtgctgagtgacagaatctagaccaaaaacaagtacacattatgttattccctttatataacattcaggaaatatgcaacctcatctatagtggtataaagcaaagcagtggcagactgaggatgggtggtgtgaaggggtgggagaagtgtgggagggagccataggaaaatggcatgagcaatcttttggagaaaatggatatattcattatccgactgcagggattatttcacaggtgcatacatatatcaaaactagttaaattgcaaaactagtcaaacttcacagtttactatatgttaactataccttaacaaagctgttttgaaaaattaaaaagaaattaatgcatagtgaatgtgttattagaactttaaaataatctaactaggtcctatattaattataacatctggattgtaggattttaaaagagaaaataaatctacaaactaggattgagtgactaattctagaaatatctgtttgtaagggtgtactttttggttcactccagtatcataagacaataaagtaaatatcatatagtgaaattccctaaaaatagacaatgccacgttttgccaaaacatctatgaaagtatagaatattttcaaaagagtggaaaatatctgagagcacagccataaatttataactgttcctctagcatgttaagtaacattatacatcaatttatctactcggggtaggtcgttcaaactgatactaaatagtgtataattatccaaagcattcagatcaaagtaagtagtttcctagaatcttatgtttcattataatgggcagagtttaccttataaaattagtgtacacgtttgaatgtattaaattttattttacacataaaatttttatcttttaaaattcctgtttatatttgctaacaaggcatatactttgttctctctgaattatttctgagttataagtagtttgagaaacacaaaaaaactccttgttgaagataatttccataattatttaaaaagtacattgagaaagatttactatggtttttaaaagatcatgaaaaaggaaagagaaataacacaaggtagagaattcatgaatagataatcactttccgcagacaataagcaatgttccaataaaccctgagaaataactaattacttttctaagtgagcaaacattattctgtagtcccgtagacctgaaaaggaatctaaagatagtgaatagcaatgtgttcctaattttcaaaagaagattaaaagggccgctcgtcctcattgtttagctgcttcaaatcctatcaaaataatagaacctaaattagcaaaagaagcaaattttcactgtcctggaaaataaggaagtgagaagtagcttttgtttgtgaagagatgattggtctgagtaaattggatgactttgatgaaattacaaaaggaatataacccaaagcactgtagattcaatactttgataataataaacacttgaagccatataaattctcttcactatattaatttaagatggcttaaataataaaaatcagctgagaattttcaactgaaggaaaaacagagataggttatttaaggaaaagatacaagttggtgaaagctataggaattggaggtaggaccaactgaatcacagtgatttagaagtgggtgcatactgagaaactaaaatttcccaagtatctgaatttttagttatagcaaatgtgagagtatatgtaaatactagaggaaaatgaggtgagttcttggaaaataagaatagtctggtggaaaaaaaaagacttgatcaatgctgagttcaaaattgggcaaagatctgtaaagtggtaacgatatttcagaaagcctgcatatgggctggaatggagggaacagacagggcagggtctttaggaataatccattgaaagggttgacagtcaatatggtttggctctgtgtccccacccaaatctcatcttgaattgtactcccataattcccacatgttgtaggagggaccaagtgggaggtaattgaatcatgagggcagtttccccatactgttctcgtgataatgaatacgtctcatgagatctgatggttattataagggggagttttcctgcacaagctctctttttttgcctgctgccatccatgtaagacctgacttgatgctccttgctttctgccatgattgtgaagcctacctaaccatgcggaactgtaagtccaataaacctctttctgttgtaaattgcccagtctcacgtatgtctttatcagcaatgtgaaaacaaactaatacaacagtacaatatgacagtagagaattgttcctacctgattaatgtaccattactgcatttaaaatgtttgcaatgaatgcagcaaaaatggcaaagcccaacctgatttttaacaaggctgtattttaaattgtgattttcagtggtatataccctatttctctccagattacacatcccacacaattgaagagaaatcaacagaaaaattagatctttctccagtagtccaaagaatattcaaaggtttgggggactctcctacggctgcttctggcttgctctgtacccccagtggtaggttttccttggcatgatgctctatgaatccaaagttctccttttagaagtacatctaaatgtgagtatcccaatcatgcctcaggtggttttggttttttaaaaaatcacccaaggtctcttgatttctagtattaagccataaaatgggagagttctagtcttgttttgcaggacaacatcttcaaagagactctgggggcctgtggcacatctgagccagaaccaaacacccgacgtcattgttacagatacaaaagtaaataaatgaaaagaagctccaggtattggtgatttttatatctcgtgctgtcaatctgtttgtgtcagttattattttttcaagtacacaaaactgataaatatgagaccatttgggggaggttacacaaaaataagtatgcctgttggccacaatatgttattaaatagtattgtggtcctcagcatttctcaaactattgatgatgcttcctacattacagcgtatgttttcacaactcttttgaaattatagactttggctctgaggtatctaatccaacagtctcttttcacagatagaaagatagagactttgagaggtgcaatatgttggcccacagccaagtggtatacatacctagtactagcagagcctgcaatagggtccctggcaacaggcttctaggtctatcctcaaaatgtgctgctgccattctctctactgtccaccttgactattgttattggaaaaaggagtttgagaaatagttgtctaaaagagcaatttgtgtgcacacatgggtgtgtattagcatttcaaataacaatgtatcaatagatatccaagggataaatacatttcctcttccacttgcttactacattgttgtgtattgaaaatttagtatttgaataaccaaaaaaattatctttccatttgctattctgtcctgacaatattatgatgagctgtattttatgtaaaccactaaagaggacttattttaattagtcattcaggttttatatcatttctggccaattttacacagttttagttatttaaaatgtagctatatgagattcaacatttaccagcatttcatatttggaaactatttaagaaatgaagtggccaggcgcagtggctcacgcctgtaatcccagcactttgggaggccaaggcgggtggatcacaaggtcaggagatagagaccatactgactaacacggtgaaacatgaaaaccttgtgttataatcaaacggatggactatgagggggtaagctgttaaacaatagagtaatagaaagggggaacaaaggcagaaatgagcctctgagcagtagtgagctgaggggcccagagttgatctgtttccctttattaatactttcaccgtgttaatacttttccagaaaccttgcctccaccatggccctaagtcctaacagatagcttaattttcttagaggaattcaaataacaataataaataatgtcacatagacttctaatgttttaataaaaaccttcagcaacgcccacatttttacgtgacaattttttaaagggctatgagggagccaactatgtcagcaaacagacatgctctgaagacagggtggtccatggcattcaaagtgtattcatttctaccgatggtgcttttcttgcataggttctgacttgtgtagatttggacttcaagctaaaataaaaagagaggaatatgtgtatacatgagaatgtgtgtgtaacgtgtcgatggtataaatagtctcttcctctctctctgaattgcatgcacttaagcccctaagaaaagatctcttacctcttatctaagtaaagcagaattttgagctttgaagctaaatgatacaatgagatcagtgtaaatactctttaacacaacaatatttgagtagctttgaaacagtcgtcctcatttcgttacatacagaacgttcgtgcttcctccctctcaggcaagaagcggagtccgtcgtcagcagttagcagagtccagtgcgagtgcacgtttcttaaccggataacttagttgcccctgccccccgtcgctgcgcccgaattcgcctccagtagaagacgttcagcgggcgacttggcccggcgcctgggatcggtggctatgcgttccccaactagcaccctcgctgtccttgtgcagtggaacgtccccaggtctgagaatgcacctcccgccgtgtccaccccggccgcgtctctcctgaaggcagatcttggaggtgcagccaggactcctagaggagcctcctccagtcaccatcgcgggtggggcgagccgggtctcctgctgggcttcccagccgcttcgctccggacctgcctggagcctacaaaaaacaagggctcgtccttgcactctcgccccccatggatcacccctagaaggtgctttccccaaccctcctggtgccaaggagagcaaacctccccggggatttgcccaaagtggtgggaggagggttaatatttgctttgttattcggataaggggaggcaagtatgccttgggtgtgtgtgtgtgtgtttgagagagagagaaagagagagagagagagagagaggtgtttttgcagcgggaaacaagcaggaagaggcacagaggccggcgcccctgctcccctcggggcctctgagagcggcacacaccgtaattcccttcccagagcctacagattcccacaaacaatgacatcactccgccgccgctggcctgattacagctggggggattttcctgggcgcgcggcgggccaggctgagatgggggagctctccggtgctgaaaggggcgggggcgcgggctcgctgcgctgcgctgcgctgcgctgcgcccccagaaggcggaggcggccgggccgggccgggccgggggtgggcgggggcgggcccggggcggcccagggcggggcccgccgcttcccccgccctcattggccgctggcggactcacgtcacccgagctggtgctctcccccagcccctagggaattggagctgaggaggagctgaaaatgcagatttagcatcaagcacagacctacactcgctctttctctccggtacacacagctccccacattcgcacccctgcccgcgcgccgggccgcctgactgcacggcttcccctccagccagatgctggagaacacacactgattcgctgctttccaagaccctgttcagtctctttctctatacaaagatttttttaaaaactatatataagaattctttatttgcaccctccctccgagtcccctgctccgccagcctgcgcgcctcctagcaccacttttcactcccaaagaaggatgaagggtggttgtgtctcccagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccgaaaggtaagctctcccatgcatttcgcatgttgtttcaaaacggggggacgggggggcagccctgcgcaatctcattgcagatttgcaagttttctctctttctcatgcgatgcagatattctgccatgggctctttaacacgatattgcctccggtgatctttcaccggttatgtaattaaaatgtccttcatctgtactagtaaggtcatcaaaataatttactgctctttgacttgatggcgaaaataggataacacctttcacaggatgccatgctccggggatgctgtccgaggtaccaagttctcgaggctgcctggggatggagggatgaagccctgaacagctaagcctggcgttggctacttggccagggaagtctcccccacccccatcccccggagaaagaatagtttcctacagacgaggctggacgtttggacactgcaattcacctcggtgtttctcccaccccgcgccgggaggacttccctcccagggacttcggtccctgctcctctccgggaacaacggcttcctgactctagatttggaaagaaactggtctctaaaatcggggcggaacttctgcgccctcacccccgcccacgaccgcccacccctggagcgcacttctggttggctccctagttctcaactcccggctacaggagctggagaggtggattttgagggggattccctacggagaagtcgaggtgtcctctcctgatgcgtgggcggccagcctggctttcccactagagcgtggggatccccattccaagaagttgccagagttcgacagtttgagcagataggtgagcctcccagctttggacaccttggatctcctttggagactccagggtactcatcctgggaggacagagagaagggcgctgggtgggggctgtggctgacctgcgtgtctctcctgcaaaagatgtatcagggttctccagtgtccttaggggacctggcgcaggctggggtggagtgtgggtgcagagagaaggtggggcgaggggaacccaaaggacagagatgtggctaccagagggctgggtggaggtccctgagattttaggctccatctcgctcctgatcccaggaagagagaggagtgagatgagcggtgggtgcttttggttattggttttgccttgaagggccgcgcagaccgaagctcttattagtctcttctgtcctgacttcccaagcctcccgcctctctcccagccaccgccagggctcctccaggtgtgggggcctctccctcctcctaagggcgtaggcagtaccggaatttcgaccccagaagggtctggcgacgagtttgacagaggtctgggaagaggctctgggtccgccggtggcgcgcgggcgggtcttgcggaaaggaacttgttgctctggaaagcgtgggtggagcaggggaaagaaggcgccggcggagggagcaccccgctgtggttttggcccgtggcctgccggctgttttgagagacaccaacacaataaagaagccgaccttccttcttcactcccccccaccccaaacttggcaagacccaggacccaaacgccattataaaatataatagtgattattattagttatacggaagcttacgtgctggagtccttacatagatttttacttaatcttctcaacatctctgaggaggctactatcattattgagcctatggccccgttgaggaaattggttcagaaaagggtgcgagataaaaacaggcaagggcttcaatccagatctttcagaagtgaacccatgctctttactccttagtacccacccaagcaagctaggtgctttcaggggatgtggggcattgagataagttgaaaagggattttaattcttgagtgtgatcttgctgcagaaacctgtggctccctccccctcccccacaccttttcatgggtgcgggggagtgggagggagccataggtttctgaaaaccattgttctcagtggttttctcttctctttgctgccccctttgaaaatgtgcccttaggatcagagatcagataactaggcctctttgtccttcattctttcttggagaggagcacactgattttgcatcacaacctgaaacctgcagttcccatctgagagacctctctccttacttctccataacctctcaggtagtaccccacaaccaaatccagtgattttttttccccttttacacgtttaagtaacagggactgcctggtgcaacatctgcctagaataaacctccttttggatccatgtcttgtccattcttcaagacctaaattcaaacctttcctgatgctacagaccacagtgagctttccctcctccaaatttttatgcgactgataggcaaacactgcactacataagctaataaatgccatcacttttcctcattatttcaggtatataagtaaatatgggttcagttgttgtatttctacttaaaaggtaaatattcagggatgatacctcctatatttctcatttcctccctgtaaccagcacattactgttttgccagccttgaaggaaacttccttgtctgtatttattatcccaggtttcccagacaccgtcctatcttgctttcatcatactgttttgtacttttgccaacatttgttattgtgcatcttagaggcccttatgtccttctccttccttgctctgatgcttagcatgcttcccaactccctactgctccctgctccgaggctcagtgtcagacacaaaagattctcagtggttatttattcatccatatgaaaggtcagcaatggaggctagaagaacatgctttcttattaaattatctcattctaagctcacaaatctatgagagaaattactggcatcagctgtaattctcagatgaaaaccttaaggccttgagaagttaagtatctgcttatatctgagaagtaaaagaactcagacttaaaaccaaatttgcttaactgaaaaataattgcttttctacatcatgctgcctccaggaagccttccctgactgccaagaactcttcccttgagacacaattttagagctctgctattttcccttttctttttacttttattatatttatcatttattttctattaacacatgaacatgtcattagctaatgggtacgtgtatttatgtcttcaggtagactataaatcttccaagaggagaaatgacatactatatctttatatagtctccatatctagcatggtggcctgtatatgaatatttaattgtttgtcaattatttgattgattcttataagaccatgaacaaacatttgttttctctctaaaatgaaataaaagcacctataactttacctctgaaaaggttatggagattaaagctttctattttatcatgacctggccctggcccaaagacctatgtctatcagaaaagatacttaagtctaggagagtgaatgagtttacagtaatgacaaaagcattattccaaagagtgccttaaaattctcaaaatgctactaattttaattgatttgaaacagaaaacaaaaattatttattgaagcaacctgttgaagattaaccaaaaatcaagtgagagttagggtttaaaaagaacctgatattatcctaggggtttcattgtattatggtgtgttttatgttttatccacagaggacagatgctgaaatgattacacaagtaaaatcatgtgaccatttttataatgtgtgagaattttttaattttgaaaacaacctaataatcattatgctgccaggtagtaaaaaattaataaatttctggtcgcttcacttttattaaagtataatttaggaaagaacacagcttagggaattttcacaaactgagcacacatgtgtaaccagcacccaaatcaagaaataaaatattaccagtatccctaagtccttttctcactcacttgctttgttttcaggttttagctattataaatatagcttttgtggatattaaagtctacgtattttggcaaacacatatatggccttctacagggaatcctagaaatggaattgttgagtaaaaggatatgcatgcatacagctttataagaccatcagttttctattgctgtgtatcactaaaaaacttagtggcctaaaaccacacaagtttgttatttcacagttttcatgggtaaggagtctggcacattttagttgggtcctctgctcgagtcttcacaggctgaaatcaaggtataggctgctgggtcccatctagaggcatgaccaagaaacaaccctcttctgagcattttcacggctttaaaggaattgagtttcttgtggttttagacctgaagtctttattttcttgctggctgctgggccaggaccactctcatcccctggagacctctccatagccctctcacacctcacccttcaaatatctgccttcaggaagagcccactctccttgcaaggttaacctgattcgttcaagcccaccaggattgttttccttttggttcttctgatgaactcagagtcaactgatttaggactttaataacatttgataaatctcttcacctttgcgtaatctaatcacagaagtgaaatctatcatcttcacagtcccacctaggctgtccacactcaaaaggaagatgattacatagggcatgtacatcagggagcagaaatcttgggggccatctcagaattctgccggctacagacaaacagccacatggctttcctaagtagttataccaatttacattcccttcagcagtatgtgagagttccagctgctccacattctcaccaacactagatattttacatctgttttcttttagccattctggtggtatgtagtagtgtctcatcgtgactttaatttgaatttccctgattatcaactgaagttaaacacctcttcatatgcttattgatgatttggatatcctcttttaaacacatttgtttcagatgctttgtcctgaaaagtttttcttttgggttgtccatcttcactttttatttgtaggatttctttacctatgatggatagaaatttttggtcagatatatgtattttgaatatttgataccacccatttaatgatatcgtaatgtcacaacaatgttcaatccagattatatgcttttacttctactttgtcaggcagccaattgtaagtcaaaggaagaattatcttgcagtatttccacatcccctatcccaaagttctttagatcaaaattgacaatatttggaggaaaaaaataaaaacagcatatagatttgatcataagcattccctgaaagatttcaatctaagaagactttaagggacagttcttctggaactaaaagattttccacagtagctaagggaaaatagcaacctgtaaccttgcttccctagacatggctgccattcatgttgtgccttagatcgaatccaagctaatccctcaagacctgtctggttgacctagaccacagtgttctctatccatttggtgctttgatgatgtataatcgattcctttccctgataccagtcatagccatcagaacgctcactgtccccaatacacctcttgtggctgaagaaaatgaggaacaataatgttgaaaggtaaagatgacaggatttggaatcagatagcactggaaacttggctaggttactaaatctctcagaggctcattgtcttctgaaaatggttaataaaatatggtggctgtgaaaaataaataatgtagttagtgcatgtaaagttctgggcacagcactgagtgcataggataaaatagctattactgcagtagtaacaataagctggttgtgcactagtgacactcttttcctcaaaaaagtagctgtgggttatacttgtgagggagtgacaactgattgagtaaggaataggaacccagcccagcagcaatccacccatgggctagtcatgacccatgagatgacctggcccaaattcagtaaatttaattcattatagaccatggtaattatctcagccaattatactggattcctcaggaaatctgactggctagttgctctagagaggagaatgcagtacagttaccatgagaaagcccattcaggccatgggaaactcagacattttatctaagtttctaatagctttccaaccccagtttccagcaaaagacgcctgtaacaggctgaagagctaagcaccagattcattgctccttcttcatgggctgcagcaagaccacatttcccagcctgccttgtaaataagcgtgatcatgtgacaattctagcctgtgtaatgcaagcagaagtcatgtgtacttcttccatgcctgatgcataagaattctctatcgattgtttctctgtgttctgctctcctctggggcttgatgtaattgagaacagtacattttgacaccaaatgccaaagcagcatcacaagatgaaaggagcccaggtccctggtccgtgaattagaagaccttatatgagtgagaaataaactgctattacattaagacactgagatttgggagtactgcccaaactaatatgctgtcagtaaatatccctttgcttaagttgctagagtgaatctctaaacctcgaaggcaaaccgagccagatcacaacaaaaattgttccaaagttctgtgagagcacacatattttcacaatatactaccaaacaacttttcaaatatttgtgatttgtcttctccagcaacaaatagaacccattctacacactgttcttcctgctggcaaccaacgtgccctactcataataggtgtttaatatgtgctccttgactatgactacagttggaccacaaggtggtgatttgtccataatctcaggttgaaggtgctggaaaaactattttttaagaaactgttcctgtagaatccatttctctataggcagccattcagctaggaaatagaattaagtgacaaccagcaagtgggcaactggcatgcttctttgtttctctaaaattccccaacttcgatattatcagtagtagaacagatgagctctttgaacaaagaaagtaaagtctgcagttacaacctgatcaaaatccaaaagaagggaaagaggggaaatacacctttttttctcaattgaatgaatatctagaaatcaatttctatttcagaaggtcttattagctatagatcataacgtcatagcacatcagatagtgatgctatagttaggttcacaataattatatattccactcaaactaactgctcaaagaggtctggctttaagaataaaacatgaaatctgaagttcaatttttcattgagttcagatccaacgtttcaaaaagaaactctgtgctgaatttgtgaattattatttgagatacaaataatcacgggacagctcaaaaactgacatttctatttgactttccttattaaggtgtatttatttagctaaagtccacaagtgattaagaagtcaagaaattacatctgagtcaacacttcagtctgaaatgtatagttgtgtattaatggatggtttatatgcgagacacatatgaaaataatttaactgccttgacaattttttgtcactgaagctaatttgaccacaactttttggaaattgttgtgatgtgctgagattgtcgataaaaataattgaataaaacaagttcttacattgaaagtagaacaatgacacactcttaatttcctgacataaagtagacttcagactgttacagcgtattggcagtttctccattagaaaattgacaagaatggggagaaaactgtaggatcctggggttgctctttgtttacaactttaaatttgacattaacttccataaatatccaattgttctcctagtttttcctaaatagattcatttcatgctcattttgtatcaaaggcaaaagagtccaaagaaaagtgaacaatatacagaatcactattggaagcatcaagaacataaagataataacttaggtttaaaacatttgcaaagtgttgtaagtcattagagaaaaaagttttgacctggaatatttgggtttcactcttctaaagttttaagtagagggcaaagagatggtcagccttgctttctgtgtaaacacagtgtctggcaaaactaagtctacaggaaatatttgttgaatgaattacttgattgatgttggtattagatgtagtagacaattgaatatctttcctcttaagatttaaacaatgacacacacaaacaaaaaagtgaatccttccatttgtgagatggtaaacatctcaatgtcaagacagtatttttacacattgcaatattcatgaataccgtgagtggacataatcaaattaaatcacgagataagttaggaaccctgataatatgaaaaatgtaataactttgatatttttgtcagaatcactcatcattattttaaaaaataccaagtaataaaaaaatacaagaaggtcttttttaattatctcaaatctcattattcagaaataaccattaccagctttagataaactctattgcagatacttctgtatgaatatgtatagagagaagagagatatataaattgttttatagagctgagatctcatcatatgtgctattttaagttttaaatcattcagtttaattattataaaatttaacagaagagaaaatcaaaagaaaactatggaaattgttaaacttcagataaatatgctatacaaaggagatattatttcctaatatacctccctaaaattcataagaaattattgtgtctcatatttaggagtttgtagttacatattttatacatacatggtagataggttacatatatttaattacatgtttacttatttaattacataattcaacttttgtgagttatggactcagtgctttgtaaaatggggaaattagcatcctgacactttctctcagcttccctacttccacattccaatgtttgttaggtatatcattatttttgcattgtgttacatataaatattaaccttctactaataaccataatttatagtattgcttatattagttctttcttaaaattctaatgttaccacaagtccttttatcagaacttcaattacaaattcatttttattcatcttttgagtagctaggttttactgaaacatgaagaaattagcctaagcatgaaaaaggagctgtctcagtttcagattaaaggggaaaaaattggcaggggaagtcctgtttttaggtcacagaggagaatgtggtgataatatccacttaggaatcacaattatttcagaggattaagaggcaaggtcaatgttcagagggaaggaagaggtgttaggatgggggcttcaaggagatggaagttcagacactgctagtagacatgagagagggagtggacaaaggacagatcatgatttctgggcagtactgcagaggcaagtgggaaagaatggatttatggtggcaccagcagacatcttaagaatgtcttaagcaacattcagattagggttgagaggtgagagaaatggaatcttccaaataatagagtgtcaatgaaatagaagaataggtaaattggaaataacagtgagagagatgaaagggagagagctatggttggtgagtgggatattgaagctcaaggctccaaaaattgagcacttccagataatgatgaagttcatggaagtgaattatcaaagtaaaaaggagatgaaggtgatcaagacactaaaagtaacatgcacaaggatttgttcacatacacctcattcatgctatggcaagaaataggattgtcaaggaagactgttgagagaaaacaaagcgaagtcctaggacaaaatgttggagaactttggacatgaaaggagaaagaggaaccaggagaggagtcagaacttggacggttagagatatggaaaaagaatcaagagcacacaggcctgtgaaaggaaaggaggagagagttaagaaggaaagaaggaagcaacctcagccactggttttagagacaaagtcattgttgaaataggaggagtcaccctagcacagtggaagaggagacgagtgttaatttgggtccccagatgtaggccctggaataaggacttaaatgcaagtagtttacttaaagagtgattctacaaaatactggtagaggagtggggaattgagataaggaaaggaaggcaggaataaagggtacatcataaagcaagttgtcactgtgggtaactggaactcaatcccactggaaaactgggagctggtgtagaatatgtgcttcagagttatcctgcctgaggggtgaggaagttggggtatttatacacgcattgcattgacatattaattaatgattgagagttactccaggctgatgttaacactccagcattttgtcctggcatatgctcagacagagcagaatttggccatccagaaaaatacttgcaaacagatgcagaggctggcacccacaaaatggtaaggcctatccaagaggatctgagtgtgaaagtaaacatgtctgctacaggaaaaaagcccaatcatgaaggaaagcatcaagtgtgatgaagtggaggtaccaaatatagaccatcccttcaagaggtatagtggttaaaatagaaaaatagtgttacagtcacttgatgtggttttaaaggtatttatgaattaataatttcttagcacttgtcagaccactggagattgctatcccaccagaatattgtgacatacctagccaatcaagtctgcattactctaactggtttttccagtcatttacatttttacaaatgataattataattatgaaattacagcctttcagaacaggaagggatcctagaaagacattaatttaacccttcatttaataaatgaaggaaataaatgagggaaagggcatcgaacactatgtttgtatgcttaactattccaaaaagcatttgagccttgttgctcattggcggtggtttagacaatgcattattgatatcactgaaccagctttccagactggatgagatagacaactagattgggtgagactcctataagtgattagccacatacaccaacttggtctgaccatactaattcatttcaggtcctcctgatgtgcttttttggtttgtttttttaccattttacccgtagaatttttataaattctgattttccaaacaaagctattcatagactcaaggattccacaccaacaaccattgggtttacacttggtaaaagacagaataggaatttatacttccttgactactcccttagtgactaaacagtgctatatatttagtaagcactcaataaataccaaaataaatactgagaaaaaaatttaaaggcttagcatcatcattagattttcactgcacacccagccgatgtctcatgagatggtgcaatcaggaaaaccaagtatgctaggaagggttataggaacatcctatttagtgcctgtgttaagtggatttccttaattgcccttaatagcctaaaattttgtgacttaatcattaagaatccagtgacagaggagaataaggtgacccacaaatcctattcctctttgcctttagcttctcctctatttctgtgggaagaaaaaatatcacttttatcagggcaccaccaattctcttcagtgatgatggaagctcaaacccaagaaggtagttgacatccaagagtcaattctagtcagttccagctgactatgtttctaggaactgtcagccaagaatgggagaccaagagagaccttgaagaacctaaaatgtgggaagaaggatgggaaacaagccatttgtgatctcttgaagttcagtagcagcactttaggcagaggagaagggacagggatccttggagagttgtgtcttaaatgaggtttgtcattaacccaaatttggacccagcagccgaagccagaaacaaaccattctggccataaactagaaaatgaggagaggaccaaagaagagttatgggagtttcaagccaatggaccaagaaattagcaagagctacagtcataccacagggacgtatagaaggagaagattattaaggtcattcaacaaacatatactgagtaagttcagtaaacaaacataatgcaacacactaagacatggatttgggaacaagtaagcaactgggattcaatcttactggcctaagatgattccaatagatagatgaaaaatcaaaccccaaggtgaaaacactttttttttttttttttttttttttttttgtgagatgaagtctcactctgttgccaggctggagtgcaatggcgcgatctcagctcactgcaacctccgcctcccgggttcaagtgattctcctgcctcagcctcccaagtagctgggagtacaggcgcacaccaccatacccagctaaattttgtatttttagtagagacggggttttaccatgttggccaggatggtctcgatctcctgacctcgtgatccacctgccttggtctctcaaagtgctgggattacaggcataagccactgcacctggcccatgaaaacactttttaagtctctgcttgtgttgcatttactaagtttcattggccaaagcaagtcacatggccaagtttagagtcagtgtgggaggagactaaccaagggaatggatacagggagatatgaacaaaacatggatccaatttcctactacaggcccctctgacagttacaacttatctgtgttgtcccatcaaagggtgaggaggctgggatgtttaacctccagctaccatttcttcttggttgatggttgctcctggggaacttcaaatctctcatacttctgcctgctgtaagtagaccaagcatgcttccactgccagagaacaccctcaggagagcggtgcctgaaagacattggcatctgtatgtactctgtacaggtgacctccagggtggaccaagggaaggcaggcagtgcatcaatatcatgtgctacacagaggacctaaagttacataaaattgaggttcgtcagaggctagaaagaaacagtttgtgagtgaggctgtatgtcagatcccctctacgtgtctcattacctaggtgtcactctagacttgatataaatcagtggttcagtctttagggggtacatcatagtttgaatcccattgtggactgttagcccagccctaaaatagttggtgtttgtggctaatccctcataggagtgtcacacaatctagttgtctgtctcattcagtctggaaagctggttcaattgtatcaacaatgcattgtctaaaccacagccagtaagcaacaaggctcaaatgctttttgcaatagttgttaggcacataaacatagtgtttgatctgctttccctcacgtataaaatgaagggttaaacgaatgtctttctaggatcagttcgcgctgattacagacaaatgggagtgctccatgtaaacaagtccagaaagtttttgtgatagatttaatatatagtgcatgtgaggccgtgactgtcagcagaaggaaagtcttcacaaagcaggcaataatacattgaggtaaatttacaatgaggcttataatttcaagaggtttaaaggaagaggtttataaagaaaaccacaggatgtgcaatgaaatgggcacggtttttcggaggattgcaagtagttttgtctgtctagatgacaagagactgggagatgaggccaaagaagtgacctggggtcagttcatgaccagtcacccatactatgctgaggaatttggattttgcaggtaggtggaaggaggcatcgaagggtacttgggaagtgtggcaggatggccacatacaggacatcctaggataagaagttgagctaatagtgacttggagaagccttgatctctgcctggtttctttgtcctgtggaatcactaattctggcaacaagtagcacatcatttaatagatgatgccactaggaagtcaggttatatgtctttgattccattgtcactggatgatggcatcagtgatactaatggcttgattaattattgtccttgtagtcacactgaacggctggtagagcagccagttctatccatgaagattagtccagctaagaacaaaacaattaaatgcacctcccctgacatataaatatatgaatgcagaacaaatcccgtaacttagaagccaagaagaaaagaaagaacagtggtgtatcaccatgatcctagctcacctaataggcacattactccctgatattccaaagaaataatgctcatttttaattttttctttctggaatgatatatggaaatgttgcctgaggctagaaagaaagtttgtgagtgaggctgtatgtcagataaccactacctgtctcattatctgggtgtcattctagacttgatataaaacagttgttcagttcttagggggtacatcatagtttgaatcccactatggacagtgagctcagccctagaataatggataaccatggacaacacaagctgcttcatactgttttcctgcttatggggaagagtggatcctggaattacagaagagaattgagcattatccgtggagaacaaatgcttaggaatggcataggagtaggcagggctggcttacagccaagtgtactgagtgctaagtcagtgacttacccctctctcccctagtttcccttccacacagcctcttacaaatcagctaattacagaagaacattcatacatgagttcttattttattaacaagtgtgtgttgagccctatgaagatgaggcacattgaaaggggttgattctacagacagaaagataacaggttcaagtttatgcccaaggacaagcacacttatagttctatagttctatagtctagtttataagaattcatacaatctgaggtctctattttgctattgcaaatgtctactttatgtgttggggtgtgacaaactgttttagcaattggtctctcgttctaaatgcaaaggaccttctcagaccatgctaacctggtgacacatcctaataagttgaggctgaatgagatcttttgtcacatctggttactcaaagacatgatgtcctcactccacaggccttgtgctattgagagaggagctgaagtcacacataaataatttaggctcctccactgcatgaaaagcatctgtttaaggagctgtcaagctgtccacctctctagtgaaatcatatttactttattcatctaaataatgtggcttgtttgccttctgtgtgaaattgtcttgcactgtttctcattggtgggttttatgggacagcatatgattttctgtgcatccatatgccactctacctctgggaatggaatggcttcttgttcagtagttttgattattatagccctttatagcttatgagtcattgggtttactcaaaatgtccagctcctcattctcatttttttctctatggcccagccatgcccgtcctgaaaaatttttaaaaaggaataataaaaataaataaataaaagtcatgtactctatatttcatttccaatgagttgcttcttgtttgggtaattttttattgtattagagacaaggccttactctgtcacccaggctggagtacagtggtatgatcatagttcacagcagcctccaactcctgggctctagtgatcctctcacctcagcctcccaagtagctaagactacaggcacacaccacctaatctgactaggtttttattttttctaaagacaaggcctggcaatgttgcccaggctggtctcaaactcctgggctcaaatgatcctcctgtctcagcctcccaaagtgctggaattacaggccaccatacctggccttgtttggataattatagcaataggagtccaccgaagtaagttgtgtttttttagttatttggcattctcacacttggatgctcagaaacatgtgagcaaatagcactgaatgtacccacaattatgtcttgtgctcagtttgtaagtcactattacgtaggtgagaccagagcagttactgtgaagtggaggtagctgcatttaagactgtgaacagcgcatcaagaagcacacaccacaacgtgtgtaatgcccctgccatgatacatcacttcaatctaatgatgagaaagcagatgatcccaattgagagacagtctgcaaaataactggcctgtactcttcaaaagtattaacgtcataaaagaaagacagatagactaagaaactcttccaaattaaaaaaagaaatgacaaccacatgcaacatgtgatcttggattgaactttgggccagattttttatttttttttccataaaggatgctattaagacagttggcaacatatcagtgatgtctgtaaattagaaaatgatatcacattagagttaactttctgatgttgatacttatactgccttgttcttagaaaacacacacacaccatctacaacttattctcaaatgattcaccaaagtaatacgtatatgtaggaaaataattttttaaatgcagtaaaatgttaacaattggggactctgggtgacatggctatatgagttattttcactattcttgcaacttttccataagtctgaaattatttcaaaagtaaaaaaattactgctaaaagaaaaaatgtgtacattgatgcaaaactaacattgaggtctctccctctatgaaatagagctgggttaaactttgtcaccaacaatgggtttctgtcccagctctgccactatagagcagtgtgaccacatccacataattcaactttttgaacctcatttttctcatctatgtaatccagatgtcaactagaaatacctggacccttgagatgtagataagatccactcaaatccccataatgtaccctgtagaagtcttaacccttcccaatattcctttaaattctaggagtggagctagattttcgttttacttctggatacagttttctacttctaccaaaactttccagttaataaattatgtctccttcctacccaaacaatcattcttcacaatggttactcaagtgtaaaattcagccaactcccttgatttcccttcaccaaaaaactcttaccattcacccaaggcatctgtgactagaatgtattttcctgaagatgtcacaggtgccaggaggggatttatgttgcaaacacaaagaactttaagtaagcacttgctttgaggagtcatttcatcccctcatcactgggcacgggcggtggcctcttcctgcccagcctcacatttcttgccagatcctcgccaccttcttttatctgccccttggtttctttagtatctcctcctctcatgggtgtgggcagattcttcccaggcagagcaggtcagatctccttgctctctaggcacccatgacctcaggtacccaccaaccatcacagaattatcccaaatagagacagtttcctcccgaagaagagctcagatgattacattctcaccctcagagtctctgcaaagtgagacatagtgctagatacacgtggaggtcatctccagtggaaatatgctgagattctatgaagtgcacctgctttaaaaaaatggaaattactttttcaagcagacagatatcaaacacaagttcctttcctctagccttgttatctgtgtggaatttaatagggtaccaataaggtttcactaacaaattacactttatacgaccttgccaaatgcagcattcttgtgggttattctagctttttaaagggatatcttgcttgtgaagatactagcatgtaattttctagcttagacatctacttttcacccccttttctcctttatttagaaataactctgaacccaaagctgatgtttgggagtagttaacttcttctcttgttttctatagctgctccaaagagcttggacctgactacagaccaaagtaacagagaatgctagcctcatctgtaattgataggatttttttttttgctagaatatctgagagtatttttacctcgtgttcaatctcatgagtttcttttcattccatatctcttatgatgtgccttctgtcttgtgcttagcagagtcctagacagctcagagctaacaagtgcaatgtgcatcactcattggatcacaaattgagtttggccagcacaatgctttcaatctgtttgacttgtggaggagcacgtaccctccagtttaccacaatcctcaccactttctattgtcttttacctgattcgcttagttagacagcctgcttgacccccaatatattaaatgtcttaccaatgcccaaagaactccataaccttagtcatccacactgaatagcacaactacttaataactcttgctagaatctagaacctcctgatctttttaatttactcagcaggtatctatgacatgatactctgcacctaggacatgagcaaaaccggtgttgtccccatagagcttgcaatccaggcattccgaggactgtgttctgagagataattctttccagcataccaagataattttgaaagatgaatatttaggcaacatgtcagtacctcaattttctttttcatttaagattcttctgctccctactactgtattcgaaaccagcctagtggatggctcttcctataagcaagaactatttccttactataaagtgtgtacaatccacttggctgtgggttggagcggctctattagaattgactggggatattcagttggaggttgacaatgagaacacgacaaggcagatgatcagagaaattacagtaattactcacaatcagtcttcgatagtaagtcacaaaattaaaaaggagaatgtaagtcacaaacgtaaaaaggagaatgtaaaagtatgaaccaagagaggttccatgttcctggtttaacagtggaatagtaaatgcaggatatcctccagaaaatgcctgaatgaatggtgcctctactctctgctatggaagttagttgggtccaacgcattccatgggggacgtggtccaaagtggacctgaagagtgtggtctgtcccctagtggtcctaggctgtcaatcagactatcccatccttgcctgggagagcagctgttgtttcactgatgataaataattctgcttgaaaaaaaaaaagtggtttctctttagtgatggaaatagatacttaatttgtgttttagattagacatagtcactcttatgttgttgataattaagaaataaaatcactctggaagttgttcttctctctccctttgctctgaagttgaaactcaggcctgtctattaggtacctttagaattatcactgagatcattttaccttgcacacaatccagggaaaccagtaatcatctctgggcagatatcagtaatgtgcaaaacccatttcctacttgacttggaaggagaaagaaatgttaggaagagtgaaaaatgaatggggaaaaagaacacatcagttcttctccacatggtctctcatcctccagcagcctaccccagacctaaattcaaatgagcttccctttctctcccatccctactcctgggcatcatgttctgcctataagagattgcatgcaattgaaggaaataaagaacggtctctgagaaagtcaataaaatgcagagcttatccctgttggtaaaattcaggtccccaaatgaaatggacaagcaattatcaactgagccagttttcaatccttggtgattgtttcgtctgccagtttttgtttcttaaacctcttgacagcagtccctcttacaaataaaattataaaaatcctatatagcaaatgatgtccagtgttctaccaaactagatcccgactaagcctgactgaggaccatgaaaaccagcacagtggacaaacacaaagaaagcagccaaaggaaaagtgaagagtctgatccgggaagccttaactgttctgagggttctgaatccatttgagaatctgtaataagcagtagactctcctgagaacaagcgaatgcacagatgcacaaaatttggaatggaggccatgccaaggtcacagaccctctggagcatctacagattccctaagggaagagaactctagtgtttaaaagaagcaggaaataggctccatgagaatttaacacttctttttatctgttcacaattggttgccagttccctggagttccctactgctgggaaaatggagtgtgtgggttcagagaggtgctatagcttggagccatagttttcaatgggaaaaggaagtaagaggaaaagaaagaagacaatgagaagtgttgctgagatccatacatttttgtggcataatgagaatttctaaaaactctgcaagtctgacttagcagcattattatactgtcacccagcctgaatcttcaagctgacaatttgctgcgagttcttcattcacttctttttctccttccttctggaaccatgcatattttgccttaagagaacaaagtgatgatataaaaaagggtgtgtgtgtgtgtgtgtgtgtgtgtgtgtgtgtgtgtgtttcaatgaagaaaacatttcaaaacatactaaatgcccgcagtatgagaggcttcttactaggatactcaggtgaatgtttgggaatctaccactgtgttcaatatgtctttgctatttgcaagatttgcagtctacttaagaatctcaggaatgcatcgatcagccttacatccttgaggtctgtgtaggcagcaagtaccttatactactgtaagtcacatagcatctgtctttctctccctgcggtggagcttatgattgcacaaagctcttaagcagctgcttctcagatgctcagaagacagtggatcttgggtctgcactccaaaagcaagagacaaaaaaggcccagaaaaataaccaatgcctacaggttagtcttttgttaggttcatgatcagtcaatttacctgtttattgcataagagtaagctcgtcagaggttcaaattttagctttatgagaccaattagctccattttctttcatagccaagaaagaatcccaaagaatccagactcaagggtcccaagatcacagcagtggggatgtcacccatcaacctggctgtccttgagtcccactcatctccatcaggaattccaggccaaaatctcatggattcctagtcatggttacaaaggggctgggacgtagagtaggaccaccacacaagcagtgtggatttacactcaggagagctgggatttctgcagagagctcccattcatctggtcaggccctggcaccccctgagccacagtgtcttctctaaaaaaatgaggcagctagaccaagccaggtatgcaactcagtagcctaaggtaacacaaccgtggaaagggagcttagtgtgtgaccataggaagtgcaggggtaggtgggttctgatttgaaactaggaaatacatgacctttctgaggtcattcaaatttaaattttaaaatatttttacatttttaacttgcatcttggaaataatttagactttaaaaatgttgcattaagtcgggcgcggtggctcacgcctgtaatcccagcactttgggaggctgaggcgggcggatcatgaggtcaggagatcgagaccatcctggctaacatggtgaaaccccgtctgtactaaaaatacaaaaaaattagccaggggtggtggtgggcgcctgtagtcccagctactcgggaggctgaggcaggagaatggcgttaacctgggaggtggagtttgcagtgagccgagatcgcgccactgcactccagactgggagagagcgagactctgtctcaaaaaaaaaaaaaaaaaaagttgcataaatagcacacaggtacacctatgttcatggcagcattattcgcaatagccaaaaggtggaagcaaatcaagtgtccatcaacggatgaatggataaaccaaatgtggtatacagggtggaatatttaaccgtaaaaaggaaggaaattctgacacatgccacaacatgatgaaccttgaagacattgtgcttaagtaaaataaggcaggcaccaacagtcaaatactgtatgattccacttatataacctaattcgagaaatcaaattcataaagacagagtgtagaaaggtggattccagggctggggggggaatggagagttactgtgcagtaggtacagagtttcagtttgagatgattaaaaagttctggtaatggataatagtgatagttgcataatgtgagtgtacttaatatcactgaactattcacttaaaaatcattaaaattgaaaagttgatgttatatatatttatcacaataaaaacattacttttaaaaagaagcagagtttccatatacccttctttattcagcttccccaaaattaacgtcttaggtaaacatagcaaaattaccaaaggcaggaaataaacattgatataatactattagctacaggccttattcaaaatgttccagttgtcccactagtgtccttttttctgatccacgattcaatccaaaatatgattatatttaatagttatgtctccttagtttcctctaatttggaaaagttctgcagctcttttttgtcgtttatgaacatgatgactttaaagagtactggtcagttatgagtttgtctgatggttctacctgaataaatacacgttatgtatttttggtgagaaaatcacatgaacaatgtgcccttcttagtgcatcatagcatgactcatcactggtgaagttaacttagatcgcttgggtaaagtggtctctgccaggtttctccactataaagatacatttcccattgtttattattgtatctcacctattaattttagcatctattggagatgtttgccggccacaattactattattatgacattttctgaatgatgatattcaatgtccatcatttcttctacatttattaatggcaattccactgtaaggaagagttttccctgcacctcagtttacatttaatttcttattttaaaaaaacactaaaacaagccagaatcatggtaagatatgttcctctgatacccactggcacttaacaactccaaattttctttctagtgttaaaaattctaagttctaggccagatgcagtggctcacacctgtaatcccagcactttaggaggtcaaggcgggcagatcacttggggtcaggagttcaagctcagcctggccaaaacagcaaaacctgatctctactaaaaatacaaaaattagccaggtgtggaagtaggtgcctgtaatcccagctactcgggcggctgaggcaggagaattgcttgaatccaagaggcgaaggttgcagtgagccaagattgcaccactgcactccagcctgggcaaaaaagtgagactccaaaaaattaaaagtaaaaaaaaaattatcagatccataatgcttcctgcaataagaaacaaaaggtcaaatttcatactacctgatagtgttcaaagtagaaagtttttggaaagcaaaatacagcacacatacattttcttcctctcccctcactttttttattttattaaatcttaatattatccagagtatatcagcagggttaagtagagaaaacatttaagaaccattgagcctggaattatcacacgaaatatttatgttaaatttgccatggggaatatggcttttagtgaacaggaactaaatcacaaaagctacaatgttctaaaaaatttttattcacagaaaagacccctggttaagttggctatgccttgaagatcatccagtatctgctgatctgagtccaggcctgtccccctgtgccagggatgtcccttgagagcctttatctgagctgctccaagacggtgtcatcagttgacagacagaaccaatattattgtagagttttatgttaacacagctgtgaaagctgaagaaataaaacttttttttcagctagctacttgtttctgtagtccattgctgagtaacaaaccaacccaaaatttggtggtataaaacagcaattttattatactcatgaatgtgggaatttgtaatccaggcagggcacagtggaaatggcttgtctgtggtccacgatgtgtggaggctcagttgggaagactcaacagctagaggatgactggtatggctggagttggaatcatgtgaaagcttcttaatatgtgcatttaacaccataaatgggatgacttgaaagctgcgctcttccaggattgtcaggcaaagcactacacatgcttctcaatgttgcctgggcttcctcataacatggcagcctgagaggagttggacttcttaaattgtaggtcaggactttaagagcaagtgtgttccagggaacaaggcacaagtctaatggccccttatgacttagattcagaagtcacatggcatcacttccaccatactcgtaattaaagtgatcatgttccccagatgcaagggctggaatcatggacctcatttcttgatatggggagtgtttaaaaaaaagctgtggctttaaacagccacactcttcaaaattaaaacactagaaaaatataatttttaacagaagtggaaaagagtctcttaagctgactgccctcccctttctccaaaaagtctaagaaatattccccaagtatccctctgattgaaataacctctcctttgggtttccatagcagcttgtgaataactctgctacagcacattctattctaacaataaaaagagtaacttatgcttgagtgcaagatattattccaagcacttttcatgcattatctcacttaattcccataacaaaaacattttataagtaaaaaatctgaggcccacaagggttaactaacttgccaaaggtcatagcgctgttacgaggaagagcgagaatttaaaccaaggcaatctggcttcagaactcatgttcttaaaccactccaccacagagtactgttaatagattgctgtgtgcaaatcttccttccctgtgaattgtgagctatttgtaggctgagaccatatcatcattacctttgtctctccagcaccaaacacagtgcctggcttatgacaaggaacacaaaaatacacaatagaaaaatgcacaaaagagaagaaactaaaatgtcaataaacatatgaaaagatgctcaaactttcaaaacaattaaaaatattcaaataagatgaaacattttgcctataaattggctgcagttaaaatatcattaataaatgtcaatccagtgttacttagagaatgggaaaaaggatatttttattcttatttacttttcggtgaatcttggaatatacaaccttatagggaaacttttctgaagtatctatcaaaatgataagtgttcataatctacgacttagagattgaattcctaggatatatcctacaggaaaactctcatctatacaaacagtgataatcacaaagctgttcatcatagcatttttaatagcaaattgattaagatatagttcacatgccataaaatttatcctctaaaaatttgcaattcagtgatctttagtagagttgcaaagttgtgcaatcattaccagtatctaattttagaatatttttaccacccttaaaataaatcctggaccattaacaatcactcttcatttctgtcccctctcagccccaggcaaccactaatctaatttccagctctatagatttgtctattctggacatttcatataaagaagtgatacaatatatgaccttgctgtcaggcttctttaacttagcattaagttttcaaggttcttccgtgtttttaccatgtgtcattgcttaattcctttccatttagaaataatattccattgtacatatatatcattttgtttactgttttatcaattgatagcaatgtgggttgtttctagtttttgactatcatgaataatgttgctataaacatttgtatacaagaatttgtgtaaatgtatgttttcatttctcttatatgcacccgtacatggaattgctgggtcatatgacaagtctatatgtttaacattttaagtaactgccaaagagctttccaaataggctgtaccattttactatcccaccaacagtgtatgagggttcaaattcctccctatccaggtcaacacttgctggtttgggtgcagttgggcaggggttgattttacccattctagtgtgtgtaaagtgatatctcatggttttaacttgcattctctgatgtctaataatgttgaacatctttctgtatgtttataggccatttttacttcttctttgaagaaatgattcctctaatttgcacatttttaattggatttcttgaatttattgttgaattgtaaacatttttaaaacattcctgtgcgagatccttatcagagatatgattttcaaaatttttctccaatctgtgggttgtcttttcgtttccttcgctatttcttttgaagtacaaatattcttaattttaatgaagtacaatttatgttcttacacttttggtgttgtatctaagaaaacattgcctaacctaaagccatgaagatttatttatatgttctattctaagagttgtacaatattagctcttacatttgggactactaatcattttgagttaaattttgcatgtggtatgagataggaatccaaattcatttttttcatgtgaatatctaattgtccaagcacaaaactgtgcttgaacagactattcattctcattgaattgttctagcatccatgttgaaaatcaattgaccataagttgattatcataaattatttctggattcagttttattccattaaactactatatgtctctcctatgccagtaccatactactttgattactttagctttgaagaagtgttgaaattgaaaaatgtgagtcttccaactttgttcttctttattaagattattttggctattcttggtctcttgagtttacatttgaactttaggataagcaaaaatgacagctgagattttgaaagtaattgtatagaatttacagataagttagggagcattgccattttaaaaaatccgtgaacatgagatgcttttccatttatttagatctttaatttctttcagtgatgctttgtacttttcagtgtatacatcttgcacttcttttgttaaatttattccccagtattttacttatttgatattattttaaattgacttatattcttaactttatgcttggattgttcattgcttgtgtatagaaatataattgattttgcatgttaatcttatattctgcaaccttgctgactcttttgtcaattctaataatttttctggattcattataaatttctatgtacaagatatgtcttctgcaaatagagatagtttttcttctttctttccaatcttgatgcctttatttctttatcttgcctgatggcattagctaaaatctccagtacactcttgaatggaagtggcaagagcagataactttgtcttgttctggtcttaagaaaatcattcagcctttcaccattaactatggtgttagctgtgagtttttcatagatagatttatcagattgagaaagttccctttcattcctaatttttttttttttttgagacggagtctcgctctgttgtccaggctggagtgcaatggcgcaatctcggctcactgcaagctctgcctcccgggttcatgccattctcctgcctcagcctcctgagtagctgggactacaggagcctgccaccacgcccagctaattttttgcatttttagtagagacgaggtttcactatgttagccaggaaggtcttgatctcctgaccttgatatctgcccacctcagcctcccaaagtgctgggattacaggcgtgagccaccgcacccagccttcattcctaattttttaaaacgtatttattataaaagaatgttgtattttgtcacatgtttttctgcattgggatgttcatgtggtttttgttatttattctattgatatatttattatagtaattgattttcagatgttaaaacaactttgcattcctggggtaaatcctacttggttatgatgaaaatcctttttatatgtgactggattcagtttgctactattttgatgagcatttttttgccatatttgtaagggatcacaatctgtagttttcttttcttgtggtatttctgtcttttcttcatgtcagggtgacacaggcctcaatgaattagttgggaagtgattcttcctcttccattttttggaagagtttctgaaggactggaattatttatttaaacattagtagaactaatcaggattagtagaattcatcagtatttattttgcagaaagttttaaaattactaattcaatctctttactgctattgaggctctctgataaatttttaaattctgttatgtactttttagctccagaatttctgtttggttctttcttcttattatttttatctctttattgatattctttatttgatgattcaccattctaacactttcctttagttctttagatatggtttctttgaacatatgtctgggtatagtgatatctatatataatatcatgtgaatatttatagttatatagtttagtctttgtctagtaagtccaacatctgggcttcctcagagagtttttattattttttcctctatgtgtggagcatatgttcttatttctttttgtgtctcacaatttttcttgaaaatttgacattttaaatactgtaatatgacagtttggaaaccagagttacctctccccaggttgtttgttgttgtttctaggttttgttgtttttactattgctatttgttttcctgcacccccacccctgtttttttttctttttttttaattatactttaagttctgggatacatgtgcagaacatggaggtttcttacataggtatatacgtgccatggtggtttgctgcacccatcaacccatcatctacattaggtatttctcctaatgttattcctcccctagctctgcaaccccacaggccccagtgtgtgatgttcccctttctgtttccatgtgttctcattgttcaactcccacttatgagtaaaaacatgcagtgcttggctttttgttcctctgttagttgactgagaatgatggtttcctgcttcatccatgtccctgcaaaggacatgaactcatccttttttatggctgcatagcattccatggtgtatatatgccacattttctttatgcagtctatcattgatgggcatttgagttggttccaagtctttgctattgtggaacttaaataaatttacaagaaaaaaaacccatcaaggagtgggcaaaggatatgaacagacacttctcaaaggaagatacttacgtggccaacaaacatatgaaaaaaaatgcaccaccactggtcattagagaagtgaaaatcaaaaccaaaatgagataccgtctcacaccagtgagaacggtgatcattaaacagccaggaaacaacagatgctggagaggatgtggagaaataggaatgcttttacactgttggtggttagtgtaaattagttcaaccattgtggaagatggtgtggcaattcctcaaggatctagaaccagaaataccatttgacccagcaatcccattactgggtatatacccaaaggattataaatcattctactctaaagatacatgcacacatatgtttatttctatttgcttatttaatgtctttctggactaattctataaagtctgtaatttctataatgtgccattgaatctgcttggttaacttaatagttagccaatgacagggcagaggttttcttaaagaccttgaatcaataaggctttttgtttttaccctttgctaaggggctctgttgtgtatatcgggacatatcctcaattctcaagcaggcagttttaaactctgctatggccttcacctcctgtttttaaagagacatcaagtcaactaaaggtgagcacttagggccttcttagatatttcctggttgtgtgtacagctctgcccatgtgtatggccttctaagtgtccaggaatatattagagctttgtaaagccttcaatggacatcttattccctagattcttttacaaaggtttttgtccagccttttatttgccccagttcatattgctacttcaggaaattgcaaccttaaaaatttgccactgattatttttgacaaattccctggggagtaggacttttccaactgagcaaaccctgggacagatcaaataacaacaaatcctataaatggaacttttccagatagcttccaggcaattatttagggatggagctttttaaataactctaaacccagtctgcaccctctactatgtatttggctactggttttcacagctgctgtgattgtgaggttgttcatgttcaaagatgctgcagagctatgaagaagaggatggtcatagggcaatctaaaacagcacagagtttgccattatcactgagattcaacttttttattgaataaacacccttcgggttgctgcaaacctcttgtcaatttcctgtgttctgaataagttgatttggcaatttttttcagagttctatttgcttttctatagcagtagatttttgaaggttcttattctatcatacctgaagtttccccaccccaacacacagcattatctttgaatgtaaaaaaaaatggaagcatcttaatatgcatcaataatggaaaggctaaataagtcatggtatagcccatgtaatggaataatatgcagccattcaaaagaaggaagtagtctaggtgatgaagtaatatgtaccataaaccccatgacacgtgtttacctatgtaacaaaccttcacatgtacccccaaacccaaaataaaaatttgaaaaaaggaggtagtaagtgaaagtctgtgatagcatctgagtgacaagagaagaaccactttgcataatatgtagtgtgtgtgtgtgtgtgtgtgtgtgtgtgtgtgtgtttaagcaaggaagaagatctaaaactcactcatttgactattaaggaaataatcatttgctcttacaagtaggtaggcctagaggaaaaaaaacaaaaaggtaacctaactccaatactgccaaaaaagaaaacatgaagaatttttactttgttatctgtgtttttcggttttctaaatttactctacattttctttatattaaaaataaaataataataataaatattctttaagaaatatttgagccacactgaggttctatgtgatctaaaaatctcagattggccccatctatgttagaaaacttttctatcaaatcaaccacatctgcttcccttttcttccaaacactggatggcaacacacacaccaaaactttcaatagccaatactttgagtagtggaatgctttttgatttagggactcttttgagaatctgatgaaatcatgtgtcctatttccaaaaaaagtacatatttacattatttgtctataatttgtaagcattcaattaaattaattaatcaggttaagaactgcaaacagcatgtcttcatcaatgtgaagacgtggagaaaagggagagatctgggaacttcaagcccctatatttatacagaagagaaaaagatgcccagagaggaaaccacttgcccacaatcatactgatggtaacagacctgagccacatccaggcctccaaactcccaggtcaaggctcttcccaccaagttaccttgaatcatagaacaaatgattggcctgtttaggttctccaagactcttagaggccctgtgccaaagacaacctctcattactgtgacttctctgactggttctgacctgatttcaaggatccttgagataggaaggtagagggaaaccagacctgccatccaactggtatttactaaatttagatgttcacactgtgctcagcctgataaaaggcaccaagggttcacagaaaaagcccaagacacagacagacagttgaagatctgtcacagacagctatgaagacatgactacaaaacatcgcagcataattctgaagcaaccaggtggtacctggggtatgcacactagaccaaggaaggcaaggagaatctgatgcaggtgtgaatgtaaaggcaaggctccatggaaaaggaaagggaatcaaaggatgtgcagaaagttaaaaaatgggggaaagaatagaaggtatttggggagcaggaggagagtggacaccacatgaacaaaggcaaggagaagagaaggaggacattgatagggaaatagaggaccaggactgacaggaggtttgccagtggtttccttgcatacttccctaccccatggagcccctgcaagcagccccagctttggtgtccctgtccctgggccaaccccagaagctaactatgcctatgtctacttgactctccacagcttccctttgctgaaggtctgtaccacttttatcacaatggccttgcaaaggccaagagaagacgcagcctacaccacaagcagcagctggagagagaccccagggtgagttttccccagaaacctgcctcccaatctctgctgccatggctgagcccaccaagggggtgtggaggggctggcagggaattttgaagtaaaggcacttaatgtactatgatagggcaaatgaatgctttgcagagtcatatcagggactctctgctcctttgtctctgcataataaataatcacaggcccctttgtatggctggaggaagaggaaattgggataccacccttttactggctatcttctcctgagttattattgggtgaggacttcgggttgcctgggaacatgttttggcctgtgatggatgggaagacaacaagcagtttaatgagtcattttacggaaggtttctactggtgaatccacatgctcagaggaggttgccatgccccacgttgtgaacggaaagaatgagagagccagtcagtgagcagctcacagcaggcagtggacttctcagtatccatgcatgactgtggccatgagactatctcagcctttctttttatcctatattttctagcactgatctaatttgccttcatgtctcagctgtctacttgatgttcatcacccccatttttttaatcttcagtctttaccttgctcttggactccaggtcccattttctactccctgtgatggctcaaattcaactttcccccaatcaaacatatcatcttagcaacaaagtggcttctctcccagtgttcccacttcttgcctttcagaataggacctttagtaatcatattttccaccatcccccatacctacacactcatccaattgggtagattctgatttctgttacaagaatcactaggaaggaaagtatgtaataactcagacaagttgttctctgtacattgaaggcagcgtaacctctttctcaggactctcagggaccagctgatgaaaagcgtgtcagatgtttgagttaaggactttcacatgagattcttttgagctgatagaatctgaaaactcattcttgtggggcttttcatgtgaacatttccctgggtttaatttgggcttcaattaggaattcagataaaacagtctctcagcagattgccaaatgacaggccacaggcaattttttctttaacttctcaagagttcccaccttctctaaagaggaatttctgctctaggaagccactttaactttacttttgcagtaacaattaagctgcctgtgctgccagccaaggccaagtattcttaaaggatctgtcatagaagccggcaccaagacctaagggagaagctctctattctatgtgataataaccttggccttggctataccaattcattacctggggatacccttgggcagtcatatggacagggatcttgccctgaacccaaggtgggcaccagtagacaaagatcaccctggtgcaccgtgacatttgtcttccctacacttcaaccctatgccataaccttgccatttatggccagttgttttccttttagttatgtattttcttaaaagtcccattggctactcttcttccacgattaaaggcgttgctccaagattattcagaaacatataaactgggggcagaatgaaagagacatttaaaaggcttgggctgggaaagagaactgaggcacagtagaactcaaaagtccctgtttggtcagagagactatttagcaccactggcctgagcttttcccattctaacacatatgatctctgaaatgctgattcttgaagtatacagtgacacttttaaaatataaaatgggactaattgggtaataaaaagaagagatcagtcactggtgattctaatcatttgtctttctcttcaaaatattatctgttatcaccaaaaggggtgcctatttccccttcattatctattataaggatccaggtagccaattgcctctatctggtagttgtaaccatctgccttgcccatgaagaccaacagaaaatagcagaaaaactaaagaagaccaagtatcctatatcttttccctatcttgtcatcaaggttaaatgctggggatgttgtcaataataaactcattctaggaaaataaataaagcacaaaaatctcataatttttttcaaaacgaaaaaaaaaactgctaatgatgactgcctttttccaaaatattagattaaggtctgagtctttcctgcatgatgttctcgtggttgtctaattttggcatctgctgatagaaaaatagagtggcaactattctgaaccaaaaatcattgactatgaacagtgcaaagatagtaaactaaagattctgccttgtgggtttatagctgttaaacaaaagggtaaataagtctagagtaggaataccccaatttgggggttctcaaacacattcaaacaggttgcaaaaagaaaagtaaatgaaagaaaaagggagagaccaagtagccagaaggaggtccaggcttttatgtcttacatagatgtggcaagttatgctttataaacacagaatttaagagtaagttgttttagcattccctgaaatgtactgtctcctagaactgctaacgttaactacggttgcagccccagcccccagcttccttctccttcctgtccctgcaccacttcccagcctgtctcactcactgtctacaggcttgtggtaaggaacacaaagcccagggagggtggtctgagctgctattcgctttcagggcttcatctactgaggtagctttttgaccaaagaaacctccaagctctgctagcaacccaagaaataaaaaagaaaaaggtagaaacccaaggtactttttggctttttttgacttcagaccagaaatttcaatgatgtttgcctctcatgtaacaactaatttttatgctaaaaggaaaacagaaaaaaaaggactagaaagagctaaagtgctactttccatgtgctcatctttgttcatcaatatgcagacaatagctaagaaaacagattctgatgtagactgtgttaaagatgttcgcttctctttccagttcttcctgctaaaagattagctgactgccaagtatcatcatttagatgctaaaaagcaaaagttgtgtcttgtttatttcagtaatatctttgcacagtgagatgttcaggaaatgactgagcatgtcaaatgaatgaatgattactattttttcttcagggttttaatccatgtaatagtattgcccttctcattttatattttcctccgtatcccaaaatttgtctccattaggaaataaaagtactatatagtcttctccctagcacctcttttacatacattcttaattgtgggtaacagaaaccaatgactgtttcattacttccaagttttatcacaaagaatcccatgaagaaccagttcttaatttccaaaacccaatctgccttcttcctaatcatattcacagtcgtggtacaggcaccaaagcgggacaatgtgtctggaaggttttgataatgaaaataatttgaagaggtaataaatcaattcaacactgaaatgaaataatgaaactaaaaataccttctcaacatcagggtcaaaaacaaatattttatgcccaaaagctctgtaagatttgttcaacattagctagaacaataccaacaaatcttaaagccaaacctatcttcagtccctggtcaacatatcaaaacctcataaattctacaagtacctgaaaagcttccgaagagtagatttatttaagataatatttgcttcccagctctgtcaaaccatacttgcacatctgaaatagaatattaaagtgaaatatattttaaaaacatgaaggactcataattctatgagtaacacacactagtcttatggaagcaaaataatttaattaaaaaataacctgaacttcatttcttgagagaggttatatttgagaattaaaaacatttatttcctttactaagcaattttactagaccatacaattattcctcatttttaaacatgtttcagttttacaagtcagaaacttctatcagtccaataaaaactttccttgcttctctcatctcaaagaatggatgatatttcctttgtgttctatatttagaagctatatctttctagcttctttcttatccaaatgtatccacatgtttaataaccataaaaggcagccacacgttctggtagtgatctgtttttggtctttaagggtctattcttgaatatatctgtggagttttcaagatactgccaataacccacaaaatttagcttcactggataatataatcacttcagaaatctcataataccactggagcaaaagaaaagtttcctattctttaaaatcaactggacatgatttatatgatttgtgtgtattgtggccaaactcttctttcctttcaattatagtagttaattatttgattatttattataaattaaaagggaagagaagggaaaatgctgttatcttttggaaagtctattttcttttctttctttctttcttttttttttcctgagatagagtctcactctgttgcccaggctggagtgcagtggcacgatctcagctcactgcaagctctgcctcccgggttcaagtgtttcttgtgcctcagcctcctgagtagctgggattataggtgcgtgacaccacacctggctaatttttgtatttttggtagagatacggtttcaccatgttggccgggctggtcttgaactcctgacatcgggtgatccacccgccttggcctcccaaaatgctggaaagtctactttcaaattgaaaatgtcacggagaaaaatctcctccccctcttttgtcttgaccacaccttcctccagtggataactaatggaatttgaggtgacctctacttaccatcaccatgactgcatgagagcctcacagtctgggggctgggtaaaaatagaaattagatagttttagtgcctttttaagggatttatacccaaagaataggctgttttttatccttatacttgttaactctaagaggataaggtctgaggttgtgaggtgctgctctgagaaacatatagaaattttccaatttatcttccaaatgttttattgaaggaaaaaaataaagcatatagatttgattatattttacttattaagaaacatagtcatggtaagtttattaatattatgagaaacacaaaagggaaaatagcattttgtatttttctagaactttttattctacagggcatttgtggctgctatttcttcatattctcatttccttgtagcataaattggacaaagggtggattctgagttccccaaattctcatggtttgtaaggagacttaaccactccatggtgctgctctacactgatttgtattccataattttccctgctcctctgcacaaagagaattatagagcaggaagagtcttaaggaaacattgattcagcccttgaccttgaagcattaaaatataattttaccattgaggcaaaatagacccagagagagagaaggtgacttccctggggccacacagctataactgataggaagaaaataaaactcgtgactcctctcaatacgaagtctgatttaaataaaaaactaagtgagaattgatactgcttatgaatctgtcgttctttaaacaattgtttgcactaattagtcactgaattttctcaattaaaaataatgtgctgaaaagaagtgaagttgcctcctgagtttatgtcacttatgtgaattcagtgagctcagctataaatggaaaagtgaaaaagaagagggaaataaaaagggcggcacttgagctcactgttctgctcaatttgcttatgccctggagtggccttgaactgaaggcagctgagtatgcagttggcctcggttccctggtgaccctcacagtggaagcatttcacctttctgggggtgagcctgtagcatttaaagttaatacttttgatacaaaatatttcctaaacgcaagctgacttcttcatttgctgtgagaacaatgggacacgaccagggtccattgtgaaagggaaattccacccttgtgatgtattgagacacaatatcagtttctaacccttaaggagttttcaaagttaattttaaccatgcataagttccactttgcacactttagaattcactccctaaggcgtgattcttctaggagaaattaaacaaagatggggtcttcattttggatttcccagaaacagactctgagatgcagagttgtatgccagagacttcttggagagcaaggaagagaacactgggcaaagggagaagctgagcaaatgggctttcaacaggggcctcagtcaattttacaggaaactcagaaacaggggtggcccttcagagttaccccagtgtgaggcaaaggaaccggacctttgtgcccccataatgaccagttattggcatgggtactccctcaaaggaaacatagtcttaggtaaatcacgtcctgctaccaaaggcaattctcagtgaaagaaactctgagccacatttagcagctggaggaaatgtgtgagggccctaaagaggaaatctggagagtgcaccacagttttcattacacctgccatgcccacttcactcaatttgtctgtaaattcacatttgattcaagaggcattttctgggatctttgacctttctggaagagtggacatggcttcccagatcaggagctctccgtgcccaatccagctccccatccacccctgctgcccttttccagagattgaactgaactaagaggggaaaacatgaatctgtaggcacatgagctggaccatattttgaacacaaatagtgaagccaagagacccaagtgaaacagtttctgacctagcctcccatctgtggccaaattcattttctagataacatgccaagaggtcagcgggtgtaaaccattcatgagtgatgcaagttgagagttacttgacagcatcaggaaaaggagaaatgcaatgggggaggtatgcataagaagcagggcagaggtatcttcatggatgccccaacctgtgggaaaaattcatctgttctaatcctctgctttcagaatgtggcagggaggactttcagcatctcctctgggcattgcagatatgcctggcttcccaactcaaagagctgctgctggtgctataattaactatttgtggggaacaggggagaattatttactacagctacagaaaggcacagggaaagctgctaatgagtaagcctggtttttttctagatgctgtttttttctagatgttcatttttaaatgatgggtactgttcgtgctgtcatgcttcctaaaggaaaagtgggaactctctgggaggcatcatgctagcaaagccagagatctcttggaagttttaactttctttgggagaattcttacaagccctggtatagagaaaagttaacacagagaaaattggtggctctgtatcgtctttacaattcacaaggtgaagagtctctaatggtgggctagcaaacctttaggacttcctgggaaaatcttagatgtttgaagggcaaaattctcctgatctgcctcacctgattccctccccaaccttccccaagatgcaaaaggaaatgcatttatatatccaatgtgtatatatatatatatatatatatatatataatgcatttatatagcctctattatatcttctaaaaatgattatatgtgtatgcttattaaattcataatgtaactctcttatttagttgttggctagaaaaccagcattcattcagcaaatagttatcaagtccaaactatatacagggcactcttctgcatactgaaatataacagtgaacaagacaaagtcctcctcccagggggcttgtatactagtggcaatgaaggagagaaacaaaaaacagatgaccaagcaattgtatgaatggtggtcaaaatgctatgagaatgagtagagcagagtatgggaagagggagagccatagaggggtgtttctattttataaaaagcatccaggtttggctagtctgggaaagtggcatttaaatatagacctgaaggagatgaggaaggtattcatgtggatatctggagaaagggcactccagacagaggaaccaccaaggaaaaaggcctggaatccaagacacacctggtgtgttccaggaacagcaagaatgcgagtaaagctgcaaaggaatgagccaaggacagtggggaaggagatgaggttagagaggaaaaataaagcaagatcatgggcgacatgataagctggggaaagaactttgaattgactctgaatgagatgtggcttctgtgcctatgggcaaataatagacaatggggtagaggtatggatgagggacaactggactagagagatccatgcaaggcgattgcaatatttcagaagagaaaagccagtggcataggccaggatagaagtggtggaggcagtgagaaacaaatcagatctgggagtatgttgtgaaggtagtcttcaaattcgttgatgcatttgctgatggattagatgaggaatgggagaggaagtgagaaggcaaaggtgactcctaagttgttggcctgcattactatagaatgaaatggcacttatgcatatggacaagatggtgagaggagcaggttgatggggagtggttagggaattaagagtttagttttaagcacgttaacatttgagatttgtattaagtaaccaagtggagatgatgtgaaatgaacagatggacttaaggatctaggagagaggtcagagttggagatataaattgagaggcatccatctattgttagtgttcaatgccaggagactagttgagcttacctacgaaatgagtgtagatatagaagagaagatttgtgggactgagccctagggtactctaagatttagaagtcaaagagataactggggaccagcaaaggagacagaaaagcagcaagtaatctagaaacaggatcagaggtcaagagaagaccaactttagccattgtgttctagctcgtctacattttaccatagtaacttggccatccctataattatttcttattagaggtatcaatgtttcttcacttttcccctctctgatctatttttcaaacgctttctcaacggatattgaaatacatggttcacacatgaacttatgaaattaaaggatactgatgtgtttgggctgggtagtgtgctttaaagcagcaggaggtcacatttgactcagaatgttgagaatctagctcttaaacctgcaatcccaactaggcactaactcagagccaagaccgcgttctgcaagctgccaggtgaagttaccaggaaacagcctctgtttgacatgtcaagggaagaacctgaattgggcacctctttttaattttgagaaactataaaagccatgagaaagatcatgtttgactgtaaaccaaaaagaaaaaaccttaccctccaattaaggaaaataaaattataagttgttgttgatttaattctgatcatattttcatagatttcagaaagatatagtttttaaaagaatttcctgttaagattcaaaattttttctaggatataatttctcactcctcaaacctctgcttcaaaataaattttattcaatatttagcataaggagactataaagttccttaatggtgacataaatgaacagttataatcgtatgtctatctagctactgaatatttctaagataacgttttgtgaggcaaaagtggtttgaagttggtgatgcctcaaaaaaaattttttttaatactctttagaactctttctgggtattttaaaattggtttagctatttttcctttttgatgcctattgacatgtttgtgatcacatctctttctataaacaggtttcacggtcttaaagccaaaccaagggaattttgaaaatgagtggaattgaattcctgccatttccagtaatttcaaagctttatgggttcaggagaggataacagtgcagccaggtctagaaatgagtaaacagcagttaggcaaagagattcatgtctgaataacaacccaattgctggagtttatctaattggtttgccattatctgtaccaaaaacattgtgtttttcatcttctctacgatgagcatgtcccatttagcaataaagaacttattgcttgagagaaaacaggtaagacaaaatagttttccattccccctgaaaagggagagcagtccatcccaagtaaagaatagtttaatggatgttaatttttaaggacaacttagagaatcaacatgagaaagtttcttctcccaacagaagcaaagaaaagcaattaaaacctattgtgtggaaagagacccaaataattgtctattagggagaaaaggaacatgatagagtccaatttgaggtcattcttgagttccaatacttacactgacaccaattaactgtgctctccttgaacaaaccgttgtttcccccagtcttcagttctcttgtctgtaccatgaggagtgtggactagttagtctgtaaaatgccctctgaggtcctaaatctgagattccagggactaacctgaagcctctccaactggttaatatcaaagccacgactaaaacccagcaattctaaccagtttgtgatccttcctttacatgtctttcttttcatctgagaaatagggctttttctttaaaccaatgctataaagtgtttgcaagaactagcatttatatgttggtatcctcaacttatagaacacaatttcaaatcctgtactgttcaaaccaattcaatagtaccctaaaattccatttcttgtctcgggggaaatattagattatgagatagaggttattcatccacttcaaagataatagctcctctatcatgttttataaattgggatttggtttaagatttccctggtatcatgggtgtgaaggagtgggggtccttaaaataaaaaataatgtttgaaaacctttgatagctaaacaagttcgattctttagcctagtcaatcagtgtatccaacagggataacaagcttgatgcctacacaggccatgcaaataaattacaaattgaggtgggtcagttgtaagcaaaacagctactcaagcaagagaataaacggcaaaatgatcttctcctctgtgtgaggaacacaacagagagtggtggggactgtggtgaacctgagtgtacacaccctcttaaaaggaggaagcggattcttattctcagctaattgttacctccaataatggacgccctggttgccacatctacaattttgaagaaaagtagcaactaccaatctttgtaaagattcttttatctttttaaaaaaattagtgattaaattaaaatttcttaacacactgtccaatctaaagaaaatacatcatcagaacaaatttttccatgcactaccattttgcagtccctactctacaacaccccaggacaggatgaaacctgatagaacacctctatgactagtccgtgacttcattatttgccaaggtagtccacataaaagttcttccttaagggaattccaaagctacttccttgtagcgttggttcataatccacattctcctttctgaggccaaattaatctatcttccatgtgagaacccttcaaacatttgaaaatagttatcatgccccctggaccttcctagagtaagcattcttagttctttcagatgttttcattgaatttggcacttctttcccatgccttcctgattacacctctctgaacattactggagaacaatacattataacatccaggtctgctctgattatttcagagtagtattgcatgctcacttcccgtatctcccacattttaaaagctattcttctattagcacatcttaaaatcattttagcattttgtggaagtcatagatctcacattgattaatagtgaacctacaattagctaaaatttctaggttcttctaaaatacactcataatccatccttgaaggatcgaggtattggttctaaaacaaggaacctttaaaaaggatttattttttgaattttcatcttattagagttcattctgacctgtcaagattttattagatttggattcagtctcctttccactttcttgtcatctatgattttgatcagcatcaatatcttcaacagttcttaagaaaaaagttaaatagtacaaagaaaaatgacaaagttcagaaccctctgccaggatgatatgaatctattaatatagactctaaggagtatttcacactgaccccatattaaaaggaaattctaaagcacccaaagttctgaaaaatcattcaagttaaatgaaaaaacagtgtctcaccagggaggctatttgaagactgtttatatggcttaactccaacactctgaatctggttgatttgtgtgtgtatatggctctctgagaaatcagtttatttgccatggaacaatctaatttggtcattcacatgactaaaagtaccagaccaacatgttttcaatccagtcccttgaggcaatttgaattctgttgataacttgtccacacacctgctactgatggatgtttcgtcatgaaattttaatcagagagccaaaatcaatgggtaattgttaatttcaagggtgccaggtgacactcaagtgtagaccaaaccaaatttttataaaacttaataaagtgatttcctttaaatgagtaagtcaagatatctcagacatagattaattcagctaaggatcatattctccagagctgaaatattaactatcattgaacttctatcagtgcttccaaaataattattctaacacttattcatgtgacatgggcaagtcatttaaccttcactaattgtcttcattttatcatctctaccattaaataacaatgaaagtccaaatgactggaaataaattgccttaatttttaatccctatcatggaattacaatgaaagtgcaaatgtctgccaatacatgcctaagacttcaaagctggaagtatgactccatctaaagtacatgttaatttcacaaatacattataactttgccaaagcagaaaaggtgatagtgtcacctactccttttgcatcttcttagttctctacttgttttccttgcctgcccctactccatgaaaaatatgggtgtgaattaaatcagtgttccttaaactgtgttacgctggagtccttgggttttcttccagaacgttgtgaataataaagatattagttaggataaactagattacgctgcagtaacaaattaacttttaactcccaatggtttaatatacaaatgtttccttttcactgtgctacaagtcacaagtccagcatgagctggatagatttgattaatataatgctgttgaaagtttcaccatcttgaaacgccactatcctagcacatgaattccaggacactggaagagaaagaggaagtgaaagcataataagctctacccacttgtaaatgcctcagcttgaaaatgttacatatcactctgctcaccacccattagcgagaactaggcaaaatgaatgtcttaatgaaaagaagctaagaagtgtggttctcccatgtgctcaggaaggagagacaaactggatttggggagcagtagaagtcccttgcatagtgtattttttattcaaaacaacaataaacatgtgaataaaagcccatattctattattctgggtgatccttgggattgagactttcccataagttcagcactcatgtttataattgtattggcagcaatactgccatccagtctctggctattgagaaagggtgggatacaccccgggatgcttctgttgtcctaaaatgattggaacatctctcttcatgtgtgaccttctgcaatagggcctggctcctcctctatccataggtagagtctatttattcacccatgtgaaggctctgtaacattttatctggtagaacgtggtgggagtgatactgggccaattctgggcatagccagcccctacctgacctggtagcttctactccttcctcagagaagctaaagaattgtgattaccctgagaactccatgctgtgagtaggccaagccaggtggagagattgatataccgtggggagagagagaggccaaggagcaccaagataccagaactatgagtgaagaagccatctcagaagtggatcttttagccccagtcccaactgctgttacctggagacaaactacccagtcatgtctttcctgaattcctgacccaaaaaatcttgagccaaataaactggttgttttaagccattagtatgtggtgtaatttattatgcagcaatagataacaagaagacaaacgaattttcccagcagtgcagaggggatgagtggtggagaactgagtcatggcataaagcacattaaaatgaaccccaagacactacaccccagcagtctacagcatagtcacattgtgttttaatcagcattgcttctttggctattattgtttttgtggtgtttatatttaactcgtaaacttgtcttagttttatagttgtataggaaccataatcattaggagttgttattctatcttattttgtgcatattatttatacatatatatatatatatatatatatatataatgttgggcgactaatgaaaaatggttttcttataaaagagtccctttcttgtttaaatttattcgagtttaagaaatcaatgcatttgaaaagatctaaaagaagtaggcttttccaaagtataaactttggcatgaaacagaagcaatgcatcccttttggtgcagtgatatcagcaggtaacagcatacgtagtgagaggagaatcaaaggaagaattaggagttccgagttctaatcacagctcagccatttattgtctatgtgggctccaggtaaccacttagttttatggtcctcaatgtccccatctgtgaaatgattaatgacattacctgtgcttattacatggggttactctggcaatcaaatatgatagaaagaaaggttcgaaaactgtggacttttactattgttcatagagattcaggctagagtcttaagttttgtgctgacaaatctaaaagtaacctgactaaaaatgtgtagcaactgagtttaaaagaagctcaaataaaattatctttaaaaactcaatccaatgtaagattaaataggaaatacattggatttacattttctttgaagtataaggaaacgtgcagtctgctgggatccatcacactgcttggtctggaaaaagaggagggtgaattcagaactcttgtccctctctaaattcttgtaaccttctaatctctctggagtgtaaacttgtggccaagattttgagctctggataaattctagttttaatctcaggtccaccactcactcacttgccagttacataagtttacgttgttatttaacatctcacaaccacatctatacaatgtgggtaataataatattacttatctgaaaggttgatgtgagcattaaatgaaatgatgctagggtaaacgttcaaaagatgacagccatgaccaataatattttgttctctagcattcgattacatggtgactgatactgatctctgaaacttgcctatgtagtagcatttttgttcactgctgtcctttagtaattctacataccataaaaaaattagttatgcatggtggttttattttcatcttaccaaaatgatagtttacagttttaaaaatcaaatgcaagccttataattaaaaacagaagcattttgctccagctttctcaaatccctcagaggcattatccaccaattctttaagtgtttcttgtgctaattaactccacattttaaaataatatgtgtatgctgaaatgtgtggatttgcttcatttcagatgttgtctatgggctttcttctatggaagatgagatttaacttttaaattcaacacacacacacacacacacacacacacacacacataccatgtttatattttttctggcttttgaatatagatgtatcacaagatggggctaggttaatattcagtgttcatattattgtgagtccttaagtactatttacagctgagccatttataccaataacatcccttcctctctcaaacagctttttgtttccctgtagttaataatggccctgtgatgccctctctcaccactcctattcaacatagtgttggaagttctggccagggcaatcaggcaggagaaggaaataaagggcattcaatcaggaaaagaggaagtcaaattgtccctgtttgcagatgacatgattgtatacctagaaaaccccatcgtctcagcccaaaatctccttaagctgataagcaacttcagcaaagtctcaggatacaaaatcaatgtgcaaaaatcacaagcgttcttatacaccaacaacagacaaacagagagccaaatcatgagtgaactcccattcacaattgcttcaaacagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaactggaaaaaactactttaaagtttatatagaaccaaaaaagagcctgcattgccaagtcaatcctaagccaaaagaacaaagctggaggcatcacgctacctgacttcaaactatactacaaggctacagtaaccaaaacagcatggtactggtaccaaaacagatatatagaccaatggaacagaacagagccctcagaaataatgccgcatgtctacaactatctgatctttgacaaacctgacaaaaacaagcaatggggaaaggattcccgatttaataaatggtgctgggaaaactggctagccatatgtagaaacctgaaactggatcccctccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaattaccatcagagtgaacaggcaacctacagaatgggagaaaatttttgcaacctactcatctgacaaagggctaatatccagaatctacaatgaactccaacaaatttacaagaaaaaaacaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacacagttcatgggactgtaaactagttcaaccattgtggaagtcagtgtggcaattcctcagggatctagaactagaagtaccatttgacccagccatcccattactgggtatataaccaaaggactataaatcatactgctgtaaagacacatgcacacgtatgtttattatggcactattcacaatagcaaagacttggaatgaacccaaatgtccaacaatgataggctggattaagaaaatgtggcatatatacactatggaatactatgcagccataaaaaatgatgagttcatgtcctttgtggggacatggatgaagctggaaaccatcattctcagcaaactattgcaaggactaaaaaccaaacaccgcatgttctcactcacaggtgggaattgaacaatgagaacacatggacacaggaaggggaacatcacacaccagggactgttgtggggtgggaggagaggggagggatagcattaggagatatacctaatgctaaatgacgagttaatgggtgcagcacaccaacatggcacatgtatacatatgtaacaaagctgcacgctatgcacatgtaccctaaaacttaaagtataataatgatataaataaatagataaataataatggccctgtaaccccaacactttgggaggccaaggtgtgtggattgcttgagcccaggagttcaagaccagcctgggcaacagagcaagacctctgttgcctttttttttttaacttgctcactttcctatctccttatgtctaatttttcccctacattgtctaatagtttcctaaattttttcagtatggtcaaacgcatcccctaaacgatccattgctttatttggttgtcatccaccctagagataccatcctttgacttcacgatgtagtggttgctttctggaccagctcacacctcttaccctagcacttccttcactattatcccaggaattccctgttggctggatagtgttggattcctctttcctggaaccccttcatttccctttctcagattatttccgcattccgatgcagaatgtccttcatgagaggcgactttttaggacttttaatctgcgttcaaatcaattaatagtttgacggttatcaactattaggttgggaataaacatctctcagaaatttgcaagtgtttctctgttatctttgcctacaatggtgccattgggaggtcaagatcattctaattcctgtttcctggtattcctctttctctctagaatttgctcttagttctctgcattttgtagtgaaactcgtttctcttatttgatttttttgtttaagttcatttttttccatgaaagctatgtttctattgacatgacatttgagtattcattgcaaagctttaaaatgtgtgtggcccagtggtggctcacgcctgtaatcccagcactttgggaggccgaggcgggtggatcacctgaggtccagagttcgagaccagcctgaccaacatggagaaaccctgtctctactgggcatagtggtgcatgcctgtaatcccagctactccagaggctgaggcaggagaatggcctgaacccgggaggcagtggttgctgtgagccgagatcgcgccactgcactcctgcctgggcaacaggagcgaaactccgtctcaaaaaaaaaaaaaaaaaaagtgtgtggcccatccacatgcaaatatccttgtttctctgataaaattgctgattgtattcttgaagtgttgattcaataagtgttttcaaaacaacacttttttatttttttattttatttttaattacaaaagtaatgcatatatgcatttttatgctaaacatccaaacaaatgtagaagacaaaaaaaaaaaacacacttgttccaaatcaagcttatatcctccgcagaagaaaacactattatcaatttaatgtgtagctttcagacattttattatatgtcaacatggttatacatgcacatatggaaatagagagtttaatttttgtggtaagagttttttaaccaaaattgaattgtatagtatatactattttgcaaattcctttcttccatttagtagtatatcttagagaatttgacttataagtacacacatattgaatttttcttattaatgactgcataagattccaaaatgtagatatactatggtggaaatttctttcaaacttttcactacataaacaacattgcatgcttctttgtgcacaaatataattgtttctttaggatagctgtcagaagtgaaattgatgggtcaaatttgtgttttggtcttgtaattatgccttatcccagaatgatgccatgtggaagttagacacaggcccttgtgttttagaaagtgtggcagagccttctcaacttcagagtcacccagaggaagttataaaagtcagaagggacctatggctacatatagtgggccatgtctaataagaaggtagttttgttccagaattctttaggtagggaaatgctctaacatctgttagctctacctaagacaaatagaagattctccattaattccccaagtcaggaagtgataatgaggtacacctagtgcctgggtgtttaagatcaaaatgatagctgagtaattaattggcactttccatgtgccttttgtctttctagctggccaaataagcatatctgacagtgtgtggcaaatgataaactcccacaccaaccatgtggaggcccgtatctgctgcaaaaatcagttgttccgatttgcttttcagcaacctcagtggattgttcctttctatccactgcattttcacttgtctggaaggtctttcaagcaatatgactataatttgcaaccaaatctgatctcccgccatatttgccttctccttctttttcctggagacttctttcttctccctttaaaagcaaatatttttacttgaaagtatagtaacccaggtgaggttcaccttcaagactctccatctgaggtcaaactgggcatgtgacatttctcagttgatttaccatccacgttgactacccatctattaggcagattttggagacaacctctttgtcctcctaactgtgcaatggaattaggcttctcccttatcgacaatgaccccatacctaacttcagccttcctggaactccctttttatctaaacacttctcctggccctgatgaagaatgcagtccagaaggaaagccagtgaactttaaggtcaggtgctcctgtcccttgggagcaaacctcggtaaagactagatcccaaatgtgggtgctatatacaactagttccaccccttactatgttaccagtgttcccatggtgatgctgagaatgttacaaggacctttcactcagctattgtatcagttcaggctgcttggtctgggcatgccaataaccatatataaatgttttgtttctctttattctaattaatctgcccacttaacttggctggtatggcttctcatccctggcccaccttttatcatactctcacctttatgtttgctgccccctgttggttgctgtgaatcccagtgaatgctgtatgttagccaagcaattgcaggccatggccagcctatgcagcaagccaggtgttctgataccttttcttgcaggaatgggaatgtttctgaaccctctggaaagtgccctgccactctcacctgattctcatgcttactggtcccacctatggataaagattctctctgggaattgcagggaagctgccattcctacctagtatgatgtcccagtaagccacttgactgttgcccttaggtacctccccttccccatattattcttaatctttgaccttcccagtgccattcacacaatccataacagttctctcctaccctggaatattctctattagtctgactccacctttcaggagtttctcatggtgtatgctccactgggggcacccattttgctttctaatgcagttaaggatgtctatataggcatgtatatatttacatatatatatatggatttatgtttatatagctgtgtatctgcacaaatggcagacagacaatccctacctctctctccatacacacacacataaacacacacacacacatatgtatatatatgtatattctgcatatcatattataggatgatacatatgtatgttaatatcaaagggttcaaagaagggagaagacatgggaagtggctcttagtctgccatttgcactgagtcctctgtagctttaagaagaaatatcgatttatttcattggttgtgcttgtttttgacccaaatgttcactttagcccatggtctgatcttttcaaagacaagcttactcaagcaaagaaagaggaaagctccccattgtcacgtcaattatagataagttcatgccaacataatacctcctcctcatcttatttctgtagctcaggataaaaagataatctccaaaggaggcctaaaaaacagccacattaattaaaggaaagagattttttttttctaggaagtgcctaataactaacggacaagcaaaggagactcattagtggaagtatttcctttgaaagggcacacacgctgtgaaaaaaaaaaaagaaagggttatgccaggcttttctctttgtaaataaagtgacaccttttatctttttttctgttaataacacaggctggggagaatgagtctgagggaggcttgtagataagctggcaggatttgaagattattcagatctttagtttcttatttctctatgttctagggtaagacttttcttcattgttcatggccttgtataaagaatggttaggattggggatcttagggagttaggcttaagagtggtggcttagactccattatcccagttaactgatgaaccatttgccatgaacacctttggtaggtcatgctccatttagcaactgggcagggaatccgatcacctcaaacactacattcaaacagaaaggcaaaagatgctataaaagctagatggagagataggtggatacacagataaataaacctgatagaaagatgatagatagagatataaataagtaggtagataaatgaatagataggtaaagagactacagaataattagctaaattctgtagaaagacctaaaagggaaaagatattcacaagcgggggcattcagggtgagtttgaatctttaaggagatttcaaaaaggcacagagtgatgtctaggatttgcatgataaactggaatcttacttggagcacattttaccaacaccccataatgaaggttacacacagaaacagcctcagactctccagaaggaactgtcgaatttgatgagcacacatagagctagactaaatggatggggtgctgaggctgggcttccataccttaagtacctacgaatcatgtgagtgattaaaagatttcttaggtcaggcctaatttctaatcatctctcactcaagccagcatatggccactgtatgagttcaagagtgagcatttttttgaaacgcagttaagacttcagtttcctgcaccgaagaactaagtcactggcaacttgtcatgctagagaaaaaggcaggggacaattccatctcaggtatcatcacttcacgttgcttaccctacctacctaaatccagctagcatgtttgctcagccccacgtcagctagagtagaaattacttatccacttctcctctacacaaacctctctttatgagtacaaataaggaaaacaagcctgccaaatgacagtttgtcattgcaggagccatggccagaatccacatttcccatatctaatgagtgtgactccagccatgttcttcatttacatttatatcgttcacaggaatccatgtagccctgacttttgtgggcattgttatatcaactccacccccaccattgccatctcatctggtttgggagttaacaaagctctgtcatcttctgagtactgtgtgagatggcccagaaaggtatcattgttctcacttgggaacattgttcccactaaatggagagatggaggtttatggagctaacagtcaaagagtagcagtcacatccaggtcttcagcagcaccaggcttggccccgtatacatgaactctgactgctccatcactaacaaggcacatctaatctggaactgtgccttatgctttgctaactgtgacatacagcacactattggcaatggctttcgtccactccatccaccatcaccactggctctactttgcaggagttatctgatccattttctctgttgtttccttgtgagggagagcagacatgcacaagctattgtcaaaggacaaattacaacaaatttagtttaaagatctcgctgggctttatagcaattttagaattggtcaacacttaattccataaaatagaataagtgttccaatgagcctagcagaagaggttggctttctagacagagaatgtaattgtactaggtttgttgcccgatgtgcatggcaaatcaatatgccaagacactggattgtgacagagaagagatttaaccatagggccaccaaatgaggaagagggagggaaaatcaaatctgtctccccaaggagtttggggatagagtttttaagggttatggagtgggctgaagcatggagattgttgacggggtgaagagtacagagtgaagtcatgggacagggagataaagaaactatattctcactctgatttcattactctgtggggggtttcaaactggttggcaacaactgttttgctggaattcaggatctggaaaacaccttaagcaattcttaaacaaaagtcttgtgattttaatgtcagagatcttatctataggaacaatggggatgccagtggtcaggatcagtgctctgtgactatcaggttcaaggaagtgggtaaaagtgaaggctgattatttactcttatttataactatatttctgtccagaattcttcttaaccctgtgaggatggcttcaagaagggttgaagaaagcagaaacaaagaacaaaggatgtattcattatttttcaaagttactttttcttgtcgggtgggaacagggaaatagaacaatagaaaaataactgattagttaacatcaagtcatgtcaggctacttattttgtgtaaggaatacagcagaaggaactttattaccatgtcgattgataattaaaactgacctgcttggaaaatggctgttatttctgtctcccgatttctcagaaggctggataatgtcatagtttaggtttggtgatgtagaactttagcatgggtgactctattttgatctttagtctggtctgttgaagtctagtgcaaaagtttagtccaaaacaacaacctcctataatttttaacactgtaaatctctcactagccctgaattcttcagtagactgtattttgagctcctgctgcaggcaactgcagacagattggccacataagagcagtagccttcagaccaaagctcagaggaagtgccaaaacatgtacaaaccctggatgggttctggccttggcaatcatgagccaccattactgttaaggaattaggagtggaatagtggaattttccttgctccagattttaaggacacactcaacttcatccaggccccagcacatcacagacccacctatgagtcagtactaatggcagtactagtggcctcaaaggacatttgaagaaaaattgttacttaccagaccccaccagagctgctgagatgatcccatgtaaccctaactacagagttacctttagcttttttcagttaaattgtattttatgtgagttttaattgacacaaaatataattttgaaagcctgcaaaaaaatgcataaatgtaaggcagaaatggccaggacattcctccaaataactctgcctggaaaacaaaatcttgctgtcattactggattgttcttgttttctccacatgaacaaggtttggataatgaagtaacagctcttcctggagccccattgccaaaaactagcaataaaggaagaccttactacctaacacatgtggctacttgaaaattatctgaaataaaaacaagccagaatcaacataatagtgtataacaaaacccagatgtctcttgaataaaaggttaatcaaatgctaatgttaaacgaaagagtttcaaaggcaggaggaagaatgttagagataaatgaagaaattaggtgcagcctctgtatgacttggaagagcaagctctctgcacaggatcgtttttttgttttttttaggaaattaagcttttctttcacacctagaatgtgtcagatgctttataagaaaggcactaaatacttttccaggagcttaatcttcaaagtacaatctactaagatgtacctggaggaagaaaaatgtagcaattcttgcaaagcaatgctttggatattacctttctgccatattttggtagacgtttatatataaatcctggtttggtcaggaatccagtaagaatttgcaatgtttgtaaaagcccacctgctttgctcatgaattgcagaacagctcatgcctccctccacagcaccctctgccctggtctccatcccagtgaagggggttgtgctcacagtctgtatcagaatcagtcagggttctccagaaaaacagaagcaatagggtgtatacatacaggttgtatatgtaaagagagatatttattttaaggaattggcttatgcaattgtgaaggctggcaagtccaaaatctgcagggcaggccagcaggctggaaatgccaacaagaatttatgctgcagctcgagtccatggcagtctggaggcagaattccctcttccttaagcggaccatagtcttttctcctaaaaccataagataagacccacccatattttgagggcaatctgctttactcagctctgctcacttaaatgttaatcacatctaaaaaaaaaaaataccttcacagcaacatctaaactagtgtttgaccaaacatctgagcctcgtggcctagcccagttgacacataaaattagccacacatccagtgggcaagacagacaaagtcacaatagacatcgaaggctactggcggggactgagagaaagtggggagtctacaagggtgaaggagaggaaagcaccgtgaaaaatacttgcaaatatttattcatgaggtcgggaggcatttcagggatcttgcaccagcatgtgcgtgtctgtgtgtgtgtgtgtgtgtgtgtgtgtgtgtgttaaaatggggaggaaataagagaatgatacaaatgaagctgaggaagtaaacaggtcaaggaggggagggtggattctttcttgtctgctcaagcataggagcaagtggggtcatgcaattttattttataactagtggctaagcatccacttatcttatggaagaaggtcctcaattctccaagaaccctggtgcttcagagtcagcagtgccattagcaaccacaggtggcgctgtcctttctcaggagagcaccaatcctacaactcctttggttaagattataaccctggccagccagtattcccccaagccaccctagtgggaggcctggggagccttcctaagcccctgggctttgtgtcatacctggccataaggcttgcctgccttcatgctccagatagctttactctggtggcctcgttgcccttgcctaacacctgaccttgatgtaccctcccccagctcaccctgaaagagcagcctgactgggaatctggggatggggtgtttttcctttctgtcccagaacgccctgtcttcctcatgcaaggtgatgagctctcacccaagggctggctctgcaggctggatcacacagctgtacatgcccttccccacttcccattctaaatccacctgatcaagctggactccttcaccaggcccttccaggaacggacaactctgctctgaggagatcccttctcatggaggatgactcagcatgtcctttcatgcagcttccatctaacctctacctcagcaggtgtctgctaccctagggcacatgaggatgctcccaaagccagcagaaatccaggacagcatttcaagaaggggagaggccagggattctgcaacatggtctgtcacagaggagggtggcttcgatggacagcaatagcaagaccagagcaggtgcaattccaagggtgcaaagacagctctggatgctggagaaagtcaatgacagtgagtccctactcacctgctccaccactaatggctgcagcaatgccacggctcatgttctgggctgaattgtttccccccagattcatatgttgaagtcctaacccccagtacctcagaattagactgtaattggagattgggcctttaaaaggataactcaaatgaagtcactagggtgagtcttaatccaatataatgggtaaacacccatgagaagggcaaatttggacacagacacacagaagaaagaccacaagaagacgtaggagaggaaggccatctgcaacccacagacagcagtgtgagaagaaaccaacccagatgacaccttgatcttgaacttctagtctccagaatcgtgagaaaataaatttctgttgtttaagccccccagtctatggtactttgttacagcagccctagcgaacaaatatactggcttcaatctaaatcaacttgcagttagcaatttcaaaagactgcgtgaagctatcccaaaaggctatccgcaaaggaaagctgcgttcttgtgcagtactattaatagattatagaaggaaataaggatgacagatgttactggaaaccaccttgtgcctagaaagaagcatttcctttctctcaaccgaaggacagcagcaaggtcccagatggtgctgaataagcaagtgatcaaatatcttatcattttggatataaatcaatgcagtgatattacctctcaaactttgctcaatcacttagccttgttagattagtcaatatctaggttgaagagcaaaatgagaattggaattggccttttcaaagtcagatttgtgtacctaaaacaagccaaattagttttgcattaaaaaaaataacacagcaagtcacatatgcatatttgagggtcactatgaagctccttgtttaacaactaacactgattgtaataattgtgccactgtggttctgaatgtcaataatgggagaggttctgtggagatggggtatatgggaaccctctgtactttccactcatttttgctgtaaacctaaaactattctaaaaaatatagtttattaatttttaaaaactgaaaatagtaactatttaaaaatactttgactattcaaaaaaccaacacatcaattagtctgtatctatcaatatatatattttagagagtatcactttaaaaataaaaattacccatacccaaagctaaacatcacttaactttttttgtttatatcttttcagtgttttgtctctattttttttattttacaaagctgactttctattgtaaaatcaatgtttgttttactttcctttataatatagcttttgaaagctgcaatgtttttcattgtatggttatagcatcatttatttaacaattcctctatttaggaaaaatggccatttctaattttttgtagtaaatgagattcaaaaaacagtgtcaaaataaattctcttttgtactctttaatgtacatctgattatttgcagaagataaatttctagaagtagaattggtgcattcatcagtttgctcattgtttaggttttttaatacatctctgtcaagagggtattattagcatttttcctctgtcatcaatttggcaggtcagagatggcatcttattttattttaatttgcatgtacttgatttttagtgaaagcaatttttttccacatatttctcaatcatttatagttttctttggtgagaagacaggtaccttgagtgtgtggcttacagcatctatcacagatcactgcctggcacacagtaggtcttcagttagtgactgaattaatgatttaccctgtgttcttgtcatcttttgggaagtgctccacttttccctaaggatctgtatgatcccattttgtcataagaatatcagcccattttctaccattcatatggaaaatggtttgttctcttttctcatttaaatttctaataatcatatttgtccctgctaattatcaccatgtgcccagcctggaatgtgtactttacatattttatcttgcttaattcttaccaccaccctaggaggtggatgttatcatcctgtttactaatggaaatattaagactactcctagacgttaaataactggccctggtcatactctcaagagacagtagcacctagttctgtctgatattccataagccttcacctacagtgctatatcgcttccttttaaattatatttatgtgggatttttgaaggaggtaattgtctttgtctattttctgctgctgtggcagaataccaaagactatgtaataaagaaaacaaagaaaagaagtttatttggcctacagctctggaggcttggaagtccgagagcatggtgctggcatctggtgaggaccttcttgtgttaacccatggtggaagggcaagcaagcatgtgagatagcgagaggaaacggggaccaaactatactttcctgaggagcccacccccacggtacctaaaccatgccctcaataatggcatttatctattcatgaaggctccaccctcatgacccaatcacctcttaaagttcccacctcttaatattgttacagtggcaattaaatttcaacctgagtttaggaggggacactcaaaccatagcaataatatattcacctgcatcaaaaataatatatataggtgtgaagtttaaaaaaaaaaactccttccctcatttgctcatttttacccctacttactttaaataaccactattactaatgttgcacatacaaccttcttgagcctcttttatgtatatacaaaatatgcatatatattcttctcccatctttttacacagatggcagcacactataaacaccattgtgtacctgctgtttagacctttcttattagtacatgagcagcttccttgtttttgttgtgttttgttttgttttgtttttgtttacagacaaatgatattccattgtatgaattgattacattttagctaaccagttcaaatgttacttaacatttgggttctatcaatcttttgctataacacagtgttacatttattgttgaccacatatgcaggtatatctgtaagataaattcccagaaatagaatggttacagcaaagggtatatatatttgtaattttgatggatgctaccaattgtcctccacagcaattgcagtacttatatttatggtacttctgaggtatagaaggtttttattttatcagttagaaattgtgtttggctgctaggaacagagacctaaccacagcagcataaacagataagggttttcttttctcacagaaatggaatctggaggcaggcagtatagagctgatatgagagctccacaaagtcataaggaacctaggctcctttatttttttggctctgtcattctgaacatataacttccaatctcgagatcacaaaatgactgctgaaactctactgtcacatccctgttccagacaagaaaatcaagaaaaatctaggggtaaaaagtgtctttcataggagtccaaaaatatcattgcccacaccttttggcaagaaatattgggaagtataattttgtgactgagcacattgcagtcctcagtaatataagggttctattaggaaggtcgaatacagcgcatggatattgagtagataagcagcaacctctaaatgtgtcccatatcttgatctttttattcatagagtcctcactccaaaatcaaatacatattacctgcatttctttttatttctttcatggcctcaattttaactctaattcattttgcatttattttagtatgtagtattttaaagcattttttcttgttttagaaagaaaagaaaggccttaaagatctgcccccattccatctttccaaaagaaagaaaaaatatttctatatttataagataaaattacaaaagtattaggcaaattaattaacaatatgcatctacatggttaatctatttggaatttatttttgtgtatggtgtgatacaggaatttcttttgtagttagctaattgactcaatatcacttactgattaatttatctagacctgattgtttgaatttattatatacaaatggtttaaaatcaaatatttggattcaatttccattaagcttattgattattaggaagaggagaaattgatacctttacaatgttgggtcatacccttcaagaatatggcatatctcaatttattcacatctggtgggttcttcagcagaatatcatcattttctttatttaggtcttacatatgtcctgtaggtctagtctcaaggctcttatagctgggttattattgtgaatactttttcttattaagttttctggggtgtttttttttatttttgtttgagagtgtctagctttggggcccaggctggagtgcagtggtgctatctcagctcactgcagcccctgcctcctgggttcacacgattctcctgcctcagcctcccgagtagctgggactacaggcacgcagcattatgcctggctaatttttgtatttttagtagagacaaggtttcaccatgttggccaggctggtcttgaactcctggctttaaaggatccacctgcctcggcctctcaaagtgctgaaattacaggcatgagccaccacactcggcccttattacattttctaaaactttattgctaatacatagaaaagctatgaagtttttacatgttgattttctccagcttgctgaactcttattaattaaggcacctataaaatgattctctcaaattttctaagaagaaactctcataaagaataaataatggttatttaacttgtgttttataatatatttatatctcacacatttttcttgctgttgttttggctacaacctccagactaatgaataatagctgtcagtgtggacatccttgtcttgtttaagattttaataagaatgcctctattttgtttttatgtcctttggcttctaacaaattcccattatcatgtttcagaacattttttatgtttctaatttatacagagattaatcagacatggaaattttatcaactatatcaagtatacttgaaacatgtatccacataatcacgttgcattttcttttaacgaattaatttaataaagtgtattatatgaatagatttcttaatataaaatcattttgaaatgactagattagattttactttgtcatgagattatgttttattattctttggattcgatttgtcaatattttatttagaattttaaaaatctatattcctaagatatatttgtctatagtttcctcttctggcagccttcttctcaggaattgttcagcccaacaaatgaactggaaccttcgtgtttttctgtgcttctttacagtttaaatggcaaagaaaacatgcctcttgatggtcaatgtaactcatttttaaaatgggctggtccagtccctttttgaaagtgtatctttggggtttcaatttcttttaagcttactgtctatttaggtttctaccatttcgttagtcatttttggtaatttacatgttccttgaacgtacttattcacctcaattatgaaatttgttgttgtaaacttgtataaagtattttcttttttttttttttttttttttttgagacggagtcccgctgtttagcccaggccggattgcagtggcgcgatctcggctcactgcaagctccgcctcccgggttcacgccattctcctgcctcagcctcccgagtagctgggactacaggcgcccgccaccgcgcccggctaattttttttgtatttttagtagagacggggtttcaccgtgttagccaggatggtctcgatctcctgacctcgtgatccacccgcctcggcctcccaaagtgctgggattacaggcgtgagccgccgcgcccggcctgcagtcctcattttaaggcctgcgtattttatgcttctccagtgttttcctttttccctttctagtcttctgctggaataaccaactttactttatttctcctgccctcacacatgaaggttagacagtttcatactgaattcagaagccacaatccattttcctctgagctctgtaaaatatatcacatgttctcttagcatttggtatttccactggaaagtctagtacctgggaagctccatttgatcctccttcctttataatgtttttcccccttgtctaaaagtttataggacttttcctttatcctataaattcagaaatttcactagatgtgatttattttcagtaatcttgtctgtcattcagtgagagttaacaatctgaacactaaaacttttctgcaaatcaaaaatatgtttgcctgttttcctccatctcctctgttctcttcttctcaaactcttattacataggtataagacactctaggtctctcaacacttcttaccctcccttcctttacttctttctctttgctctgggataattccttgaattcattttcttatttattagtttggtgtttagcaatgtccattttattgctaaattaaatctggaattttaatagtttttaattgcttggagagctctctttttcctatctcttgtttttctcatagcaaattgttcatatcatagtgatagaagcatccctcacatttcactgacattcaaaattgtaataatcttccctgcattttcagttgtttcagtgaggtctgcatttatacgcagttaacacacacacacacacacacacacacacacacctctctcaagagtttaatgcatgccagatattgttttaaatgccattattaccacttcccaagcaaggagactgggcagagcctggaagccaacccagacagtctgattcagagccaggaacactctaccaccgtgcaataccagcatttgttctttacgctcagctgggtctcctatttcaagttgctacttctacagatttgtccctaatttttctatctgcctcatttttatttacttatttatttattatttatttattgtatatttatttttatatatatttatttatttatattatatatatttatttatttatttattatttattttagagacagagtcttgctctgttactgaggctggagtgcagtggctcactgcagcccaactcctgggctcaagccaccctcctgcctcagccttccaagttgctgggactacaggtgtgtgccaccatgcccagttaatgttttaaattttatttttgtagagacgggggtcttactatgttgcccaggctgttctggaactcttggcctcaagtgatcctcctgccccagtctttcaaagtggtgggattacatgtgtgagccaccgtgtctggcctctcacttttacaaataaagataatgtatccatattgataaccactgtggcctgcacccagcccctcctcaagcaagctgatagcagggcatccacaaatgtgcttgtgtgaggggtggcacagacctggggttcaagccatgccagcttctaagggtacacaaagttatagttccataacctcagagggtgcaggactctgatgtgtttcaaagccccagaatctggtgtctgtccgattttactgctccagcctctgatggccaatgagcagaaatgtgactgccagtgtaaagcagcaagacagcctaagcaaagcaggctcccttgggccacagacgtggcttggcaatggtgagtgccaagggcctctgagcaggacacagggtccgctacacagctcagcgtctcaaaaactcccaacatcccagaacaagacagagttaatcagctacataaattgagttaattagctacataaatcatgaaatataagttgttcttatctaaaattataaagaattaccaacttttaaagataaacattaaataagatgaccttttgtagacatccctactgctgacactgccaaaccactcgcgcccctctcagcacttcacctgtgctcacctggacgccatctgtttcctgtcttccagaaattcttccaacctggcctgtcaaactcagccttctgggttttccagctctgttgcatattttatcctaaatgaacatcccttcagttatttcagcagaattttgatagggaaggaaagagagcacgtgagctcaaatcaccttaaaaatgagtcttgtatttctggcagattttatgctgcatatttttaaattaattatcataattttttatcagaagaaagtgtgagaaggatttttcttggtgaagtcacttcaaccctaaaagtttgggtgaattcacggctactgtaaaggtaagccacaagcccacttacgacagctcttcacagtaagataatgtatgtctaaagatcctccattcgttggactcaaagatatttatttttgttaaatatcatatttccttgcagaccagagagcagcatatctagagagtaagctaagcttaaatgagcttcagagtggcccctttatatatttatttttaagggcatttaaaaagattaatgtatccatgacataagaatacaattataatcgtataaccttcattaattaaaagagctgacgtttaagcagagaagttagtaaacagggtattgtatgcagtggggacagccaagttcaaagtcaaaaaaggagctgtttacattagagaaatagcaaagagtccgaggtagcaagaggagaaggaagcagagagcgatacagaacagtgccagacagagacgtggagtccagatcctgttgggtcttgtaaaccatggcagtaagcttgcatttcctttgaagagggaagtgagaagatctgggatttgggagagtagtttggtaactccattgaggtggtgttggtgagtgtcaggtgctatggtggagttgcctgggcagagagagctatgcatcctcgagcatcatctggggaactaggaatggacttatcatgaatggatccagattcaacactaccgtctgaagcagcactagctcaggttgactggactgtgcacttcaggctgcaggaggggctcagggggttgccatgggtctctttccaggactagcccctccctggagcttgctcattacatggcaatggcaagagcggtttatatactttgacaggatattatttggttcagagtcatcagggttatcctcttcgtgaatgtccttccttatcaatataaaatcatatcatgtaatggtttttgcctttgagtctacttcttccaggataaacactgccacctttactgtcttattattacatcagcctgatacacctttgctcattccttcattttttgccttcctatgtcagttatttttaagctaattttttaaaataacatacaattggattttgcattttgatttaagctaaaagtatttttattttagtaaagcactttaagatattttctatgtattatcaaaacaaatacatttgctcttataacttctagactagctcctttttccgccctttattttatgcattatatttttattgctcttttccttcctcttacgctttgaaaacttaatccatctttttattcttctcatggttgtcataaaatataaacatattttaacccattttctctaattataaaatgtcaactatcaaacaatatttattatatcaatcctgagtaagatactaaattttagcacactgttacttcctctgtacttgactacttttcaattttaattgatagaggtggggtttttatgctttgctttcagccaccctcctccacagtctacattttatgactcagcttaaaaggaatggttctcaccacatagaaatggggtgattttggccccaggggacacttggcaatgttgggagacagtcatgattgtcactggtgggaaggtgggtgtttgctactggcatctagtgggaaaagaccaggaatgctgttcaacattctacaatgcacaggacagagtccacaacaaagaattgtccagcccaaaatgccaatagtgttgaggcaggaaaattccattttagaggttttgtggctcttatgataattgtaagttaatattactcattgtatttaaattatttttaccaccagtactttcatatcctcactcttaaatttttaaattcctgtttatccctcgacgggctagaaaatatttttaagtaatttttttttcaagtagactctatagaaaggaggaattatacttccctaagctgccagtatttgagcaaatctttctaacactctcagacacactcactggaagcagatgaagctattagtcagtcattccccagcctctgagaaggaatatttttcttgtagatgttttccctcatatatttgcacatgttacacttccatttgttaatcgcctgtccttatcttacccgtttacctattcctatagtctatgatgcaatacttttatgcattttagctcttgcataatgtatgtgttacaaatatttaacctataatatttaagatatcactgatacttaatatttctaatttttaatgtacagaaagtttaaaagtttatttttttaaaatttacctcactgtctcttccttcacttttttgctagaaaggtcttgtctattctgagatcaacattttcctaagtgcctcatctatttgttttcacatgcgatcattttaagccatgaggatttattttggtgtttgaaaataccctcaaattgttaagcaattctcataatttggtttattaaataattcatcctttcctctctaatatgaaatgctacttttatggtgtaccaaacacaagggcctgtttctgcagtttatgtcttgtttcatcaaatctatcttttcttaccctaaattttatttcaattattttggctgtataatgtttttatatttgccagttttccttcattacaattacttttaacaaccatatttttaattttccttgcccatttattctttcagaagaattctggagcaatttaatccagtttcaaaaaaatagcccttgggacttttggttagaattgtattacatttccaaataccggaagaattattgcaatactagatatcctcagcccatcttccatttctcttttcttctacaatttttatttctttattgtttcctctgagttctggaaatttttcttaagtttaccttttccttcgctaatccaatttttcacataatctgccattcttctggtgcaggggttttgaatgtagtaatcctatttctgttctttatgtgatccttactgatatcaaatcatttcattttggggactctcaggtctattttcataactttgggaagtagaaaaacactctttcccctatcccttgctatatgtctattttggtgaaaagcattgactaactctttggaatgaacaaagctagtcttcttagagtctagggatgtctctgtttttcctcgcagagacaggtctgtatttagcccccttgctcacagttgagagattgctgtccacatacttcaggcccagaaaaggaaggagtgaaatgctgagatttgctctggttttatttcacctgttcagagacccaggggacagtgtcagagttcaagggatggtcacaacatccagcctgactcccaccccttctgctgaggcagccatgagttagccccagcagtctccacagttcactggctacacctgccctcattagaagtccacagccctgtcctcccaacagagccatctgtgtctattgaacccagtgtgtgcactgctgtgggcgcctgttacccagtggcattgatggaattaaaatgcatctccccaaggcctggccggctgagtgacagggcatagatgggttccccagaggtccttgcccattccccagaggtccttgcccagcctatctgcatgaaatatggaagaaatgctagctaacttaaattatgcatgttgtctgatttacagcccaagtataggtttcagtttttgcatcccttttagttccttctgcagtttaggaggatgacattgacatctgtgtccaactcgctgtctctctggatatttaagaagtagaaaggtggtcaagggaaagttgaactttatttatgtctcagtttttatagtgagaatatttttatttttctcatttctcattttcatattttttagttaataaaaatagaaaggttttaaacaataaagtccaagataattcctaaaacactgaatttttcctaatgtgagttgagactttaccaaaattaccctcaaaaggagcaagttgccttcaggcgaagtcctcacaaagcctcttataatagtgtgtaatagtaagtgctctcaaaattatattactcataaaataaatttgtatttaggagaggcataatttcccttaaccttaatcaatgctaattgagctcttagggaaatgacccaatgaaataagtataaaaaggatgaaaagaaacttaatgaagatgtagtcactattgcttgggaaggggcctgcacttcaagagtggggtgtcgttgttaaaaagccttctaaaatcaatttagaaagcaagacactaggattgcagaccatcatctacaggataagcaaagagagcaaatgtatttgacgttagaaatttgggaatgtgaacttaggtcttaggataaaatttccagcactggctggatgtggatgccaagagttctgtatctcatcattttggtggaggagacattgctagcagctctgctctgacaactctgtgtgagactcaaaaagcagctggaggaggaggagggctctgatatcaaaggccccttggaggagttaggataaaatagtgtcaagaactgtgagagtaaaaaagcagtggtttgaaatcaatattccatatacataattttaaatgtgtgtgagtaaacaaataaattaatttccataaggagacatttgactgattcatctacagtccaaagagctttgatatttaagttgcctataaaacattttttggatagtcttcttggagaaaatgggatatcaccttatattagagattggagatcaccttttatttggatttttatttatataaaaatacatatattatgaccaggcacggtggctcacgcctgtaatcccaacactttgggagtccaaggcaggcagatcatgaggccaggagttcgagaccagcctggccaacatggtgaaacccagtgtctactaaaaattcaaaaattaaccaggcgtggtggtgcacacctgtaatcccagcttctcaggaggctgaggcgggagaattgcttgaactggggaggcagaggttgaagtgagctgagatcatgccattgcacttcagcctggtgacagagcaagactccatctcaaatatatatatatattattatatttttttctcctcttcaatttacatacttggtacagcagccttgaccttcacaccaagtcaaagtgtgtgaacccagaaataccaatgtttaggatgtaggcaagtaaaaaaatcacacgttttgtctaacatctctccataggctgtccctgcttaacccagaacttcaggcaaccccaggccttgagaaaacaagaatattcttattgggttacagtaggagttttgtgctcaagtcaaaacaggtgatactaaatttttcttaatcttcgaattccatgaccctatatccactcaacaactccctccaccaacccatgtcagtttctatcaattattctttgtcatttgccctgagcatgtttaaatttaccaatttaaacatgctggtaaatggtctgaaccatttgaaaacaatctgaaaaacaattttttcagattgttttgttgctgttgtttactattgcttcttatgtcccattccttgcctccaggcctcatttttcttcttactgaagcacaccccttggtagctctttcagtaagggtctgtaccgaaaacacttttggagccctttatgtccgaaaatgttcttcacatcatgttcactcttgattaatgtattagttggtaataaaattctaagttcacttcctttacctcaagaaacagtggagctattctctttatcttcatgggtagacagccctgtttcaactcctgaattcacacagagaaccaggatccaggccgtgctgtgaatgagatttgtttgaccccagtcatcagaaaagctttgaggaacgcactgtgatgttgttattcagtactggttacgaatagcatggaaagcttcagatctcacccttttcccaatatgttgttggtgttgttattcttgtctcctgtttctggttgaagaagagctcccttccttgtttttgaacatggagatatatttaatattacccttttgtatttgatctatgtttggaatgagaagaaggctcaatgtgagctcactctgacatcttgaaccagagaacttgaaaaaatttaataaatctataatccatttttctcctaaacttttttctataaattctcatcttttctcatttgaatttccccacatctctaatgtcaagttgctttttcctatattgttcaatctcttgccaggcaaagggatgggtatagctcagtgatttaaaaatatatacatatataatatatatatttatattattataatataaccatacatatctatttcatatattatagataattatatataatatatattagtataaccatatatgtctattacatgtatattatatattactatattataaccatatatatctattacatataatatataatataaacatacaatatatgatatataattatatattaatataatatataatatatgtaatatatatgtatggttatatatttttaatatataatataatatatattatattaaatataatatatattatatataatatatattatatttaatataatatatattatatataatataatatatattatattatatataatatgatataatatatattatataatatattaaaaatatatactttttttttgagatggagtctcactctgtcacccaagctggagtgcagtagtgccatctcagctcactgcaacctctgcctcccgagttcaagagattctcttgcctcagcttcctgaatagctgggactacaggcacgtgccaccccacccatctaatttttgtatttttagttgaggggagttttcgccatgttgtccaggttggtcttgaactcctgacctcaggtgatccaccccccaccccgccctcccaaagtgctgggattacaggtgtgaacgaccgtgcctggcctatatatatatttttaagtgagacctctcaatttatgactatatgtattggaggtctctttccagaaccatatatatatacataatatataaatatatattataaccatatatagctattacatagctatatatggttctggaatgagacctctcaattcatgattatccaactgggagtcttttgggaaagttacttcacctctgtaagcctcaggtttttcatctacaaaatggagataataagcataacaatttcttaaggtggttttggagaattaatgatacttggtaaggaaagtgcttagcacaaagtgagcactaaataaacattagttattttattatgacctattgtaagtttttgtgtttttattcacattatgcaggatcctaatgtctagatatatttctgccacataatagccattcaataaatacttatgaaggaattaatagcagtaacagctcaaaagcctaaaagagagaaagtaacagtatattttgagttggggagatggaatttcagcataacattctttaatcagcttttcaatccatgatttcttatctttttaagagccaattactggttaatagatagaattttctgaaacggagcacaggaagctattgtagggacactggactggcaatctgggtagaagattcttttcctcactttttcttgtttacctattttctctacttagaaacttttctgtgttgtgtaatttccataaggcaacttacacatttttttaaaatctgtgagcctgatgggataattgattttgaagtcactccttctgagttttaattgcagctcaattcttaattgtgtgaccatgtacaattgagcttatgattcagtctccccatatgtaaaatgcagataataatagatagcaaaagtttttgcttattgttttcaaaaagaagccatagtagggagagaatttttcagtacccagaagctgcgacaagaatatagttaaaagcaattccacctggcctcctattgtgttttattttgttttgtttctgactgaatcatctgctacggttaagcccacctcagcaggctgcagctcctcccagctctctctcctttcaatctcatttcacaagcctagtaatgcttccattgcctcctcctgttaccatttttttgtttcctacaggttgagattcagtacgttctaagagggagttcagtttctgctccattgaaaaataattatgacaaagcagcattttccaaaatatgtttactaataaatgttaggcaagaaaatgtttctatggcccaggaatttagggaaacactcgtataaataatattaaacagatgtctttatcttaagactatttgacattttaaatatcagaagattctgtcgcttttctgaaaaaggggacaggataagtcacttgcaaaatgaaaatgtttttttttgaggcatctggagaactacttttatgaaaggcacatgttgggaaatgttctgatggagctaaatccaaagaggatagtaagacaagagggatgattggagggaagaagggaaggaatcgtgtgtaatctggtgacaagagcagcaccatcaaaaccccaggcttggctgcaaatctcggctctctgccacttcccagccatgtgattgaaactggtcactttaattcttttacaagctgttttctcatctttaaaatgggtataatactacatctctcaaaaggtcattatgagaatttaattagaaaaatcaagcacatagcctaataagtatgctttcaagacaataaaaaacataaacacagaaaaatgtcttattttccttatgtattttttgcattcctagcatttgcaatggcatcaatcatagtaggcactcattaaacttttgctgaataaataaatgaacaaaaaagctttatcaattcactgaataggtaattaatcaaacctttgcaggtttagcactatgccatatacacaaaaactaaacaaaatattatcattgtaattaagttgaacaggatgcattttgctactgttaggcattcgcattgtgagtgctacagtcttttcttagcctgacatttttctgcaaatgtgttacttccaaaatgagggcagaatttgcatgaataacgttttggtactaaacactgtatttattaggatgaaccatttttatagggctttctaaaacacaattatatggacataaagatggacaatacaatcttatctccctttagccaaagagtattgacaatgcaatttgtgcaaagtttatgtgaattcctgtagttcctcagtcgtttcttggtttgtagataaattatcatgttgagtagattctttgttttcaacttggcattttgatttgttttcttacttgtttacttgacaccaaacaattaaattatgcccccccaaaaaaacgcataaaaataagcccttcggtgactgaacctgcatacagactgatgcagaaaaggctgaagcttcccaaagaggattgtttgaattctcaaacagaagatggtcccaggcaggcaataactgcttctgtctagtgggcattagatttataaagtgaaactgcttttctccaagtttaaaagtataacatgtaaaagtttgaccaggcctcattgcacaagtggagtgctaatgagaaatgggaggactcactgaagggaggacactgttcgcataggaacagtgactcagtgcctcgcagtacccttccctgatttctcattattgctccatctatgcaagactgggttaaaccactgggttcactaacagaagcatttccagtgactccagaatctttttaacgtcctatgtaaagagttcagagcaatacatgatgaactgcacacaaactctttcggccttggtaactttcctgaggaaatagatgtcagacctaatcacaactcttttgccattaagtcttaggggaaagtttctcttgaaactatattggtatttagaaaaagctttgaatctaaatgtcatgcatctctcatttagatagataatttgtgagggaaaatagtctggatgctattggctcattcattcgttctactaaaggtggaatgatatgttaatgtcttatcagccaagtcaacctagaaataagaatgtcaaccatgttaaattgtaagattattcaatcttatagattataattccctatagcatgcagagttatttcacaggctttatcttcttaatttgacaaattttttagagaccctacttgccaagcactgagaatatgaagttgaataaggaatagtctctaatctcaatcaattttcagactaatggaaaagtctatcatagaaacagttgttatgagctctaaaatcatagatgaagaataattaattctcattgctgaccagaggtaaatagaaagaagagtcaaatttgagctgagagccctagagggatgaaagagagtttgtcaaagcccattctgaagtgaataacacggtcataagaatgagccatggggaatatgacaaacagcctggtgtggccaaagggtggtggtggcagtggcagaagagaagcagcctgagagatggctagggccagaacaagagccataggatctctcctagtacaggtgggcttcaactatccgcgtttttacatgttgctttggcaaacttgagagaattgatgaatgccttctatcccttcaccaagattgtattgaatcctcttccatatacctaccagcagtgttctaggctctggggatacaacatactccctgatttcatagagtttacattctctatgaaacagataattaatttaaaaagcaataaataaaaatctatatatcaagaaataaatactctgcagagtattaaagcatggaatattagtcttttctcactttgctataaaaaaacacctcagactgggtaaattataaagaaacgaggtttaattggctcatggttctgcaggctgtacaggaagcatagtggcttctgcttctggggagatttctggaagcttccaatcatggcagaaggtaaaaggagagcaggcatcttccatggcaggagcaggagcaaaagaaagagtgaggggaaggtgctacacacttttaaacaaccagatctcacaagaactcattcacggggagcaggcatcttccatggcaggagcaggagcaaaagaaagagtgaggggaaggtgctacacacttttaaacaacgagatctcacaagaactcattcactgtcatgataatggcaccaaggagatggtgctaaactgtccatgggaaacccactcccctgacccaaccacctcccaccaggccccacctccaacactggggattacaattccacatgagattttggtggcgaaacagatccaaatcatattacatgataatgtgatagaagataaataggtagtacaattagaaaagatggtcagaaaaggcctctccaaagagcctacatttgggctaagacttgaatccccccaaaaaagaactaaacatgcaaagatctgagggaagagcattccaggcggaagtgcaaaggtcccgaggacagaacaaattctctgtgttttaggactagaaataaagctgggtggctgtagtgaagggagttctgtacatgtatcaagtagctattgttgcataataagccatcccacaatttaatggcttaaaacaacaatggtttatttagctaagtattcttgcatgtcattaatttaaaccgagttcagctaggtgggtgtctcatacatctatggacagctgtgggtcatggaggcaactttgctgatcttagccaggacctctagcatttctggggttttcgtgggagcatttgaactgactcaactctgccccatgtggtctcccatcttccaggaggctagcccggcttggtgactatgtaggatcccaaggagagcagaggctcccaggcttcttgaggcctaacctgagaactcacacaccaccacttctgccaaactctatcacagagtaaatatcaaaggaaatcaaaggccagcccagatttaaagggaggggaaacagactctgactcttgatggaagaatctgaaaagtcacatggcagagggagtgaatgaagtagacggagcagtggagtattgtggccattttcgcacagtccaccataaaattgaaaagattgaccagagacagatcatggagggcttggcaatctgtactgatgaagccatggaccagaagagaagtgagtcaatgaagagagtttctcttttcacatggccataaaataatagtgagggctatgacagcaaagaggaaacaaaagctgtagtgatgagtgttagacaattgatgagctgggagagaatttgttgatccaaatgcaatcttctcatccttactgtgttccagaaagttaataggaaagctgaagttcaaaaacagtctccaaaatttatttaaaaagcaatgaataaaaatatatatgtcaagaaataataaatactctgcagagtactaaaccatagtgtattagtatgttctcacattgctataaggaaatacctgagactgggtaaattataaagaaaagagatgctgggcatggcggctcatgcctgtaatcccagcactttgggaggccaaagtgggcagatcacttgaggttaggagttcaagaccagcctggccaacatggtgaaaccccgtctctactaaaaatacaaaaattagccaggcctggtggcaggtgcctgtaatccctgctactcgggaggatgaggcaggagcatcacttgaacttggaaggaggaggttgcagtgagccaatatcatgccactatactccagcctgggtgacagagcgagactccatcaaaaggagagaagaagaagaagaagaggaagaggaagaagaagaaggggaaggggaaggggaagagaaagaggaggaagaggaagaagaagaagaaagggaaggggaaggggaagggggaggaggagagaggtttaataggctcatagttttgcaggctgtacaggaagcatagtggtttctgcttccggggaggcctctggaagcttccaatcatggcggaaggcaaagggggagcaggcatcttccaaatcaggagcaggagcaagagaaagagcaaggggggaggtgctaaaacacacttttaaacaaccatatcacatgagaactcactcgctatcatgacaatggcaccaaggagtgccatttccatacacgagtcattccaaccaccacactgtccccctgataagacttgctgagacatttgctgatacctaattggcttagaaatgcaaaagtacacctctaaagatgaaatttgaccctttcccccaggctctgtctggaggttgggttgctatcacgaggttaaaaaacattgatgataataaacaatcatgataatattttcttatgtggaaattttattacctgatatttgcaacatttaaaagagctaatgaaaataataatatattaatagccaacactggttgagaacttgccttgttcctcttatcttgacctctgagatgccaaaaataaatgttgccaatccatgcatgtgcagttattcaagctatattttcttgaattgaaatataagtcttaaaaccagtctgttccctcacagcagattgatttccttgagattagagagtaggtttcatttatctttatgtatctagtaggtcatatagcatcctgcaccaagtaggccatcaaaaaatattcatggaggcagtggctgacacctgtaatcccagcactttgggaggccgaggcaggtggatcacgaggtcgggagttcaagaccagtctggccaagatggtgaaaccccgtctctactaaaaatacaaaaatttttatttttgtattacgggcgtggtggcacacacctgtaattccagctactctggatgctgaggcagagaattgcttaaacctggaggggcagaggttgtcgtgagccaagatcgcaccactgcactccagcctgggctacagagcaagactccgtctcaaaaaaaaaaaaaaaaatcatggaaaaagtgaataaatggtcttcctcagggatagaaagggtaaaaaatgttttttaattagaaagatcaacaactagagtagtttgagcccattaaacatagagcaaacctccttggacaccctccattttcatgtctgtgtataaattgaacaagataatgaaaccttctgcttataagaaaaaatgttagtttctattctgcattgtagtagattttaaaaagatttccattgaaaacatctactttttaacatttggtgctaaatttgtaagttcctgtttccgaaaaaaattcacttaagttgactaatttatttcctgataaatattacatgaatatctcatatgaatatatttctttaaaaatttaggcacctataacctgattcttatcccaatagaagcaattaaggggcaggtggtggtatcacctttaactgaagtagtaagctgttggtcttccaaggtgacccagcaagcagatgactgaatccaaaagtgggtgatttatcatgtcattctgggagaacatgaagaagttctcagcttttagaatgtaccttaggccaattacgtgcacgttgacaaagatggatgtgtcttcattatgtagtttattatggatagatcagggctgggacaagaacctacatcttgtgatcctagtacagtacatttttaggaagcacaacccccatagatgaccctacaaggagcctatactggagtgaaataggaggctgtgagttttacaagacatcaaacaatggctgcaaacttgattttataggtttagtaatatctccagggaataattctctttccctttccctacttctgtaattggtatatactctaaatgccattagacccagcttgctctaaagatctgtagggatagtatttctctctctccctcattcagtatgtgcccatgtcaggcctaactgaacacagggaccaaataaatagaagatattccattcagattttatagcctgactgctttactctgcaacctctattattgagaattatctattttgactgcaaacacgtcatttcatcaaaggttctttacaaagcagatgacattgaaaagcagcctcacatttttcaggtttagagactagatttttatggacttggaaacttggaagtcagctcaccattctggcatagtcttcctgccaagcccaaattctgaaatcagtgtgggagcaatcagtgggtgacatccatctcagagtcaaagaaacaggggacttctgattccttgtaatttctctagaagtaaatcctcttttccttgactggcactcttctcttttgagggccaataacaacctactcattaagaaccatttaacattttccaaaaatacttccaaaaccattaactcatttgatccatgtatcaattctatgaagtcagtaggccaaatattaatatttgtagtgaacaagaaagccaagcacgaagtgttcaaaaaactaacccgacaacaaactgaaaccctggatattatcaggataacaaaaaaatcacctgacctgacccccagttaggaaatttcccactgtcctatgcactgttctgcacacagtaggaaatttcccaattaggggccaggtcagatgattttttttgttattctgataacattcttctcttctagactatgagaagagaggtgctgtagtggtggagaagcgagtgtgtgtgtccccaagaatattttaggtatggccaccaagttagccctaaagaaactacaattaaactaggaaatagagcagataaactctgtgtctagaattctaaacttcttagatttatatgtcctaaacccaagtctttcccgtctcttttcaggctgttcccacaagtactgacattacttccaaagaggagaatttgggtcactaatctagcgaaagcatcttcccctctgaattcaccatcaagatgaatgctatccactagaaatataaaggaagccacataggtgatcttaaattttctagtgggcacattttaaaaaggaagacaaggcaattaaaatataattttaataatatatttcacttaacccaacatatccaaaatattaccatttcaacacatgatcaatattctaaactacattagtgagatagttacactcttattttcattcttagtcttcaaaatccagtgtgtattgtccactcacagcacacctcaactcagaccagccacgtttccagggcctcaaagtccacacctggccaggagctgacggtctagctcctgtgagtaagctagtcctcagattttataaaactctctcttcagggttgtgctcaccttccccctcccactcctgctgctcctgacctccatcaccagaagagacccccaagagcaaatcatatttttgtttccaagagggcccactgacaacactaaaacccaggaggaagcagttgacttaagaccttcgagtgactcactttgtaggaaaagcagagaaaggctggcaaacaagaaaaacataagctcatttttctccccctcatcaacctcattccccaacctgtttgcatcctgaagagggcagaggcctccaaagttgctttagagggcagaggcctccaaagttgctttctgggtcactgcggggtgattcacccaacaataggctataatttacaaggtttttctctgcaagtcaactcttgctaatggaaggacgacatgaatgttgaggctgacaggctggaagataagagtagttgtttgttccctcagcccattgaaaaatccagccccaaacccatttgaagaacagttcctaatagataatgagacacaaatcgtgtgtacctgattgtaaatgaatagctcatatgcacaaagcaaactgtaaaacctccatttctcagccaggatagcactccattaatgatgtgcttttgtttcttccaaagactaagtgctcctttccaggagaaaatagacctcaacctcacctccccacccaccatgtccctacccccaccccaaagagactgcattaccctgagtattaatatacattgcctaacaaataggcaggcaaccaaaaactgagcaattttagccatttaaaccctgtcttgaaatagcaactcactggataaatggacctaccatttagcaattttcaagatttccaacctgctttgatttcctctctaggtagttttttattttgtgtttcagcgggcatcaactttgcaatatcaggaaaaaccagagccaggcttgaaaataatgctgagacatctagactcaaacccgggacacaagtgggaatgaatcaagccgggaggatttttccaaatctacaggaagtgaaattcttctgctccaggcaatgtttatcacccatgtagaaacctcattggtttggcaattgtgagctaacagggtatggcctgagttatgctctgaatagcttacagttactgccttggatgtgaacgatttgggagggacaagtctgtgcagtggcctaaagtgaggcgtgagtttgtgcctagcttgtctgtgaaattgggtttgttttttctgcttttactacacattaagccagatgaacacaaggacaccagttgttacttttgaatgatttttaaaattacatctctagtagggaatattgatttactttattgattttttaagatcctttctatttctttagtgtctgctagtcagtggcctcaaaaattgaattttcacgtgttgtctttgccacttaacattatcagaagcttcttgaatgtttactaatagaagtgtgactcctttcatgcttgctgtgtctaatgttatttttgtgttagcaaaattgctcttcaggaatatgctgatggctaacttgcagaaatagagatttaggatagacataatgaaggacttccctacaacactggatattaaatgctgaaaaaggcttttcaattccttcctgaaataagccagggccataagcacttagcccactctatcgaagtctccccgagaaaaccctgcggctttctctgcggattcctccagcccaacaccgaggaaccagggcctgggacttctggagtccctcccaggactaattcccgctctgatgcccagcacaaatttatcataactgcctgactctctcagtgtggtgtggtggtggtgatggtgtgtgtcttcctgagtgtgttggttggggatgtggtgggaggggttggccagagagttgaataaagaggaggaaaaaaaaaaaggaattagatttttcagaactgcacaaccaaagatttgcacacttatttatagaggtgacccgtgagcttggttgaccctggatgcttttctgcgctataagggaacccgtgggtggccgatcactctctggccctccagagggggcctccctcctgcgcggaaagcgtcccggtgcacagcgcccagctcccgggtctctgtcggacctgcgactcccggcgcctttctggtgccctccacgccctccacgggcaggggcggagctgaggggcccacacagctccctctgccccaaacggggcagagaatgagtaggtgcctgcagccaggggcgcgcccatcctttcgcacacaacaggctcctgttctctaggcagtgattaagtgagaaaaagagaagcctggcttgggggtgagtctggcgctgggtgaatgtgaatcgccgacacggtctcctgcagggctgcggcgtcctggcccgtggctgtcattctgtcccggtgcttcacccccggccggtgtgaagccagtgtgaatccatggcccgcgcggacacacccgccaagcaggcacaggagcaaggggctctagctgcgtccactccccagggttaaaaattaactgtccggccttgctggcatctctgttgacaacgcgatcattcctgctgggagcgagtgcgccacagagattaactctgcctctccagtcaggccgcctgggttccactcctaagccttaccctctttaaggctcgttcttcataggtcagatggatctcagtcgtcctgaccgcatagggttgctcaggcatagaaggcactgggcacctggtgtgggcaagttgtgcctgctcagtaaatattaactaccgactcacaggacatgcctctctttttgctaccctcgcacgtttcttttctcgtttccttctccattgtcactgacccagggttggctgatataagtgaaaaacaccaagggtgccgtctgttatctaagtcatgcaaatgctttaaaattatatgtctgtgtatgtatgaatatatgtatcaggctctgggcacatagaggtgaaatatcatgtaagcaagcacttgtataattttcttcagataacaagcttgaaaacacagcctctacttgtttccttcccttccctgtctccctttctctaccagagctttctggaccatctccaaataaactacttgctctcaaatcccagtgtcagagtctgattctaagtgaatctagagtgctggcaacccagaatccttttccaggattcaggatggaatcttacaggagatacacagtcctataaaaagttagaataataacgcagcatcaatttgtgcttgatcattaagctaataatgcctcctttctccaccagccccatgtttctgatactgtgatgtgtgatgttgtagttgtgaaatgtaatattgtgatgtggcagacagattataagagttgaatgcaccaggagatttcctgtggcattataagagttgaatgcaccaggagatttcccgtgacataagtaattctcaggccctatgaagtgcaggctttaaaaaaatctggttcagcagccaaaagtcatcaaaaattaatgctagtattttctctctcagagaatgctaatgggaacatgttctaaagtccacttttctttccttccttgttttctcagctttttgagagtgccacattctctctttttgccctgacatctcccagcttcccaaacattctgactcagtcttttcttctctcccaacagatgctcctgctagctcttagttaggtaaatcaacttagcctctctatatgcattaattctctctcagttcccaaactctccctaataaagaagaacttgagagttgactcagctgtcccccagtataaagtggtgggcatgagggagagaaatgtgaattactgatacataattttccccctattaaactttattccttggaacatctttgtgaattctgcaaattcacaaagatattcatagtcctatattcatttgaattatccaaagctccttccagacccagttgacccatcttttctttccttttctcactggagtgggcataatttcctgccatttcccactgtgctgccgccaattctggctgtgtccattagtgtccctcttgacaaacttggatttgaaaaatgggcaactaaatcttcatttattagacgtgtttttcttttactaacagctgccatctgttcctctccacctcaatacaactcccccaatccctccagcatcctttttggacattttcattccagttcctctttattcatgtgcacattcaattgccagacagtttttgaaagagtagaaataagaagtaacagaaaatagaaataataataaaatactacccccaaaataaaagagacatgggaagagtttcttttttcaaaagggaacacataaacaacacatgaaaggttggaaaataacaaagaaaataattttttaaaaaaagatgtagacgcaggaaggacaattatggaatggctggaaagattaataataaccaaatagcttgagggttgcctgcagcagagatgaagagaataaatcagaatagaaaaaaggtttgcctgattctattttacagacagtctcttaaaatgtatgtgtcattcaaatttgttttgatgtgtcagtcatctccagcattcatcctgggctttggatgctacttagttgcacgactggatgtgttctaagatctgccatgcaggttatattctgatttacttgcttacagtgagctcctatttggaacatagttctgaatgccaaagaaaaccaaagacagaacacttccagctcaatttccatctataaagtggtcaaagaaaactccagtccttgaacttgtgttctagtcttttatgcactgtttagaggttctgcaggggctttatgcctgccctctgtgagagatgaagcatgttaccggctcctgatgaatggacatttaagatccaaaatgtattgaagtcgagttgtcatcacgtttttcatttgcccaagtcctatatccaaaaaaaaatgatgtttttcatcatttcatatagatgaaaaacaacattaccagcccctgtttcaaaggcaaaatgcattctgcattgtatatgagttgggtaatgtcaagtgtctgtgattgcagcgtgggagttgttttggtctgttttattttgacttaagtcaggaaacaataagtatgtttgtcattttccaaacaatatggtccaaaaccacttgtggctggtgttctttcatctccacggggcattccacccaacaatcaccatctgccagggacgcctatgaatgtcaaagttctgctaggtttctctgaagcctgcttctgctttcagcagctttgaataagctacagggccacaatttacttctattgtcatttcttcagggagatagagagaaatacatctgccactttagacaagaagcccatgggaagagtacacacacaatcagaacagccagagcaggattattcaattcagctgcaatcagaaatgggggaataagacagagaagaaaagccccatcttgttatgtgtaatgctcatttctgagccagtgtttgaagacagatcatgctttgtgagaaaaacatattttttcatcagataggatgtaatcaaccaagaattaatcattagtgagccattaaataattaattgtaaattgtaactaatttctgattattaaaatgactttttttttatacctgggctcctataattccccattttaaatagttaccaagctacgccccgataagataaagacaaaaaagttgcaataagttagctttggctatgtaacaaaccattaagacataatagattaccacaaaaagtatttattagttcactataatctgggtcaggcatttaggatgagttccgctaggcggatcttctgcttgtcttgcctggggttcctcacgcagaggcaatcagctgatggtgtcagtaggagccgattggtcttgaacggcctcactcacatttctggttttaatgctggctgctgtctgggaggtgcaagggattgggccctgtatatctccaacagagtagcccaagattgttcacatgctggtggtcaacagtgttccaagatgcagcaagacagaacaagccccagtgcagaaacatttttcaagcatctgcttatagcatgtttactatattccactggcaaaagcaagtcacttggccaggtctagggccagtatgggcaggaaatcacaagggggtgaacactgggaggggggtataaatcaaggacgttactgcaacaacctaccacagacgtatccttgaaaatgcttttatccgtatcaccagaccaaaactctagggactttgaatcatgtaagcatgtgccaaaatggatctcagctatcttcaaatccttctttggacaacttaaattcagaaaggtgacttttttgggcccaaagtcacatgactaactcaatactacattaattatgaaggtattggcaagcatctggaatcactgatatagtagtttcacttaatttttaggataggaaaatttatttataaggggaaaatctatcaggactaaagagtctagaaaatattttcagaaagaaaagacagagctcaggtgggcaggtaaacaagcagatgtaatgagggaaaaccaactgaagctcaaggtgttatgtttttcttatattattttcagattcataaggcagtacttctcaaacttcaatgtgcacatgaactgcctttccagggagaactgtcctactgcaaaaggtgtatgcccaggagacacttagctctcatccatgttgttcccagaaatcatatagaactcataggacatactctgaaacctgaattcctcctcctacagtgcaccttagggagactcgttcccttggtcgcaagacacatcctcctggaatcagtgtcttcttttcataactgcagttatccactgcagcagagaagagctgaattctcatgtctcccctccctagccagcccacttgatctaaaagtgttctgtacccaggtcaagttcctcaggcagcaccaatgtgaaagtgaggaagtgagacaggaaagggaagaaacaccataaagtgtgtgttttcaaggaaattaccagtgtgggcaactgggactcaggcttgctgagcacctctgggaaactgtggagaacatgactcagtcatccacccaatgggaagaaagttgggtgtttatccacaaactccctgtcagagaccgctggagggtgctcggggaggattagttctccagcacatcactcttccttaggcacacagctagtgagtcagagaaaagccttcaggcagagacagtattttggggtttctaaaagcagcttcaagcttgtacaggagaatgcagaaggaatatgggaaaggctagagtccttctgccttaaccatcgccggagtactaactagaaagtcaggactagcttaaatgtataatggttgtgactaaaaccaaggcaagcacatgaaaagcaacacattagtaaaacaagcaaaatgttaggcatcaaacagccctgtcggttatttctgccttttcccccttctgttgactggttgggttatgttgttgttgttatgccaaccaataatgtctcagctgccttaaataaagtatttgttttcaacattattcacccaagttactcaacaggaaagcaaagattttttccttgctttccattaggaagcaatattagttagatctggatttcattctgtccctgtcgtctctcaaaactgtgaccttggccaagttatcctccctcaacttcagtttccttatctgttaaaagacaatagcaattctgaccacataggattgcagtgacagaagtatgtaagcagcccatccatgaaaggcacacaaatgttgtcctccttcttccccactctccaatactctcctcactgctgaggattaaattcaattctacttaatcaatttatgttgaagttttactgtgtgtagactctgtcttggattacatagcaagtatagagctaataatcctttctttctaatagctttccattttggggaaagacaggcatataaagctctaacaaaatcaggtaatgataagtacttctttcaatgtgaagagcatcatgctctgatcctacagggagaaacaaattatcctctattttcttgtaatttacataacagtagttgattccataattcactctcaactgctagagtctgcaagattcccaccaactgccatcttcagcagaattgtattacacatgaaaaaacctttgactaacctctaattgattccgacattccaagaactattaaaaagagttgaaaataatctagaaactgctgacttgtatcaggcatagatttattcagacaaaacagagagacagaaggattttgaagtgagatggttttgtcaattgggcataacaaaggaagaaaaataaaaattatcgttcatgctttgaaaatctctcttgtgatgtacctctctgctacagtacctggcatttagaggtgtttaaccaatgttagggaagaaaactaacactggttaaacacctctaaatgccaagtactataacagagtactcattgatcattttattcaatcttatctactcttcaaagcccacaaaagaaacctgttgatcaagcaaagcttatcacacttcctgcaataagagagaacattgtcttaatggagaatggttttagggcctgagctgggtgatttcgaagttggtcttgcaaggcagggcacttgttgggactggaaaagtttatgaaaagtttctttgggttggtaagcatatggaggtaagggtcttgaaaggagtattgatgagtaagtcatcaatcttgataagtaagctgtttcattggtgttatgggataaactgtgcccctctaaaattcataggttgaaggcccaaccccccttcctcagaatgagactgtatttggagataggccttcaagggggtaattaaggttaaacaatgtcatatggttgagccctaatccaatatgacttatgtcttagttcatttgtgctgctataacaaaatgccattgactgaataatttatgaagaacagaaatttatttctcacagttctggaggctggtaggtctaagatcaaggccaaggccagcagttatggggtctgtcaggagcccagtctctccttccaagatggcaccttgttgctgcatctaccacagggaaggaacactgtgtcctcacatggtagaagtgatggaaggacaagaaaggtgaactctctctgatgcttcttttataagggcattaatttattcatggaagtggcaccttcatgacttaatcactttccaaaaggccccagttcttttttgttttgttttgttttgtttttcttgagatggagttcactctgtcacccaggctggagtccaatggcgtgatctcggcttactacaatctccacctcctgggttcaagtgattctcctgcctcactctcccagagtagctgggattacaggtgcatgccaccacgcctggctaatttttgtattattagtagagatggggtttcactatgttggccaggctggtgtcaaactcctaaccttaggtgatccgcccacctcagccttccaaaatgctgggattacaggcgtgagtcaccgcacccagccaaggccccacttcttaataccaccataatgggaagtaagttacaacacatgaattctgagggacattcagaccatagcaaatagtgtccttataagaagaggagattaggacacagacgcacacagagggatgaccatgtgaggaaacacagggagaagacagccatctgcaagccaaggagaggtgcctcagaggaaacaaaacatgccaacaccttgatctcggacttccagcctccagaactgtgggcaaataaatttctgttatttatagccacctgttctcacagccctagcaaactaatataatcggttcacagtcatctttttggtacttccagaaacaggagattaagtaacatacccaagattacaaagctattaatgtggagccagggttctaacttcagtctactgaactacaaaaccaagttctgcatattttaaactttcctctgaagcagaaacaaattataaatagggactaaatagaaagtaactaaagctttgttatatgtttcttcaattgctcagttttccatgggcagcacagggcactcattgctgtttcttttctacagcctccagcctaggacagcatttttgtttataagatataaaagccagccagtgttttatccaggtgagctgacactcttgtgtcccacccactgtcctcaggcctgaccatttctgggagcagagattctgtgatttccaactgccaatacctgcaactcttcatcttaggcagttcccacttggccctggttcagggcagattggaagttctgagtagtgaatgctccccaccagagaagccctcaaccaatgattgatgggagttggtggacaaataccccagttccctcctccctcacgtgggatgactctgagacatgttttctgtactattcccagaattccccaatgggattgacacctagttgtggacagtagtaacaagcctgataacataccttgtattggctgccttttctccccattgttgctttttgggattgcctcctagataaactatactcaagtctttgtcttggggtcttctggagaagctcaaatgataccaggctataaccactggctccaatctgacagtcacctcccatctccaacacctctgtatggatctctaggtttcttaagcaagaggccactttctttaacatgacctggaagagctggcatgatctggcacctacctacctattcttatcagggttcttaggtttaacaacagaagtagaatctgggtaactaatgcagaaaatgaatttattacaagggcatctctcacagaatcagattagcaagatgggaaccaggctgatttagagacgagtaaccaaggccctaccataagaaccatcgacttaggacactcctgcagaccctagcccaccttggtcctgatcaccctcttcctgctgccagattccacaacccagatactccccctactgctgaatgttcagctatcagtagcccccatggaactctctaaccagtatgtaccctcctggccctcccgaaagacttacagcctgagaaggagctgtgggcttgatatgcttaaaaagcatgctcccacagtgcatggagaaaggtctcttcccctacttcagcatctgcagaaggaaatggggatgtcccaaataatcagggtgctcaaatactgggttgccagaagacagaccccctactgcctcacagccccctcctcatcctgaagtccagccctaccaggctttgtgcagtgtcgcgaggccaccatgcttctccttgccacacagtgtgcatagaaggctcccctcttctgcccagtcaaactcctcttggctgcagaattcaggtcagccttcctcgtggaagatttcctgagaccacaaacatgtcagatcccccacaaatgcatgcacaacagctttcctttgagaaattcatctcccttgtaattgcatgtcatttgcctccctcccaagaagtcagctccctgtgggtccaggctgtctccacttttactcaccctgtgtgctcagcaccaagcagaaggtccagcacatattaggtaccaaataaatagctgttgaagagatgaataagtgaatgaacacatttataagcagctcaattttggtttttcacaaatcactacacagtttgtaaatagcaaaagacattgtccttttggcttagaggtgaggcagctcatattttcaatgagaaagatgttctctcatgacagacactaaaataacccaatggggcgtgtgatcaccttgattacatgttcccaaagaaatacttttttaataccaaatatttttcaaagtttttataaagccttccatctactcaatggtaggtcatatctcaattaactattgctacgtaacaaatgtaacaagtgtctccaaagctcagaggataaaaacaacaatcattggttattgtccattcatctagacgtgggctggggtaaactgttctagatgaggctcagcagaaagcgacaatgctccacgtgcctctcatctttcttaactactaatgggctatcccaggcatgttcttctcaagccaccagtgggctagcccaggcatgttattctcaagccaccagtgggatggcccaggcatgttcttttcaagccattagtggtatagcccaggcatgttcttctcaagccaccagtgggctaacccaggtatattcttctcaagccaccagtgggctagcccaagtatgtttttctcaagccaccaggggcctagcccaggcatattcctctcgctgcaatgacagaagcaaaagaggtcaagtggaatcacaggagtcctcttaaggcctaagcttagtcatggcccactatctcttctgcccccatgccattagccaacacaactcaacatgatcaagtccaaagtcaagagtaggttagtacctccacccacaatgggtacagcaaaggatgaaaattcaaagccaacgagcaatctacctcaatattagaggtcaggtgaatgataagaagcatttagagaagcaaacagccaaatggcaatcaagccctccatcagcgtgtatgttgtatgcctttgaaaagctgtcagagacagtacttgtcaaaactgtcaaagtcatcaaaagcaagaaaagtctgaaaattgtcacagccaagaagaacctaaggaactatgatgaataaaagtaatatggaatcctagatgagattataggtcagaaataagacattagttaaaaactaattaaatctgaataacatatgggctttaataataatatatcaacatcgtgtcattagttgtgagaaatgtaccatactaatggcagatgttaataacaggggaaattgggtaaggagtatatggcgactctgtgctttcaacatttttataaatctgaaactattccaaaataaaaataaaatggttttaacaaacacagcagtcagagatggaatgtggtttatgacagcaagaattattgcttgtctagactcaacaagttcttaaccttattacagtcttacaaatgacggatttgttatctagggaagaaaaagccctcttctgggactctgagacaaaggatttatttgtacccacctgagacgtgctcagagagggactggaggtgcatggagagggctcctgtcagaatcttcaatccgggggaggccagctgcctgggatgtggggctgcctgccctcagtccctatgcagcctccctttgggctccttccagcctcactccactgtgatcttactcttctcagtatatctgtagtcttctcatcctcccccttcttctgtctcctcatctgtgtgaaaagactggatgaattctagacccaactccaagcttctatacgtttgcagtaacacaatgtaaacaggctaacttaaaagtccacagctacaagatcatttatttttcaaaatctaattgaagtcacagctcctttcaaagaaagcactgttcacctcaaagaaggtatcctgagaccacgaacagatcagatccccgacaaatgcatgcacaacagctttcctttgagaaatccatctcccttgtaaatgctgtgtcaatcacattcctcccaagaagtctgctcccggtgggtcggggctatgtcaactttggctcacccctaagtcctcaggacacaggacataagcagatgcattttccgagggcgcccggcctaactgtaagtctcgtgaaggcaggggccaacatgaatacatcctgtatcctccaaagatttagcaaaatgctaggtcctgtgccctaccccgacccccacccgtaaataccaaggaaggaagacgccctctgccccttcccctctcctccctggggcagagcggcgcccggacctgctcgctgccatggcaacgcggcgctccctcccatagacagtgcaccctccacgaagtcaccgagcagctgctaccgctgtgtctccgccagtgccatttctgcttcctcgaattttaaattggccagaataatacaacaaattaaggtatttgctggtttctattaccattttttggtaaatcactttttccctattaatgcatgggaaagagattgccagcaaacacaccattaatttcactgagaaaaagctttaaatgctcagtcatgtttttctaatacaattcagtgcttccaaatttatttactgctgcctcaaaaacaccaagtaaatcatgcttttatacacgcacgcgatgcccatgttgagaagaaatttgctaagcggctgtgtttgttgaatcctgagcctgcctctgcacctagaacaatcccaccatgaaatgaaatgaatgcttgcaaagatttcttacttcctcctttaaagagtggtaggaaaatgaacaaagaggataaaaggaagcaagctcatcatgcattcaccaacgttaaatttccaaacggtagttacaaagcatttttaaatttaagtttcattaaagatttggaaatatattgctttttttctctgacttctcccagaaaagtttttgggatttgggaattttatgtgtaggttttccacaatggagtttccttcccatgtatgtgtgtgtgtattttaatatatatataattatatgttacacataccatatgcaatatataaatattacctaacatatattacataattatatattatgcaattatatatattataaaattatacataattttatatattgtagaattacatataattatagaattatatgcaattttatatatattaaaatacatagacaaacataatttagtacatatttattagcagtggggatatttgtaatgcagataattacctgcagctttaaatgacagttttactgatacactgtatgtttggtgagaaagggtgctatgtatggtaaacggaagaggagaggaggacacaagttcaaagtcgaaaaaggttttggagattatcttccaatctaatgccctattttacttgcctagaagatgaggaccagaggaaaaactgacttggctaacaacacacagtcaacttgtggctgagctgtgagttaaatgatgaaactgaagcaaaatcacttggatttctgcatgggagttgtcgacagtcatgaaattacactcaaagactccagtgcattcaactaaatgtcaattagtatctaaactttgccagaacacagcaaacagcagagctaagacatcctgtgggtgatcttccctccctgcagcctggcttgatgaattagagttctttggttttcagaacgtggttgctattttcttctccagctccattagcaggttgggaatggcacactagctttttaattaaaaataataataattaaaataccaaacacagtgttgactaaaaacaaaccattattcttccttaatcacttaggcttagtaatttctctttgtatttggcaaaacttcaaaaggagtaaatcaatgttaaatccaaaatttaatgactcgagggtttttggagaaaaagaaacctagcagtacatcacaataaggcaggagccagaataagtctgggctgttttacaagatgctgtgttctaccactaaaaagagggttatcataaatattattagttatatatgagctaaccccaaaacatcttgattgccttacaagtcaccttttatttttaaacttatgaaaatgttcccaattattcagaagcaagatcattttatatagagttctactgttaaaaacaaacacattctgttttattactgcaaaccctacatgtttctccacaagctttgtctaatatttaaactgaaagacttattacacgtattgaagtgcatataatgttccaaaatagacggtcaccaagtttaaaaacttcgctctctcagctaacacgtgcatatctttaacaattgacaaattacatatgcaggattgttacacaaaatgaaaattaaaaaagaaaaacaattgacaaagcgaagcatatttgcatgtattaactcatttgttttgatcttgtcctatattcctaaaagtcacagaagataatctgttacgtaaatatatggtcagtgtggaaaattcaagaagtatatgaaggaaaaacagaaatctccctctatatcgagcccctctttcatctccacaccccggaggtaatcattattatcattagtttggtatctatctttttataacagaactggccaatagaaatgtaatgtgagccacaactgtgtacataatatgaagtagccacatttctataataaaagcaaaggaaatgagagaaattaaataataatatatttatgtaacatagtatatccaaaatattatcatttcaacatgttatcagtacaaaattataatgagatattttacattgttttcttgtactaagtcttcaaacaccagtgtgtgtttcacacttagagcacaaatcaattcagactgccaagtttcaagtactcagtagccacacagggcagtgactacctatgggacaatacagctctagaccttcctttctatgtgagagagagactgtgagatagtatatcaactaagaattcttggccgggcacagtggctcacacctgtaatcccagcactttgggaggccgaggcgggagtattaagaggtcaggagttcgagaccagcctgaccaacatggcgaaaccccgtctctactaaaaataaaaaaaaattagttgggcatggtggcgcgtgtctttaatcccagctactcaggaggctgaggcaggagaatcccttgaaccagggaggcagatgttgcagaatcagggaggcagaggttgcagtgagccaagatcgcaccactgcactccagcctgggcgacagagtgagacttcatctcaaataaaaatacataaattaaaataaaataaaataaaataaagaattattttgctgccaagaacagaagtaataatcactgaaataataaaggcttcaatcagccaatgtaacaggaagtctacaggtggccaggtctgaggctggaccagcagctaacaatccaggcctcaggatgctctctgcaattgtctcaaccatcccctgtggttgtaagatggttactgcgggtccagagagcacatcttcctactccagcttccaaaggcaggaagcagaagcatagctgagaaaatgagaaagagctctttcttcactcatgaaggggaaaaaaatctttgtcagatgccccctttatatcttttgctcagaacagatcacatggccttcccaggttacaagggaagctgggtaagcagctgtctggctcttttagtctccacagtgagaatcagtcataggagatggggattgaaaatgtttaaaaggtaagcacccaaagaactgacatggatagatctaaaggtagcgctcctgactcaaacagcgttcctacttcagagctggatggactcttccagcccactccttgtgggctgtgctgatcacacttccttcataaagtatgtaaaagaatgtttcagcacatctgcagcacgttggacattattagattctcaaataaccccgtacagtttacactttcatgagtgtcaccttcattttacccagaagttaaataactttctgaggtcacagccaagaagaacctgagtcatgaaccatctattaaacccaggccttctgtctacaaactcactgctttttccattctcagctgcaatccacctgacaagtaaagaatacttcatgaaaattgaaagtataattaaagaatctcaagttgaattttatgacaagtttgaaaacccaatgtaagacccttcccaggataagctctggcatttataaaaatccaaacagccagtctgtgactgaccaccagaaaaacagatcttggggcacttaaatgatctctctactgtgaaccactcagaattgcttttattattggagagaaggtaaaaataatgacagcaatggtggttcataatcttcaaagtatttttatgcccatcatctcgtgtgattaaaaaaaaaaaaacctctgaggttggcagaagtgtgcaaccttatttgataaatggtaactaagactcagaaaagtaaagtaattgggtcaaaatcaaacctgtaggctaggaccctggtcttggatgctaggaactatgagaaagatggatatcagaagtcattagaagctcttctattatcaaaactttctcagtggtctaggcactggttataataataattatagttcacacttacagagcatttattacatgctaagcactgttctgaaccctttacatttgttaacttatttaatttcacgagaatcctataaaattgtgcatcagtgctatgtcttcataacaaactaacgaaacttgcaggtgttcacagcaatatagacagttacttctcattaacagctactaaatgactggttgaggtttggctgatctagggtggactcagcttgggatggctttgagcccaagggttgcgttaaagtttacttctgattcatacaaataataccttgcttgtaaatttcacactcaatggacctcacacacaaatactattttcttagtcctcctgagtgggagttggagtgtcttggtggaaatgggaggattctgacaagtagagaaatgccctgatagccacctctatcaaaaagccaagtggagttgaaaatagggcactggatttgataagaaagagatcactgatgaagctgtcacctgaaatctgggagggacaccatcaagcacagctttctctagggcaacagttctcaaattgtgtcccctgaaccagcagcaccagtgtcacttgggaattggttaggattttctaagaccctgctccagacttacggaatcacaaactctgagagtggggcccagcaatttttgttttaataagctttcctgaggattctgatgctgcttctaaatgtgagcaccactgctctagaagaacaccaagaaactgagctgtgcacagcattcaccattgctgacctgctagaaggttgatggttttcaccgtagcatttgtaatcttggttgtatgcaccctgcctttattttactatatatgcaatatagtctttgaagtccctgtcctaccaagagaatcctaccttattttgggctttggctgctctaaaaatgaaaagttttgaaaagcacaagtcaccctaaattggatcctgggttgttttttgatgggggcataaagaacatcattgggacaattgatcaaatttgaataaggtatagattagataatagtattgtatcaatgttaatttcccaatgttcacaactgaactgtggctatgtaagagaaagtgactgtttctaggaaacacatactgaagttttttaacttcagagagcatactgtttgcaactttcaaacagttcagaaaaaaatgattttgcatatgtcgtatgtgtagaaaaagaatgataaagcaaatgtggtaaaatgttatatttagaaaatctgaatgaagagtatgtaggaattctaaatactcttttcccaatttttgtattatttccaaattaaaagtttacaaagaaaaagcaagtagatccaccatgacttgtgctccaaatgtatgcaactgattttgcagaatctcatgcttcatgctctatcctgttttggagcataactttcctccctccaaaggaaacaagagacacctatggaaatgctgatggagcgagggtggtcaccaggcatggagcagcacaggaacacaagcttcttgaggcctcccaacttgataatcttcacagctggaaatgtcccccttccttcagaatttctctgacattattgtctgtcctgggatattattgctcatttgttagtactaagaagtagtttaagagagcagtctctggggccacttcatgtatttatggcttcaaacagccagggttcaaattctgcctcatccactttctacctgtgtgacctcaggcaagcccctgtgtcctcatctgtaaaatagggatgataatagtaacaaggattaaataagtgtaaagggctaagaaccgtgctagcacatggaagttattcagtaagtcttcactgtgctattatttccatacatttcttccttctaagtcactgcatatatatatatatatatatatatatggcttcaaatctagatagttgtgtattcatagtatgttcacaacatgttcaattcatctggcccattctctcacttcacacctgaagaagcagagacccagaaaggttaaataacttgcccaagtaacacagcttgtcagtgttacttaccagctcaagtcacttgtgcctggaatcatttctcccagcatactctccagattggggatctgaaagagcagtggagtgggcaatctacttttccagagaaggtctttatatagaaaacagttttgcctggagggagccagaaacctcctgatgtaggaataacgcctctcactagagtcatcagagtcactggaatgagaaattaccgggtaccacaggcacactgaattgtaatttatttttcaaatgtgtggtaagttgaggacactggaaatgagcatggtacaatgagaatcagaaaacagtgggttaaaatttaccaattaacttgggtatgccacataattcccacaagccgcattctctgcatccacaaagtgcagttagtggtgcttctctctcagtgtggtgacagcgatcagagcggattcttacgggggggcaatgagtccagggccacggatggccaaaaaatgttctttgcttcaaaaaaggtgatggctgactttggggcagagaaactggtggtaaagttaaggctggggagggccaataggaaggggccatgaggggtggagaacaacacctggaagaaaatgttcctgctctgagagaagtagaagacctggaaccacaggaccagtacttctcacccacacatctattgtatgggcctgggatggaaatctgcgccaccaactgaatcttcaagcaagcacataaaatagtggtatttcatttctaattacacattctgtcagtcatgttgggtttcccctgcaattaactggctctttacaaacgcattagcatatacagccaaaggcattggtttcagactgaggcaaatctggtgtaaaaccggcaactcagaaattgtgtgactttgggcaagttactcagagtttatgaagttcaatttcttcattcgtagaatggtggacaattattcagttactattgctgtgtagcaaattaccccagagcctagagaagaaaggaaaccacagttttttggctcactattttgtggttcaggaatttgggaagggcttgcggttcccacttgggatgccatatacttgcagtcagacggcagcggagattgggggggttgtctgaagactcaacagggctggatgtccaagatgtcccatcacatggctacaggctgggagcccagctgaggatcaaccataggaccaaagctcagcctctccaggaccatagcctcagggggctcagacttctttacaggctgactggcttgccctaggccaaaacacaagatgtccttttctgacgtattcttgtaagtcagacagcatcacagcatcactttgtgtgtgtgtgtgtgtgtgtgtgtgtgtgtgtgttccttgtctagtttttatttgtttgcttgtgggctcttttatttatttcagtaggttttggggaaacaggtggtgtttgtttacatgaagaagttctttaatggtgatttctgagatttggcacacccatcacccgagcattgtacactgtccccagtgtgtagtcttttatcccttgccccctcccatccttccccctaagtcccccaaagtccattgtatcatttgtatgcctttgtgtcctcatagcttagctcccacttataagtgagaacatacgatgtttgatgttccattcctgagttgctttacttagaataatggtctccagtcccatctggattgctgcaaatgccattatttttttcctttttctggctgagtagtagtccatggtgtgtgtgtgtgtgtgtgtgtgtgtgtgtgtgtgtatcatattttctttatccacacattgattgatgggcatttgggctggttccatatttttgcaattttgaattgtgtggctcatcacagcatcacctatttcatgataaatcagtggttgaatcagtcacatgctcatccaggtcaaagagaggaacacaggttctacctcttgatgagaagaatatcaaagaacttacagatatgttttaacactgtcacaattgtaataccactttataatattgttgaaagaattagatatataatcattgtaaagtattttgcatttggtgctattgttaagatttttatatttgcatatagcagggaaacaggttgctgcctctgagctggaaagatgcaggttttaagagacaaacacaggtatacaccatcctttctttaagccacagctttataaaaacctagtcactcaaacccaggctagcaactagttgaatgccattgatttcttagaggaattaaccaaataccttctctgggtccctaagatgcattgatctcctgctttcctccccagcactgtgcgaatgtcactgaatgatgggaggctgtttaaatgggtagaaatattgattttcttttctacctttttgaaagttctttgcttaccaggtgctgagcaaacatcaggcaaacggcagtccacatagaaatagatgatgtgaggagcaacaatggcagttctggcttctgaatgtgaagctggttaagcagcaggtgcccccactacacactgtggttttagattcaaaaactacacatcattgttcacacttcgtcatttgctaattgataatacagctcgcccctgtggcactaagtagcatagtggaaaatatttccaaccaatccatggaaacagctccatccgtgtctgaagagggtcgactgaaagctgagatgaactgagggccagtgacggggtaatgaggtgcatttcggaggctggggtctgcatcctaggtgtccatgtgcaaaattggttatacccttggaaatgacaacaatgttctgtcttagtctgtgtcagagatgacagataaacacaggttaagaaatttctgggtttctttgatatagaggacatccaagaaaccatgcatcaacattaggttgctattgacacccaaggaaactgatgtgtggttaacttctccgaaagaaaaagccaggggttccctcagggagccaaagggcagcagattggaaatcactcgcaattcacaccattggaaggaaaccaatgatggaggatggagaagagccctgtttccaatatgtgcttcctaaaggatacagtcccagagaacttgcctcaaagaacaacaaaggagaatccccagagagtgacactttttcatgattttgtcagatactctgaatttaagtagattactgctttcaacagaatatgacgaaaaccacagtggggcattcttgggcttgcttttcagtttttgcgatgttcttagggaaaaggtcttactgggtcaggtttgccaggctctgcccttggagcacattttcagcacttggttggaagaagattcatttaaccctcagctgtagatgagaacaggatgcagcaaatttactgcaaaccagaaaataaaattggcttttctatccaagaaggaaataaagaaaactctgccttatcttactttataaagataattcttttgttttccctgaaataaataataatcatttaaaagcattgggagaggtgtgcagtgactcaggcccgtatcacaacattttgggagtccgatgcaggaggatcacttgagctcaggagttggagactagcctgggcagtatagggagacctgactctttaaaaaaaatgtttttttaattagccaggtatggtggtgcatgcctgtagtccctgctactcaggaggctgaggcaggagaatttcttgagcctgggaggttgaagctgcagtgagctgtgatcatgccactgtattccagcctgggtgacaaagcaaaaacccatctcaaaaaaaaaaaaaagcattaggagaagagaaagagggaaataaggtctaaatgtcccctttctgcatacaatgtgcctgggttcaggtcagatcaggcaggtactggaacttgggttcaggtcaggcaggccctggaacttgggccagttgctcttacctgtccctgaactcaagcacttccacacctgcattccctccagactcaggttctttcttctgagaagaaaccttacattttttttgggggggggggttgtgtttttgttttttgttttttgtttttttgagacggagtctcactctgtctcccaggctggagtgcagtggttccatgtcagatcactgcaacctccgcctcccaggttcaagcagttctcctgcctcagtctcctgagtagctgggattacaggtgggcaccaccaagcctgtctactttttgtatttttagtagagatggggtttcatcatgttagtcagactggtcttgaactcctgaccttttgatccacccatgtgggcctcccaaagtgctgagattaccagtgtgagccaccgtgcccagctaaccttatgtttttaaaattgttgttgttggttttgttttcaagtgaactttttgcctgttctgtcaggatcatttcaggagagtagcaaccctaaagaaaactctctttttctttgacataaaacttatttttaaaaaattaaataaatacttagtgagttcctactttgcatctggcacttccgggaactcagaaacagagtgagagaggggtcattcccagggagagggatggtactaggagatgagacaggactgggaccttcctagagctctgggtgctattgggagggcaaacaaatacatgtcattcctggaatgattaggagacactggcaattcaaagggaagacaatctcaacacactagtgcgatgggtgagtccaaattgatagcagaacttccagcaaatcgaccctccttaaaattcaagatagaactcttagaaaggatataggaatgttcacatagcatcttgtttttgaagtgattttgtggcctcatcaaggaatcccgtctagttttcattaagaacagcacacatttttagggagatttattcaacaattactataacaagaccctcccctagaaagcttcttagggatacacagcacttttcagaccccatacaacagttccataaaagtgatcaaatttcacattgtgaaacgagacacgatgcagctttttaaaatgctgacgaggcatgaacaacctggtggctttcatttgctttttgacctgagcatgttttgaagtggaggagacaagtgaacaaagtgaacagaaatcagtgaactccatcagagaaccacggtaggcttgttcacaagctgctgtgagccaccacgtcctgggtttctttgttttgcagcaacagtagctggaacacaaacattgagctcatgatccgtcgacatttcctcattggctttggccatttagcattgcaggcccagcccatgttgatttttttattcctttacaattaaaatgttttggttgtttttgttgttgttgtttctgcttgaaggcttctggaattttgtctctatcactgcaatttaaatattccctggaatatggctaaatacagatctcatgttattaatcttgcctagagtgaagtgagcctttcattctctacactgaagtgttttgcttcgtggcttttccaacggttctgtttatttgtttgtttgttttccaggaatattgttaggaatattcccaagctgaggagctggtacacactgataaatctggaactgcccagctcccctgtcattgctgccctcggtctaaggaccagcaatggaaaagagtagagtggcctcctaactatgcatagactatgggctcagtttactgtagattacagtgaacactagcaatggacatgtcataagttaatgctttgaccttcggattttaggacctaagactcaacatttgccttttataacatccatgcaacccacccctgcctgttatgtgacgcattccccctctcaggcctaagtttatagctctctggctataaattcctaagcatggggtctaccccaaatgctggcatcactaagaacaaatgggacaagaaaacccaccctttacttctacctcctgaggctcctcagtaaggagatattgaagcttttagagtaaacacacaggcggcatggaggaagagtcatgcaggtccccatgaaaagatatctgacttgagatcactcccatttgatagcagtagcatttgctgttgagaaggcattcagaagtattcccatcccccaaactaactagctttattgttgaatctgtttctctgctctgtgtcctacacgcctataattttccccttttgacattttaatctctttctggtaaaactgctaaaattcacctgtcattaccagtccatttctgcattgtgaattctgctctttgctgctttcaaaccagatttaatttgggttttgtgctgggcatcctcttcttgtctctatgattcttcaatttaccttttgttcctttttaccttttgtatcttttgtttaaaaaggtaaaattcttcaattttactgcttatcttgtgtttttttcctctccgtcttacggatttgggctcctattttgttacaatcttgatgtacatcctaattaatacaccaaggaatttcttctggttcttacgcttagttattttgcagtgcagtgtttttccctgaatcttcagcagaatgttcccctcccctgttccttgcatttttcattccagctctcctatgtgggcttcttttttctggcttacttatttttaaatgagataagctttacccaaacccagaattcaccaccagactcactgctgggttgtccctgatctgtccattaactaagtcacctcctgagagatagcactggaagagcatagttctttgccaaattcccaatgtttaaaggattggccgggcgcagtggctcatacctgtaatcccagcactttgggagactgaggcaggtggatcactttgaggtcaggagttcgagagcagcctggccaaaatgtctctactaaaaatacaaaaatgagctgggcatggtggtgcatgcctgtaatcccagcaacttgggaggctgaagcagcagaatcacttgaacccaggagacagaggttgcagtgagccaagaccgcaccaccgtactccagcctggaaggcagagcgggactgtctcaaaaataaataaataaaataaaagattgcagggtttaaattgaatctcttcctacccttactgcatatttctctgacattctgaacaaataagtgattaaaaaatgacaatccaccagggttcttatgtttccactcacacacttgaaagttgtgatttatagctcccgaagtgaagcgggccgcccccagtatctacctcctttccataagctgtgtattttggaaatgtatatgtctacgtattattttatgtttaccctttcaaagaaggggtcttgctgaaaaattcccttgttttcaggaaccctgcagagatggaccgtcaaatgtgtttatctattcagccgcactgaatagctacactacttagcagcaattcttttgaattctagcagcagatggactatgagttctgcttttcatggcgtgtcttgagtacttcagtgagaaactcaagagcactaggcaaggagttagtatccagaagcctctttcagaaaaatgattctggcagaaaactgtttttaagagggacagacacaagagtagaataaccacatgtgctctcaaaagtcagacttgtttacagaaaaatctatctccacaactttttttttccacagtgttccatgaacatgctccagggccacctctcaatactcacatgtgcaatatgcatttttgcatctttccaatcctgtccagcctgcttcagctgctgttcagtgagaaccatgtgttcccaaaactgtaagtttagcctggccacaggggtaattgattttctttgatttgtttgtatgaagcactatccagtcccattttacaagaaggagaattggagtagacagtttaaggagtggactacatactgtaaatgttcttgagtgataaggtgtgtgtcacacccagcaccagcaaattacacatacacacacacatacagcaaaattagcatcattcagaagttcttcccacacattccaagaaacattgttgagatggtgttattattccatgcttacttatttagaatgcatttagtgttaagcaatctataacgctcttgtttgtttctttgcttgtttgtttgtttgtgacagagtccttctctgtcacccagactggagtgcagtggcgtaatctccgtgcactgcaccctccaccccactgaggtcaaccaatcctcctacctcagcctccctggtagctgggactacaggcatgtatcaacatgcctggctaatttgtgtattttttgcagagatggggtttcaccatgttgtccaggctggtctcaactcctggactcaagcgctccacctgcctcagccttccaaagtgctgggattacaggcatgagccaccaggcctcgcctataaagctctttaataaacttttttttttttttgagacagggtcgtgctctgttgctcagactggagtacagtggcacgatcatggctcactgcaaccttgacctcctgggctctagtgatccccacctcagcctctcaagcacctgggactataggtgcgcaccaccacacctggctaattgttttctttttcttttcctttttttctttttttttggtagagatagggtcttgctatattgcccaggcttgtcttgaactcctggcttcaaggaatccttccaccttaacctcccaaggtgctgggactacaggcataagccatgcacctagccaacaattattttttatcacaacacagcgaggttcctgctataattatcctgactttacagatgagaaaacaaatgtacagaaagcttaaaaaacttgactaaggccaaacaactagcaagtggtagattcagtatgtgggcctagacagtccttctccagagactgactctcactatccctttattcagcactctctgtattgcatgagaaaaaatacatgttgcatctgtagctgaacttcatacaacgcacaccaactacatttgggagacagattcatttatttacaaattcccagtggccaccaaaacatctgatagttaaaaagcccatcttaaatgtttgtggaaatgaatggaattggatggttttagtagcttcaatttgactcatctaagaaaacagtataacccacatgtagctgtcctcctgagggtggcctctgttttcactatctgccagccatgaaacagggctgcttcatccctgcacagatatcttcagtagaacttgtcagcaaccaacctcacttctccagcatgaatattagctctctctctgcatgcgggaggcagaataatgaccttctcaaagatgcccacattctaagccctagaacttgtgaatatgttatgccacatggcaaggtggggttaaggttttagacgaaatgaaagttgttaataagctggctttgagacagggagattatcctgaattatctgaatggccccaatgtaatcacgagtatccttacaagaggaaggcagaagagaaagtcaaggtgatatcatacaagaaatatttcatccactgttgcgccgttaatgatggagaaatgggatcataagccaaggaatgaggaagcctccagaagctggaaaaggcaaaaaaagaatccctgccccctacaagagcctctagaaggagcacagccctgctgacaccctgcttttagacctctgattcctagaactgtaagagaatgaatttgtgttgttttaagccactaagtcggtggccatctgttacagcagccacagaaaactgcccactgcaggatgaaaagccactttctcctggtatttctcaaaggctaatctaagagcatggattgttctgtatcttccaggagcactattgcaaagtcgattcattacttttttcatttgttccgcatcaccgtgctggggctcattaacgccctgtcatcgggtgctctgtgcgtaagtagaagtgtgttaagaatcaatcgctctgacctttattccctgttggtgttttgtcattcgtgggctgcttggcttgacatatgaattactctccagctgcctggtgctggggaggcacagtcaccagcccccaaatatttcagacatatgccaattgcaatttcaacacacattttttttctaccgtcaccctggaactgttccattggcaatgcatgaaatatgaacaagaggaaataattgacaaggcaccactgttgactaaggggctaacctttgaggaagattaaaaacagatgtccttgaagaagaaagaactgaggaagtgaatcttctctcctcttaactctttagttcattgtcctcatccaaaaattaaactaacacactctgaagaaggtttaaggagatcaggaattttcaagaattcatttgtattctgtagcagacagcttgtttgttccccattgaaaacctacaagaaacaatactgcaacctttgttatagcaaataactggtgggtgtatccctccatgccaaacacatgccaagcataaaaaatgtgcctagaaaaacaaataactttggaaggctcttttcccagtgccttcttacttcctttgtcttagtcctcctttctgtgatggtgcccaacctaagccctggatcctttgctgttgatttcagtagcatttctccctgacttgcaggaaactgcccaaggctttcaaaattaccttttccataaactcctgttccttcctcgaacaatctcaaccagcatctttgcaaaaagctgcctaattaatgacttcatgcacaagtgtgggtaagtgataacacctggatgtgttgcccttcccagaggacttgttttccaaatcttttcaaatagagacataatcagcctggataatgagtgctcaaaactaaagcttaacccttcatggcaggagtgtggtcagtgtgcgtgtgctcaggggaggtgatatgggtcattggaggctttctttgtgcccctcaaatcacatgatttgtactacccaaatgctgcccctgcttccactctgacgatgaaatgatttcatgaatatattgaccattataattatagccagtgacatttatagtatgcttcattattctcaacaagaaaagtttatttcatgtcatcctcaccaataagcctgtgaggtcaagaattccatcatgtccgtgctatacaccagaaatcaacaaactttctgtaaagggccagagagcaaatatttcaggctttgaggccatatggtctctgttgcaattactcaactctacggctgcagtgtgaaagcagccataggcagtgtataaacaaatgggcatagctatgttccaaaaaatttatttacaaaagcagtcagcagactagacttgccaaacccatggtctggatgaagaaagcacaacctggagaatttgaggccctacctcagaacatgcacaaatcagaagcaaaccacctcagaacccaaacccagttctttcttacttgaaattcggtgctctttcactgaaccacacggtttggggcatagtctttagcattcaggagagtcatgactttggatcaaatcaagaatactctccacccacccatctcccccgttttcatcacacacacctgtaaaggagcagctggggctggggtaccatcattagcctgtggccatggaaacagagtcaaggtaactgacccacaggaccaagacacatgaccttgatgctattagctctttccattgaagcttgctggccatatacagcataattgaatgaaactgcagaacttcttcagtcagatccacctgtgccttccagaagcacattaatgaggcccccctccggcacagaatgggaactaggcaatccagacacatccccacccagcatcctccttctggttcactagcagaactggatcatgaatcaacaaaatgaaggaggctttgcaagaacaaagcttttggaacctgtattcctgggtggtgctggagccattcattcctagccaggtgccatgagcactttctctgtgggcgctgttggctcccctttacctctcacccccaaacgcctttccagggaggtgtagtgctgagtgcactggtcagatgtggggacactgactgttcacagctggagtgaagagggacagagacttctcctcgtctccccaccatccttctgttcctcctcccatttgtcctcccaggagctctccttattagactgaggccctttagcctgcctgcaatggaaaacagagccattcacctggcccaggcaggctctttggggtgctacaatgtgcatggccaaagctattcatgtattaaagaggcttagctagctttgcttctttactgcacttacatctcaggagacactcattgagaggaacatgtcattttggccaagaacagcatttagggactttctagcttctctggaaaattgtcctgtcaagtacaccccagtctaaccattcctgccgtaatatctggcatagagcctccatcttttaatatccttttccttaatataatttcctaaatccatctcctaacattgccccaccaccctggaaacaagcatagccctggctgcaatgcacatgttccaaccaatatagaagctgagatttcactttctcggggttctcgttggctgccttggcacctcgctccacaagaaacatctttgatccctccctaattacattgatttatctcacggtataccttgtatccagagctttagatgatagatagcaatttgttaatacttgtcactaagactcaatgactggaactgtggtcagaggcatgcagccatatcctccctcctcaattgatcatctttattcttgcaagatggtccaacctctctaaatgagggcaatcaatactgtgcattcagccataatcgtggcttaacttggtattctttgaaaacttaagctgtgtaatttgcctgtaattgggctttccaaaaagtcatatctcctgctcaaggaagcaattaagccggcacactccctgtctgctgcctgctccctccctcctggcatctgactgccatgggccaagtcttccctccgcagacctctctcctctccagatccctgtttggatctcgacaaccaaagccagcagttggcggcaaagcagatgaactagaatatctgagccccttggagaggcctttttcttccataatctcccacatcacttccatcaatcgcttttgggggtttctcgcttgatgagctgtgtccagctcatcaattcaaacactgagataacacaccgcattgcaaaggcaaaggcagaaaagctagagccccaacagtgaaccctcatgtaaaccatggaccgtgggtgatgacgatgtgtcagtgtcggttcagcacgcgtaacaaatgcacgctgtgctccagcagggatgttgataataatgggaaggcagtgcatgtgaggagacagaggatatgtggaactctctgtgccttcttctcaatttgctgtgaacctaaaactgctgaaagacacatagacgaaagaaagaaagaaagaaagaaagaaagaaagaaagaaagaaagaaagaaagaaagaaagaaagaaagaaagaggagagagaaaaaagaaagaaagaaagaaagaaagaaagaaagaaagaaagaaagaaaggagagagaaaaaagagaaagaaagaaagaaagaaagaaagagaaagaaagaaagaaagaaagaggagagagaaaaaagagaaagaaagaaagagagaaaagagaaagaaagaagaaagaaagaaagaaaggaaagaaagaaagaaagaaagaaagaaagaaagaaagaaagaaagaaagaaagaaaagaaaagaaagagagagagaaaagaaagaaagaaagtctaacaaaaagatgtggagacatgcccctcatgcagatggggacttgtgttgcatttaggacacacttaggaatggactccagctggcttctcttctcacatttgatttgctttgtcttcagttagctaagagcaagaagattaaagtccaggcatctgggcagctttggagtgagatgagcctagcttgaggtgttttggaacaagggaagtcactaccccactgcctttctacattacaaaaacattagcaaaattatagaagtaactgctggcatttcttgagttcacacagtgggccaggtgcttatatgcaccatcacttttgatcctcaccacaaccaaagtacacatgggagtggaggagcagcacagtacgctagagaagtacctagctagactgctggagtgtcgtgtcagtttgcgaaggctctcatatggggggccacagccagggtggcttaaagaacagaaatgtatggaggtaaaagtctcagatgaaggtgtcatcagggttggtttcatcagggccatgagggaaggacctgttccaggctctttccttggcctgtagatggccgtcttttccctgtgtcctcacaccattccctctgttggtaacagtgcctgaatatgatgacaccagttatattggatgagaccccaccctaatggctttaattaatgacctctttaaagacactatcttcaaatgcaacctcattctgaggtactgggggtaaggacttcaacatttgaacttagagggaagagagtccagcccacaacaggcatgacccgtggctctgcccttggctaaccataggaccgttaaccagccacttggtgtcttcatgccttcactcctaacctctcatgtggttgtcggggaaaataactgagataatgtacatgagtactcagggcactgcccagcgcaacagtcagccctcagtaagtgtcagccatcactagggtttatccttattttacaggtgagcaaactgagtcttaaatgggctccacagcttgctggagaccccacagccagagaacaacaggtatagcagggcctgtaactcatgtctgcctgtccccaagaccaagctctcatccacaatcctatgctgcctccttcacaatattacacagaaggcagctgtgtgcctacaaagaagtcaagctatattcccctttctgtgagatgaaggatacacaacccaatccatctcaattcttaccagcttcccaaagcgtgaaacgaaacttcccagccctgcctctaacaccttgtgagaggaagaacttactctgtcactatctggtgcccagctctgtgagcacaccccagaaatgcctcagatcctctaccctccccaggaagataacagtgacaaggatgaccaggccagggcccagaggtaacttctatcttcagccctaatcctgtgtcccatatggatgcgtcctcaagcccatccatgggtgttagagctaaagtgttttaacctaccaagaaaaaaaaaatcctcagactataataaaggcaaggtatcttaccatgcaaattaagaggtttttcataaataaaagattcatgctctttgggtacttttgctacatttttaatacttcctccagcacactggctcactacgctggctggtcatttgaattacctggaaagttttaaacaccgctgaggccagggcccatccctagcaactctcagttccctgctctggtggttggcctgagcacagggcttttgccaccttcccaggtgattgcactgtgcagtcaaggctggggacctctgcttcgcgaggacaccttgttttcttgtagtgatgttaactccagtctctgcctcctccatctccacatgcctttcactctgtgtgtctgtatgtcttcacatggcattctccttgtttctaggccctcttagtataatgacaccagctgtattggattgagaacccatcctaatctagtatgacctcatcttaactaattacacctgtagtgaccctatttccaaataaggtcacattctgaggtactggaggttagcgccttaatatatctttcaggacagcacaatccaacccatcatagtggtaaataaaataattctcagtggcacaagaaataattttacacaatcaaggacatcatagattaataaaccagtatttttagcaacatgttagttttgtgttttatgctccttttcttgctctcacttcaagcaaagacgtccctcaccatctttggagcaggtttcccctttgctcccctttctcctggcccctcccaccccagcacagtcaatgctaattaacagctgtttaattatcagcccagcagggaagtgatcatggcccaggtcctcagagagttatatgcacagttaagttgtcccagatactggaagattgactgtgttatgtgcccatagggagaggcaatgcggcttagtcgaaagttcatagcattgagaatccatcaacctgatgactctgccatgttttaactgttagacaatggcttccaaacctttttttcctcaaccgtaacaataccaaccccacagttttgttgggaagattaaggccaggcgtggtggcttatgcctgtaatcccagcactttgggaggccgaggcgggtggatcacctgaggtcaggaattcgagaccagcttggccaacatggtgaaaccccatctctattaaaacaaaaattagccaggcatggtggcgaatggctgtagtcccagctactcgggaggctgaggcaagagaatcgcttgaacctgggagtcggaggttgcagtaagccaagatggtgccactgcactacagcctgggtgacagagcaagacttcatctaaaaaaaaaaaaaaaaaattaatgtagtaaaagtaccttgttaagtatacaatcatatgcaaatgcacagggatgttttctgcttcatcttagcatggtcataactggcacatcatagagagactagaggtgggtaagggatgggtagagttgcttgagcaacatttgtgcacaaatgtcaaattaaggttcaaaagttgaactggaattgtgaaatagccatctgttcattttaaagaaaatattaactagtaccaattctatgaatctattccaaaaaatcaaggagactcctctctaacttattctacaaagccagcatcaccatgataccaaaatctggtgaagacacagtgaaaaatgaaaactacaggccaatatccctgatgaacatagatgtaaaaattctcaacaaaatactagcaaaccaaatccagcagcacatcaaaaagtcaattcaccacaattaaaaaggctttattcctaggatgcagttagttcaacatatgcaaatcaatatatgtgatcatcacataaagagaatgaaaaacaaaaaccatattatcctctcaataaatgcagaaaaaacttttaataaaatccatcatgccttcaagaaaaaaaccctcaacaaactaggcattgaagaaacatacctcaaaataataataacagccagctatgacaaacccatagtcagcatcatactgaatgggcaaaactggaaggattccccttgaggacagaaacaagacaaagatgcctactctcaccacccctattcaacatagtactggaagtcccagccacaggaatcaggcaagagaatgaaataaaaggcatccaggaaggaaaagaggaagtcaacttatatctcttcatttatgatatgattctatacctagaaaaccctaaagactcaaccaaaaggctcctagaactaataaaaaaagcttcagtaacatttgggttacaaaatcaacgtgcaaaaatcagtagcatttctacacgccaataacgttcaagctgagagccaaatcaagaacacaatcccacgtataatagctataagaagaataaaatacctaagaatacatttaacgaaagaggtaaaagatctctacaaggagaactacaaaacactgctgaaaaaagtcatagatgacacaaacaagtgggaaagcagtctatgctcatggattggaagaatcagtatcattaaaatggtcatactgcccaaagcaatctacagattcaacgcttttcctaccaaactaccaatgttatttttcatagaattagaagaaacaattctaaaattctataaaaccaaaaagagcccgaatagccaaagcaatcctaagcaaaaagaacaaagctggaggcattgcattacccaatgtcatattatattgtaagcctacagtaatcaaagcagcatggtagtggtacaaaaacagacacatagaacaatggaacagaaaagagaactcagaaataaagccacacacctacaaccatctgatcttcaagaaagtctacaaaagtaagcaatgggaaaagggctttttattcaataaatgatgctaggataactgtctagccgtatgcagaagaataaaactgcacccctttctttcaccatatgcaagaatgaactcaatatagattgaagatttgaaagtaagacatcaaacaataaaaactctagaagaaaacctaggaaatgccattccagacataggtcttggtaaagatttcatgatgaagactccaaaagcaatcacaacagaacaagaattgacaggcggacctaattaaggtgcttctgcacagcaaaagaaactatcaacagagtaaacaggcaacctagagaatgggagaaaatatttgcaaactatgcatctgacaaaaatctaatacctagaatctataagaaacttaaacaaatcaacaaaaaaaaaatccctattttaaaatgggcaaaggacatcaacagatacttctcaaaaaacacacaggtggccaacaaacatatgaaaaatactcaatatcactaatcattgcagaaaagcaaatcaaaaaccacagtgagataccatctcacaacagtcagaattgctgattaaaagtcaaaaaataggctggatgcggtggctcatgcctgtaatcccagcactttgggaggccaaggcgggcggatcacgaggtcaggagattgagaccatcctggccaacactgtgaaaccctgtctccaaaaaaaatacaaaaaaaaattagctgggcgtggtggcacacgcctatagtcccagctactcgggtggctgaggcaggagaatcgcttgaacccgggaggtggaggttgcagtgagccaagatcatgccactgcattccagcctggtgacagagcaagactccatcacacaaaaaaaaaaaaaaagtcaaaaaatagtaaatgttggcgaggctgtggagaaaagagaacacttatacgctgttgatgagaaagtaaatcaattcagccactgtgaaaagcattttggagatttctcaaagaacctaaaacaaaattatcattcaatccagcaatactattactagctatatactcaaagaaaaataaatcattctaccaaaaagacacatgcacttttctgttcagtgctacactattcacagttgcaaagacatgaaatcaacctaggtacccatcaaaggtggactggataaagaaaatgtggtacacctcatatacaccatggaatactatgcagccataaagaagaccaaaatcatgtcctttccagcaacttggatgcagatggagttcattatcctaagcaaattaacacctgaacagaaagacaaataccaggagtcctcacttataagtgggaactaaacattaggtacacatgggcataaagatgggaagagtagacaatggggactactagaaaagaggaagagcagggaaaacaaggactgaaaaactgcctattgggtactatgcttactacctggctgatgggatcattcataccctaaacttgagcatcatgccatatatccatgtgccccctgaatctaaaataaagttgaaattacaacaaaatttttttaaatgtttaaaagatattctcatagaaataatagtgatacccagtaacaaagacttctactttcttatgttttttatttgtacaaacgtgtaagccaacggtcctatttgaggaagcgttctaaaactaaatacagaagtgaactatacgttattttctgagaaggggaataattaagttgtatgcatgttattcgtatcacatctaaatggtaataaaaggtatagtgtatggaaggctaaaattcagagaaggaggaagagagaataagtcagtgaccttttagtaataatgtgaaaatatagtttagacactcggaaatatttctctgacattaagggctttatcatacatggaattgtaacactgcagtctttcccagaggtcttctaaaatagtttataacccaatctgtccggtcatggtaattttatttataatggaaaacaatctaaatgactaataagagggaaatggataaattgtggtatatgactctggaacatttaggtagccattagtatttaattttacttaaattttaattttaattaaagtatgatagctaagtagcagcatattacaattcttatggtaggatactcagtgaaaaaagaattcacaactttatagtatgattactactctttaaaaattaggtatgaatatgaattaagattgaatgagaacccagaacaataaacatgattaatggggttacatggtatcattgtggggaaaaaaaaaagttttccagttatttgtgtgtaacaagtgaaagcatatattgttaaaggtgttcgtctctttcaaagtgtaactgtggacaagaagataaactgacagactcagaaagcccccttcagtctcaagactcctaaattgctgagttgcaaggaggcagtgcccagagaatgcagcattcctaagcatcactagtttccattaaaacctaatttatggaattaaaaattaatttcatggaaatgaatttgagcagtcttttcattagagcacacttggtctaaatgagtttggagtggttgtaatagccattcctgcactgttatttataaaggtgaaatctgatgtgagtatttttgttcttacgctactgagaaacaacatattgcttagagttttcaaacttccatgtgatagttgctcttgctccccgaagatcctctcagggaagttatttacgacaaggagtcccatagaatgggaatccctcagtgaaagtcaaccaaggcctccgattagtgagtagagcagataaaggcctctcgttgtggaaccaaaatgggaagaggcaatggccaaagtgagacaccttctttcccaagtgcaagaggcactcttgcttccatagtgaaagaagtttgcgagatgggtgtatctgatggctatgtttccaggtggagaactatacatttacttcaacattttaaacattctgttaatgaatatgcacatgtgtgcacgcaaacacacacacacacacacacacacagagagagagctatgggaatatgctgcaaaaatctctgacttcagggaaaataattgaccaaggcccccagctgctgcactctgaaatctgtcactgtgccaacaaggccacactccccccagtgactgcgagcagcaggggaactcaggcaggcccatttctgggagacacagggctcctcaaatttaatccccaacagttttaccaaaccatccttagagtacaggggaatcaaggatgaatttgcccaactttgttcactgttctttacttggggtcagacttacatcacagtttcttgtatttttctctcataaaatacttgcacatttaatcccatcttggcaatggcttcctagaggatatacatgtgtgtgtgcatatatatgtacatatgtgacagtatgacacacacatatatacacacatacacatatatatttatatatatacacacatacatgtgcataagtatatatatatatgtatatgtacctttgaatcataatttatctccatttgatgggcactagttaggtccaaatttttgccgttataaaaatacccatctatcccatttttctaattatttcacatttctttggggagatttttttttaagcttgccacagtgactgtgactgtcctttgttggaatacctccaaagaactcccagagccaatgccacacttaacacttgttttccacatgtatagattttctggtgtggcttcaatttctctggtaaatgagcttcaggccttctcatgtcagtgtgcagagtaaagaagtgaggatctagcctttcacaggatcctctgcaaggcagtgcagtaaggaggggaagggttttctgccacgtctgtggtctcttcattcttctcttcctgctgtcattctcgacctgggccctgctgtccttctctcatctggtatccattagagttcttgattacaagcaacagaaatggattctgcttcacttcaaccagagagaagttgtcaggaagatatcgggggctcacaatcaatgggcagctggaggatcagtcttgaaagctccggggctgggttgcaggaacatagtgaggatcttttactagaagagcctggtgagggaacctccaggataaatgggctccaggggatcttggtccttgcttcaccttcccaagattcaaatcctgggaaagagacacccacagaggcacccctaaggcagagggagactctaatgcctgcagcaggcgggcacctagaacttcactccaccaacacagaacctgatggattggaagtaattcccccaaatacactggggagatttgggaagaggaaaaaaaatgttgggctacaaaatataatagtaatatctagcagcacccttttatatatgtgcataatccttgagtttgtacatgttcggagactggccacaactgttgcatgataaattagtctttgtccaagtgaaaacaagtttcctgattaaaacaaagcctagccattgccagaagctgcttgaactaactcagctcctaaattgcatttacatccaagagcttggggttctttctggctgtccaaaattgaaatgttgtcagtgcaaggacacaccatccatcaatttcttctcagaggttcctctctaccttctaggactttgctatggcatttgttggctctccatgctggcctcattgtttgtctgtttgttcttgtcttggggaagttttctttttcagcagattctcaaacgtgatagcactgtcaacaaattaaagactgggaagccatccagaaaaattatacatgctgttttcactctctctcttcctgaatccacatcagtcctctctccttaatagaaatgttccattgttttatttcacttaatgacccctaccacattatcttctttaagaatactttactcagccaggtgcggtggctcatgcctgtaatcccagcactttgggaagccaaggctggtggatcacctgagattgggagttcaagaccagactgaccaacatggagaagccctgtctctactaaaaatacaaaattagctgggtgtggtggcacatgcctgtaatcccagctactcaggagcctgaggaaggagaatcgcttgaacctgggaggccaaggttgcagtgagccaagatcatgccattgccctccggcctgggcaacaagagcgaaactctgtctcaaaaaaaaaaaaaaaagaatacttttctctatctaattcttactttagggaaactcactttgagtcatcaccaaagcctgtctgttcagtgcaaccataagtaaatgctctcataaaataatggtaacgggtcaggcacagtggctcacgcctgtaatcccagctcttttggaggctgaggcaggcagatcacttgagctcgggagttcgagaccagcctgggaaacatagcgagaccccccctaatctctacaaaaaaatacaaaataataataataatggtaaggtgagcatgtatatgagatgaacttgcttttgccaaagaaaaaaatacacctgatatacaaatgaaatttggattcatggaaacaaattccagaagacagaatgttcagattatattcaggtaatatgtcagcattgtcattccaggtaaagatggctttgcagcaggaaggatttgaccgaaaaaagcgaggttacagagacatcaatgagatcgacatcaacatgaacgatcctctttttacaaagcagtggtatctggtgagtgtctttatgtccttttggacatttcccatcttgagactctggataaaagatgaattcctgtatcctcattattcactaggatgttagccagtatccaacccagtgaccctctctgtccccttacatatgtattgattttctgtcaccacctgtgcatctagttctctaatctgctttcttctggaactgctaagtagcccttgtctcctagggtggaggctatgaccaacaactagtggaattctcttcagttctgaaaaagtgcaccagtgtatgactgaagattagcaaaactatataaaagtcaaatcagaggtctgggaagagtaatgcaggggtttcaacagacagagtaacaggggacataatgaagtcacaggcctaaaagaaaggatccaatgactttgcaaggggctagcaagaaagcttggagactaaagtagcaaaaagagcatctattaatgcttcctaaaacaatggcaggaaatcaattccatggggcttaactgatgcaggcctggaggcactaaaacccattttgcctggtgaagtgagcattttgtgggtcaccaacagttcatcatgatccatttggattggccaagctatgtttaaaaagggatcagtgactccaaaccaacctgaactgcagggcatattgacagaaagggagtgactaatttgtaaatgtgaatgaagctgtattttatttaagattaaaaagtgatgaacaagagagagaactaaattacagccttgtggacggctacattacaggaattcatcacaatttcccttctggggcttcagagcttgactctgacttatgctttttggcatggaagtccgaaaatccaatatgggtaattgaatgagtgtacttgtattagttaggataggctaggtttgttgcaataatgaacaaccctcggatcacagtagcttatcaaaagcaaggcttgtttctcacttttgctacacgactaatgcttcataattgctcagaaacgcaggctgaccaacctccatctgagctccattcccacactgctttcataagcccttcagcaaggaaaaggggcaaattgtagaatttttaaaagaaactcttaaagcttctgcctggatgtgaaaaaatggcacatgagatcacatgtcattggccaaaatcagtcatccgccattctaacttcagagtgggtggagaggtgtgtagtcttaacatgtctttagaagaaagagcacagtaaattttttaaagagccccaatgacaatcatacaatgttttagcaatatcataacagccactgatcactgtgggcttttgccagtacaagctctgacttcattattttttttacaatccatcctggagaaaacctacacagtacaaagacacatgaagattgggagtggacatattactgtggaattgctctttgttttcctttctttcttttctgaaatatttttgggggccaggatgaggggccttaggatttatttttctgcattagaacatgcactaaaggtgagccagttttctttaattcagttcaacaaatacttttgaacaagacttagtgtggtggcactgaaattacaaagattaactaggacatgtcatctcctgcaaaagatattgttatttagtaagaagttatattcaaataagaataatccaaaacaatatgctgtaaattcaaaacatgaggtagaaacaaagagctatgaaagtgagcatttaattctaaatcagggagggtttcctgcaatagcagctctcttatggaaaaagtttaaagatagtgatctagttataagatattaggggattgaaactatgtttgcatatttacagaaaacagaaaacacaaagtgtttataccaaaaaaaaaaaaatggagaggaaacactataggtaggttgggagggacacccaaaagtactgtttcatggaagatgtggcctttgagctggtcctgaaatattagatggctatagagtatgtcaagtaaatatgtacatgggtgctttacaacaccaaactaataccattctctgctttgaaattcctgtaccagatcaatactgggcaagctgatggcactcctggccttgatttgaatgtggctgaagcctgggagctgggatacacagggaaaggtgttaccattggaattatggatgatggtgagtattttgaagcctgtgcctcatttggaaataagcgtgcctttgcttgccttttgataaaagttgtattgttttggagatgctaaccagagatggaacagcaagatactgggcatgatggccacactgcactgtgcccagatcttcacctttcttccaatcagtggtcctcaaacttgaggttgcacttaacaaatattttttgaattaataaataataagctaaacaaatgaataaatgaaagctgcctatcactcaaccataatttcttactgcttacactttaccttaaaatgtcctctaaactctttatattcaccatcaatttctctagactcacactatccaatgtagtcaccactagccatatgtgcctatttaactttacattttaattaattaaagttaaataaaatgtaaaattttatttcaattcctcaatcacactagcctcaagttcttgatatccacatggggctagcagctgctgaaattcaattccattttcatcatcacagatagttacattagcgtgactctacatccataaaacagcttttcagtaacaggattggagcttggggaaatttgactttattgctgctttcagaatgaacccttgtaaagtagcctttgataactttttattacagacatcccttacatgttattcaacctgcgtgcctaccaaagacttagcagagcttcattttctatagtttgtgatatgaaaaccaatgggcttgatgaattggcatttttccaactacacacgtccttggccctgccaagattgtggagaattgccgcctgtggtcgtttcactggggatgtgttgttgccctccatcacccatctgggtctgccagcaaaaagctctactgtgcattattgacccaattatatacaaaggctacacagagatgaaacagttgagcctttcccatccgaagatcctcaaagaacagaacactatgttccttaaagtgaggctttgaagcagaaatgacagaggaaaccaagaggagccagcctgcttaaaacctgcgttgtcttgtgtgggctcattaaatatcaacataaaaacaatgcctcaatgttttttgatgtgtgagacatttttaagtggatgtaaaaccttcctccagaggccaagggctctcacaagaagaaaggagccctgcatgagagtgtgtgtgctcagatgtcaggagtttataaatgtttcttcttttctcacacttgttcttgaaaactgttccaaaggggttcaggccagctcacccaggaaaacaatgcatcaggatttggggaaaacctacctaggagatattgtcatgaccatttctaacagcatatcctactgggtatccccagccggggatcagagaagccaccctaaaagtggcactaaagtgccaacagatgtgcattgctctgctcttaggaaacctccaagagtactgtagatgcccatttcagaatactttaactgaaagctctttgactgactcctaaagtcattggctcctgactcatttccacatgcaaaggcaagccctttagaaagtctcagcagaatttctcatttgatgttctttcttcagctgattaatggcctttgggttcccacaaaagtaaactctgccccccaattacaattcctggtttcttcttcattttagtcaattactgctgcagaacaaagaatcccaacattgagtggtttaaaaaacaaccatattattatctctcacggttctgtgggttgctggagttcatctgggcagttctgcaagttccactggagtctatcatgcaggtggagtcagaaggaagttgaccctggagtcaactagaggctccaatgggaggctgaaaaggctcagcctccctccctttccatggagtctgaggacctctcctctcacatgaggcctccagcaaggtagatggatttcttataggtggctcaggactcccaagagtaggccttccaaaagagaagaagcagaagctgccagtcctcttaaaggctagacctggaatgggcaccggtaactctgccacttatgttggatgaatggtcccagggccaatccagattcaagtggaaaggaaataaactctgaatttgtggccatttttaatgcatcacatgctattccatatgataactgaagaaaagtatccaagttcactgttgaatagcaaaatgagcacatttgggacaagggcagctccccacatggtgaggacaaggacagatgctcttgccatgtaattggccatctctgtcctcacagctagaaccgggaaggctggcaacatcagtactgcattctctctcttaacgacctgcacgcatgaatggtatggtgccatgtcccagacattttcttggcaagatattccaaaataaggttaaagacagacacagatgccaaccctgatacctaagggcaaaactaatgtcatattctatcaacattgtctctccacatgttggcctgtgtggcaaatgttcaatcatctgcgtgcagaagtttaaatttgtggacagccagttttaatcactgccctcccatctctggttgcccaactccaaactcagccatcatcccctctgctggatccagtgactcaatggatgctcaataaatatctgctgccttcacgtaggtacaaagcaatgtcatttccacatgctacatatcactaggagaggacctccatggttagctgctgtctaaaggggcagaaattatttcttaagggtctactaggacatttcacctatgtagatattagcaaggaccccatttaatgatgacaacttccgcccttttactgtaatggaattgtttagagttgggaacttgacctggaaaatggaatgtgatcatgacaagatacagggatggacaagagtcatccagcccaagagtaattcagggcagatggctggttctcaagatcacacaagatcagagaaggcatgggtcaaggcccttagccattatcagatggagccaaggaagtgagatggaaggccagcgagctaaggtcagagggagcttcaagctgaagtaagaataaacaactaacagtaaaaacgacgaacatttattgagtaatcactatgtgctagacactgcttagcattttggaaatacaaccacagttattccctaaggttggtattattataatcgccattttacagatgaagaaactgaggtttagggaggcaagaaactgcccaaagtctcacaactaattctaaccaccattcttggtacttgaaacctaatcctttgctctgccttcctggtgagactttatgaatgggagcctcattcaaaatagcattaggagatatacctaatgttaaatgacgagttaatgggtgcagcacaccaacatggcacatgtatacacatgtaattaacctgcacgttgtgcacatgtaccctaaaacttaaagtataaaaaaaaaaaaatgacaccaccaggatgtggaaattctccaggacaaaagacagttttttcaataaattcaaataaataaataaataaaagattcaaacctgaggaccacatagtcacccacacccttctgagagatttagaactctgcatcacatagaaaacagtaggaaggtccagcagggtgactgctccagttacttttgctgcataacagataatcctgtattagtccatcttcacattgctgataaagacatacccagactgggtaatttataaagaaaaagaggtttaatagactcacagttccatgtggctggggaggcctcacgatcatggcgggagatgaaaccgtgtcttacatggcagcaggcaagagagagagtgagagccaggtgaaaggagtttccccttataaaaccatcagatcttgcgagacttattcactaccacgaaaacagtatgggggaacccacccccatgatttaattatcccccaccgggtccccccaacaagatgagatctgggggaggacacagccaaaccatatccaaccccaacacttagcagcttgaagttgctatttatctttaatcatgattttgtggcacaagaatctgggaagagcctggctgggcactgctcactcagtgttgctcatgcagttatgatgttagctgggctgcagtcttctgaaggccccgctgggctgcacatccatgatggtgcactcctatcgctggtggttgttgctggttgccactggagctcagctgggaccgtcaaaaagagtgcccacatattgtgctttactatagtttggtcttgatgtcttactcaccagagtggctataaactctatcctgccccaacaggactccaggggattggctgtagatgtttacaatgtgccttagtccgttcctgatgctgtaacaaaataccttagactaggtcatttataaataacagagatgtatttctcacacttctggaggctgggaaatcacaaattcagtatctgataaaggcttgctctctgcttccaagatggccccttgttgctccatcctgtggaggggacaaacactgcgtcctcccctggcagaaggggtaacaaagggatgaactctctccctcaagcccttttataaaagtacgaaccccattcatgaaggcacagccctcaaaacctaatcacctcctaaaggccccacttcaaaatactattgcaactagggattaagtttcaacatatattttagagggacacaaacactcaaatctcagcatttcaccctgcccgcaagcaccacccccccgaaaatttgtgtccttcacatacaaatacactttttctagcccagtagccccaaaagtcttgatttgttccagcaccaacatcaaagtctaaagcccagagtctcatctaaatatcatctaaatcagagatgggtgaaactcaaggtacgattcatcctgaggcaaattgctctccagctgtgaacttgtaaaatcaaacaagttacgtgtttccaaaatacaatggtgagacaggcataaaacatacattcccattcccaaagggagaaataggaaagaagaaaggagtaacaggtctcaagtaagtccaaaatccaaaaaggcaaacaaattctgaggcttgagagtaaccttttctgactctatgtcccaccttctggacacactggggtgggagctgggcctccaaggctcctaatgaccgctcccccatggcttcactgggcacagctcatgcagcagctctcatggggtggagtctcatgcctgccattctcccacactggaatcacatgttagtgggtctgtagttctggggtctcagggcagtcccacccccacagctccactgggctttgtcttagtgggggttttctatggtagccccaccccatggcagttctctgcctgggccccgaggctctagggttagggttagggttaaagaactggagctcagagccagggttctgacatgctacgcatctcaagtgaactattaacattctacctaggaatgtgcacatggaactccttcctagttcctcgaggtctccaggactgtcaccgcttcctgagaattgggactattgtggattagactttccaagaagcttcaaattgatgataggatactaatgatttatgaaccaaattataaccaagtctttgtcatttctgtgccacatttattatgattggctggtgatcagtcggtacccccataggctgtgagccatagatagttgtacagctcaggttctacgtctaaatcacctgcggttttccaggaccgacactgtgcctggcattcactgctgagaaataaacaaaagcatgaagtataagaatgaatatgagaatattgtaagaattaaacataagccgattaggaagatgtgttcagtacctcccaccttaaaagataatcaaatatacaaaaatataaaagtactatctagttaccaaattactattttccattcttcagtccattattactttttccgaatcatgtttgttgtccttcacagtcgtatcaatcattctctttctcagaccaaagtcggtatctgttctaacttaacacttagtattcctcttaacctaatttaagatcgtttattttaattaggctaaatttatcttgttttaattctaatttccttctggtctcaaattatcttcttgctccagtattttcccttgacagagaagacactactatttattggaacatttttctccttaacagcttccattctcagaacatgaagccatgtttcaaaaattgacttcctgttggaaaatatattctctgggtgtgtctttttttacacttatttagataagttcgtttgatctagctaagtgtgaaaaaagacacacacagagaatatattttaaaatataaatatttaaaatataaattatatttttgatcatttatatttaggtataaattatcaaaatttttcacccaatgagttcacaaaatttaagctatcttaacaaatagaagcaatttaatttcaacacaatatgctgaaaccaagtggatattttttaatgtttcttttcttctgcatatgcacactactccagagatgtggtagatgttaggactaatgatgataagaaatagaatgtattaagtgtttactataagctgaagactttcaatgaattgtctctaatcttgaaaaccgctttgcaaagtaaataatagtcccatttcaaatacatggaaaccaaagctcagacagattatgtcacttggctaaagccacacaagtgttagtgtctgagcccagagtggaactggatccactgatttcaaagcctatgctcatccccaacttcaccccacagcctaaactgaccattttgctggggggatgtttcttggtttgcttttggggatttgtttgttgtttccttttagagacagggtcttgctgtgtctcccaggttagtgtgcagtgatgtccttatttttgtagagacagggtctcactatgttgcccaggctggtcttgaactcttggcctcaagcaatcctcctgcctcagcctcccaaagcaccgggattacaggcgtgagccaccatgcctgaccaaaattgacggtctttgaattaggatccagaacaagggttaacaacatttaaaaatatttgtctttaaatattctgatgcctttccctctgaagacttcgggaggcaagtgggagaagaaggcataatgatttagggaggggactatagtctcccaaactatagaaagcagccatagtgacagcaattgcttcactcatcaaaatcaacagtgaaacctaacacacgtaccgtagattagtgactctcagtccagttactcattgtataaccggaaaaaaaaagaaaaatttcttttcagaaatatgcatcctaatacaagctcttttggggaaggcaaatctctaatggtggcctagccttagtaagcatgcagtgaagatagcagccttgggacagatttaatgatacttctggcttttagatattgcatccccatatagttattaaatgcaccagctgctgggccaagcataccacatgcattcatttctttagtccttacattgttctcacccccagttgatcaaaaaggaaaattatcacagagtccaagcaacttgcctgaagtcttgcaggcagttatcagggtggttgggactcaaatgcctgtctttgactccacagacctacgtttgtaaccattatgctagatggtgtcaagaacctgccctgtttcttggagggttagatgctcaggtgtaactgctgcaaagcttatgtggttttgcaaacccaaatgagagcttttcaattgcccttggagtttcttgatgctttctgaggtccaagggtctgatggaactcagcagtgctcatagtccctgattttacccttggaacgactactgggcaacaagacaggccaccattcaggagaaagcagggctcctgctgagacattcaagcctcaggcttcctggaaagccacattctgaggagacaagcctcagctcccaaccagcaacacctcactggaaaccatttgccctttacctaatggcttttcttgcccagccatgttctcttattatttccatgccagagtacattctcctaatccattgctgtccatgccctgttaaataataatcacttttcctccccagggccggtttcatttcagagaaatgccagttgatgctttaaaaatgtcaagatttctacaaatctcttttagatcagtgctctgatgagccatccatctcactgtcacaaagctgtcttgggcagctgtctctccgctctggcagtgcagcccaccttcacacctccacacagaagggaggtgcaagactgggagctgtgtgatggggcactcacccccatggcaagccttctggcaccagccccataaagagggcactttcttgggcagctttcctgaggacacagtggcaggtattaacctttggttcctgtgttattgttgtcttttcacagggattgactatctccacccggacctggcctccaactatgtaagtacaagccaactttggtggggaaacagatgcatcttaaatgtcctggtgtccctggctattaggaacatgcacatgtctacatgtctatacacatgcatgcaagtacaggagcatgcacacacacacacacacaggagtacagctgctggaacatatgcacgcacacatggaggaacacacacaaacaggaacatacacacacatgcataagcacaaaagatgcacacgtactcataggcacacatgcatgcacacacagacagccacatgggcagccacactggaactgtccatcccattggagccacagctcaggccacaagcaaatggacaaggcatgtggcctggcagcaggcaaaggcagtggctttgagagaagaaagaaacctgacatctgaaagagcagagtgccaagaaagtaggtacagggagggggaagaagagagagacttggcaaggtttaaatcaactctacctgatgatattgaattgaagggtggaaatgagccatttgggttcttgttggacaaaaccaaaggcaaaaagccaaaaactgcagtgactcacattgcagccccagctttatgaaagtaagagcgttatcttttttgattatttgtgtcacttatgaccactccactgactttcccccataacattgagaattactatcccttgacaaacaagcaatgttagcagagaatcaccaaaagccctgctgggctagaaccacacactctaacttttgactcagcagttcacacgctgctttcctgatgaagcccacaagccctttaaacagaatcgatcacttattttaaccccagggagtacaagattcaagcattggtgcgttcacttaaaattatccaaactatttctaagctatacttctgagacctccagatctaggtgtaaaaaatgttgtcttagtcattgaagagactcatatttagagaacaagggcttgcataaaagaaaggatggttacccagcaaaaagtgtttggaggtcaccagtctgggtcatttgtcctggaaggcgagtgtctctacgttgcacaaagaaagggggaatattccatgtgtttcatgcactgggcaacaagaaacaaggcattcaagggatcttataaatctagaagagcataaattgagaggagcatcttttttaatattaggaaaaactattaaatgaatcattggcagaatccagccaatgtggccccagaaagaaatgacagaaattaaaccaaagctatattcccagcaatgataataatccatgtctatggagaagaccattgtaaactgcctgtgccagcggtcctgtgtgtggagtctgaggaaacagcccttctccctgtctcctcatggtgccttccctactgaacatgagtggagctgtctgctggtcttctcatgcacttccttaaagggactgccctggacacagtccttgctgcctctccctgactatggctgactccgctagtgccttcacctttccctgcctcctccataactgcagggccctggagatgtgtcaggcaggggattgagaagtgctgcattgcattttctccaaggctctgatgtatctggggctgttcctcacagagagcaagtgtggcagggatcatggcctccagggtcggtggtcctccctccgagggctgtccccactccaccctctgcagacagaggcattgatattctccacagttccctccatctccaggacccagtgcctcacagggcagccacgtggagttctgctcactttcccaaaccatacttggggaaacaatcatcttgtcacttggaggacttcaaggtggggtggtacccattgggctggagagctgagggcacatggcctgtctcctgtgcatagcataaccccacaaaggcctaagacatggagaccgacctctgcatccttcccttctccctgcctagcccaggcagttcctgtcaggctgctcccaactccagctgccagattcgaaaaagatagtcattcattgggggcaagaatcctctggggttccagtgagctgcaggtacaatgttagtggatggtgtgatccatctgccaaaaccttcatctgaaattggaatgtgaaacctccatattgagccgtgccagctcctctgagatctgcaataccagaatacacctgaagaactcttatcggttctgtgagtctcaagttcttttttcttcttttctttcttaagaacatttttctgattaaaaaataaatgcatgttatctgtcaaaaaatatgaaaaagcataaaacagattcaaaactagccataataccaccattcttattattttgacatatttggggcctttaatttctatgtgtctatttttaatgaaattgagctcttattgcatattcttcccttctgcttgatgtgccataaacatttttatgttattaaatattctccaaaacataattttaagggctacatggcattagctcatgctataatttatttaaacattctgatctccaattgttgaacaattaggttgtttccaatcagtgtttcactgtaagagggagatgagatggcagacagtaacatgggtggactccaagccataccatgctaaggagaactgaaagaactggaaaagcttttcctggaaaaaagaaaacaggcacattgagtatgttttcaaatatttcaaattctcctggtacaatgaggcattccacttgttcagtaatttctcccaagaaaattctcaccaatgggtggtaaccacagaagcaaaattttaactcagtcaaaggaagaactgtctagtgattaagatagtaaattattgggaggccaaggcaggtggatcacgaggtcaggagattgagaccatactggctaacacggtgaaaccccgtctctactaaaaatacaagaaattagccgggcgtggtggcatgtgcctgtagtcccagatactcaggaggctgaggcaggagaatcgcttgaacccaggaggcggaggttgcagtgagctgagattgcaccactgcactccagcctgggcgacagagggagactctgtcttgaaaaataataaataaataaataaataaataaataaataaataaataaataaaaataaaagattagtaaattaatgaaagtaacaaattcttcatacctgaaaatattcaagaggaagtttgatggccactggtgggatgttattgaagagatgacaatgtctatgctgaacttaaactagatgagacctaagaattgaacagaaaatgtgatttctgtgcaaaactgcgcatcttgataactttcattcagagcaaagtctgagtcttcaacttgtatcaaacacttggaagctgacaatgaaattatatatatttacatatggctgtgaaaatgttctgcctctggtatagatgagaaaactgaacacctaactacctcgtgcttgattcctcagcagagggcccaaactggctggtttttaatggcacagtgtctctctcaccctgtgtagagttcagagtggcaacttcggagctactaaccacactaatcttctttatttttaattaaaaattttacactatcattaacacaatgaggacagcaaatagagtagaccagcccaggagagcaatgaaaccagtagacagtgataggctcgaaaattgtttgagcagagaattagcaggcagcttcacacctcgttaagtgacctaatggcttggagggatgagccagcctggtgccccttgagagagaggtacttggtggagtctttgcttgggtttccctagaagcagactctgaagcaagggtttgagtacaagtaggttatttggaagaggattctaggaagcaggggtagaggacagggaatgagtccgggaaggaaaggtagcttgtaaacggggcagttatcaaacaagacagcactgtgggcactgaggcttaatctcactgggcagctctgggagacagcatagaatatgtgagccagagtgatcccccttgggatgtgatgcctcaagaagctggggtatttatgtgacaacttcgtcagtcattggttgagggcttgtcccaaaagatgttcctacctccccacagcctggggaaaagccctgggcagaggtgtgggtacagacagctgcagcttaccagggacatgagggtttcaggctgaagggggatgtagcaacgtctgccccagagatgccttggaaattcattaaaggttaaaataaatagacatgttctatgttgaaaaaactccttgtggttactgatttattttcagtgaggattgaaaactctacccaaggctcctcaaaaaaattactttataatcaaaccaaccaaaatgtttctgaaagcagaattattttcaaagcttggttattctgtatattaagagaggaaacagcatatgctggtagtccagtttattcccattaaactaagaataaaatacttggaaaattgcaaatcaatatataaatgtaagttgttagtgttaatctaattcaaaaaatccacactgagcctgctgagtgttgggagtaaaggataataacggccacttggattattactctattgttctatgattgaatttcatcggagggatccagtcccactggtaaaagttcactattccaaataattaaaatttttctttttctatcccaatagtcatgacacgaaatgagtattagccaagaggctattttagaccaggttaaaattataacctcctttacccatcttcgctataataactgggtattttctctaagtcaatacaatggctgtggattgaacctgctatgtgcaagccccagaggaagagagataaataagacacaggcactctctagagaagtcggcaggtcagtaaagatgcaagcatgtgagacatgactgtcaggtgaggggtaggcagacagggaggttcgttgtctctttactctgagctcccaatccagtgaggattgcaggctgggttcacagtacgggcccaagctcaggggttctgttaggtctatggaacaaagggagacttcttcaagaacatgtggagtgtgacttaggtggcagctttcagggcatggaggtgggtggggtagaacgtctcctgctttgtagctttgctgaagctacaaaggtgaagaaaaggctggtgggtctgtagaatccaaggagagccttcttgctgtgtgctgggttttctcagaagcagaccctgagacaaggatttgaaagcaagtcattcatttgagaggagatcccaggaagcaccagctgggaaggaggaaattgatgccagaaagggagagtggcccagagagcaaattaccccctagggcaatgggagctcaatctccctggggaactctgggaaacagtgtggaccgagtgggcctcagagttacccacaaactcctgtcaaccactgggtgaaggccactacccaggagtagagatgaggtggggagatagaaggattcattctagacaagaaaaatagggccctgcagacagagtcttcagcagagttgcatgtgctgacagttggaaaacagccagcttgcaagggtagggttctgacagttggcagtagtggaaactgagtcaaagctgagatgactcctggctccctacctcatgatgcagccttagaggagcatatcaaacatctttgaaccttaattttttcatccgtgaaatgggcaaaatggatgtcttgtcaggtttgttgcaaggtatccttgagataatatgcgtatcaggcctggcacataatagatgctcaataagcattcatttccttctgtctcagaagagttgaggttacaacgttgcacaatttcgggttgtcctgatggagaagcaggggtgtgcctcaagaaaccagtgcagttgttcattggacctcccagtgagcttagggtcattaaaagaagaaagggcaactgatccaggctaagtataagattgtgagggttgcaaagttaagggcaaaaatcagaggataccaacataaatctcaaaggctttgaaaaacaacatccaagaaaagagaaggtaaaggcagggagaagacccattgctcgtggccagggatgtaatgaaggatgcccccgaggaagcggcatttctgacctgcatcttcttccctgtcacataccttagaactagatgaatattcaaggatagtcataagggagggttaatccctaaggtgggcaaagggattataaggtagcaactaccccaagtgaggttttctccgagccagggaaatctcctggtatttaagccattgcagggtgggacatcaactcctgttctgatggctgggaggatgggccacttcttgcactccgtcttctagcttggaaactgtgagtgatgctctgagcagctccaagatcctgtgctgagaatctgtctagattcatgacacttcatgagcttttccaagaattcttgagtgcagcaaatacagaagtttgcattgactcaactccacatccttccctagaccacagcttctgccatgggactctgtagaatctccctttaaagaggtgaagtgtgtttcctaccccttgactttggattgggccttgtgacatgttttaagcaatagaataatctagaactgacagtgccagtttggagcctaggccttaagaggccttgtgtgctcccaactgcctacccacgcctctgccatcgccattagaagggcattcccaggctctcctgctgtaccctagaggagggtgagagacatggagaagagcttccctgctgccacggcctgaagcaccaccacccacactggcctacagagctgcagtaagaagcagagctgcctagctgagccccaccaaaatcaccaaacctcagccaacccacagaaacaagcaagccagccaagctcagcagagctgcctagctgagcccagcccagagcacctagctgccagctgaactgtggactcgtaagctatctaaacacctgctgttatatgctgctgacatattatggccgtttttgtgtagtaactgttacagctgcccatgctagacccccttctccatcctcctacagtacttgaggtgtaccccagtctggagagaatattggcttctaggcctatcctagacctactgaatcaaaatctttagggacaagcctcatagtgtgtatttcttttagaatattggcttctaggcctatcctagacctactgaatcaaaatctttagggataagcctcatagtgtgtatttcttttgaagcactccaagattctgatggttaacctactcattcattttggcacttcattcatgcattcaatcattcattcattcaacagtgcagtttacctataatgtttgactacatcacagttagatcataagctctttgtaaggaagtgtgtactttgtaagtgttttgtgtccctcttaacacttatcacagtgttaagcaagcacttaatacatatttgttaaattgcattaaatgttaactcaccaatattattgcaagtaataccaggaactaaattatatgatgaccctctatcgacgatgatcagaaactgcagcatgcacaaccctctgtgtaattcctagttctcaaccacctcataggtggatgccaccattgcctccttcatcatgcatgatactaaggaaagagaggaccctggaacctaactgagttcctatggctgcaagcctggagagaatacgattcgagaggtgaataatccacaggcaaataactacaagctatttcttttctttaatgtctagaatccctcaagttgctggaaatgcaattaggttcctagataggagaggacaaattatgttctttggttccgttcaaaatttggaacattatttatgttccagggttgctatttcaccaacagaagtgatcataagagaaaaaggcccacccctacattcctgcacttttccattctttagatgggtcctgacaggtgactgtctctgaagtgggtgcctgctgagagctcagaagagctgccagcacaggaagtaccttgagcttgacagaagtgtgcacattgggccccagggggcatgtggcctccatgataaaagggcgacagcaagaaaccggcacagtactcagccccgaatgactcagatgttatgaagtattgatcacatacattgcttctggcttttaggcctatgaatatttaaataagcacattaatattgcatatgaaactgaggcttaaataacctttgtttcttattgaaaggaagggctggcattttcaatgtgctcttgaatgctggctggatcatgatgagcactttagcaccagatcagactgaatactgagaatggggactttttaaaaatcactttgatagaccgtcagtcaaatgactatcacttaatgcaactcatgtactagaggaaactatttatttttacagaaacatactttgctttaaaaatagggcagaaatgaaaccttgcttaacaaaatgaaactacttgtatggacctaaacttacagctatagctgaaagcaaagaaaatatctggtcattctattatttttaattattcaattgactagtatttgtttcattgaacttagtcagcattcaagaaagccgtattgttcccactgtgcaaaatgctatactaggggcctgaattatgaagtgtgaaaaatccagtccctgaccttggggggttcacatgtaagtatataattacattataatatgcttagtgctaacctggaaataaaacaccacccatataggaatgcaatagctagaaaaagcaagtcagccctaaaaaattagagaaagaaagatacttaaatgcatttaaagaatgcagctcaccacatgggggatgaacttgttttcttgggtcgatacagcatatgaattcatctagaagcttcatcaatacgatactagacaaatgggtaattggatttcatctggagatttgcttccacctagaagcctagacttaaaaagtagcccacatcatttccttaccccaaattccctaaagcccttcgacagattctcatctctttgactaaatttaactggcttaaagaccagggtaatgtcttccaactcttttactcatgagagaatgaaccagcggcctcattccccacagagatcattaagagagacttcataaataaaagactgaattatggatggatggacggatggatggatggatggatggatggatggatggatggatggatggatggatgaatggatggatggatgattggatggatggatggttagatggatggatagatggatggatagttggatggaacggatggatgaaaagatgggaggatgctaatgagactattgggattttattccatttatcactaaacacacctgttcagaaaaagtgtagcaatgtttactgataagccacaagaaagtcatttatgcaaatataagaaaattgaaagattactattctcaactgcctttgttcctttctttgtcttcattatcggtatatacgcactgaattcccaaaatgtgaaatattttactggcttttttatttgggtttctatctcatagaaccaaaaacctttaggtgaccaagccttacaaataattaacttggcaataacccctggctacagctgtggttcaaaatgctgcttctgctgagctgacatccattttcactttgtccctctcctcatgtgcctgtttcccaatcatactgtcttaaagccacagttctgggtgtctaaggcaggcctgaccagatttctgaacccatgtcccccacccaggaggggagtagtgggttgatgccacagcaaaatgggcagtcatccacactgcttgcccatgtcttgttgccaagcaacagagcccaagtgggtgtgtccactagagccacacctacatgggatcattgcctgggcaaatgtggatctgatggagaccaaacgtctgatccatcatccaattacagttttctgaagcagcaacaaagaccaagaaacaatgcccaggcctcaattaagaaggatcagactctgaagccatggagtcttctaaaatatgatagaagataaattttgtggttgtgtcaaagaatcatgagtactataactgtcattttggctagagccccattcttacctttaaaagctcttaatcatttttccttgaagacaaagacttgatggtaggcagaattgtaaaatgcccccctaagatttccaccctctgctgtaagcactctgtatagtccctctcttgagtatggcaggacctgtgaatatgatgagatatcactcttacaattaggttattagattgcattatatggcagagttagagatttttttcagatgtcatcaaggcgcctaatcagttgactttaagctaatcaaaggaaagactatcctgggtgggcctgaactaatcaggtgagccctttaaaaggtaatctacaagtcagagaaggaaggagtcagagagattctaagcagtggaggctttcacctgttggccttgaagatgccactgccataatgtgaacagggccacatggcaaggaatggcggactccctgggagctgaggcctcactcctacaaccacaaacaactgaatgaacttgaaagaggaccccaagccctagatgagacagctccagtgacaccttgatttcagccaggtgagaccttgagcaaaagccccagttaacccacgtccagaaactctgagataaatttgtgttgttttaagccactatgtttgtaataatttgctatacagcaataaaaaaactaatacaaccttcttgattatagtggatatttgagcacaaactgaatgacttgctgtctctctgaattaataaaaatagaccactcctcagtttttactttttcttaatatgtttgcttttatctcaaaaataagtatactctgcctattgccacatggggccctttcataaataataattctgctgcaatgagaggctcagagaaatttagtgaggaagttaagaagagctcttgggccagcctcgctgaattcaaatctcacgtccaactgcttcttaactatgtgccctaggcaagttaatctctctgtgtctcaatttcctcatctgtaaaatgggttaataataatactgatcttaccggtgattgtgataattcaattcagtagtgcacacaaggcccttagaactgcctctggctcataagacaccctcaataagcattcgatgttgttaagtcccctgcccaagattgcacagctagaattcagcagggaagaacacaagcctaaggtggtcagacctcaaagtctgttctcttagcctccccctcccttcctgccttaaggacacatatgaatttgcagaaagcattttttaaatgaaattaaaaggggcaattagtgcgttattctaagttttctttccactttcctgctaacaactagtgtgttattctaagttttctttccactttcttgcttccccagccctccctgtcctgcctcccagaatactttactggtttcccctgggagcacatccttaataaatcacttgcctacaagctttcatcacagggttggctcccaggaatcctgatcttacattagagcggtctggagctttaggcaaagcagaattttccatcctacatggccaaggcggagagaatctctgacatagaaataagattagcttctccaccatggtaaccctgctgctgactcccaacctacgggaaattatttttcacaaagaaagaatctttaattactaaccaataattaaaacctgaagccaagaacaggaagccagactttggctcttagcaatgttccttaacatcaccgggagtattatggtgaggtctgcactttccatgtggcatgcacacaacctctccacaatgagtgctctgctaggcagaagaataagatgtattacagtgtgtaggagatgttttcattaagctatggaaagagatggattatgttttataactcaagcattgccaattttttaaataaggagttcagtgtaagtctaagctattcaaagagcactagttcacagactcccattgaggtactgcaagccaaaaaaaaaatgcgttgtttgatctttatggccctcagtttccccatctataattgtcatccccaacaagattctcattgtctccagaatcaaaagagtataatgattattcatatggctgatatgaacactgggtctttgttgatcaatcaaaaaatagaaattaaatggaacttctgagaatgttcaaggcgttgaagctattctggtatgggtattggaccaccctccctttttttctccacaacaccccacaagcatacacacacatattctttctctatcatgtaaagaatgttccagaacactaggtggaaaggagccagtccctgtgtagaggcctgtgtggtgacagatgggcactgagtcatttgatacagtcagcaccttgcaggaattcttaccaggcactttaccaacaaaaaatatattatctgtgaataaaaccatggccaaggctattaaccacttcgattaatcactcacaagcggtcacaatgatcctatactacatggcagctttattggggagttttgacttgttgcttgcttgattattaataactcgcaaatccatctctcctcccgtggagagttggtagttggctaacgaagtatgagaaccatgtgttgtctcccacctcttctccctgccgtggttctgatatttctccattgatttctgtggaatagcaggagtgttagttcccagaatttgttgagtatttactgtgtgtttggccttgtgttttatatgcatgatcacatttaatgagcgtgttaagccagtgaagtgggtactttcttacccacctgtcatagacgggaaactgaagatcagagaggctagtgatttgccttagctcacacagacagtgagtagcaaaatgtgaagttcaccatctgtcatgctgccttcatttaacctggccccctccagtctcccacatcttaccaaatggcatcgccatggtcacaatgactaaggtgctaaacgttaccatccttgactgctgctcccttctttttcccctcagccaccctatctgccagttctgctaggcaatacacctgcctctctgttcccaccactggcatcctggaccaagccagcatcacttccctcctggaccccacaaaagtttcctgcttccactcttaccctctgcaatgcattctccccaaaacaagcagaaaggtcgttacaaagaacaaagtagtggaagccatatcacttccatgcttaaaaccaacaggtggctctcccccttccctgtgagacttagcctgtttgcctttgtcctgcttactcacgatgaaccagactctacaatccaggattctccctaattaaaggcttggaagactgtcacactagctcttcccacagttgagtccatctcaacttatattgcacaccctgtgtagccacttcctagttcttaagatagtctgtggttctgtatttttgttttgttgcatgtgttcccccattagaatgtcagccccaggaggatgaggccacggggatctgacctgtcttgttcacctctttatccgcagcacagcaccatggctggaaccaagtgagtggtcagtaggtatctgtgagatgactgactggctgaggattgaacacttggctttcctctttttcttttgccttcaccttttaatttcttctggccatgctttctcctcacatagctcctatctctgtctttttgctatgcttctccttatttatacctcagtcaacaccagcattttgttatgaaagaaaagctgcaggtcagtgccacaaagaagacaatttccccaggaaatgaacacttcagtacttctttagtaacttctggggagaaatactatatttcttcatagctacaaccaaaaaacagaaagcctctctatccaagactgccttgtccatcccaagaaaacagagaactacagaaagcagcaggaatgattcccttgatgcttttaattcattcatttgtgttatatgcaattaacaataggccaactgatttctcaaagcatgcaatttcaagctgaaaaattaacctaggttattttccactcagttaagtatcaaaaagattttgaaaaataaaaaaaagaaaaagaaagaggaaaaaaaccaacatgagcatgttcttaactaatgagctatgcttatccactgttccactagaagagaattttccaaatatggacactctattcacaagtctctcttgagaaacgtggtgttacagtgtcaccattattaatattaaacttgatgcaccatatttacaaatccttccaaagggaaacaaacctgccctggaaacaatgcttataattataatcgtggattctatctgttcctcacagggaatgcttaaaatatcaatttaaatgcaaatgaatcttatcattccaaattagactcatcccattgtgttgaaattaatatagaaaataacaccgaacaccaaattacaagtaattaatattgacactgtgaaaagtatacactctcattttgatatttggggaagaaagtcttgtctgtgcgtgtgccattgtgtcctataagcaacaactagaacacaataccctcagtgctagtaatcatgcaggattaacacagcaaaaatctgagagggaggacaaatggcaatgatacatcttagaatccagtaatctattctttgggtctgaggaaaagcacttaaatctgtatttaagtgactacatactatttaaaaataaactatttgaggccaggcctggtggctcacacctgtaatcccagcactttgggaggccgaggtgggtggatcacctgaggtcaggagtttgagaccagcctgaccaacacagcgaagctccatatctaccaaaaaaaaaaaaaaaaaaaatacaaaattagccgggcatggtgtcacatacctgtaatcccagctacttgggaggctgaggcaggagaattgcttgaacccaggaggtggaggttgcagtgagccaagatagtgccattgcactccagcctccccaacaagagtgaaactctgtctcaatcaatcaatcaacaatttgagtcttaaaaattaaaatatttttcataggctgaacacagcggcccatccctataatcccagcactttgggagactagggtgggagtattgcttgagccaggggtttgagaccagcctgagtaacatggcaacaccctgtcgctacaaaaaaattaaaaatttgctgggaatggtggtgcatctgtagtcccacctactcaggaggttgagacgggaggatctattgagcctaagtcgaagctacggtgagccacaatcacaccactgcactccagcctgggtgacagaacgcaaccctgactcaaaaaaataagaaaaagtatttctcttaaatgcaaaggcaaagaggacctttctttgtctcttctgtacctaacgtaagggttggctaactacacagattctggccacctgtttttgtaaataaagttttatcggaacgcagccatgctcacttttttacttgatatctatggttgcctgcatgctctaagggaagggtggagtagttgtgacaaagtccatatggcctgcaaagcctaaaatttttactatttgatcctttaagaataggtctgctgaaatcccctggtctaatcagttgtgtgtcaagatgtaggaaaatggttttgttagaaacttaagtccagagagcttcaaaacaggctccagtgacagctgtagcaccttctagcagtgtgacatctggaaaactgctgaatatcttgggggcatagcaccctcatttgagagctgagaaaattgaactcttgtctgttgtaactctaaaatcttatgaaactctcctcccttccaataaaatccctgattaagaaacaaaagctgaattagttttgttaaggaaatggaatcgtcaagtagtttgaatctagttaatttgcttttgagaatgacagacattaagtcaaagtgatgctccttttccatgcatgatgctgtatacactaatcactggggctgagtgatttcaaagagttttgcattcatttactgtcttagctgggattcctccaaaagctgactgtgagacatggatccacaaaccagcattttatttggaatttggtgccaggaagcacaggtaggggagcaggggagtgaaaaagtgaaggaagtcaatacagggtgtgcacaagtgtgtcctactgtgggcaacaggagctcagttctgctaagcacccctagaacatgagttagaacacatgaaggagaaagagtacaagtatgaacacaccaactcttatccatcattggttgatgattaatatcaggatggagagaggaacaatttcctatacttctaagctgccatatcattggtgaatttgactccagagataaagagataaaatgctgacagatggaagttgtgtcaatgtgcactgatatgctcaaagcaaggagttattatggatggggcatctaatagcatctaggacacttacaaaatcagaggtctccaatcacacatccctatttgtaaaacaattttaactaggctctcctaatacatgtatagctatttattcagacagtatatgtatgtactactatcaatgggctatgtacattataaagcatatccaagaaagaaaattttaaaggataaaatataaataaatattaaaagttaaaatgcacactcatgttcatggtaacattattcacaatagccaagaagtataagcaacccaaatatcaatcaatcaatcgatgaatggagaagcaaaatgtattacatacatataatggaatattattcagcctttttatcaccttaagatcctaaggtcctaagattatttattcagaatttcaggaaggaaattctgttacttgcagcaacagggatgaactttgaggacattacactaaatgaaataagctagtcataaaaagacaaatattctgatcccacttatatgaggtatctagagtaatcaaactcatagagacaaaaggtggaaaggtagttgccagggtctgggttgagggggaaaatagggagttattgtttaatgggtatagagttttagttttgcaagatgaaaaagttatgaagattgtttgcataggtacttaacattactgaactgtacacttaaaaatggctaagatgatgaattttatgttacatattttttaccactattacaatgaatacatcgttttttaaatcaaggtaaaacaaggcttaaaagatttcctcccaacactccaatggatcatccagcacatcctcccaagtgagcacaatccacttttgagacctttgcactaaatacctagtctgtagccctgccctcagtgtaatcagcaaaagattctgtattaaaacataaaatcctctgtccagctagatgttaagatctctgtctttaagggagataaaacagaataataggaatggcaccaataaggatcatgcagacaggtagatctgggtccaatcctgcctctatatttagttactgtgatttgaaacaagttaattaacctctctgttgtacacgttgtacattcctgagatataaaagaaggatagcaatatgccttcatgttttcattcaacacctagttattgagagctatgctacaccagaaactgtagtatattagttacctattgctgcatctcagattacccccaaaacatggcagcataaaacaaaatacatatatatattttgtttcacaccgtttttatgagtcagaaatttaagagcagtttggctgggtggctccgtgtttctcgtgaggttgcagtcagcatgttggccatgactgcagtcaactgaagactcaaccagggctggaggatcgacttccaagatggttcacatggtggctgttggcaggaggcctcagttcctccttgcacgtagctctccacaaactgcttgagcatcctcatgacatgatagctgacttcacccagagcaagcaatctcagagagggaccaaaatggaagctacaatatcttttacgatctagcctcagaagtcacacaccacaattttgaaatgtcctattggttatatgggtcagccttgttcattgtaggggactgtatacaaggtcatgaatatcaggaagcaagaatccctaggatcccaactgggaggcggggacaagtggctgaatagagcagacatagtttctaccctcaaggaccttagcaactagagggtaaaatagactccaaagaaataactacagaaataattatgatctaggtgctttgctacagcggaagagtactcggtgatataaatgtgtttaatatggagaaccagatctgggctgccagttaagggaagatttccctagagtagctatccctatgctgataccttaagaatgaggaggagttagccaggaatctggaagcagaaggaacagcttgtgcaaagaccctgaggcaggaacatgctcagccctttcaaggatctgaagaaggccagtgtgtgtgtgctgggggaaagaagtatatcagtacgggaaggaaaaatatggcatgagatgacattggagaagtagaaagagaaccgactgtataaactttctgagccatgaggattcataacttcatcctaggagcaaagggaagcttcagggtggcagggagggggaataacatgcctagatttggcatttttcaaagatttgcctgctaaagagacagattgggagtgaacaagaaaggaggcagggagagcagatgggggcttttctaggagaaagattatttgccaaagagctgttatggttaaaaggaagatagagagagagaaagaatgtagttaaagcaccctgaacttcagaggtgctccctaaatagtctttctctcttcctcttaaaacagaaaccttcagggacacctaacataagatgatatctgcaaaacatatatctctaaaaaaagcagacaaaaacacaatcacttagcgcgggcctcattaggcacctcataagttcaggcactagggtcctgaaggagtcttgtgcacaggaaattcaggaggggagtcagcagtgagcttaaagcctcgctccaccaccagcaggaacccggactgacccacagagagcgctgaatagcatttatgatgcttaatcagaaagcatgcagcgttgatctggaaattaattggatgctcggatttttcgcacatcatggagagttagatgttacaaagattttgacgggaatatatttagtaacagtatcactgatgttcagtctcaagcaggggcctgtatctactctggggctcattatattctgagtgacaacgggtgcttagtaaatctcctttgattatgatgatcaaccaagtcactcagagtgtctttaatagataatgagaaattgtaccagagttggggttttctaaatatgaaatcaaactgcaattctcatgacccactgtgcttttatttatttaatcatttttacttaactgattcactattttaataggtagttttaaaagttaactctacattaccgccataaatggaaaatctcacttgccatataaataagacaatcataaaaatagataccgtctacccctaaaatctgccatgtacagctcaggttgggcacagcacaccctgagaactgctggacctggatgtgcttgtagtcaagggtcttggaaggaacagccgtggtcatcagttcacacagccaggatacaggggatatgcccttatgtgacatagggcatatatgatatagagtatatgtccacacattccaatatcaatatagggagagaatggtggagagagaaagggagatctctcaaattaacaacaatgaatatcgactgaacctgaagaaacagatgctctttggttcatggaaagggtgtgaacagatgctcaggcctgaacactgctcagactttgcagcttcagggaccatcggctaagagacttgtcttctggacttactgcctggggtaaggaccagggctcatttatcttatctctctaatctggggagctgtgaggactagaatgggtaagggttcagtgcagggtttacagctgctgaaaggtccctgtagcatttcctttatggaaaatcctatggatatacttaaagataggtatttgtgagggtgaaacctacctacaacctcttacactgctagtgcaaatgtcaaatggtgcaatccctttggaaaaagtttggcagtttcttgtaatgttaaacacacacttagcatacaaccagcaatcccactcctaagtatgtactcaagagaaacaaaaaggtatgtttataaaatggcatatacatagcagctttatatttgcaaaacttggaaataattccaatgcccgtcaacaagtgaatggataaataaaactgtgatgtgtttatacagtggaatactatcccacaacaaaacaaacaaactgctgctgcatacagtacaataggcaaatctccaaatgttgttagctaccaacaaagacaaatgcaagagtacatatactctctggttccatttacatgaagctctaaagccggcagaattcagatacagcgatagagatcagaacagtggttgcctaaggtaggtgaagattaactgagaagggcatcatatggtgagacaactcctcaaggtgatgacagtgtccactatcttgattggcatgatggtgactcagatttacatactgctaagatgcagcatgcatgcttaagatcacatatgctactgtaaattatacctcaattaaaaaacatgatttaaagcacaacctataagcaaaagagccagtttagaaatcagttaccaccaaaaatgccctgtgaatgtgggaagaatgagtggagaagcctgcccatgtcttgcctcagaattttcactgcccacctgctcacctccctaggttgtctcaggcataaacgaagatgatagatgtcagggcacttggaaactctccaatcgctgtacactctaaaaggggtctagtttaatcatttgtactaatttcttagaaatgcatcactcttttttccttatttgcctttttaatatagaatcaaggcttgctcatcatcaaaaagattcaaacattacagaagtgtagataaaataaaaactgcaatttcccttctctctcctctccttttcctcctctatacaacccactcactttccaattttggtgacgtggcagttctgcatggatctttccagattttttttctcccccaactgcaatcatacagtacaccgtatcatgcaacctgctcttttatttaacaacatattctctccaacagtgtggatattccgtcatttgtttaaccaagcccctaatgattgacattttgggtttcccctaaagttttgctgttataaactacgagacgaatgtgtttccttgatcttcttcaaatccttgtgtgaatatccctttagaataagttcttagaagtgaaatttctgagtcaagtagtacatgcaatattaattttaataaaccttatcaaattattctctgaaaagattgaatcaatgcatagtcctcccaggagaatcccttctcattttgatctcaaagacaggaaaaataaagttgagagaatgctgaaatattcaaagattctccgatgcccttgaaaagcagaagtggagctgacatcaacatggccttattttcgctgctgacttgaaacttccataatgaggaaataaaacacatgatttaaaaaaaataaaaaaactcatcaatgagattaatgagagttgagagcctatgacttgaacatttgctggttaatagatgtagggatggaaacagtgttgtgccaattactgtaattaaccagaaatgaagacaaatggaagggagcctcttctgcccaccaagcttcaacttaaatgctgagtcatgagctactagtggaggctggaaggccaagacctgggctagtgctgggaaaaggaagtagctcttattctcccaaatgtgtgctgggtgctcagaaacagagacagtgggaccccatctctacaaaaataaaaatttaaacattagctatgtatggtgacatatgggtgcctgtagtcccagctactcaggagactgaggtaagaggattagttgagtccaggagatcaaggctgcagtgagctatgattacaccactgcactccagcctgagtgacagagtgataccatgtgaaagaaagaaaaaaagaaagagagagagaaagagagagaggaaggaaggaaggaaggaaggaaggaaggaaggaaggaaggggaagggaaagaaggaaaggaaggaagggaagggaaggaaggaaaggaaggaaaggaaggaaaggaaagagaagccatcctgtcaaggagtcccaaatatcccctgtctcatgtagctcatccttcaggaaataggacactttccaactaacacagttaggctatatcccccaaggtattatgtttttccttgaatggagtcaaacactttctaaactcgagagaatatggccctgaaggaaactacgcctgttcctgtgatgaaatgacctgacaggaaagaactcagcatcttgctgacaagtcaggaagaactcacaacctgcccagtggtcattttagtcaattttggggggaaacagttcttttgaataggtcccctaaaaaaggcttgaaagaagaattagtacattccaaagcagtgattagaaatcatcataattttctaccaggagaagagcactttattattacttaaaattactctagtccaatagccaattgctatattttatgttaacttttatttacaggaagtacaatgtattccttttggtgcactgttccatgagttttgacaaaagttcatacagtcaagaggcagaacatccccatcacccaaaaaactttcctcctgctgccccttttcccactcgcagtcctggcaaccacagatctgctttttattcctacagttttgtctcttctagaatgttatacaaatggaatcatacagtatacagcctttgagtctggctttttcaagcatttattctttatcaatgtggttgcatatatcaataacatgttcttttttattgttgcgtagcattcccttgtgtgatgtaccacaatgtgtttatctgttttccagtctgggaacatttggataactttcagtttggacgattataaataaaatcgttatatacatctacacacagatttttgtatagaatttagatgtcctctgtcttgggattgaggggctgtatggtaaaccaactgctctttaatgtctagaaaatgtgacagtcctcagagtcatggagcctagaaaacagtgcggttgtccctggagttcagaatgctttactctgtaaatatcattcttacttggatagccttggtctgtgagtaaatgtgctatgataggcgttgtgtagccgttcatcccagctctgtccccagaatcagataaggactcatgctgtgaactctgatgccttcagtccaatgagaccagaacatcacttgcccgtttttattttaggtctcgtgtcaagctaagctaagatacttcattcctttttcttttcccatcaaattttgtatcttaaaagtttcaaaaaaatttataagcaagtatatctcaagatttttaactgaatgaaataaatttaaataaaattctgagtatttttccatttgattttttggaaaatatatgcagttcccaaatttgaacaataaatgtgcatttataatgtaagattatgctcccagaaagctaaaaaaaagttagaattatcataattacataatccctattatacttcaactcttagacataatttttaatcatttatcttcaaaaagatgaatatttttaaattttttttcttttttttcaatcactattaagcacagttgagttaaatccagtaagcattctgttgggactaaagattttctgttcaaagcacacctaatgatttctctcttgtttcaattgtattaaatttatgagacctctattttatctctagtgtcagtttatttcatttccattttccacttgttttcctaaaataacaacaaaatgcaattaaaatgtgtaaataatgctgcttacaacacctccatagctaagtgtggtataaataaaagtggtatggcactagcacattaaaaaaggaggcttgaaatatcaacatttaatgtaaaaaaagtacaagtacagtaatggaaagctgaatgtttaaagatttggaaactcttggaagcatgcttgtgttgctctaccgaattccaaaggcaaacagttttattttaataatttcgttagctgggcatggtgacatgtgtctgtagtcccaacaacttgggaggtggagacaggaggatcgcttgagcccaggaatttgaatccagcctgggcaacatagcaagaccctggatctgttttctgtacctatagttttctctatgataataacaaaataataataattttgttaatgttcagagcatgagtgagctccacctgacaactcttataatgtcaaatgatactgacgtcaacaaaacaacttagacaattcttgaaatttgcttatttatctgatacatttgttgagagtctattatgtgcaagtggtatcaagtaaaaaacccagtgcatatccttgaaccacttggagagaactggaggggatggaaaagcgagggatatctgttcacagcagagtgtcatgtgggaagaggacatgtccttgaaccacttggagcgaaccgtaggggatggaaaagtgagggacatctattcactgcagagtgtcatgtgaggagaggacaaggaacagggaggcacgggggttggatgagctctcttcctggttcttgaaaatgccacgaatgttggtggtagcaggaatggcaaagagcaccatgagtcagggacgtgtcatctccaaaaggtctagggcagagtatttccttcccaagaaaccagtgtcccataattcacctgctggaacccctgtgcacaaagggattgtgtgattaatgtagattttggtgtttcatattgtagcaacttaataaggtatgtgcccagcttctaaatgaaggctataatcacttttccatagtttatgaattatgaagttggattcccatcccaaatgctgtccaagttttttggcttcaaaaccaattaaaatgatgaatagctgtgaaaagaaccagaagtgcatttaatctttcttcagaacagttggggatcagttcttttttgtcacatttcacattagctgggaacataaacttggtcttgttcaaaggttcaaactacttcttcctgaaagagaaccgatctacttaactttttttttccccagctattataaacactgagatatttacaaagtgccttgtacttctttctgtttatctcccaaggtcacgacactctatttgcatcttctcttagcaatgttatcctaaaaagaatcatcaaagcaaagattaactgttacaagaaaaaacaaataagcgagaagattacttacaaatttcgggggttggtttattatggatgcaaaaatgagtagaaactcaagtccctgagtccacctttcatgacggtagtcctgattttgctatcatttaatacaacttaggtcttaatgttctcactcagtgctgagtgtgctgggataagcaaggtgttcacagtcttgtacatttttttctttactttttatcataaaaatgagctgcagatgtcatgcagtgcagagagaagagaatgctttctgagtcagaaggtcacattttttgtactcaaccacttctagctggaaaaccttgagcaaattacataatctcatggagactcagttttcttacctgtagaatgggggttataatatttaattctcaaaactgctgtggggctcacacaaaattaatttgtgctgaattacacatatttgtaatttatacataaaacttatatgtatatgtataatagcaacagacccctgatacagtatttattattcatatacctgtccttttgacagaaggaaaaaacatcatctaagatgtgttttagacaaagtttccaatcaatgatatttggacacaacagccccttcgatgaggtgactcagctatcagtgaactcatctttgctatttttagagctgaaaaaggagaagcaggtgatactgaagttgtgtaatcagtctcagggggagggctataaactagtgtctctgtctctctcaggacatctggactcaaaggtagtggcctcaacctcgccagccattcaaaggcaagcagaactctcacagaggaggcaagggcggagaagctttgagcatctctacaacatcagagaacacccagtcaaaagagagggaaacacaaattgacttgtacctcatcaccttgacaacacaaatttagactctggctgctacattatcttctggttccttttccggagctgctctccttgagctgatttacacggttgctattgtagacccttgactgtacacccagtctttgtggaactccaagaatcaggcttcaattgtactttgagccagctacactgggccccttcaaccctcagccttctctccaggcaagtccataactgcagctgtggtaagcccatctgcaggctgccctcttcctgtcctgagtcccggagggcatccctgtgtgatcactggccttaacctctcattaagctatcaaagctaccttccactgcttttcttaaacccacgtcttttctatttccttcaacttcaaattagccattgtttccacatcatcctctcatgacatgatagggaatgaagtgatgatggctcacagcactgctggggctgcttttacaagaagctcactcaaagtcaacttattttttttttttttgaaacagggtctcactgtgttgcccaagctaggatgatacagttgcacaatcatagcttgctgcagcctcaactcccaggttcaagagatcctcccgcctcagcctcctgagtagctgggactacaggtgcgtaccaccatgcctggttaatattttttatactttttgtagacatggagtcttgccatgttgcccaggctgagtcaaggtcagttttgtcaccatggggggcatagagagacctcagcagtgaaggcctctaggaaatgggagaaatccaaccaggctggaacaaggctgggagaatcggccagttctagggcagttgcctaagtagaatgggtcatgaattcgaatctgcttcaagcgatactcaggtcaaatttggacaatgaggccaagcaaagacttgagcacagaatcaaagcacacctagagttacctatgtgcatctccgtttttgctaaatccaaattacaccttactatactgttaacttttatttgtctatatcatttgttggaatccagaaaacatacattgtttctttccaggaaaaagtcaggtataaaaataagtgtgtgttgaaatataagcacattttaaaaagaaattagctcctattctcattcctgcagcttggcattgagtttgtctgtaattgggtgtgttttaaaattaaaaatttgaaataaacgttaagcagcaggagtcaaaaataattcagaccgtaatattcatcaaaacttgtttaatagcaggaaaccctccactctgaacttttactcttctttcttgcagaatcaatccctccagcagccctcaactaccagaagcacaaaaattcaatatatttttttttttgagatggagtctcactctgtcgcccaggctggagtgcagtggcatgatctcggctcactgcaacctccacctcctaggttcaagcaattctctgcttcagcctcccaagtagctgagattacaggtgcccgccaccatgcccagctgatttttgtatttttagtagagatggggtttcaccatcttggccaggctggtcttgaactcctgacctcatgatccacctgcctcggcctcccaaagtgctgggattacaagtgtgagccgccgcccccggccaaattcaataatattatgcttagtagtcacacactttctcttgttttcttttgttttctttggctcattagacctctccttcagaaccaaagaaatccattgtgacaactctgttctcagagctgactttttccatagagagaacttcagtctgagacatgccaaggagttcttgacgctcccaaaattaacacctttcaatctttactattagagattaacttgtttcaatgcccattctcttctgttaaagcagataatattgggaaaggcaatgtctgaatgtatttctgccaagatgtcgatggtttatcaaaatcaatttcttcctgtggaagagtttaggtgcaaggggaggagagaaagtgagagaagattataacagggaggctatggatgcagaaaggaaaagcggggaatcaaaggcaaacctgccacccatttcacaaataaaagaatcagtgtgggctggatgcagtgtctcatgcctgcaatcccaatactttaggaggccaaggtgggagggtcgcttgaggccaggaatttgagaccagcctgggcaacacagtgaaactctgtctttacaatttttttttaattagccaggcatgatggcacacgcctgtagtttcagctactctggagactgaggtgggaagatcacttgagcccaggagttggaggctgcagtgagggatgattgtgccactgcattctagcctgggttacagagtgagatcctgtctcaaaaaaaaaaaaaaaaaaaaaaatgcagattcagtcagtctgggctggggcctgagattctggatttctgacaagttctcaggtaatgtcagtgctgctagtacacagatcacattttaagccacaagaaggctaggatatgaggtatgaacaaaggtgttagctcagtggttctcaacctggactatacatcagaaccaccaaaagaggttctgttgggtttgttggaggtttgtttttttttttaagctcctgatgctcaagccccaccccagattaattaaatcagaatctaggaattgctcaagtatttgtatttctaaaagctctccaggtgattctcttgtgcagcttgagttaggaaccactgttagttgataactgaaggtgctattaaaaattccataatatatgagctcatgaaggctaatgagacaccccagctaagggcatcttcctctgcaacagcaatttgctattgtacaatgggggcaaacagttggtgctcaataaatttgttcaatgaaaaaaaataagtgattggctgaatgcatgaatgaatggaaatgtttgaagtcaacagtctatggaatgaaaaggattacagtcctattatcaaaatgacaagtggcaggatgggtattttaagacagatcatcttttccatcactctttcaaataccccatagaagtacttaaatcttggcccacttttaagcctgactttgttaataactggaggagtcaaagccacaaattttccacaccattactttattccagtgtttgccaaaccaaccaacagtcactatacacttttgctactggtgttattatttacctagtatgtttctttaaattgacttactttttaacataaacaaatgtattttaaagggaaactataaatcactatttcaaatagaaaagcaactaatattccatgacatcagtagaattgacagtcaaaataaatgcaacgtaagcaactgaagcagggtgtttctgcctgccaatgcttgcctctgtcagataagaagaaggattaacaagtatacggaggtgttaaagccatgggggcacttagcagagactttgtcactggcataataaggattgcaggagcgttttgcaaggagccacagtcctgccgtgcgatgccatgttatttaacatgaaaagcaggcaccacgtgtaagcatctcatggcattttcagtcaatgattgtcaagctgtactcagaaacccaggggccaccaggtagtgttgaagaggctctagaaaaaagaggaagtatttcagattctgaggaattcagtcgtcagtgttatttgtcttatagagagtatgatttttttttaaatcctatttctataaggaacaacataatcaacagagaacaaagaaacaggttgaaccctgccattgaaatcaggagaattaaccttctcattggaggcatatttgctggtttaggcctcaaaggcattacatcaaccttggatgagacaatttactaaataaaaccatgttattaaaaaaatgaatggaccatacaaaataatatatttcatgtgctcccctagctctttagtgaagtatggccctctgtgggaggttaaattattagctaaatgtatatacttggatttaaacagaatgatccactgatgttctaggaagtaaatgcactaacttattcttttttatttgccaggtatttgcttttcttttaaataatgcatgcagtagaatatgattaatataattctgatgcagaaaagcaagattgcacacttaggagagaggtctctggagccagactgcctggtctaaatccctgctctgcccttcatcatctgtgtgaccttgggcaaagtattcaacctctctgtgcctacactgccctgcttataggatgaggatgacaataagggtattacccacataaggacatcataaggatgagtaatgcatacaaaatatctaagagtcccctatacaaaatacgcactccatatgtgctacctgatatcattacagtaaaaaaaaattacacaaaatgtaatttttactaattttaattacaaaatgtaattaaaactaagtcttccttccaccctagaccccacgcctctccccaggcaaagtactgtaaaaagacccttgtgcttcttctcagaactactctatacttaccatcaagtccatccctctcttctgtgcaaatgggagcccactatccactctattctacatattgccttttttgcttaacaacatttcttgggaatgagttcattgctagtttcatacctcattctttgccagagctgcagagttttgcatcatatgggtgcaccagaatttctttaactcatccccagtgttggagatttaggttgtttctaatatttcactattacagtcactgccagaatgaatatatttaaatatacatctttcattcatatggaagaatatctttagggtagagtcttagaggtggaattgctgggtcaaacagtccattcatgtttattttgatagatattgccaaatttctcttcaaagagattgtgccaacttccataccaaccaaccacatacagaagcacctgtgtcccctcattctcaaaataatattttaaatacattaacaagatatacaaggtaatcaagttttttagtctgtttgagctgatataacaaaatatcttagactgagtaatttataagcaacagaaatctattggctacagttctggagaccagaattccaagaccaaggtgccagcagatgtggtgtctggtgaaggcctgttcctcatacacaaggacttcctgccacatcttcacatagtggaaatgttaaacaggctccctcaggcctcttttataagggcactaatcccgttcatgagggctccaccctcatgacctaattacctcccaaggaccccacctcttaatacaaacacacagggggttatatgtcaacatatgaattttggagggacaccaacattcagactatggcaccaaggaatgctattatatggaagcagttatcaaaagattgaaattacacatctgtgaaatgctaacatatgtcctttattaatgcatcaaataacaaaatctagtggcaggtaggggtgtgctgaaaagatactttttagcataccggcaacaaccctaatgtggaatgaagatacatgttgatgatatgctcacaggtactgctaataatactgttgtttgtacttcccattcgtaattgaaggaaatgcttgatttgaggtggtggctagtgcaaataacaatgtaaatttttccacccaagttttagagcctatcttggagccagctcttagagcctcattccaatgaatggcagcttatttttaatacatcaggtcagctccaggaatgtacgcttttagggaagctcttaaaattcatgtgtgggaatcagcctccatctagcctaatacatgcttcactggccttctaaaatagcaagccgagcaagaagacatagacaggcaaaggccactctaaagataccctccggaggtgtctgcctcggctgttacttagagcaactgtttgctccttcctgcaatacagctgcactcctccaccacagggttttggaaaatatcaattaaataatatattttaaacaactttgaaaaagataaaggcatctttttaatttggggcaccctattagccattaagaattaatgttattatctcctcatctgtttagtgtttagaacctctcccaagtctgctgataatggtggcaatgagggccaaaggatggagctgcttagctctggtaaatactggccaggcacagaggctcatgcctgtaatcccagcactttgggaggctgaggcaggcagatcacttgacgtctggagttcgagaccagcctggcctggccaacatggcaaaaccccgtctctactaaaaattagccaggcatggtggcacacctgtaatcccagctactcaggaggctgaggcaggagaatcacttgaaccctagggacagaggttgcagtgagctgagattatgcccccgcactcaagcctgggcaacagagcaagactctgtctcaaaaaaaaaaaaaaaaaggcatggtggctcatgcctgtaatcccagcactttgggaggccaaggcgggtggatcacgaggttaggagatcaagaccatcctggctaatatagtgaaccccgtctctactaaaagtacaaaaacaaaattagccaggcgtggtggtgggctcctgtagtcccagctactcgggaggctgaggcgggagaatggcatgaacctgggaggcggagcttgcagtgagccaagatcacgccactgcactccagcctgggcgacagagcgagactccgtctcaaaaaaaaaaagaaaagaaaagaagaaaagaaaacataaaatgtccagccacccaggacacaactgtgtggcctgaccgttcagttgtatcactcctcttatctggaaagtgctccagtgactacagaagttgctagaatttccaaaagcaagaagaaagtgatgggaaaatgtgtcaaatccacaatgggagaacactgtgtcactagaaaattatatgaccctggcaaccttaggagtatggaagaaagatttcaaacaagtttctgactatgtatctttttctaaatttttttgaatgctgaagaaatgttaaatttcattaagttttacagccagatttaatatagacataaatccctttaatgttcgtttcagtcaaaagtgagcggaacattatcgttaaaccagtgcatgtgggagaattacttgaggaaaatcaaaataggcacagttgggaacattaagccgtggccatattagacgcaagtaggcgcaatagcaaaattctttaggctctaatggactgggctattttgcttctcagtttccatacagatgagctttgttctggggcaatatggttgcagtttgagagtctatctgaaggagctcatttctctttcattagtccatgagcacagtgcaatttcagctaatactgttacacagctcctagctgggttatttggttaaatgccttcagggaaagtagcaagacagaataaaaggacaaatgcaatgcggtttcttgttctgagttcctgtagctgtggaattacattggcagttaatcattaccacgttgtactcgtgatcataaactcctgttatttaagatgttattcaagtctcacaagaaacatcttgtcttctgtggcacaatttccttgaggtcgggtttgtgcacaactataaccatagagacctgtttcttgtgcttcgtggacatgctagtaggtatatagtgccatttgtgtgaaattgaaaatgacattccctactggtgggtgaactgggaaacagcaccctgtctatgggcaaattagaaaagatgtccccttctgggtggacaaatgagcaaaaggcagcccctctgggctgaccaattcttttttaaagcctcctccaccttggggtgtgggggtggtgcacatggcttggtaagtccaatgcagaccctagttgctccctgtgggcaggaacccctggcgcaatgcacaacctgcacaactgtacacaacagccctgattacagaatccattttcacaattttgtagttggaccacagagtttgcccctcagtactctaaaaatatctgttcaatcacatcagtggatgtccatattaaatacattggtcttctttcttatggcaagtaactgccactctctgccaagggcagtgttctaaccttggaaacaaacaggacactcgtaggttgagaaacagaagaactagaggacggtgactcctaggggcttgaccagtggtgggcagtggagtggtggaaaccacggtggcacctcttcaccatcgcaatgtaatgctctcctcagcctccatcattacctggtgagctggggctcagtatctgcctgataacccaccttcagctagcatgagacacaggaggagcaagcttcaaactcccaacaaggtagtcagcctagttcataccagattcagtggctgtagcccaggagagaacgaggtatggggcacgtatgtctcagagcagagagatctgcctagaaagacaaagactgagtgagaagctatagtgtgggctatcagagggcagcctgggagcccaagaggcctcggacattggtcagggattggcaaactctttccgataaaaggccactttgtaaatactttaggctttgtggggttttgtcacaacgacttatctctgctgttagagtgcaaaagcagcgactggcaattcataaacaaatggatgtggctgtgttccgatacaactttacttacaaaaacaggccatgggctgatttagctggtgggccatattttgtgacctttgctgtcggtgatcaaagaaagaggacacaacaggagaagtcaggtgaggcattgcccatactgcgtggggcaacgtgcttgccagcttacattccttgtttcattttatcctcacagcaaccaactagtaacagttttaccacctacattttgaagatgaggaaactacagtttctaaaaaataggaaaatttccagggtcaaaaacagcctcatttcaaaaccaagtctgtttgacttgaatgtctctcttccttcccctacatcaagctggtacctgcagacgtatttgtctagggcagcccagccagggaagcccattgatcacagaggcattaaattccagatttgaaggtatggatggcagtgccagggccaggtgcaatctcaggagcctcagaagcttctctgtggatgtaaaagcaatgggcacagccaccattgactgcaggagctctcacctctctcatcaccagccattcagatagacaagccccaaatccgaaaggtgtcatctgtgggcctgcgtctttgatagccaggcaattacagcacctcatatataaaaagccagaggaatctgtgaatataataagtgactgtcctttcttagcgtggtgcaggccatctgtttgaaaagtacacactgcaaacaatgccaagttgtaattattaaactttctagctaagagcgagtctcatctttcttcctaattatgcattcaaatattcagaaattaagccttagaattattatataccagggatgggtttttttcccctgtgcattaaacttttagaagagaacatgagccatcatcagaagtttctcccagaaataactcccagagaagccctgaggtcagcttggaatcaacccaaccttctcactttcggtgtgatggtacaatgataattcaagttcttaatgatgactctgaatcatctcgatcctgaatcatcagagattaaattattttcaccaaacagctagtattttctaaagcaggaaaatcgattaaaggatttcagtaaaaagttagagaagtccaaacaaagcaagcatctggcaagcctcggtgaccagaacattaaattcaccaaacaccacctgctccaaatgtccatgttaatggcaattatagaagactccagtagcattcaaggccagtttaacttattcctgtacacaaataactttatgggagacagcattgtaattcaaatcaataaatgactcggtttggctgtacaagcataaacagaacgcttgcaaaatatggttcctccttgctagaaaccatttgatttttagccagaaaacatacagccaaacaagaataacaactgtttgccttccttaatgttcagtgtagactgttacccaaggaattaagcattagtcatcaaaacttcattgcaaaggcaacaaaataattggggttcctgagttatcatccatttcaacattcagaggccaatttgaccccagacaatacaaggtctttcttcttgttataaaagtggttgcagagttctgagggttctctgctgtaagctctgctctcagaactctccaggtcctgcttccaacccctgccatgtccggccaaactattttcccagagtcaggagcagagccaacagcctcactcagacagaccccagtgataattatcagcccaaaagataagcccaagtggaaagtttgagaagccagtcactcaggcagcagctacaaagggacaaacactctctagttttccctcactgacttcatttccctctgccagcctggtagaaacatggtctcagtccgctcaggttttgcccctgtcctccctgtctccagaagcgccctcaagcttcaaaagattcatacagccttccagagagggagacggggacctagtgctggttttcatcatctgtccactctggcttctgcagtaacaccattcccattggcctcggtggtcagttcacccagatcctgcctaaaccctggatgcttattgtcctgaccacccgaatgtcctaggccagctagttctcagcgtcacatcctcaccaacctccgctccctgctctccactggggatcaagggaatgcaggatggagctgccccaagcctgtagctcagatgcctcacaggggcatttctgatctgcaacactatgtccctgttgtgagctgagtcccaggcctctctgaggttggacatcccagcgtgcctcttcccactccaacagcacacctcagaaggaagaggcagcctcaggggcccgctgagtggccactcgtgctggatttccacccacctcaccttagggaattttaattttttctaaagagaaacaaaccagattgggcagatactcttccaaatctactgcttaagtttcaatctcagctttgaagcccagaaaaaaaagtattaacttgtgtttctctcgatattcctaccccactaactatacctaagaatgctgttatctctgaaaaattcagaggttaggagaacagaacacccttggggaagacaagttactatttcaaaatagtatctctgaaaaaaacagaaatccaaatatcgcatgggaagtcagtgggagaaaggccaaatctgagagggtctcccaggaacacggattgcgggccagatacagaattaaacttttaaagtgaatgaaagcaatctggggtctaagtggggaaggagtcgaaaaactggcaacttgccagtagttatggtcagtggagacgagaagacttcctcctctctgaaagccaagtgttgaatgaagacctagatcctggaataaaggatcaacatgcttaagactccaggcaaattactgggccaaatttcagggtgactcctgcccaagtacagcatttatttaaataaattagcattacaactctgattattacaactactggtgattttgtcacctaaacaataaaacaaaaattaatggaattagtggagttgctcttaaaaacattatgccaccacattaggcttacaaactcaagtgtgtcacaaaacttgtgtgttatcttatgataaagcacagttcctaaatatgtctcaggacccataacatcaagaaatgccaaagctggaatgtgcctctaacccagtgtttcctggcccagtgtatactgtgaaccaagaagccatctggggtcttcatttcagacccccaaaacaaaggagaggagaatgagatgaggaaaaaggaacttgagagagagcagcttctccaagcaagcagagaagggaatggggaaggaatgggttattcactaaacaatggtggatcatctcccattacagaccagaataaaaggcaaaccaactaaagacctaaatgttaaagaaaaaaaaaacccacaaaattgcttagacagttttagtggctacataattattttatgtggggaaagattctcagtgggaaaaaggaaggtgctggatgacagagaatagtacacttttgaccatatgctgtagggcataagagttcatacagatacttattgaagtttgtaatggtacatttctttgtttgatctttcgattgatgtctgttcccgcaactaggctataagttacataagggcagggatgccaccattgtattcccgtacttagcaaagtctctgacatatattggactcttaatgatatttgttgagtgaataaataaggtcaattgtggacaacgtcagggccttgggcatggggtttaaaacccataaggggaaaggaaaccagcctatgctagtctgaaggaagaagctggttgtgagctttctgtgtaaagcaaggaaactctagaggccatctcacttgtgatgtgagaactagaacatctggccatctgtccaaggaaggattaaggaagcttaccctacatcttgggttccaggtgaaatccattaaccacaagggctacatcaacttgaaaggaagacagtcctggagaacacagggcttacatttgctaaccccttgaaggcttgaaataggatgaaatggggaagcctgaaagagaatatcaagagaggatggaaaaccccaaagacatgctttggctccaacacaattttgtgaggtttggtccagtgcagcacactaatccagcactccagggaggactagaaatgtttaaagtctcccagcgctttccctttactgcgcctctggctgtacggacctaatgagatgccttgtgtttttcagaatgccgaagcaagttacgacttcagcagcaacgacccctatccttaccctcggtacacagatgactggtttaacaggtaaactgggccttgggaggtctctttgactttaggctttggggttttattctactttgttttgtttcaggcttgactaccaccagcaaaataatccccatgcttcattaaattatattgtgatttttcttcttagtggttacattctctaaagtgaaatttttaatattacaatcttcctctagaataatcttttgactgttttgttctgctaacttgaaattatttgctactttaatccattaaagagaaaagaaaatagaaataagaagttctttctcaacccattacaaggtgatttaaaacatgctgattttgctttatgtgttgaaactgtcgtagagaagtattttgccccatgggtctatgtgtttttgaaaagcattctgtacgctttctgctataaccccataacagctcatggagtccctttcaacaaaacagtaagtgtgattggcagaggtttgaagtattgcttgggacaaagatcctatgatgtcaaactacccaaacagtccatccaagagaataattttccttcagcttgttttgccactaaacatggaaatgtggtctcttttttcttcaagtaaacatttttcttaaatggttaattacatataagagatatgaagaaataaagatgtgcggtttgctcaatgaaagaatactgtaatttttaaacctagtgtttccctgttattgacgtccttgggtgaagttcataaaaacatatgaacttcaattagttgtataaaaatatatgatgtgcagagcactttatccatttttttttttatttctcatggcactctaagtagcacataaaacaaatgttgtcatttttagtttagtgataaggaaacaggctcagaagggttgaagggcttccttggtcaaacagttaaaattcaagtcaaagccaagattagccccatgcttcaaattatttccaaatccacatttgtactattctttgctgagtatcatttctattatttgatacaggcagcatgatgaccagaatatgttcaagggtagagcctcagtggacaggaagcttagattctgtctctaaagttagcaagttgacctgagacccctcagtctcatcaagggttgacacagggtacacaggttctgagtacaaatgcagaaaataagaaaaaagaaaatgaaatttaattttgtaatattttgtaaagatcattgctgatgtcggatagcacaattcattctctatccacatcacctgcaacctgaaaatgacatacaatgcttggaggtgtgtgtttagaggatgagaatgtataaaaaaggtctgaaaacttttggcatgaagtgtgttttatctctgtgacttctaaccctagatggtagcatatatttagcaaataaaccatttcagacacaagaatgtgaagttaccaaatgtgtgccattaagctggggtttagacagaattggcagtggccatccagggcacagtgctgagaagggccatgagagggtctggcttcagcaggattgattaccagctctccgcatgaatatcagaaagtgcagtggcaacatatccactggctacttgctgtctttctgtaactagtaggtactaaattagtctttgatggattgatgtaagcacaaaaatataaccaatggaaagattatcccccaatctcattttctgaacccaaacaaaatctaccctagtcaaatcttcctgggcaatgtgctataaaaatactccttaaaaaaactaaaaggttccactccaagatggccaaataggaacagctctggtctgcagctcccagcatgatcgacgcagaagatgggcaatttctgcatttccaactgaggtatctggttcatctcattgggactagttggacagtgggtgcaaggggtcggaggatttccctttcctagccaaaggaagccgtgacagactgtacctggaaaaatgggacacttctgcccaaatactgtgcttttcccatggtcttagcaaacagcagaccaggagattctctcccatgtctgggttggcaggtcccacgcccatggagctttgctcactgctagtgcagcagtctgagattgatctgcaaggcagcagcctgatggagggaggctgagacttgagtaggtaaaaaaaagtggccaggaagctcagactgggcagagcccaccacagctcagcaaggtctactgcctctatagactccacctctgtgggcagggcatagctggaaaaaaggagcagaagcttctgcagacttaaacgcccctgtctgacagatctgaagagggcagtggttctcccagcatggcatttgagctctgagaatggacagactgcctcctcaagtgggtcccttacccccatgtagcctaactaggagacacctcccagtaggggccaacagacagctcacaaaggtgggtgcccctctaggacaaagcttcaagaggaaagatcaggcagcaatatttgctgttctgcaatatttgctgttctgcagcctctgctggtgatacccaggcaaacagggtctggagtgggcctccaacagcctgcagctgagggacctgactgttagaaggaaaactaacaaacagaaaggaatagcatcaacatcaacaaaaaggacatccacacgaaaaccccatttgtagatcaccaacatcaaagaccaaaggtagataaaaccacaaatatggggagaaaccagagcagaaaagctgaaaattctaaaaaacgagtgcctcttctcctccaaaggaccgcagctcctcgacagcaacagaacaaagctggatggaaaatgactttgatgagttgacagaagtaggcttcagaagctcagtaataacaaacttgtccaagctaaaggagcatattctaacccattgcaaggaagctaaaaaccttgaaaaaaggttagatgaatggctaaccagaataaacagtgtagagaagactttaaatgacctgatggagctgaaaaccatggcacgagaacttcgtgacgcatgcaaaagcttcaatagccgatttgatcaagtggaagaaagggtaacagtgattgaagatcaaattaatgaaataaagtgagaagacaaggttagagaaaaaagagtaaaaagaaatgaaaaaaccctccaagaaatatgggactatgtgaaaagatcaaatctacgtttgattagtgtacttgaaactgacagggagaatggaaccaagttggaaaacactcttcaggatattatccaggagaacttccccaacctagcaaggcaggccaacattcagattcaggaaatacagagaacaccacaaagatactcctcaagaagaggaactccaagacacatacttgtcagattcaccaaagttgaaatgaaggaaaaaatgttaagggtagccagagagaaaggtcgggttacccacaaagggaagcccatcagactaacagcagatctctcagcagaaaccctacaagccagaggagagtggggaccaatattcaacattcttaaagaaaagaattttcaacccagaatttcatatccagccaaactaagcttcataagtgaaggagaaataaaatcctttacagacaagcaaatgctgagagattttgtcaccaccaggcctgccttacaagagctcctgaaggaagcactaaacatggaaaggaacaaccagtaccagccactgcaaaaacaccccaaattgcaaagaccatcaatgctaggaagaaactgcatcaactaacgggcaaaataaccagctaacatcataatgacagaatcaaattcacacataacaatattaaccttaaatgtaaatgggctaaatgccccaattaaaagacacagacaggcaaattggataaagagtcaagacccatcagtgtgctgtattcaggagacccatctcacgtgcggagacacatataggctcaaaattaagggatggaggaagatctaccaagcaaatggaaaacaaaaaaaacacaagggttgcaattctagtctctgataaaacagactttaaaccaacaaagatcaaaagagacaaagaagaccattacataatggtaaagggatcaattcaacaagaagagctaactatcctaaatatatatgcacccaatacaggagcacccagattcataaagcaagtccttagagacctacaaagagacttagagtcccacacaataataaggggagactttaacaccccactgtcaatattagacagatcaacgagacagaaggttaacaaggatatccaggcttgaactcagctctggaccaagtggacctaatagacatctacagaattctccaccccaaatcaacagaatatacattcttctcagcatcacatcgcacttattccaaaattgaccgcataattggaagtaaagcactcctcagcaaatgtaaaagaaaagaaatcacaacaaactgtctctcagaccacagtgcaatcaaattagaactcaggattaagaaactcactcaaaaccacacaactacatggaaactgaacaacctgctcctgaatgactactgggtacataacgaaatgaaggcagaaataaagacattctttgaaaccaatgagaacaaagacaaaacataccagaatctctgggacacatttaaagcaatgtgtagagggaaatttatagcactaaatgcccacaagagaaagcaggaaagatctaaaatcgacaccctaacatcacaattaaaagaactagagaagcgacagtgaacaaattcaaaagctagcagaaggcaagaaataactaagatcagagcagaactgaaggagctagagacacaaaaaacccttcaaaaaaaatcgatgaatccaggagctggttttttgaaaagatcaacaaaagtgatagatcactagcaagactaataaagatgaaaagagagaaaaatcaaatagacgcattcaaaaatgataaaggggatatcaccaccgatcccacagaaatacaaactaccatcagagaatactataaacacctctacacaaataaactagaaaatctagaagaaatggataaattcctgaacacaaacaccctcccaagactaaaccaggaagaagttgaatctctgaatagaccaataacaggctctgaaattgaggcaataattaatagcctaccaaccaaaaaaagtccaggaccagacggattcacagccaaattctaccagaggtacaaagaggagcggttaccgttccttgtgaaactattccagtcaacagaaaaagagggaatcctccctaactcattttatgaggccagcatcatcctgataccaaagcctggcagagacacaacaaaaaaagagaattttagaccaatgtccctgatgaacattgatgcaaaaatcctcaataaaatactggcaaaccaaatccagcagcacatcaaaaagcttatccgccacgatcaagtcagcttcatccctggaatgcaaggctggttcaacatatgcaaatcagtaaacgtaatccatcacataaacagaaccaatgacaaaaaccacatgattatctcaacagatgcagaaaaggcctttgacaaaattcaacagcccttcatgctaaaaactctcaataaactagatattgatgaaatgtatctcaaaataataagagctatttatgacaaaaccacagccaatatcatactgaatgggcaaaaactggaagcattccctttgaaaaccagcacaagacgaggatgccctctgtcaccactcctattcaacatagtgttggaagttctggccagggcaatcaggcaagagaaagaaataacggtattcaaataggaaaaaaggaagtcaaattgtccctgtttgcagatgacatgattgtatatctagaaaaccccatcgtctcagcccaaaatctccttaagctgagaagcaacttcagcaaagtctcaggatacaaaaatcaatgtgcaaaaatcacaagcatttctatacaccaataacagacaaacagaaagtcaaatcataagtgaactcccattcacaattgctacaaagagaataaaatacctaggaatccaacttacaagggatgtgaaggacctcttcaaggagaacaataaactgctgctcaacaaaagaggacacaaacaaatggaagaacattccatgctcatggataggaagaatgaatatcatggaaatggccatactgcccaaggtaatttgtagattcaatgccatccccatcaagctaccaatgactttcttcacagaattggaaaaaaactactttaaagttcatattgaaccaaaaaagagcccgcattgccaaaacaatcctatgccaaaagaacaaagctggaggcatcacgctacctgacttcaaaccataatacaaggctacagtaaccaaaacagcatggcactggtaccaaaacagatatatagaacagaacagaggcctcagaaataacaccacacatctacaactgcctgatctttgacaaacctgacaaacacaataaatggggaaaggattccctatttaataaatggtgctggcaaaactggctagccacatgtagaaagctgaaactcgatcccttccttataccttatacaaaaattaattcaagatggattaaagacttaaatgttagacctaaaaccatcaaaaccctagaagaaaacctaggcaataccactcaggacataggcatggacaaggacttcatgactaaaacaccaaaagcaatggcaacaaaagccaaaatagacaaatgggatctaattaaacttaagagcttctgcacggcagaagaaactaccatcagagtgaacaggcagcctgcagaatgggagaaaatttttgcaatctacccatctgacaaagggctaatatccagaatctacaaagaacttaaacaaatttacaagaaaaagacaaccccatcaaaaagtgggtgaaggatatgaacagacacttctcaaaagaagacatttatgcagccaacagacacatgaaaaaatgctcatcatcattggtcatcagagaaatgcaaatcaaaaccacaatgagataccatctcacaccagttagaatggtgatcattaaaaagtcaggaaacaacaaatgctggagaggatgtggagaaataggaacgcttttgcactgttggtgggagtgtaaattggttcaaccattgtggaagacagtatggtgattcctcaaggatctagaactagaaatatcatttgacccagcaatccaactactggatatatacccaaaggattataaatcatgctactataaaaacacatgcacacatatgtttattgtggcactattgacaatagcaaagacttggaaccaacccaaatgtccatcaatgatagactggattaagaaaatgtggcacatatacatcacagaatactgtgcagccataaaaaaggatgagttcatgtccttttcagggacatggatgaagctggaaatcatcattctcagcacaccatcacaaggacagaaaaccaaacactgcatgttctcactcataggtgggaattgaacaatgagaacacttggacacagggcggggaacatcacacaccagggcctgtcagggggtgtggcagactgggggaggggtagcattaggagaaatacctcatgtaaatgacaagttggtgggtgcagcaaatcaacatggcacatgtatacctatgtaacaaacctgcacgttgtgcacgtgtaccctagaacttaaagtataaaaaaaagaaaatttaagaaaaactaaaaacactaaggaaatgtcttctctcttaaatatttcatttgcaaacttgttctcaaaattataattttaaaccagctaaaaacctccaattaggactaattagtgcttagggcaataaaactcatcattgtcagcggtaagaattcccaagtgtccaattacccaagacacagtcatagtgactcaggcaagcatgatccccatgccttagggagccaatgattaagacagagtgtccactttgaccagtaaatgggttcttttcaattatcaagtcattttcaaagatcctcacgcactatggcttgttattacaaagactggatgatgccaccactcaaatcgcagctactttcaaacataactaccattgtaaatgattatgggaggctggtgaggtgaagctcaagtccacagaaccaagaaaatccttagttcaaaacatcaccattaccctgaagatgattcctgcttgagtgaaggagaatttgaataaagcgtcccttccatgagtgtacgatatgtttatttcaaaacccctctgggatgaaatgatattatgcctgatgttttcttcagtattacttatggcttgtggcaggagggaagagaatgactgaagtatagaggcaataaaattggttatgggttaatcattgttaaagctctgtgatgagtacatgggattttactctatttttgtatgtttttgatttttttctaataacaagaagtaaatttaactagcatacggcataaaaagaggtaataacaaaactaggacttcagtttggtatcatgaaactgttttggtgtgcaagcttccaaggagcttgcaatgtcaaatgattgggcaacagatgcccaagttactacaatgcaaaaatgtagcccagactaaaataacacaaggacagctaatgcaagttgaacagttactgtatttaaggcactgttctgtgttttgcatgtattcattcaactaattctcgtagtaaccctctgaaataggtattatgattttccccttttggaaactgaggcacagagaggttaagttacttgtgcaaggttacagggctaataagaagtggaggcaggatttgatgccagtgggtcattggtctaggattttatctaaggcaataggtagagttgggagtagggaacgaatgtatcccagggcaaggatataatctggacaaagataggctggcggggaggtgcaggatatgttcaggaggtggtctggataactgctgtgggatttggaggctggtgcaggaggcagcattctaagaaggatccgcaagtgaggtggagcataaaagggttgaaaaagttgctaggagaaagaaataaattctgtggttgggtcagaaactgggccaggggcatagatgaggctcattctctcattacactcaagataatgctgctactctcagaagccccaatagcctggagcctggcacttgttgttggctggcataggacccagcatgagcctcccaccagctgtgcagacaccaaggcatcccacaggttcttcaggtgttttctgggcataggcaccaaatccgatgccccatctctgttcagcagagttggggctcttgagaaaggctggtgtcagcatgccctgaaactccagtatagggctgacatgctgagcagcgataggcttgttgctattaactattccagccacactgactgccacaaaggctagttacaatgcaggagcaattgcttcacaggaaaaggcagcggctgtccagcacgagattctcactgctgtgaaaatagaaaataaaatgcactataggggacactcaaagaagtaaaatgttccccttggttgggagactgagttcaatagcaacacatctctcctaggttttcctgacactttaaaccatcatctcataccctctgcatttactcattgttttcctttattaaactccacgccaagggtgctttaggaaaacaaacttcatacatatgcagaactgcttttagggaatgtgtatattagaatagcttgccttgtgctcgatttgcttttgttggattattcctgtttaagcagagcaagcgtatttattctactgtgaaccatttaataattacatgcagtatctgagctccagggatgtacttgaaatacagttaagacattttcaaaaagagtataattttctcttagcttgcaatgagcaaaatacatttgaccaaacaaaataataataatagtaactcaaattgtaaaaaggtagaaaatacacatttaatcagcatcagtaatgtgcaaaacagatataactgatttgctgagagctatcaggatttagcatcacattttttcccttgctggcactcaaaaaatattgactgactggttgatagatgagtggcatacctttcaaccatgccaagatgttgagtggccttgacatctgtccattgtcaagctgcctgctgctctcaaggtctgcagcccacgttttgtcaataatcttgcagccctgctcattttaggtcaatgtttggtgatgcattgcagatctgtattccattactgtgctgttgtccataaaaatctctcttgcatagcatttctttgacaggtgttcactactgaaatgtcatccctgccattgacgatatttatgaagcattggggacgcagcatactctatctattaaaccctaaacagtgagagattctaggttagatgcaattcttggctgcagaaagtttactataaattcaggaagagagaagacatttattactcaagcaaacaaaatggagggaaggaagatggataaatggaggctgaagaacatttatctctttgtgagccaatgtgattgatagcattagttaaaccttcaaataagaaaggttttctgggattaacttttattttcttattaaaagtcatacttcattctgaagaaccccaagcaacaggccacaaaaaagtgtgagaaaaaaggccctctctggttggctattttcacactgatgtaagctgataccttaccctggtgatacttaatggtttgggagtagatgaacatctttcccttatgtctttatgaactaattctgaaacacctcctggataataaaatgcaaactgttttcaaagacatagtctttttcatgtgagctttaagactacctcatcagtcgatattagctcaaaggttactgcttgtaaccaaccctttctacatccaaaccagagcacagtgaaatccaacagcatttaatttttaaatttctagtcccctacctggattagaaaagtatttattatttaaatttttccttcagctaaaaggagtagatgtaatatagatttaggggttatggagaaaattataaagatggtaaaagaaagacctatatttgggtataattagttctactttgtaagctaatgtgtacatgccatatagagattttatggtactcagacggcaatcaataactcttttcttaagagagagaaatacagcacattatgtagacaaatgtaatattatgttaattgcttggtatggaatgagtgatccctgaatcagttcccttatctataaacagggactaaagctcccaccttgaaggcttgtactgcggattcaagacaggtatagagtgcttggtacagagcatggcacatggtaagcactccctaaccgacaaccaatagagttgtgaaattcagcaaagagatttctacaggagctaagtcaaagattattcaacgacaaagaaaagtaggagaatttatgctacaggagtaaatgtagcattcacccacctttctcagacatctgctctctcatttaagcttttgacagaaactggataacagtcagctcaaggttaaactctctgtcaagattctagtgcctgtgtttctgcattgctgattgaaaaaggagttatagccaaagataccttgtatgcatgaaacaaagttgatctattaggaaatttgaaatgtctagcatctggcctcagaaagatgaggagtctgctcacttctccagaaagcaatgggtgcttgccagcagactcagggacttccccagaggcagctttgctcattctcacctgtcacctattctaacctattctgcctgagctattcatttctcatctattctatcaagtaggctcttgaaaccccaaagtcttaccctgtagagctcattggacattagccagcaaacgtggtcgacgccaaactagccaggaagtctctgcatttcagttctaatatgtctaacactggagcttctttctccaaagccaagggtgaaaagactgcagctggccaccatgggtcttctgttgtctaagaatctgtagatgcagagagactggagaccagaagacaaagacagcctcatgtgcatgaacttagccaagttgcacactggcttgctgactaatctgtcttatctccttatctctgtgaatgcagatccctgaaacactgttgtagaaactggttgtcagaaacagaactaaggagtcaattgaaacaatcataggaccagtagccaggaaaggaagagaggtaaaaaaaaaaaaaaaaaaaaaaaaaaaaaaagacgaaaaaatatctccacatcaaaattatcctaaaatccactattccaaaatgcctgaaaaaaatacacctaaaaaaactaaaaatcaggatattaatttgtactatatgaaatcggttctatgaagcagtcttgaaaaagactttatcataagttatttttagtttgttcagagtgataaatgcatgggtgacatacattttaaagaaaactaaatgatggtggaaacataggcaaaaacaaaagcatggacatgaaaagaaccaattgcagctgaaaaatacagcctgtggaataaaatctcaataaatggtataaaatctagcctggatgcacttgaggagttaattatcgaattgaagataacagcctgtttatcaaaaacctacagcaaacattattcttcatggtgaagctttgatagcattctctaagtctgacaagatgtgggttctccctatcatccctttaattcaacactatgctacatttcatagctgatcaaatagttataaatctaagaaaaggtgtgagatcattaagaagaaaattataaaatttacaaaagaataaaggagtcctaaataaatagagtggcatactaagctcagggataagaagatggaacaatataaagatatcatatcaaattaatatattaattcattgcaatttcaattaaagtttcaatagattattcagtggaactagacaaaattgttttaaaattgatatggaaaaacaagtggccaaaatagaagaagacaagtaaggaggaggaaaaaaggagaaaaaagaggaagagaatgaagataaagaagaagaagatgaggttgaagttcagcaacaacagaacaacagcaagatgggaagctttgccgaccggataccaaaacattacacaaccataataatatgagattgtagggttagcatacagagagacaaaaagatcaagaaacagaatagagagtgcaaaaacagacaccacataaaaggaaccctaatatatgattaagatagcaataaaaacaataaggaaatgatggagtgaaggtattcaataaatgtgataactatgcacatggggagaaataggcacccacaccacatactgagcataaataaattccaggagaatgaaagacctaaatggatataaatcttttaggaaaaaataaagaaaaacatctttatgatcatgacatagggactgatttcttcccttttctccccaattgatttagaagtttattttgccaaggttaagggtcatgacccatgacacagcctcaggaggtcctgagaacaggtgcccaaggtggttgagtcagagcttgattttatatgttttagggagacataagacattaatcaatacatgtgaagtagacattggcttggtctggaaaggcaggacatcttgaagcaggggcttccaggttataggtagattcaaagattttctgattggcaattggttgaattattacctaaagacctggaatcaatagaaaggtgtgtctgggttaagataagggtttgtggagaccagggttctttttatgtagatgaatctcctaagtggccactcttagaggcaatagatgacagatgattcctgttcagacctttaaaaggtgctagactctcagctaatctctccaggattggaaaaagatctggaaagggcagaggattctctacagaatgtaaattagggatggatttcttaagccactaaaccacatggaaaaataaatgattaataaagctggctacattaaaattaaacacttttgtacaaaaaaaaaagtcacaataaataaatttggaagacaagccacagactagaagacgtgcagcaaattttatggaaaaaaaggcttaatatagaaaatttgtaaagaacagctacaaatcaatgaaaaataaataaatacccttgtagaagaaatgggccaaggttattaacaggaaattcacagaaaagaaaatctaagccaaatagcctatgaaaagattaccttgctagtgatgaggaaatgcaaaatgaaacaataacataccatttcacaccaactggactagcaaaaatggtaacattcaacaatgatcaatgttgaaaaggattgagcaacaggattgctcacaccttgaaggaggtagtacatagccatataacctgttttaaatcctacaagaagacctcagagaaactattccttatgggtacatggaaataataaacaagaatgtttcttttcaaattatttgtaatagcaagcaaattgcaaacaaattaaatacctatcattagaagtataaataaataaatcacagcatatttataaatggactactacacagcactaaaaatggatgaactagaattcacaagttaacttcagaaaatgtagcaaatgaagccaattttacatagatcatacactaggaaattttatacagtttgaaacatgcaaagagtgacatgtatgcttatgcatacctgattataagttcataaaaatgttctgaacagcaaatttagtacacttgttacctctgaggaagcaaagaggggaaggaatggcatcagagagggcctcaaattgtatctgtaaagatttatgttgtttcttggcgcggagggggttgttttttgttttttgagacagagtctcactctgtcgcccaggctggagtgcagtggctccgtctcggctcactgtgacctccgcctctctggttcatgcgattctcctgcctcagcctcctgagtagctgagattacaggcacgcgccaccacgcctggctaatttttgtatttttagtagagacagggtttcaccatgttggtcaggctggtctcaaactcctgacctcgtgatctacccacctcagcctcccaaagtgctgggattacaggcgtgagccacagcgcccagccttttatttttatttgagacagtctcattctgtcacccaggctggagtgcagtggcgtaatcttggcacactgtaacctccgactcctaggttcaagcaattctcatgtctcagcctcccgagtagctagaactacagagacaggccaccatacctggctaatttttttgtgtttttagtagagacggggtttccaggctggtcttgaactcctgatctcaagcaatacgcccaccttggcctcccaaagtgctgggattacaggagtgagccaccacacccagcctataaagaattatgtttttctaaaaataatccaaagtaagaaaaatgtttggctttgatagacttggatggtggctatatgagagtcatcatactattcactgaaattgtctatatttttttaaatatttcataatttcacatatttaaataataagcctgagccaaaatggaaaccccaaagtgtcagacaggcccattcaccattaaaagacccacttctacacaccagcctcaaagtgcgcattaaataaacgaatgccaaaagtccatcatgcaccctgcacacacctagtgagagggtaggggaattcgaccactagacaaggcagccattttttttctgttcatcaaagactgctttgtactgatccttgtcacccaacatctctttttgtgggatccttcaaattagtttatgtcacttattattagaatttatccttccaaaacagtttatcgagtaggatctaataaaattataggaataatcaataggaataagattaaaatgtgctagttcatgttatcctagtagctgtaacaaataaatcttggccctgaaatattagtggcttagcggcttagcaccaaaagaagtgtatcactcacccaccagtccatctctgtgttcctggtggagcagctctcctctaagcagtgattaggggatgcagactcctttcatctttggcataggtttccaatgttcctgggcttttttgcatcaaactacttgaggggaaagagagtgaataattgcccaagggtaatttttatgggccaggttaacaaatagcatttacccatctgctcacatatttgccataactcagtcacatggccacatacaagtgcaagggaggatgggagccttactgcagcctggggagaaaagagaatgactggtgaccatttagcattttctgccaccaacaaaaaccatgttacagagtgagagacaatactgtaccagaatacctagttgaatggtgatatggtttgactctgtgtctccactgaaatctcatcttgaattgtaattgccataatccccatgtgtcaagggcaagaccaggtggaggtaactgaatcatggggtcagtttcccccatgcggttctcatgataatgagtgagtcttacaagatctgatggttttataagcatctggcatttcccctgctggcactcatttactccttcctgccaccctgtgaagaggtgccttccaccatgattttaagtttcctaaggcctcccaagcaatgctgaactgtaagtcaattaaccctctttcctttataaattacccagtctctggtatttcttcatagcagtgtgaaaacagactaatatgggtattagcaaatgactgaactaagaaaccagcaaaagcagatttaattacttagttactttttgttttagtcatggttctccagagaacagaaccagtaggatgtgtatacatataaaaagaggttcattataaggaattggctcacctaagtctggagactggcaagtccaaaatctgcagggtgagccagcaggctggagaccctgagagccaatggtccagcttgagtctgaaggtagcctgctatagaaccaggaagatccaacgttacaggtgaagtccaaagacagtcttccagagaattctctcttctcagagaaggccagatcttttgtctatttaaaccttcaagtgattggatgaggcccacgcacattatggaggacaagctgctctagtcaatgtccacaaattgaaatgtgagtctcatccaaaatacccttgcagcaacacctagaataatgtctgactgaatgtctggatacctcgtggcccagccatattgacaaatgaaattaaccgttacaattttaatctgcatgtttctaataggattacatgatagttaaagatcatggttaagagcagggctttggaagcagcagacctgagtttgaattcttgtcctgcctcctatttgagaagtgacttcacatctatctaagcttcagttttctcatctttaaaatggggataataataggctgttgtgaggatttaataggataatacatgtaactctctcagcacagggcccatctcatagtaggtgctggtaaaagaggttgttttattcatattgctggatatatctaacactattccctaagtgtagtacatatataaatacatgcttttggctggaaaaactaagtgagatgatcaaatcactctgatggaaaagccagcagtgtggatggaaaaggtgtgcctgttctttctctcaggaaatccacagggttgcgcacagggcctcaggttttcatttggacaccccagcagcccctcaatacaggctattcacaaaagccccaatacagtcaccctgacagtccagctgtgaaccctggctccccacacgtgagccatggtgtccctctagccttgttcattcattgtgtcagtaatctactgccatgataacgctgcataacaaattattccagaattcagtagcttgaaacaataagcattgattattgctcccaagtctatagtttggctggaaagttctattgatctggaccaggctaggcttgtcttggctgagctcacccttgtctccctggtcagctggcaggttgctgggggctgattggtttaggatgacctcactcacatgttgatggattactgttgactggggtgtcaggcattacaggttatgtgtctttcatcatccaataggctagcccgggcttactcacatggagcctagacagggtggcaagagaaagcagaaaagccacatggtctcctgaggcccaggctcatcacttctgccacattctttcagtcaaaataaatgacaagagaagtccagattcaaaagcccagggttgtgagaaggcttggtgttaggaacaatcgtaagaaacctctatttatggctgattgctaattagtgttgcctaatttagcaatgaaatgtttcttcccatatgttcctctggagagcccatggcattcctctcccccgcttaagggccaaaattaagatacagaagacttatttaatatctttactttgttcaagctggttcacatacacttgtcctccagcctttggtgaactgttttaggacagggacaggtttaacacaagggccgacctctgcagtgacactgggtttacatatctgggtacatgataggcgggtttcattcttgttccaaagagaattttgaggcatgaaatatgtagcctttatggaggcaggatttactttgactcatacagagaaagaaaatgtgtgtgtgtgtgtgtgtattttcaatccttgcatgtgatatttttaagggctggtgcgatagctttgcttgccccaagaggatgtcccagacagtgcactagttgatgctgcagaaatggaaaattcctagggatatgtagccaatgaaccccttcacccacatttcctgattgtttgccacaatttgaacagtgagtggaaagaccttgtgcattccgcaggccatactcgcactgtcccagcagacctgggaatgtgcccatttgattcagtagttgttccacccaccattaaaatggacttttctagccacactcagcagctcacagctgtaatcccagcaatgtgggaggcttagatgggaagatcgcttgagcccaggagtttgagaccagcctgggcaacatgggaaacccccttctctacaaaaaatacaaaaaattagccaggcgtggtgcacacacctgtggtcccagctactgaagaggctgaggcaagagaatcacctgagcccaggaagtcgaagctgcagtaagccaagattgcaccactgcattccagcctgggtgaccgaggagactctgtctcaaaaaaaaaaaaaaaaaaaaaaaaaaaaaaaagaataaataaatataaataaagtggacttttcatggttggatctggtagttccagatgatttgtaccattggaatcttttgcatcttgaatgctgtttgggtctgaaaacacagccttctcagtgattcagcttatacttgttttatttctctattgcggctttacaaaccaccccaaaatggggcgctttacagaaaactaaaagacaggtagataatggtttgctcagcactttaagtcttcacagaactttaacacaagggctgacctcttcagtgacacagggtttacttgtatatgatacgcagatttcatttttgttccaaagagaattttgagcccatgagagatctagccaaattcgtttcactgcatatctaatgtgtctttatatttttccaaagccacgggacccgatgtgcaggagaagtttctgctgccgccaacaacaatatctgtggagttggagtagcatacaactccaaggttgcaggtaagccatccctgccaaacagaggcccccactaggtatcacactgatctcaaggctgactgtggcccagcaaaaaatcccactggtgcagaaaagctaggatccacagatttggcacaagtgaaaaaaatttttttcttttaacctgcataacaatatcaatagttttaaatttttaatttaagcataatataaattcaaaaaagttaacaaatcataaataagctaatgacttttcccaaactggccatacccatacagtgatcaggaaacaaaatgtaaccagcaccccaaacatgtccccttccagttactactctgacacccaagaataatcatgatcttgttttttaacagcaaaaaaaaaatggttattgccagtttttgaaatttatataaatagaattgtcagtcactactcttctgtgtcagtgtcaataacattttaatgagtctcaaatatagactatagaatacaaggtggtgtgtataaattatttgtaaacatactcagagctcttcaaaatgttttgcacaatggaactcatctttaaaaagagaaattctgcctagaacctttttcttacatttcattgggtaggatatttaagaatttcctattgatggagcctttagaaataagagtggcaagtcactggaaatttagaacccaatatccctcccctctcagaaaaaaaaagagagagagacacagacagagacagagactgagagattcataagctttcaacgagatgtctgagaatggagtggcaccagtctttttccaagttttgcatcaaattgattcttaatttattcaggctgagtcacccaaccttgtttttcttttttcttttcttttttgtttacaactgtcctgatattttcttttcctggcaatttaatggaaccataaacctactttctgctgacactccatttccatggaactaaataaagcaaaggtaacctatacaaacccactattaacctcttttcaacactgtttgctaagaggcttgcctgaactgggtgctgaatgtcacaaaagaatacatctggaggtttctaaaatgtaaatagaggaggcttagcccctgggtttcagctctctttactttgtgcacatccaaaatgctggcattaaaatgtcaggagccattatgagctcaggggaaagaatatcactcggttaatattttataagccaggctcagacctgggatggaatctaagggaggcgggttctctactcacaggacagaactggaagcaactgaaaaattcaaacctgaatttcttgttcacacacccaaggtaactggtttttggaacaaagtaaaatgaccacctgcaaaagttaaaagagttagggggagctcacagctttctggaggttcctgggagcttctttttccatctccttcttttccttttttcctcttctcttattatttgcactctgaaaacacctgagcattgagtgctcatcaaatgtatctaattctcctgctgtcttagtttgctctgcctaaaagcaaaacctgagacaaggattccgggcaagcagttaatgtgggaggtggtccccggaagccagagtgagggagttggggaagaagacaggaaaggaatggaggccaacgaagtgagtctcatggacaacaggggccccgtcctgcaggtaattctctgaggaagtgtggagaacacccctcagaattgaccccgctaatgtgaggaggctgcggcattaatctgccagttcccatctttcattgttcgggggtgccgtcgggcctgtccagcctgcccagctcgcttgaactgagtggagctccttgagcagaggacacccccaggcaaaaagccagggagcaggccagaggacccggtgggtgcagcagcctctgcctcgcctgctgaatgcagcctgacacctcaaagacgcgactgggcttctgtgaagcccaatgacagctagggcatcacagcaacgttttgaggttccagaaaccaagaacagacatccaaagattttgagcaagggaggctcctttctttcttttcccactcccttagccccagcttggctcccctgtgaccacgtacgctggttctaactacaagggctgcgaggctccagtcccatgcctgtgccttagggaacccagtgtcctctggctccctggggcgtcagcatgaattcttgaggaagcactggggaattactcatggattacaaaaacagcagagtttatcttacaaatttaaggaaaacattttattcatcctggctggcaattccaaaagttggctggtttttaattatttgctaaaaatgagccaaaccctccagagaatctttccattcgggagctttctgggctaaggaggtctaaagcgccacctggtggccaactcggatcgttgctggtctcaaagtcgaggtgttcgttcgttacaggttaggggggcgcccctgtgatgtctgaggtccttccccagcacccctccacgctgtctccagaaaaagcccaaagttaaaatgtggttgaatcttaacccagggattcaaaaaagaagagtggagattgtaaattgagtcctctgaacagaagagagcattgagcatctctgcatctacctgagttcctcttctgttcataaatttttctcatttttccatcaaggctcctgtctttttcttgttgatttgtaggcattcttggtgtgtcccaaaggttagcccctaacccattttaatcaatgcaaagatcttctccttcatttctcttcgcgtccgtcttcatttcaaactccgtgacatgtagacccgcacatacgggatgtcccaaaagtcatcctgcagtcttcaagctttaataaccccaggaacattatttgaaagtttatttacatttccattttcactgatttaattgtataaattttgaagaaaaatattactttttttattttgaaaatgcctttattcaagtaactgtcttttttaaaaaggaccccattctttccttctttcttttttcattttaatttttaagtaaacaacatcttcaatcaaaaagattgagtcaaaaattaaaattaagtgtgttattcaaaatccacaaaaccaagcaaatgtaccacaaacaatgaccttccaaatgatggtttttgcaaatttgtcaaatgtatatttctgaaaatattaaagctcgagaccacatcaaggagtcgtaacactgtctcctgccttcaggccttttgtgtggtccatagttactgtgggcaccttcctgttgcaggggatggaagctggcggacaggtcccctgccccatatagctcacagtctaggaggagaaaaagacagggagcaaataaaaaaaaatcagataacaactcatgaaagaggacagagagtaaccagggctcagggacaagaggcgcctgagggtggggctctacagttcctcactgttctggatttctgcagagactctcagagcagccctaagagggggccaggccaggtgggtttggtcctattcaccttcctttttaaaccaaagcacacagatttacacaccgggcttcgggatgagatcacctttgattgaagattttgaaaaatatttaaaaaccacactgttgaccattgtgaaaatgccgtgaaatttctctaccagctatgaagtgctttcacatattattatcactattattattggccaatgaatctcataacactgcagataaacatattttatctgagcttttcaataaacaagtaaaaatcactgtaagtacaatgactaacatgagttttcagaacctaaaacctggatgagcatgaatttcctccttatcatccagagctaatattcatgagcacaaaaagtggcattgatgagcaccgaagtttgtgggcagatgtagtatttactggaggcagggacaggcacaccttgtgcaacaggagcagaggcagagagggtgcagctcaaatcccctggacatgcagcccccggggcaccagggctagccacagtgcatgctgcacaggcagacagagaaggctctaaatgaatggaagagacccacagagtcacctctactcattaatgtgctgtgcaggcctgcctggggtcagatagaaacacttgatgtgtgcctgtgtctgttcttgcccatcaaatacacatatcagcattgttagggatgtgaagacacagactcctagctcctttgatttctctctctctctctctctctctctctccccccacttccttccctcctcctcctcccccccttcctccctctctccctctctctcttcctcccctcctcctcccccccccttcctacttctctccctttcctctctctttccctctcctctccctctctctctaccttctctctcctacactctccctctctccctctcctctctccctgtcctctccctctctctctaccttctctctctctcctacactctccctctctccctctcctctctctctgtcctctccttctctctctaccttctctctctctcccactctctccttctcctctccctttctctctacctgttctccctctgcctctctctatcccattctctttgtctctctccctctatctacgctctctctctctctctctcccagtctgtctgcctctctccctctctctctccttctctccctctctctcactcggtctactctctgtctccaccccacattcccctgtagctcctagagcatccaggggcagaggagaggccttccctaaaaacccttgggtcacgctgagcctctgtcttggcttggtgcagttgcttgcaaaattaatactgtatctcattcaattaatgcatgcctcattcctcttgagcttaacaagattaaaagaatgtcgggtgcctggtccctgaatatgaatgagagacttgctctcagcctgtggccaccctataatgttaaaacagtcagaagattaatacacatccactctgaggttcttgcgcagcacagagggagcccatgaaggtgataagagctgcaaagaggaagagggttcaaggcacagctggaagtgccatgcaccagccctggcaaaatccagggctggcattcgttggtttgtggggcagcagaaacctgctttggccggggttgaatttctcaccttccagttgagtgggccattcagtcctggtcatcttggcactaggcaagttcaagagcatctgagcaagtgaacgccagcctctgtctatttcccacccacagagtgggcgtgactttgcacaagaagaagctgcactgaccagtttattctgtggttcattggtcacctgcattaaataaagtttttaaataaataaaaacataggtggaccaaaagcaaaatacagagtcttaaatttcctatctccttataaaatgaaccataaaatttaacatctggaaagttcaaaccaaagactaggcttattctagataatcttcctccaggagaaagaatgctaactgataactgggtgtttgttgtcaaaaatggtgattacacttatgggttaatagtagaagatggataagcagagcctgttattcattcttctggacctgttatttgtgttggggagaaaatcaactaaataaggtaataatgccagatatttattcaccaaatatttgtcaagcttaaaataaataccaagcatcatgttgatcctcaaggacatggaagtgaacaaaatagacacatgccctatactcaaagaccatgccatctggtggtatatgaaacacgcaaataagtagttgcgatagaaggttaaaggtacacaagaagagggctatgagcactgaagaggaaagtgagatcctcgagtctcctgaggactgaaagtagtagtccctcaggaaagaaagcaatttcatgtccatttcagctgcctggcaaggacctgggtggcttttaattcgattgacgtgctcgccatgttagagagtgaggcttgtgaaatagtgtccttcaggcacaacatcctttggccaccggggacaaggaaggagttttggggcccagattttgactgtgcatggcccaaccccttcattccataatcgcagtgggtggaaagactcaggtcagcttcactagcactctaagctccatgccacagaattgtgaacccactgacccatccagatgacaaagcctggagagaggcatgtgaccccgtcagcgaagttttgagggtagtgatggagagacagcacacccaacccaatggcggctactgagatccccctggagaggcctttgtggatggccaaacggggaccggaggcctaggagcaccagctctgcgggggcagcgccagcaccttcaccctgtgcccctgtgtcttaggattgtgtgtcccacactatcctggactgcaggactttgctccttcccaacattctgtgagaaatcactcccacgaggcatcagagaggaacacaaactttacagcgatgctatagggaagaaaggagaggcagccgtcagacacagaattactaatacagtttagaatagccatctctgcctttctgtcctctccgaagtccctctcagctacagtgcaaatgggagttcctctttcctgaccccacccgctcctgcactgcccctgcccctctctctgtcccctgccctctgccctctgcctgctggaatttctcctcaaatatcaaatattgattgcctcccccatctatcatatgtagtagctttatttctcccttaaaacttggctgcagccaacacccagttctctgaggccaagcttctacttagaaacgagcttatcaaagcatcgcttcagcaaaggtggtctctcccatcatgaattctagtaagttttgctaggggaataaaattgtctttaaatcattacatcagcaaagatgtgggtgggatgcagaaaggagccagtaggaccgtctgtgcctctttcttgatccctggactgcacagtggccccagagcacctgagatctccaaccattccaagtacccagggcccaagccctcctccacctccttgtctcctgcgaactggggaacccaaacatggtgtcctctgctcaacgtgtccacaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaaggtaagggggccggccccctaggccccggccactcacaagttgggacaaagtgggtggaggggtagatgcaactgggtgaaccactgtcaccctgtgtgtgagtccaggtcctgcaggaatcagacagcacaggggcttagccatgcaggaggctgactgcagggaggcctgtgatggataaggagagagggcagaaaagcctcagacgcgatgcctacctggctcctgcaaacgacagtgggaaggaaggggccgggggggggagggtctcagacagcagtccccacgccaaagctgcccatcacagacagaaaggggcctgcactggcacccccaccacccactcagtcgttggctggcagtagcacacaggattttgggtctcggcgcacacagggcggtagatccaggaggcagcagccaagactatgaccacaatgctcgtggggcagggggtctgagcatgcattctcacagctgctcctctgagattagcccaggcttggacagagctgaggagaaggaagctgggcagagcctccaaagggatgagatgcaggtcagtgctgcatagggaggggaagggggccccttctctgagacgctggggctggagccaccccagaggagacatgaccccaggctcagggaccagaggatttctgggctccagtctatcaggaagtgacttagcctcgcctgtaaaacggtgataatgaggggtcactatgatgtataaatgagataaagatgcaactgctcggcactgagaagtgcctgcaaagagtcagaatttgtcccagtctcgactgccgcttaagcaaccaccccaaaacttcatagcacagaacacaactcctttactacgcttgggatgctctgggtcaggaatttggaccgggcacactggggatggctcatccgtcctccatgattcctggggcctcagccgatagattcgttacttgagcatccattaccaaactgttgcgtcttcatgagctgttctgatgcatccatctacttgccacgcgtggcacagctcccacccctaggcttacgcagtcttctcaggcctgtcctggctgccaggccagcagttcccccccacccacaccgtgctcccagaggactctctgtaatcagcctggacgtgggactcacaccacaaggtcactgccgtgtgtggagtgagttgtctggtgttaagtgagggaaaggacagtgtgtgagattttgtgtgtggcttttggaactccattttgggaatgtttttaaatttgcttcttagattttggtaaatttcaaatagatgaaatggctatagaaaccagcactattataaatattttataaaatgcatctgctccacatacacatttaagttatgtacagtctgtttatggaaaatgcataaactcattacttatacattgataacactaaaataagtgaatgtacagaacgctatgtttaacgcaggcataaaaaagagaatattgaagaaaataagagtgggcaattgaaggctgcttttccatacatttcttgaggtcagaaaacatgtgttttcctgcccagaccatcctcaggaactggcccggggtttgagaacatagtggatgagctgttcagggggcaggtatggaattaatgcagacacgaaatggtacggttgagaggctgaaagtcacatcgaaatctatgactacaatggatgccattggtgcccaccaagatcccctttaccaggcctgggggccaccccagctgctgtgagtgttggctgctgatggctcacagtgggccctctcacgaagcattgccttgacgatggaatcttctctcccagaaagttatgccccccacacccagggcacagcccacagccgatgactaaggcaggagcctgtttgcctccaacagggaggagtcttcaatgcaatttatggtccagagccccctgtgggccaggccaagggaaagctttacccaagactacatagttttggagttccttcccctctgtatcttacttcacttccttgctcgcaggttgctcctgagagccctccctcaatgagtctggggcagccgaatctctgcctcaggctctgcttctagggaacacctcccacaaacactgcctcaaaatttaccccattaggtttccctttttcctttggctgccaggaagcttagaactaagtgtgtgcctattaccattggttttttagactaggttttcttctaccttttttttttcttttgagatagggtctcactgcatcacccaggctggagtgcagtggcacaatctcagctcactgcagcctcaacctcctgggctcaagtgattctcctgcctcagcctccagagtggctgggactacaggtgcatgataccatgcccagctaactttttgtagacatgtttcaccatgttgcccaggctagtttcaaactccgggactcaagagatcctcccaccttggcctcccgaggtgggattacaagcatgcaccactgcacccggcctcttccaccccatttttctccatctcttcaccactcacagcctccaaaatcatcccttagcttctgtccctgtgtccgtgtttgtattcctagtgagtctaagcctctgaatgctaggcaatgtaaaatttgtaaaagaattgatgaaatgagctcagtctgattagattatatttagccatgagaaatctaactttggatccttactaaattgttgcttgcttacacacattcctagtcttaccagactaaagcatctcactggacaaaaattggcaagttcacatgtaacttcctcagagtctcagccctaaacaatagtaaacaatatttcaaaccaagtggaacccttcagcgcagtgggtggccaactttggtacacaggctggatctaacccccagacttgctttgcaaagacagtttccttgggacacagccaggcccttccaggtctttgtgacattctgggcacctccaaccacagctgtcacgggtcccaggggaaggaagcacatagggcaccaaatgaaggggctcatctctcagaatcaggcttttctggatgctggtcaacgtctctgtcttcactagagagccgacactgcacagcagcaggtccgtcctgttgcagggatatttcagcaggtggagagctcttgacagtggagagacctgagttttaacctcagtcctgccccccattggctggggaacttcagactagtcgatgtctccattcctcactttttgcaaaatggtctgagtcagtgcttctcaaagtgtggccacagcccacctgggagagtgaaaaatgcaaaacctcagcgcctcctcccctcccacagatgccgcattttaacaagatcccattaaagtttgcaaggtgttgctctacgtgatcttgaggatccaaatcatctaaccctgagatcctaagaccctaacatatggtttcttaaaacctacaatgaatagaaaagggcagcaggggtgacacatttccagaaaggaacagccctgtatttcctcatcagacaatgggttggacgggtgggctgtgtgatgactgagccacacgccatttgtctctgtgttgaagaaacagaggcctaggtagcccaaataaattggtttctcgtaagaatgcaccaggagggccttggcatagtggctcacgcctgtaatcccaacactttggggggctaaggcgggtggatcacctgaggtcaggagttcaagaccagcctgatcaaaatggtgaaaccccgtctctactaaagatacaaaaaattagccaggtgtggtggtgggcacctgtaatctcagttactcaagaggctgaggcaggagaatcacttgaacccgggaggcagacgttgcagtgagctgagttcatgccattgcactccagtctgggcatcaggagtgaaactctatctcaaaaaaaaaaaaaaaaatgcaccaagagggatcagggcaatgagatagattcaggcaagacctcatagtgcctgggaccagacagacatcctgatccaaggtggctgcaggatgccagccccaagaatgtgtggaaagccacaggagggctctgcggtcacggggctaggccacactcaccctgtttgcttctccccggtttcgtggctccggctctccaactcacccttccccttccttgaggcttatgcttagaggtgtttccacttggacaccaccccattggcacccttgcttgttacaatctgtcagcctctgctccagctgccacctgcccttgatgctttcagggaaattttggctcaaaattaggggaaacaccccaagatgagcctccaaaaccaagaagtgtggttctgttgggaaggtttggaacttgcagggtcagaggccagtcagatggtttctaataaaacccctttctttctcctctgaggacatcaaagggtagttgtctatattcacagtcttcttaggcatctgatggagtaattttttctgagctgttgaattctttcaaaggtctgaacagaaatataagactgtatgcccctgtattaatctgttttcatgctgttggtaaagacatacctaaggctgggcaatttacaaaagaaagaggtttattggacttacagttccacatagctggggagacctcacaatcatggtggaaggtgaaaggcatgtcttacctggtggcagacaagagaagagagcttctgtagggaaactcccctttttaaaaccatgagatctcatgagatctcataagacttattcactatcaagagaacagcatggggaagactcgcccccatgattcagttacctcccactgggtccttcccacaacatgtggaaattcaagatgagatttgggtgggggcacagccaaacggcatcagcacctcttctgttgtgggttcaattgtgtccccaaatattcatatgttggggtcctaatccccaatacctcataatgtgaccttatttggaaatagggtcattgcagatataattaattaagatgatgtcatattggagtaggatgggcccctaatccaatatgattggtgtccttatttaaaagacaaaaaaaaaaaaaaagaacaggaacatctgggcacagataggcatacagggagaacagcatgtgaagatgaaggcagaggggctggggatgcatctacaagcccaggagagccagagatggccaacagcccaccgggagctgggaaaggaatgggatagattccttctccagaacttctaggaatggaattgaatctattatgtctccagaacttctagagatggattctattcctagaagttctggagacggaagtgtcagcagggttggctgacacttccgtctccaggatttctaggcaagaaatttctgttgtttaagccactcagtttgtggtcctttggttgttactttggtcctttggttgtggtccttctgtagcagccctggcaaactaatgcaccttccagtcttagaatggatcatcaaaaaggaggtttggcagtgcgggaatgacctgctcactgttcaaggtcaccttgatgtcacctggccctctgctttacagccaagatggtcaatagttgatccaattacgacttttttcttctagttcaggaccttgagaagtctccctccctcccttctctgatgtagcttcctcgaaggaatgagcgtgtgaaaatgctcacgatgcagtcctaggagagaaacatgtttccaagttagggagagtgctgtgctgaaatgctcccaataacgtcacactgggagcttgaaattcaacatggaaattgacgaacactaaaaataaagcccttttacgcccccttcagggagctggttgttaaacattgaatagcacacctctcgttagaggactcttctgacttcccttaaattatagcacttacatacctatgtgttctccctgcaagtaacagccacccttgccttcatgagtctggaagttccctttgcgaagtggaaaagctggaggaaaaacacctgaaaccccaaggttttgtttccccaaaatgacaagtttcccaaccagagtcctaagttaccccaagactgtggaggacaacttttctaagtcaaggaaagatctcacactttaaggaattcaccacttttacattaaatacaaggatcccaaaaacacaattatgagatgggaaacagagtcctcgaagtgaacatcatggtgacagcagctaaatgtccattgctacactgttcaggaaatagtgaagacgctttattacaaggttatgccagtctgctgttgaaattcaacccatctgaaacagcaacaggagcctgacatttgagtgacacaatgcggtttacagagaatgtctgccaacaggatcgggtggcaggaaagtgacgtccctaccctgtttcaatgcctggtctccttaagaagcatttaggatgaaatttttgatgcacagacagcctgtttccttattgcattattcattgtgtgactggagagaaattgttacacatccaagccccagaccaggtgacagcaggtgcccaggggaacagttggcagattccccctttcctcagcagacatggattttcactgagaggcactttttttgacacctgaggccaaaagagagtcgggaaggtaggagatgtgtgccctctgtccagactgacagtgcagatggtggcagcgctccacatccctgggtgcccctgtcattttccacggacttctgcacttctccactgcctctcgaagcaggatatttctctctcctccatctgtagcctccctggctgcaggtgaaaaggccctttcaagtgtgattgtcctgcaaagcatgccgagcccgctgaagcttaagagaaaaattgttatgactgatcttcagatgacagcaagtacatcttttagaaagtggagtgagtatgatgaaaaatacattatttcacatttgacttttccccaagaaatgggaataaatttccccaagcaatgggaataaatttccccaagcagtgggaataaatctttccttgtttcaaggtgacattttttggacaacattgtagcattttggaagtgagggttcattgtgcattagcgaaggttttctcctagtgacttccactgcctggtctactctaaggaaaaatccacttctgaaaggcaatcttcacacaaacaaaggagtcagagaattacctgttacacaaggcacttcttacgtttgtctttcaattttatcatcctgtacatatgttttgtttgaccaacatggtaatgattaaaaggaagagaacaaagaggagatggataagagacttttatcggggcatgcactgtttgccatagatcccaccattcccagttgtctgatggctgcttcacacaaacatcacctacctgactccttagggatttgaagtttgcacctcctacatttgcttagtaaatacttgagagaagcagtgaggagtgggcaagaaggaaatcctttttttcttttgcttagtagtctatgtgttgggtttacagttacagcatttttcacgttgtatatgggaagagggtgacagtcagaggcccctgaattaccagagggttcaataattgacttctgtcttagttttagatctcctagaagcagatcctgaggcaagatttgggatcaagtagtttattgggaaggtgaagagaataccagtgatgaatgggaggtgtggcaggaaagagacagggccagttaagggtatgttatcctgccagtcatcgctgtcagcaactggagcttaatgccactgggaaacttcagaaaaccacaccaaaacttgagaacacaccccaaaggtatcccaccctgtgggaaaggagctggaataaaacccattgatgaggtttgttcccaaaaccttgtaaatgccccagtgctttcagcctgaggacagatgcacagagcagcctttcagcctcttgggaggaagcccttagacaaaaagatgcatatgctgacatttggaaactcccaggcacagggaattctaaagcccaagggatatgggctcacacacaactcccaaagtgcagcttaagcaaaacctaacctgagacttcgagtcatcactctctggataaataaagcactggcaaggtgatgtgtttactgttcaggaaaaggatgtagcccttgcaaagagggagctacaaaaaccagccattatgggacacagcatcttattttgctctgacaaccagaaggggaattcgggtgacgctagaaggtcttgaaagtgacaactgattcatgaacgtctttccacaacttgaggaaatgcagccacccagggcaaccctggcacaccttttgctggctctgatgactacatcccaacttcttcttaatcactcttcagagttgctgctggagggaatattttaggaatatttaaagacaaggctacaaaaattctctaaggtacagatgagacagcgcattgattgtttactccctaaggggctgcaaagggcaaagcacagaactcaggtcttcttccagctggaatgtatggacagggaccacttacaagaaaaccaccatccaggaaagcaggggacagagagctgcctggggagacagtgattaatcaggcatgggcgaggggaggccacagtgcctcctgctgaaatttaatcagagccacgggtcgtacaccatggcggcgagtgccagggcctctggcagacgatgaatgcctcctgccaaggagctctcacgaatactctgtgagcccagatttatgctctgcagccagatgaaggtcgcaactgagcagaactgctgcagcgtggaatctgcagttcagccttggaaacagctggtgccgttaccgtccttcctttcatttctgggataaagagaactaagagaaaagtctggtgggtttcgggtgatccttgtgaccagccgtctcattttgccagggactttcctgtttttagcattgaaaagtcctacatctcaggaaacccctcaatcctgggcaaaccaagacagttggtcacccaccctttggcgctattagtagcgttggcccacctgggcccagtgagaaattcacccgaggttagaagttgacatgaatgtaaactcagcagcacctctgacatcagaaagattcatcactacaatggctggatcctttgagcagtgagacagaataacacaggattctgacctccaaggtggttacacgaaaaccagacaataactaaagacaaccacaggcgccatcaaacactgaatcgaggtgaggatttaaatcagaggccagggcaactgcatcatccttagcttggcttttccagagaacctgataccctactcccgctgaactaccacagaacccacagggactctgcagagtctggaactgaccagtgaaagttccaaactacaaaggataccatctatcatcactcccactcacaactcattgattaaaatggcttataagacctcacccaaccacaaagaggcctggtcatgggctcagaccgtggacagtttgcaatatttagcaagcagcagcaatgactaccacaatgtgtaccgaaacagttaggtagctcaagaggtaaccagttgacctagtgaggacaaatgtgcaaatgtcgaagatgtttgtgaatagtttgaataaaatttgccaaagatgttcatgaataatttgaataaaatttttcatgaactacgagtgcagaaaggcaatattcataaatcaatacattgtttcatgtgcaatttaaaatgtgtttattttaaaattcatattttaataacagattaaagtaatataatggaaaagtgtctgcaagtctaaatccaacacatcaaagaaaaaggaaaaactgagtaaatatatatgcacatagataatgaaaatctagctcagtttcttaatacaggaagagctcttacaaaccaataaaaggaataccatgaggtcaggcgaggtggctcacacctgtaatcccagcattttgggaggctgttgtgggcagatcccttgaggtcaggagtttgggaccagcctggccaacatggtgaaactccgtcatctctactaaaaaaaataaataaagaaaaataaaaattggctgggcacagtgctatgtgcctgtaatcccagctacttgggaggctgaggcaggagaatatcttgaagctgggaggcaaagactgcaataagtcgagatcacaccattgcactccagcctgggtgacagagctatactctgtctcaaaaaaaaaaaaaaatctatgaaagaaaaaaacataggcaaagcatattatcttttggggcttggggctttgctaaataataaagcaagaatacaaatgagcaggaaagacacaaaaagataaattcaactttagtgaaaaaatatataactcaaaacaataaggtactatttttacccaccaaattggcaaaactatttttaagaaatgacaattctaaattatgacgcatatgagctgaatatagagttctcatgcactgctggtaaacatataaactgttaacaaactttatcaagaacaataatatggcagatggactaagaatcgtcattcattttttttcacccagaatttcctcttttagaaacactgcctaagaaaataaacatacaaagacatatataagattatgttcattttaaacataaagcacttttttaaaaactagagacagcattccatgtacattcaagaagaggtgtaaataaattgcggaatggctatttcataaaactaataaaaaattatggtgtagaagagtatttaatcacataaaaaaagtcaattatataaattgtgagaaatacattttaagcaggccaagaaagttgatctatttttattatcccaatttcactttcaagcccgttcttatactttgcatttatatgtaaaattggcaagaatccacaaaatatcaccagtgattatctattcatgtaagattataaaggacttttatttccttcatcttctatattccaattattctataataaatattattttcatagtaaagaatacaataactttttccaaggtatgctaatgttgtattaagaaattaaggtgactggaaaataaaaattactataattgtttacaaaaagataagctctcccaggcttgcctcaccaggggtctgcaccctgcacccataccaaccccagaccagcacctgttctggtcattaaccctggtggctacccattggttagggtggagggactgactcactttagccacaagtttctcagagtgggatttccacctcctcaaatgtaggcaatgcgctggggacacagcaagccactgcaccagtctctagctggaatgtcaccttagctgacggtaagcaatttgtaacattctttttatattatgagcaaaataaaaaaattgcttgaatgtttcagaaattttgggcttgtgagaggctacttaaggccatgcccagcaagttccaactcactgctctcactgagcagggtttctcagcctgggcatatggacattctgggcaaaatactgttttgtcggtggtgaggaggttgtcctttgcatagaagtttagtagtctccctggcctttatggactagatgctagtaaaacacacatggttgtgatcaccaaaaatgtctccatcactgcatcctggagaaaaagtccacactagttgagaaccagggtggttaagtacactccatagtacctaggttaaaagtttccatttggtaaaaacttttgagaaacactgtaatcccactaaactccaaaagactggcagaattcaaagtggagttgcaccactcacttaatttcacctaaatgcacttgcctttttttttttttttttttcctttcacccaggctggagtgcagtggtgtgattatagctcactgcagactccagctcctcaaactcctgggctcctcccgagtagctaagactataggtgtgcctcaccacgccaagctaattttttcttttgtacagatgggggtgagtgggcctctcgctactttgcccaggctggtctcaaactcttggcctcaagtgctcctcctgcctcaaggctccacttcccagagcactgggattacaggcatgagccatcaggctggcctacttgcctcaggcagctgacagccattccactcactgagcatgagctgcaggattagggtggagaccccgccccccagcagacagccccacccacagtgctggctcttgggtcatggcctccctttgtccttcagctccagggccaccctctaatccatgggtgaattcccatttcccttttgggttttaggctttcctttaacacctattccctggataaaattccctctgttgacctgccaagtgtggcaatatttgcctggctgaatttcaattgatatattgtatatttattgggataatgttacatatatataaatatacatatatatatgtatgtatgtatatatatatatgtatatttgagactgagttttactcttgttgcccaggctggagtgcaatagcgcgatctcagctcaccgcaacctccgcctcctgggttcaagcaattctgactcagcctcccgagtagctgggactacaggcatgcaccaccacgctcagctaattttgtatttttaatagagacgaggtttctccatgttggtcaggctggtctcagactcccgacctcaggggatccacctgcctcagcctcccaaagtgctgggattacaggcgtgagccactgcacctggcacatttatatattaacatagggaaaattgacatctctgtgatcctgtctttctattcgagaatatggccaatatctttccatgggatcaaatcttcatcttcgtccctccttccatagagttcagagaggttcaaagccttatttagcacttccttagcttttttttttttaagtttgttgaatttcttcccttttttttttttttttttttttttttttttgtgacggagtctcactgtcgcctaggctggagtgcagtggcgcgatctcggctcactgcgggctccgccccctggggttcacgccattctcttgcctcagcctcccgagtagctgggactacaggcgcccgccacctcgcccggctaattttttgtatttttagtagagacggggtttcactgtgttagccaggatggtctcgatctcctgacctcgtgatccgcccacctcggcctcccaaagtgctgggattacaggcatgagacaccgcgcccggctcttcctaagtattttatcctttatgtggccagtgtaaatggggctgcctgtagggtggctgtgaagactgaataggataatatgtgaagtacttaacaagtccctggcatgtagtaagtgctatggaaatgcttgctgtgatagtcaacctttgttttctgcacttcttcctctaacgggttatggtttagatgtgagccatagttgttctgtctcgatttctgcctagctcctgttcaggtgaagctgagaggcagaaatggatcaagccttaagcagatgcccaagatcaaggcactggcaggttcagtgtcttgcaaaggctcactctctgcttctaagatggtgccttgttgctgtatctcatagaggggacaaacactgggtcttcccatggtggaagggccaaaaggggcctagctatttccctggagcccttttataagggcagtaatcccattcatgaggaccaaactctcatgacttaattacctcctaaaggtcccacctcttaagactatcatgttgtgtctcaggttctaatatatgaatttgggggggacatataagttcaaaccaaagtagggtggcatgccagcaacagccccatcccataaccagctctcagtcctcttatggaggtcccttccccactcatttctgcccccagaactagagaattttcctcactggcccatcttccccagaagccagagactttttggtgctaaaacccaatcaccagaagcaaggacacaattattattgcttcatgtgtcctatctagcttaagaaaacaaagtttaatattcctagaaaacgaagcattcttgtgggcaagtctcatggtttaaaacaaaattaacgtttgctgtttactgttcacggttcagaaacaggctgacaattgctctctgtgtaacagtgagctggctgcataacaaactgccccaaaactcagtagcttaaaataacaatcatttaattttgctcttgggtctacaggtcagctgcgttgttctgctgatctgcaccaggctaggctaatctcaggagagtgagttagagactgacggatcgaggatggcttccctcctgtgtctggcagctgtcagcaggggcagtgaatttgactggaatacttctctcttatcaatcaggaggctaacctaggcttatcttcatggtgcaacggagttctgggagagatcagagaacataggagttcttgggactgatgtttggaactgatacagaatcactttcccccacattctattggccaaagcaagacataaagccagcttggagtctaggggtaggaaatagaccactcttcttgatggatggggctgcaaaggcatagtgcacagggcataaatacagggaatcatgaataattagggtcacaatcaatctaccacactccccacacaaagaagagaatgtttagcatcgatttccttcattttagcaaacgttgcttcatctcactagcagtctacatatggactgattcaggagaaagttctgcagatggtcaacctcactcacccatttattgtgaaacacatcagttgtactttgctttttttttttttttttttttgagatggggtctcgttctgtcacccgggctggagtgcagtggcacaatctcggctcactgcacctcccgaatagctgggattacagacatgtatcaccacacccagttaatttttgtatttttagtagagacagggtttcaccatgttggccaggctggtctcgaactcccgaccccaggtgattcacccacctcagcctcccaaagtgctgggattacaggcatgaaccaccgcgcccggccacacttttgctatttcttgataccgagcccaaatctgagtctgtttgagagtgtgatcctccacaccaactgtagggatatctatttccctcgctgtcctggtttctgagagcagttccttgttttggttggagttttccagcatagatttaccaagatgctgagaatagttcccagctagtggttgaataaatatttgttcacttgtcgattcaatcaatcacaggctgattaattcccagtgctgttagaagtgattgaaaatgtcacatctgattgtcaggcggcagagagcacttggaggtaatccagtcatctctcttccttctggcttctccactcttaaaccactgattctgtgtcagtttcaagcgtaaggaccatggacacctggtgaccacacagggagagactttccctgacaatctcttctgtcttctccctctagagggtaaccaagccaccctgggccaggctgtggagtggctggaggttgcacctgccccttgcctccggcactgcatggctgcactcctatccaccctcccagcccacaggtgaacactaagcagccccaggccccattgccttggggtaagaaagtgggaagcaagaaactaatggtccaatcctgggttgtttaggtagagaggaaaatactcagaagacaaggaaaaggatttttaagaacctctaagaacatggtttgaggagaagagccatgctaactgtagggacttatgcaaagtttgccatttaaactaattagcatgtggcaataactactgtgcttactactgtgtgtttaaggttttattcactgtgtgttttacttgatcatattagactttcctcctacatttggagttcccttgctcaagtaaaatgtcatatattatgtgtttaaaaggattctagtatccaattgaataaaaaagaatatatacatatgcacacacacgtaagatttttatatatcatggagtaaatgtatgctttatatttataatgtctacatatcatatttaaatttatatattgatatatagctatttaaaataaaaggtatatatcttctataaatgttttgtatagcttatgtagctaagaaaaattatatgtccatatacttgcattttcactaaaaaatgtctgatacataaagagatgtaagaatgagataataattacctctagagagttgttttttattttcctttccatacagttagacttttcattgtgagcatgtaccacctttctagcttttttaaaaagcagtttatttgtaaattttaagacagttcttccaattttcttacctcattatccccagcttaaattgtaaattcagttgacttttttagattgaattcttcctggaaaaaaaaagtttcccacaatgccctgccagaaggatatggtgtccaacccagtttaaaaagtgcacccagtctttaggttcaactgctgaagaagcccaacccctgggctggagacctcccctgccccctcgcagcccaggctgtgggtagcggcagcgtctcccctgctctccccagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggtgagcacgtccccttctgtccttgtttccttagggccactgcacctctgtgtcagggtgggatgctgggacactggcttgctcccctcctgtcccctccctcagagcctgaactaaggctctgaagggaagaccccttttctctatgcccagtcctgctttctaacaaagcacagacctcccatctgcgagctagtagcatgatcggtgaggactcctttctggatcgttttccatagattttcttgtttattgtttctggcttacaagtaatgatgaagtctggtttaccaatcagttgccccattccatcacttacaagaataactaactcattgtaagaaccaaggcatcacactgtaaccctgtctgaaacaagaacccatctgtttatttatagcaatttaaaaaacaacattcacggatggacttttctggatccataaaccccgtaaaattgcacacacatctgttattttctcagggaaagagttgtgattttcatcatattttaaaatggagccatgatttttagaacaaaaagattaataatcacagatttattgtttgttgctcttttctgagcaaagaaaaaaaaatcttcctttcttggcaactaggtataatggtgaattttccaagcccctgggaaatacatcatctgtaaagcataataagcttttttggatcttttcctctctggagattttgctcacagatcagccttttcttacacctccaaaccaggatttagtaggtggttcagtagtcatgcatgaattatatcctgactggctgcacccatctccactgaggcttcttgagacaggaggacaggagctcaggacaaaatcattagtaccatccagtgtttcgatcccacgctcccacgtgggatcccaacttggcaagatggccatgcccctgcgtgagcgaggagaagccctttacctggaagggacgcagaccttaaaagcctgtccttcccacgagccctcctgcattcccccttggtcttggggaggatgaagaatgtgccagctcctcccaaacagaagggggctttgacccctcttatcctgtaagctgtatggacagaaagggagaagggcagagcagacagggacaggtgaggtgacacttcactctcacgcctgaaagctccactccctaccccaaagacctctcagtggtgtaaatttgtcctcgacccgtatttatgactctttctacttgggctggctaaaggccttgagtttcctgtgagtactataattttgctcaatagatgcccttaaacctccctggtaatttcttcctcaaaataataagctctcttgaggatcctacagacagaggaagaattcccgtcgtttatacatgattttaatgaacaccctggctctcacaaacattgaaaatgaggtttttcactttgtgaaagtcctttaaaaatctgtttaccagtctcccctctaaataagagttgtggaggtgatacccacatattgggttgtcttgactcaacacatctcagaatctctccgtggattttagatgtagagaaacatgttttaatagcctgcccttctagagagactttagctgagcatgttgattctttcctcttcgggaatgccttctttcccccaagaaggaaaaagaaatgctgatgaagtggcctttggcctttcaagggccagtcccaatgcaacaaaactagggtgggggtattgacatcactttccacttcataatgtttccttttaggtttcaggaaataaatctctctgtagtctctggaatagccacagatatgcttctttgaacaactcatttatcttgtggacactgtaactataactgactatatatccccttttacgtgggctactaggaagctcagataaaatctagggcaaaagagaggcatatggatgctaagtttatccttagtttcatcttaatcttcttgggaacaaagcataggttaaataaaaggagtaggctgggggcagtgactcatgcctgtaatcctttggaaggctgaggcaggtggatcacctgaggtcaggagtttgagaccagcttggtcaacatggcgaaaccctgtctctactaaaattacaaaaattagccgggcatggtggcacgtgcctgtaatcccagctaattcaggaggctgaggcaggagaatcgcttgaacctgggaggcggaggttgccatgagccaagatcatgccactgcactccagcctgggcaacagagtgaggctgtctcaataaataaatgaataaataaaaggagtagataatcccctgctccacattgtgcgggggttcaaaatagcgtgatttatccactcattactcattatcttcccttccaggcaaccacagatttgtacggcaactgcactctgaggcattctgggacatctgcagctgcccccgaggcagctggtgtgtttgcactggctctggaggctaagtatgttcatagctctgggtccagggccagctctgcagggtggactaacacgtgtctctctgcccacatgccaggtgtccatggagggaaaagttgatgtgagaggccatgaatagtcagggccaatgaactctgctgtgcatttctaagtggcccatgtgcccaccagcacacgtgcgtgtgcatacacacacacacgcacacaccataaaaccacattcctgggagcacacaacacccagcagcacgtattagcaacttactcagatacccagtgaaggcacagagatatttctttcttcatcaaatttacccctctatcctctgtgtatccctgggctcttctactccagtgatattcacaatcagctacttgaagacaaatcaaattgccaggctggtgtttcagaacatgtggcaaacaaagtggtcccactcaagatttgttaatttgtgaagtggattcactttttaacactgaaacaagataggcaaagtcacgcagtgtagaccaagatatgggctttcctgggagaccttccaagctgaaggtaagaggagaccatctcctatgtcctcaccatcctatggagaggccacatattgctactgctggacacaccttggatttgagtagcagtggaggtacctgcccacctgctactctactttcttttaatgatacctgaggctggccttatgttcacagaatgaacacatgggcttcagacaccacacacatagtgtgagtgtaagtgccggctgtgtagggaattgtcagagaatgcagttcccagcaacttgtgagaagttggattcagtctcttggggaaggagagtagagttgctaggcaaccagggctcccagcatcaatctctaggcagccctgcttgtctctctccacataggcagtgcattttctgatttgcaaaggaggcaggagttggttcctagaatagaaaggggcttcaacagattacctagttcaaccctctaccttcacaagaaaaggcataattatcctccctttacagataagaccccaaattgagagtgacttctctttttggacaagtctaaactttgactcttctaacaaaattcagatagaaaatttatgatgccaagacactggtcaaagctcaactattaggcacagagacctctgccctatcaagcacagaaaacaaaatttactcatatccaatgtacatttcctgaagataaaactgttcatctcagggtctgagtgggccctggagcctgagctggccttgctcactgcatccgcaaggagacaattagcacagcctgctgcctgtagctgagctgtgcagagccagggaacaggagtgctccaaaagcgagaagggtttccggttgccctttcaacctcagaagtcaggacttgactcacagtcttctggatttttgacaaacaaaatcctatgcctatgcctagatccataggcacacaaatggaagacctaaataaatcaaagtgggggagtgaggctgctggactcctagagattcatggctctgccttgattagtcaccattcttttagcacatacgtccagatatcctacagaaaagaatgcagtcaccattcaggcatgctttgttttgaagcaatgatcatgaacttaatattctctgctggcataaagaggaaaaaaatataacacctggcagcttgtgggtaagtccatcacgggagccggtcctaaaattcttcaaaataccaactttctgaggttggaagcagaccctgagatgagattttggtgcaagtgatttattaaggaagggatcccaggaaaggcagtaagggagtaggggaaacaagttagggatggggaagaatccaagcaaaggttcaacttcaaaagttctggcctcagtctaatcccgagtgtaaattaggcctcagagtttgttctacctccaggcaaggaagcaggactgtcatattcttatatgagtcagtcatcggctaagagctactctggagaagtaaactccaaggcatctctagctttaggcaaagcggctccaatagccaaaagtgaaaaccattggtcaggatgagatactccaaatgagagcccagagggatgaggaatagggcctccacagagcagtcccaaagctcatctctctcttatcttgagataaggttacaggaagtcctcatgcataacaacaaattatctaaatgtatgtccatcaggaccttgaaagagagagaacaacacttcccccatcatgactgtaggggagaaaaagaaaaccatctctctctcctaaccagttgtcactttgtagtttaatatcataatgtacttttctgcctaatgcttgaaaatgcctacttgagtcacaggaaatattgctcccatctcccagtatcaccaatatcagagaaatttcaaagaattttagtgggggatgactgccaccttcgaatatttaggtttctctcatatgacctggtgctttctctgtggtcctagagggtgagctaggctcgaggggtagatgtcataagaagatcagtttttgactcaagaaaatcatctggagtaaagtggtccacatgctggactggaacaacatttccaaaactgaccttccaggggatggatttttaatgtaaactctttagcgagtatagtatatagaaagaaattcattaggtgtggctccatgacattttaactaaatgaacagacccatgtagccagcacccaaatcaagaaacagacgatttatgtgccctgttgctcagcagtgcaagagattcctccatgttcctgtatgtagttataggtcgttcattctcattgttgaatatcattccattgtataaatggatatttggattgtttccatttggggctactatgagtgatattgttaggaacattcttgtacatgccttttggtgaacatacagatacatttctgttgagcgtctactagggagtcaaaatgttgggtcattaatatacatatgtgcaattctagtagatatcgtcaaatagtttcctgaagtgggtgtacccattgaccctaccttgagcagtatatgagaattacagttgccccacatccttgccaaaatgtggtattattagtcttctatattttagcattcttatggatgtgcagtggagtcatattatagttttaatttgcacttccctcatagctagtgaaattgagcacactgggtaaagttttttaaaaaatacattcccaagcctcacccaagcctcatagaatacaaatccctagggatgggtggcccaggaacctgacttttcaatgcctgttccccgggaatacttaagctgccagcctgtcgctgatctgtgaactagggtgtgaggatgatcaataaggcaatagctctgtgaatctatgactctgggtgcagagtgtgggtagctggcttctgcctctgattaggtgttggtattcagtcaagatttaatgtttctgcatgaaacaacgaatccaaataataacagagacaagggtttatttctctgtcatgtgaaagaaaatacagagataaggaacccagggctggtttagggtaccggggtaccattgtgaatcagggaatccagctctttctagctttctgctcctttgctctgccactttcatgttctctagacgtgctggaactccagccaccatgtttacatttcaggcaggaaaaggagaagcacaaagggcaaaaaaataaataaataaacaaataaaagagagagagagaaggagagagagaaagaaagagaaaaataaaaaaagaaagaaagaaaagaaagaaggaaaccagctgagtcagccatgttgaaggggttttccaaggagccccacccagtggcttctgcttatttctcattggctagaactgtcacatgaccaccgccacacttcaagggaggctgggaaatgtaattttatagctgaatgcattgctgttctgaataaaactgaagttttcttaataaggaaggagaaaagatagatatggagggaaatacaactgctaatgtcttctggcatctaagtggacaatcactcatctctggatctctattgtcttatcaacaaaaggtagcaagttagatcatcaataaggttccaatgacttcctggaatattttagctctgcttctgaaatattgtttttttagggaagttaatattttaattggatgtctggtgatttttaaggttgaatatgccttaaagctgaaaaacgttcatttacatacttttaaatattgaggtcaatacttaggaaatagtaatctaatttactttaacttctgatatatgtgatatatgttatcattaataataataaagtctttttattcagtgtccagcactgtgctaggtactttacatacataatttacatttacatcctgcaacaaacctataaggccttatgcccattttaaagatgtaaaggctagagctcgaattgttaaagtaacttatccgagttcacacagttggctttaagcattaggatgcctgttccactgggctctcggtggaacatagaaaaggccctgccactgtcttgcctgtggggctcaccactcatcctgccatggcaatgggttgcagtgaatgagttagctcttcctcaaacatgatgcacaaaatcaggtttcactttctttgagatgagattttccacaccacaactacaccagggagtcatgaaaactgaatttcctctcacgtccttataggacgtgagcaaacaaaggctatggagaaaataccagcttgactcacaaatgcattatttttctcagactggaaataatccaacctttgaaattattttttaatcctatcaaaatttagaggatagactcagaattttaaaaatgaaagaaaatgaatggatcttttacgactccaaacatctcttatgatgaagagaacgagacccagagaagtgaaacaacttgctccaggtcacacagtttacattgtcagataaagatcagatccaacaagtaaagggattaaaattctcctgttgacttctagaatttaccagatgttaggagaagtgattcctccaaccttaagactacagcatcatctttaaaacatttccattttcaatttctctaaagatgcatgtgctgactttaaattacttttgctgccttgatcattaggaggaaaatgttaattgggttcaggggaacttgatgctgtaaatagaagtactatgctctgaaagagaatggtgagggaacagccttgcacacgagaaaaacaatccattctgttagaagtcaggttcctacaaaggataaatgcttgaggtgatggataccccatttaccctgatgtgattatcatgcattgcatacctgtatccaaatatctcatgtaccccataaatacatacacctactgtgtacccacaaaaattaaaaattaaacattaaacaaaaagtcagtctgctggtcagccacttcctaagagatgcttgctgacccctggacccaagtttctcagatttcctgatgatcagaatcctggagtgcttgttaaaaacacagataccctaagcccactggagatccatagaatcagaatccccaggggagcccctggaaagctctatttttcaccagcgcccccacccccaccagtgccgtccaggaagttaggaagctctcccctgaacgaggtttgctgcatactgaaaatactaaatgtttggaggaatccatggaatcaaaacctctgaacctggacatcatttttttaaccatccccaggtgattccaatgtgcagacaaggttgagaaccactgtcccagactaccaatgttctcaaacatcactgtacagaagaatcatttggattaaatgcaaattctcaggcccacaatctccaagatgctgattcaggacaggtggaaattcacatatgtcactaatggtcctgacacagggggattgaggatcacagtgagaactcctgactaggataacacagaggctccactgatgcctccctcagcatcctgagctcccccatcatgacagccctcacattttcaatactgagttgtccctctgtccccctaggctatcagctggtggggacagggacatccgtctgacatgcccagagttagcacgatgcctgaatgtggtagacactcaacagacatccatacaatcacttcattgcgcagtaccttctcatatatctgcatcttattttcccgactcatataaaacatttgagaacagggaagaacatgtcacatttcttgtcctacagtctccaaaacagtgacctgtatatcgcagatactccataaatttattttttaattatttaataactatcacctgtaattcttgggctgctatggtacaattaaagcaggttgatgaaataaatacctactttacagaatattgtagtctgtcaattcctaaatcattcagaagggatactagaaggaacctggttttactcttcagacatatgcaaatagcaggtcaaacagtgtcatagactcagttacactggagagtgaactatgctgtggtttatctcaaaagtgaaaagttccttgttctgaaacattatttctctctctctcatgctctctctctttctaaaatgcaccccatgagaataaatctgcagagaaacatttaagggagcccttctccaggcatcagaagtacagcccattttcatggcaaagatgagaaatgagaaacctgctagccagccctctggtcatttagatcctcatttgtcaacacttctgagattaataaactcagaatccccttccagcaaaacactcagtttttagccataatcaacttaaggaacttttacaccattttacatcatttacaccattttacaccacttacatcattttacaccatatgtccaagacatgttctgaatctcctcaaataagcattgaccttccttggaacttgcttcttttctttttttctttttttttttaattatacttttaagttctagggtacatgtgcacaatgtgcaggtttgttacgtatgtatacatgtgccatgttggtttgctgcacccattaactcatcctttacatgaggtatttctcctaatgctatccctccccatccccccaccccccacacacacacatgacaggccccggtgtgatgttccccttcctgtgtccaagtgtggaacttgcttcttaatagaagaaggtctgcattcaagagcacatggatcatttgaactcttggttctgattcagatcttccaaccaatgaactttgcatatgttgaaattttatcaaatgagttatgttgctcctggtcctttgaattgtttgacttctgaagagaactgtagtgcaaggttttgccaactttttgaccagaatcctcggtgagtaataaattttgcactgcagctcagcacacacacacacagctaccctccaagtatttcatgaaaaaatagcttcctgtattatgtgcagtgcatactgcttttctattctgttccattcattttttaaaataataacaccaaccattaaatcactggttctcaacattggctgtctgttggaatggtctgagaagttttaacagtttccaatgcctgggtctcactcccagagattctgatttacttggtctgggatgaggccctaggcatgagatcttcaatgcccctaggagaaaattttcatgggcagtcccaacaacctgtgcgataacctggcccaaaaacaaatcatgatttgcaatttgaaaaacatagacaatgtgtagtaatagacactaatttccaaaaacaataacatttacaagaagactagtttattcactgaacaatgtgccaaggaccatcctggacactaaggatataaatatgctaaatataatttctctacccttgaagaactggtaccctccttttcaaaaatggaacacacccacatgccagttcccagatgaagggacagcaagaccagcactcagaagctccctgtatccccttccagtcactgccccacgagactgaccactaacatgacctccaacagcatagattagtcattcttgtttttatattttaaacagatggaatcatactttatggtctcttttctgcctggcttctttaggccaacatggtatttgtgagatttttccatgttgttcagagtacctggagttcattcattctcactgctgtatagtaccccacattctataagttacacctcaattagtttactccctatcttttggatggcatgtaggggtttcacagtttggggctaggagcattctagtacacaggtctggtgaatatgtacacatttggtcaggtatatgcctaggaaaagaatttccaggccatagcttaagcttaactttagaagatacagccaaacagttttccagtttagttggaattacttgcacgctcatccacaaagtacatgtgttccagttgctccacatcttcaacacttaacattgtcagtctttttcattttagccattccggtgtgtgtgttagaatagacttttgaaatcaatttatgtaagtaagaaaagcaagaagatttctttaattgacttatatagtggttttgaatggtgcatggacaccctcccttgaatttgagagttcacagagattccaaaatcttacaagaggtctgtgtcctgagtaatatttctcttaatcattgtgcctctctccctctctcaccctgccttttgcccttgccctcttgctctctgcttcctgtatccagcctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagtaagtgggggtagtggtccctctgctgcatgtggaaagtgcccctgagatggctccatggcattggcataatatcacattccctcttcatgtttgggtcaactgtattttttgtttgtttgtttgtttttttgagacagggcctcactttgtcacccaggctggagtgcagtggcgtgatcacagctcactgcagccttgaacttctggtctcaataatcctcctgcctcagacttccaagtagctagggccacaggcatgcgccaccacaccctgctaattttttttattttttgtagagacaaagcctcactatgttgtccaagctggtctcaaactcctgggttcaagtgatccttctgccctggcctcccaaagtactgggattacaggtgtgagccacaatcctcggcctggatttgactcagggacaaccagtttccaagcagagctgcaggtttgcataaatccaggaggcaccatttacatagaacacagaacccctgcttttggttgtgagccttaactgtttcagtgatgtatgccattatttctaagggcacaaatcaaccactataaacatcacccagctcaataaggagaacatgactaacacccccaaaggccccctgccgtgaccactgccattaacatccccatgccagcgtagccatattcttacttctaactccatagcttaacttgcctgttccatacttactagaatcatacactatgtcctgttttacaactagattatttcgcttggagttatgtttgtgagatccagtcatgtttaatgtgtacttacagcttttctcattgctgaagagtgttccagtgtatgactataacacaattcgtttattcattctacctgtgggacaatctaaggacttgattttccgctgagtgaggtggattttgccacttggagggatttgtgtatggggttccctacacagaaaccacagcgttagtcaactgcacccacttcccttccaactgccccaccttggcaagtggattggtcagtaaggatacttcttaatttctctctgtcctccttgatgcattagtaaaatggagatagtaatttttattattatcactgaggtattatttacatgtcatcaaatacacagaacttaagtgtatcatttgagtgttgataaatgtatacaccctggtaactaccactgaatcaagagatgaggcattccatcaacccaggaagattcgtcatacctgcttccagctcgtccacacgctccacaggcaccctttgtttttgcttctctctctgtagattcgtttcaccagttttcagactggactgtgtccagtttctttttctcagcatgaggcttgtgagattcgtccaggtcaccatgtgtagtcgtagctcattcattctcattctaccttgagaatacacctccgtggcttacatcatttaaatggtggtaaaattcattccctgccagggtcatatttccgaggaccatcgagcctggccagagtccaacccctctcagactttatcctcctcgccactcttcattggtcctagacttgctgcatctcttctactcagttacccagacctgaattccaatcttgacttcaccaacttagacaatacttttgacatttctgaccctctgctttagcaattctcaacctttgtgccctgtctccctttgacagcatggtgacgtctatgggccccatcagtctaatgttctccaaattcattagataaaatgcactggattgcaaaggaaaccaattatgttgaaaccaattagaaaataaattcatgctgaaatatatgtccccttgtcagcacattaagtaaaaagctctagtggcaagtctaatggccacaataatttcagagcagcagtgatgactaattgctgctgcaggatccatgcagtggctgtggtgggacacgaaaatctgccagctctttgatgacaaagtccgaggaggagctaatgccactctgctttgtggcctgcattcataatcgaaagagaagaaaagtttctgttataatctagtgaaaattaaaatgtggaattttttccattgaaattattagaccccctgaattctatccaaatgggccccaaaataagagatttttttctctttcctcaccagtaaaacggagctaatgtttttcctccgcaggctgctgggagactttagcaacacacaagtctacagcaggcacacagtaggcacttaataaatgtaacattgcctctccttctcattcatgactagatgtgaacacttctagcttacacctgtagaatcaaaagacagtaatctcctagagtttttggtgaaataattgtctgatttttatgcaaattccaaatcagatatcctctcagcctaaaatatcctccaatggacaagcatgtgccctgggattcccatcctcccatgggccagcagcctgccatagatgggctgcctaccataggtaagcatcctcccacgggccagtgtcctcccgtagatgggcagcccaccataggtcagcatcctcccacaggccagcatcctgccatatacgggcagcccaccataggtcagcatcctcccatgggccagcatcctgccgtagacgagcagccaaccataggtcagcatcctcccacaggccagcgtcctgccgtagacgggcagcccaccataggccagcatcattccacaggccagcatcctgccgtagacaggcagcctaccataggtcagcatcctccacgggccagcgtcctgttgtagacaggcagcctaccataggccagcatcctccacgggccagcgtcctgttgtagacaggcagcctaccataggtcagcatcctcccacgggccagcgtcctgctgtagacaggcagcctaccataggtcagcatcctcccacgggccagcgtcctgctgtaggcgggcagcctaccataggtcagcatcctcccacaggccagcgtcctgctgtagacgggcagcctaccataggtcagctcctccacgggccagtgtcctcccgtagaagggtagcccactataggtgagcatcctcccatgggccagtgtcctcctgtagacgggcagcccaccataggtcagcaccctccatgggccagtgtcctgctgtagacaggcagcccaccataggtcagcatcctcccacagaccagcatcctgctatagacgggcagcccaccataggtcagcatcctcccaagggccagcatcctcccatggacaagcatcttcccatgagtgagcatcctcattgtttactcactgaacccctagaaagtggcaccaagtggattactgccaagctgagtattttttttccatgaaacagtccatgatttaagaaggcctcactctaatcagcaccacatggaaaaaataaagcttcagcccaagccctataataatctaaaaacacagagctgcccaagtcccaagtgatgttacaaatgtcctataataaaaatagctactctgcacagttcctcaccattttccaaagcttctgtgtccacacatcatttctgttcactcccgtatccctcctcttggcaggacagacttctctgagctctaaacaagttgattgacacagtcaagcccacagaggctgtaaatgtgagactggaagtcacttttattgagtgccaactgcatgctatgtgctttcatacacgtaagcttcacagccaccctattgttgagggtgtgccttatactcgcacagtcgaggtgggagcaggggtgaatattttgcagccttaacaacaaactggtcccatgctgggtgtcagggagaaacaccaactaggtgtggtatatgctaggcccatttacattactgtatttaatccttgtaagcccaggaggtgtgtcctatcattattactttttatacacaaggaagctgagatccagaaaggataaaaaaaaaaaaatgtgctcagagtcacaaagggcagagcaggacttgaagcaaagcccatctaaacccaaaccccaggctcttttcactacatgaccttgaccttaatcagctcccgtgcatacaggtcctacattaggccgtatgtgagagcagccctactgtgagctcacagtgccattactgatgacaggaggttgggaaaggtcaagggcatgctaaatgtcatccagctactaagcagccaaactgggatctgagcccagtcactttgacccctcacggtgggctctcaggtatctcagtgactccccctggagaaggtgaggcttgggtaggggagggagtttcagtaaacattcccctggggattctgaaacacccacctagtgggtgctcccatctcccaaaccccatcactggcattccagaggcccttttcactggtctacaatgccaaggtctgccgtgtcttttgggaatgaacaaagagacaagactgggaaccactgtccaaatgggggatttaaggctaaaccctactcatcataactaactttacccaaagtcaacatgaaatgggcgttgacaactgtttcccttgttagagttcagaataatttcttgagaaatttggaagtgcagtgactttctgcagtggtgaaaatgttctgcactgtccaatacaatagcttgtggctattgagtgctagaaagtggatgaccgtgattaagaaacaagagttttcattttatttcattctcattaatttaaatttaaatagcaacatgtggctggtggctaccatcttggacagccatgtctaaggcacatctggtagttacatcttagcaggagggatgctgaattgtgcaaaccgaatgggaagtggagatttaataacataaactctatgaaggggtgtcaagaagatgagactgcaagaaaggcttgctggtccattttatagcctcatgccttcccccagcacgacatccaattgcagcatcctagaagcctaaaggcagccttgggagggtgctagtaagaactgctgctaagaacttctctcggaaagtcactgggatagcactttattccactatctcatttaatcacaggaggttggcatccctagtcttaatttaggtgagaaaacaggatcagacaaataaagcaaacggccttaactccaatgtccttatccattccacaaggccctggggcctggtacctcattcccttattgcaaaaggagaaagacttacgatgtctgtgcctttacagacactctgcaagcagggagtgggggctggaatgtccctcacaggcagtgcaactggcacgatatctacacttacttgcatataagcaatatttacaattaacaaaaaggcagcaccgttgcagtatttaggggaagagttagcttggaatgtactgcggccctcttagtcaagctacgtgtcaataccaggctatattttctgagattgcactggacaagccagacggacttctaatgatcgtcaagcaccatatgattatgagagagggcaggaggggagcaccgcgggagagaaggagagagagggaatgagggcgtatgctgagatgaacggcagtttatctcccagtttctgaatatgcttagcattccatcataatctgcatacatgtggaatttaaggccagagagaacactggaaataatgttatccaagtccctgtaaggaatctgaggtccggagatgtgatcatcccaacatctcacaactatccaggaactttatgcaagatcaatgcagtgttttcaatgaagagaaatgggaaagcactatatttcagcactaactcagttggggcctcccaatggactgggccctcgtctgtcatattcatggtgtaaccctagtgcctacaatagtgctgggcatatagtagacaggtgataaatattttttaaatgaatgagggaatgaaaatattcagccagcagcagccggacacaagggaaatgtctgactgctggcaataggaccggcgggccagcaaggcaaatgtgggaaggaggctctgccttggttggaagggctctgcctcctctcagtgccctccggtccctcgtccacccccacaccagaacttgttctcagatgcagatgagttaggtctagggcaaatacacttgttgaagaatgcagaggctccacagggagatttggagagcagccccagggctggctgtgccgcttgacagaggaggcccttgtgaccacgaagcacactcgaggagcggtggggtacaggaatcaacagccgtggcaatcgccactctccataatgtgcagggctgcacagaaacagcttccaaggtggagtgagtggtgattgtcaggtttgtgggtttccttggcattaatcttcccggagatggagtcaatttgaaaagcaattttctaaagaggctttatcaagagagtcagtgaaggatgctcagctacaatcaaaggggaaaatacacctggctgtgaccagctgcaccagctgtgtgtagaatgagcagagccagcccaggccggccccatcagccagctgggagtgacctgtctaacacagctgcccccagcccctctgggcaccctgaggggactgttcactgagctcctttaaggctgtgccaaaatatgtgatccagctctgaagtttaagtgaatttggaaataaatgttaaaacctggtatcaatgccggaagcagcatgggagtgagaggtcagcgtgtgctcggccctgtgccacctgggggactgtggaccagcactcccgagctgcagaggcttcctgcacaagttcatgcccacctgactctgctacagggggaggagaaaacctcaccatggccacctgctgcgtgtcgtcatgtgactgccacaaaagcaggcatcttgggcacttgagaaagagtggctgtcattgttactattgtgattattctatcaaaacaatcacagccttataactttttctttttttttgagacagagtcttgctctgtggcccaggctggagtgcagtggcacgatcttggctcactacaacctccactgcccaggttcaagcaattctcctgcctcagcctcctgagtagctgggactacaggcatccaccaccaaacccggctaatttttgtatttttagtagagctggggtttcaccatgttggccaggctggtgtcgagctcctgacctcaggtgatccgcctgccttggcctcccaaagtgttgggattacaggcatgagccaccacagcttcataactttatcttacagttgaagattcataacacaagaagcattccccagggcctcctgggaagcaacacctatttcttgacacaaggcagtttaaacacttacttgcaatgatacacaataaaataaagatacaagccaccccgacaaccccaagtttgtcttttataagactggaacactacgattttgcatgttatctctaataggtcaaagaagaactcttttttttttttttttttttttttgagatcgagtctcactgtgtcacccaggctggagtgcagtagcgtgatctcagctcactgcaacctccgcctcccgcgttcaagcgattctcctgcctcagcctcctgagtagctgcgattacaggtacacaccaccatgcctgactaatttttgtgtttttagtagagacggggtttctccatgttggtcaggctggtcttgaactcctgacctcgtgttccgacccctcggcctcgcaaagtgctgggattacaggcgtgagcctccgcgcctgacctaagaactcttaaacctccagaaagcatgcttcattttctgcagcaaatgagctccagatcatggcctggaaactaacaccctgtgactatttaaaatgtttctgcagagcctctttttgttccaccaccaacctcctcctatttaaccttcttataaattgataattcctgagcatatatctcctttttgctttaaaataagaatgtttcattccttttcttctcataaaagcaatacatggtcactgtaagaaaatcagaaaatgcaagtgagcaaatgaagagagaaacaagaaacatctggaaaatactgttcctaggctctcccaatgccacgatgccagccaaaaaaacctgacctgtgaggggagaatggtgttctttctctaccaagttcgctgcctctggaattcacagcatgcttttaatttaatttcatagtaacttaatattctcagaagagtccagccacatgtctcctctctcagcagacccagctcctgtgcaggaagcagttcacatggcagggcaggatcggggcgtttttctagctggcagtctctccgtggtgctaaaaaagccagactcctcagccaacgtgaaaagagttgttctagtgctgggatgatctcttatgatggaaggagagaaatacagattggaccaaacctgagatgaccttcaggcacaccatggctaagggggtttcagtagatggtgacagtgcctcttgttcaggtccccttcactgggctatgcaccaccccagctactgtgggcattggctgctaactgtggtcttctgcctgtgtctctgaagaatcaccctcaggggctatggaaacctggctgaaataagaatacataaaacccatgctcctgcctccaagcaggacaactgtgtggtggcgttgatgctccaaagccagcatggcctgtgacccccaggcacaccccagtgtccaaggcttctaggaaaatgtgtgattcttaacacaagtttgtgtgtttgtccctactcccacctgtctttcggctttccaaggtgcatggaatatgtctttcagtctccctccatctctcccttgcaccctctatcacaaatgcacaccactcactctcaaataagacctttagcctgggcaatcggtggcctgtgttctagtttccccttctcagcctcgctgtcattttccctcccttagtcttagtcgctaaggccttccccatgagcgtggggctcctgggagaaacagatacgacagccaccatagaagattcacacagacaggaacacaccggcccttgttgttctgccagtgaggctccttcttgggactcaaattccaggctcctctgccatgcccttaatgtcaaagtggtcgccggcctacatctatctttacaataacttcttaagggctttttaaagaaagcaaaagaagtgaggtgactgagcccacagatggaatgaggcccatattctgtatcaccaacgatgacataaatatagtcaatagtcctcagacactgtgcagagggatgtggtaatcagtttccaattgctcttctccagagacagataacacctgttttaggttgggttgctcggaagcagagcctgagattgggtttgagtacatgtgctttattgagggagggcttttcagggagaactgtaggagagtgagggatttgggaggggcagaagtagccaagaaaggatgtggaaccaggtatgtgcatgtggcctgacccaccgggggctttggagcatcaacgccaccacacagttgtcccgcttgggggcaggagcattggttttatgtattcttatttcagccaggtttccatagctcctgagggtgattcttcagagacacaagcagaagaccacagttagcagccaatgtccacagtagctggggtggtgcacagcccagggaaggggatctgaatgaggcactatcactatctaccaaaacacccttagctgtggtatgcctgaaggtcatctcaggtttagtctaatccatatttctctccttccatcataagaagtcatctcagcactagaacaactcttttcacgtagcgaaggaccttatagttaattcacagaaacttcatgtatggtgggctgtggtcttatttctagcaaaagtggctgtctcatctctgattcttagccaattgaagaaatattttcagttttccacaaggcaagcaatgccatttttctgccagagtttctacaaattgacttgtaaagggtctgtcactatgactccagtccacaagggtcctgggtgcaaattgggacagaaaacaaattttcttagaattcagctggtgttctgaattcttaagataatagtgaccactgcacttgacaaatgattagtgatgttttataatatctataatgattgccactcagttacagtctttggttgttggcttgtgaatttccttcttgaaacttttcaagaagccctagactacaggaaagaaaagagagctcaaattcaacacagaactcagagccagggtctctcttcctgttatcattctctgcttcctgcaactgtgcttctcaaagactcccaaagcccctctggctcaactctagaaggaaagcccgattctgggcctggctgcttgtctgcctagaaaccctgtgatagaatgtgtcatttccctcataccttgaggttctggatgaatatttcagagtcctccagagaggtggccagaaaacctgcaaaacaaagctgcagtttccccaactgcttttcctagagcctgtgagccgggaaaaaactgaatgcccttgaaacagaaggccaagagactctctgcctgttgttgttgttcttatcagattcaaattcaacatacataaacaatttagacccgcactgtccagtacagacgcaaccagccacaagtggttatataataacatattagattagttaaaattgaataaaataaattgaacattcatttcagcactcacatgatctatgtttcaattgctcattagccacatgtagccagtggctaccatactagagattatatatatagaatatttccatcatcgtagagtgtcctattggccaatgctggtctagacatttgtaaatatactatgtatatgagtatacatgtatatacacatatagacacgttatatatatgtgcatatataatgtatatgtaggataatttatcttgccagcaactgttcagggcaggaattaatagctcagatcatgcaaatacttgcccacaactggactcgtactctgagactctttgtgctaccctacacagctgtccactgctgggctagagcccaatctttagttattcatcaccttacctgttttgtttctgatcttgttctgaataaatagcaccatctttgagaaatccaggttatggccctcattaccccgacccgcaaagttggcttaatgcctgctttccaccaaatggatggtttccccagatcctgggaacagaaagaccaaccccaccatcactggatccccatagctgatggacactccatacatgattcagcatcagtatccgggggtgggagaggggaatacagcagtactccatgaaaccgtttaagtctatatttgtaaagttcctccagagagtattaatgaactgcactgtatgtttcagcaagccctcccaggttcatggccttggttcctagggcaatgcagaaccaaggcttgactccaactgggcacatgaccactgtctttttgtaaatgtgctttacaagatgtgtgtttaaaaatattttacttatactccaaaataaaagccatattgaggaaggatatttgcataggcaatgggccagtacatgtgccaagcattgtgcctggtattttattttattttattttatttatttatttatttatttttcagcacaggaagataatatttattatattttaactagaaacagaacagatagcaagttcacgaggtatgaatatttttttcttaaatcaggcttaaacaacaataataaaaaacaagtctgcatatatatgttggtcactattataatcttcaagggcacaaaagccagcagcataaagaaacatgaataatgactgagaagttttgatgtgccaaaaacaaagatcactgcgttgaactcctttattttgttaatattattattaaacatttaacaggtattaattattgttatttggcaaaatatccaacatgcacatggtattcctacaagaatcttgccttaatattgttaatattaacactaagtttattcctctccaaaattcaatgagttatgattccactctctgtaagtgttagtgttagtggtaatatgcaaaactgattttgtgtgcagggttaagtagcagattgacttcgcatttggtggccagctgtgtaccctaatttttatctattttcttaataaatttaattacatttcataagccctgagataacctgctaatgattgtatacttttaatctatactttattccactcaatttgaaccccacataataagtcttcaaaattatttacagatggttgtaattaaagcaatgacaaaatttactacttgtatagataagactgataataaggcctttaactaagagttgcatattttacatgcacttttaacttgctaggagcaactcttaaaattacatctatcattctgtcagaaagcagttaagtgcttttcattttgcttacttctatatgtgtaaccagactcacttttttcctcccgtgtaaaacaactgttttttttccttccccaaatattaatacttgtcttccaactgaacaattgctaaaaggaacttagcatttacacagcacattgataactatagtgctcagcagagacatatgcccataataggcatctgataaatgtttgttccacatggaatgaattgtaaggcagctgtttgagtcatatactgttcatcatatactgcaactaattttgtttaactaggaaattcagtttaccagatttaattcaccctcaagtataaatccaaaaactttaaattaaaaaaaatcgatttactaatcctcagaaaaagtaaacaagttaatcatagttgttactatgctattagttgatagaaaatttttaaaaattactttccactaaatattgtgtacaactaagtgaggggaagaaagttttaaaaaatgaaaagatattagctaattctcatcattttctccacatttatccttgcagcttatttgttcatatatttattcctgttaacttctctagctgaaagagaattttattatctgaatggagttccccatcaccttacgtacaaaatattagtgaaaagctagtgtaaatgtaagattgtattttcatgtcatgccatatttctgcatttattttttgctagcattaaatttttcgtatttaaatgatgctgtatagaatatgagataatctgccaattgctatgatattgcttgcttacaatattcagtttttgttgatagctttaaagtatattgcacacttgtcatctagcacactaataaataactatttttgaaaggatacactgacaaattcttaagttaatggctttaacccaacatttttagtcagttaaagaacagcaatggcaaaaacattgacaatacagttcatggtccagttctcccatcttacggtacaggttccatcagatgtggtatcccaaaaacaggagctgctgtgcgaaagccatatgcgctcttctggaccactgcacatttcacaatacatttataagcttttcccagcttaggcagatgtgttaacgataattccactatgcttgcggtccactggttgatgttgttgtaattataatcttcaccacctaaaaccccgtctgcacattctttgacaatattgtgggcttcctcagcattgaggccaacctcgtcgcagtggcgatggtactcctccatggtagcgcctgttctccctgggggcggagctacgcctgtgcctggtatttcatacatggtcttatttaaccacacaagaatcatacggccgggcgcggtggctcacgcctgtaatctcagcactttgggaggccgaggcaggcggatcacaaggtcaggagatcgagaccatcatggctaacacggtgaaactccgtctttactaaaaatataaataattacccgggcacagtggagggcgcctgtagtcccagctactcgagaggctgaggcaggaatggcgtgaacccgggaggcggagcttgcagtgagccgagatggcgccactgcactccagcctgggcgacagagcaagactccgtctcaaaaaaaaaaaaaaaaaaaaaaaaagaactatccacaatgacagtgaaacttcgagtgcttaaataacctgcccaagctctcatgagcagtaaacatagaagcagaattctaatccaaatgggtttattctcaaagtctggagtcttgatgttacaccacgcaatcctcaaatgcggtttccttttttccttctttctactgcaagaacctttgagcttctcccactccaagaaggccatctccagaaaggagattgcctgtaaggacagcctagagagtacttgggcttaacctcgctccaactctcgccaaagactcccccaaagtctcctgatcattcattggactgcctttcactggaattaatttacccattttcagcttttctttttttttttttttttttttttgaggcagagtctcgctctgtcacccaggctggagtgcagtggcgcgatctcggctcactgcaagctccgcctcccgggttcaagccattttcccgcctcagcctcccaagtagctgggactacaggcgcccaccaccaagcccggctaatttttcgtatttttagtagagacagggtttcgccatgttagccatgatggtctcgatctcctgacctcatgatccgcccgcctcggcctcccaaagtgctgggattacaggcgtgagccactgcgcccggcccagcttttcttaatggtagtaatggcagtcatattagcaacagcttctatttatcaaagcacttagcactttgaaagaaagacattatgagttcctgcctcagtctgggttgtcccagaagtccaacctgagacaagacttgggtgctgacagttttttgagaaatgatcccaggtaacacaagtgaggaattggagatgtaaaataaggaaggggagaaaagccaatgaagagtgcattaatgagcgagttgccaccgtgggcagctgagctcagtcccactagggacactgagttgtcacgctgaggaatagagaaaccggggtaaaaacctgtcagtcactgggagagagctacccctcaaaggttaaatccctgccacctttgggccgccctgcacgcaggctgtgcaggcttccacggaggtgggaggaagcccagggggaacacggggagattctcgtgcctggggtgggaagcagtggacgtgcaagggagcttcagctgcaggtgaactcagaagggacttaggagactcaggagggacatcacagcatctactacattctccttccacacagaaggttccaagcgtaagtaacttgctcacagccgggcgtggtggctcacacctgtaatcccagcactttgggaggccaaggcagctggatcacttgaggccaggagttcaagaccagcctggccaacatggtgaaactccgtctctactaaaaatacaaaaaattagccaggcgtggtggcacatgcctgtaaccctggctactggggaggctgaggcatgagaatcacttgaacccaggagctgaaggttgcagtgagctgagatcacaccactgcactccagcccgggcaacagagtgggaccctgtctcaaaagacaaaaaaaaaaaaaaaaaaaaaaaaaagagataagtaacttactcaggctcacacagccagtgtgggaactaaacccaggtctgattgatcaaccccaaagcccttgccctttccgccacctgaagctgccctcaaaatcccttgtaaggtgcacccaccactgcttatcctatctcctcttcactctgccctcaggaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatccatgtcctatgtgtgactctaaattctttatttctgtcattcaaatgggtgatatcctgaaaaaaaaaaaaaaaaaaaaactgggacagctttcccctcatttttttttttgtttctgagaaaagaacgtattttaaaagccacatagagtgactccaagaacaattgtccatggtctcaaacaaggggctgttacataacaagaaaatcaaagctgaggacagggtgtgagcgccacatctctgaaagcacaggagacactgtgctataaatcctttggggagcgatgttttgaatttagtgagatttaccagggatgtagattaaggtgatgtgattcaaaagatgccattcatagagagccctagttactgcatggggaaagagatccaggaagcatgagtgctggatattttactaccaatgccaagataattcactctactcagccggcgtggcaaatataaaacttacagagcgtggctgtgctctcaccagctgctgctctgagttatgttaaaatccgctagagcagcccaaatttttctcagtttgtatagagttcatcccagccccaattttctggggctcctcacatagctacccaaaagagaaaaaaaattaagacaagcctggcaacacacctggtgaagagtagtttactagcttttcaaacaagaatgtcccttttcctaagtcactttgaggtgtctcaatctgatctgagtgagaggcgacaggagtatttttttttttttacagctttacacacacagatgtgggctttgatttccaagtaatataatggaagagaaatctcatactcccccacagtttgatgtcattaatgtgttgggaaaaaggcctctgtcccggaagagtcatgggaggtgaaaggggcacgtttgaagatgcgagcgctatcttcacatagttctccagttgtatggagcctcttctgccaagagagggccatgcaattcatcccagaggaacctgaggcctgaaggaggtgagagaagacctctgtgaggaaagcacacagtcaccttctcggcaactaagcagtccctgagaccatttaacatgcaacccgaaggttatggtcaatcccaaaagtcaccactccattcccaactagacattaccaaagtgacctacccagagattgcttctcatccccagtcccaatgcacatccattcccaagaaatgctttgtcttcagcctctccaggcaccatctcccttcctgtgggagcagagagcttagcctggagcacctttccttcaagccagcaacacagagcactaggttcaattccctgaaggtggccactttaagagagaaatctgaaaaccccatttgctttcttttctcccatattggcatggatttctgtcttctctaacaccttgtgaccttctctatatcatgctttaaagtgtaataatatgattttttaaaagaaatttattacttgttgcaaaggtctttttaaaccagtttagatttcaagaaaaaataaatggaaatcatcgaaaattcatttcacattaatggtctaaaaataaaccaaaggacattatgtgtgcatgtgtgtataagtgcacacagaaatatatatacatatgtagactatatacatgtgtgtatatatgtgtatatatacatacacttgtataaatgtatatacacatatacctataatgtgtgtatgtgtatttattgaagaaacagataccatactcatttctaaaagaatattcagagaatatcaagatgattctggctgaaaaaggccagtggaaattcaggtgaaaatgttcatcaattcccattgcatcacctctgtaatttttcagctctctgtataaacattaaatgtcttatatagcagcaaaaatataaaatagttgtccatattttcacaggtgtggtgtaatttataaaattagaaagcaacttatcagctacttaagagaaatggcaagttttgatatgagtatacaatatataaaaatatatatagtgctatatatataaatatttggtctctatttcattttttgcatcagtattaatactaaaatatgtctcgctagtgatgtttttatgatatccctgatcctaactgaagagacagttatttatagtcatttattttaaaaaatgaaaataagtgaataataattaggttaacattgttgctccctgtgacaaaattttataagcaaatttcaaaagacatgttgtaaattaggaggctcaacaataaaacattatgctccagaaattatgtgagatgtgctatattgtacatgaaaatactttcatccattctaggaacagataatttaaaaattgccaaagagagatctaaagagcctgctttactaagtatgcataaaagacttataattaacatataaatcatacacaaattattatctacagcagtatttttcaaactctagttacatccattagtgggttgtaaaatcaatttaggaggtcagtttttaataaaatagagtaatttagaatacagtaggagagaagaaaatcacaggataggataggatagaatagaatagaatagaatagaatagaatagaataatcatgcataataaggataagtattgtttcctgaaatatttgtttcagatgtgtgtgtgcacacgtgtgtgtgtctgagtgtgtgtactggatcacaatgtaaaatacatttttcattgtgagtgatggtcaaaaatcttttagaaacactattctaaaatatattaatcaggctagactaagttatgctatagtaacagacaatctcaaaatctcagtggtttaatacaacaaaggtttatttatcatccacacaaattccagtgaaggttcaggtgactccccaaagccacagacctccatgcagtgactcaggatccaggctgtttcaccgtatggtttgtaatcatagcacaaggctgctacaatcaccatgcagaagagaacccaaggaggacattcatctgctcttctatgtttagcctgaaggagacacatgcatcgcttctgcccattgcccactggccagtattgggcaatagccctggctaaatgcaaagcaactgggaaatctgtgacaactaagggaatatttggtgagcattagagtctccactacagagagtgcttgacattcccttaaaacatgttcttaagaaccgatttaacatggcaatcactcttcatggatggtaccatgaacattattacaaactggctgtaccttaccccatagaccacagactattctagaaaaagaccttaataattattcataaaatattaatatactatatttaccaaagttaattataaaaacaatttataattctgtcctctgatataacacttaaactcaattattaaaatcttagccgggcatggtggcatgtgcctgtagtatcagctactcaggaggctgaggtgggaggatagcttcagctcaggaggtagaagctgcagtgagccgtgatcacaccactgcactccaacctaggtgaagagcaagacactgtcccaaaaataaataaatataaacagagtctgttactaaaaatagatattggcggatataaggtccaaggtttgatcttgtgatcctgagacactcctttttaatacttaggtttaaagatggatttccaaaagattaagtttaaaaaatgatttttaaaaattccgatagagttactactctatgtcttcattcgtatcacttataagttaatgcatggttttcatgtgatcagcgcatttgcttggagtgattatatgaaaaccacacagtgtaagaccttcaggacacataagtattttatagttaacagaaagaagtgctgaattaggggaaatggtgatctcacagctaaagtgtttagatgcaaatagtctaatttggtagaaatttctaaaaagcaaaatgcaaagataaaggacagtggttgtggaagagagttaggggatccttaaaactctggaattgtgaaatgccagagacagaatgtctcctaggctaatgtaggtggttcagttgtggccagcagggtggttctttgtctctaaagaataagtcaagagaaagggtgggaggatggagggcactcagcacatgggagcttagaataaatgagagtcagggtgaccaaagctggaagacagtgtctggcagcattcagggtagggaaacatgaagcctgacataagggagaattccagtctctgaagagctgaagtctatcgagggatacaggccaatacattggcaaagccacccccagagagagtgcattaaaacaccaccacttgccaatggtcccattgcatgctcacccacagcctcctcatgccttatgcagcttcccaagaacattaacaccggtataaacgatccaagcagctagatctgcagaaaacaacaccctctctttgaattgtaaactaatcagctagtacttgagtttttccattagtctcttgtgcatttagttgaaccctttccttggcttcaaaaaaccctgatcaaatttggtttaagatgtataagggacctggaatcaaagtctgagaacctagggtaaattctccaagccaaggtcctggctccatgtttctcttagaactgagaagagactcacgtttgtgaacctgggaatagaatgatctcaggtgagggatgcactcagcctaaaaagatgaagattctgtgtggctaaatgtttaatgctcattcatgcatgatttgcggtgggatgggatgggaaggcaactagaaatctcagctcacagagtttcaggtgccagaagagccacatgaggctggtaattccttaggcctaacgtcactgttactgatttccaaccaggaggctttgggccaacctgccctccccatcccaagatggggtgtgccagctccccatcccaagatggggtgtgccacctcacaacaccctcaaagatgtccctctgaatctgagaggatatcccatgagctactcaaactagatggagggaagaagctaaaatttatctttttcttttctggcaccatgtcccaggaccactgatgggccacaggtgacaggcaagctcctggtcacaaggatgcaagcatgagggtaaaggggcaggtacagctggtgagggcatcagcccagtggagtcattgaccaggagtgtatcttctgataaaataagtttcaactcaaaaactctgtttgaatacaacataagtcagtgtggctttttatgttgtttgcttgcttttatccatgcctgagaaaatggagtcaggtattgtaccaatcaagataccaatcatcaatgtgccaaatgccatgtgagttttggggtgacttcattcaccagcagtgtcctaaccacaaatctatgttagaaaaattttaggataaacttgatagtaatggctgcttgaagattttgtttgtttgtttttcggggttttttttcatttaggttttgtttgttcgtttgtttgtttgtttttgagacaaagtcttgttctgttgcccaggctggagtgtagtggcatgatctcaggctcactgcaacctccgcctcccaggttcaagcgactctcctgcctcgacctcccctggtattacaggcgtgtgtgaccatgcctggctaatttttaaaatatttttagtagagatggggtttcaccatgttggccaggctggtgtcgaactcctgacctcagatgatccacctgcttcagcctcccaaagtgctgggactacaggagtaagccaccatgcccggccagatctttcttataatgtaagcttcaagtcgaggagagaactaaatggaatttcccaacatgaaggtggaaggaagagacaggttccaatgccaggtttagaagtgtcttctgagatgttaactgaattttgcggcagactgttggtgcatcctctgtatcagggagtctgcaaactatagccaaacccagtacgcggtctgcttttataaatacagttttgttggagacaactgtgcttgtttgttgttgtattgtctatggctgatttcatgctaccacaagagagctgagtagttacagcagaggctgtgtggcctacaatctggccctttacagaaaaggtttgccaacctctgccctatatctccttggcccacctaaaggttatctgtaggcagtttccatgcatgccaaaggccattctatcactctgcccagctgcagaaaagccccagacctcgtgtggagcaggccacaggtgatagggcatcagtgccctagggccaccctctcctgaggagaaatgggatggagagctggtagacggatagctcagcttcctcacctcctgcttgggacaatttgaagatgttccacccgctctcttgaagggtccccagtgggatggagccccagctgctcacagtggtggccacctcattaatgccccctgcgtggacacatccattccccatctcatgcctcctctttctccagtcaggagacagaaaccataccagtggttttaacagagagaatttaatacaaagtaccatacaattagtataatgaattgttacctagttaattcaaaaagcaaaagaaaacacaagaatcacatggaccaaaaagtccaacatttgtgggagtggggggctcacgcaatgaagatgccctcctggctcgggcaggatcctaaggcatccgtggcaccccagcctgccttacccacccacagtgcccggaagtggagcacaagtgcacgtgttaggacctgaaagatggggagttaagacctggcagagtgaagccagaggaagctcaggtggaggtctgtagtggtcccaatgtgcaaatcagtcatctgacttgggtacaggtgcatgaggccaaaagattagagaaaccacccagcagctggttcatgccaagatttccctcaggaccactggcactctctcaaggaaacccatgcagattttttcttgtaaaaccaacgcttacagtctttagggagaagcccagcgggtggtatggcgctggttatggaatacaagtgcctagtgggccacttcttgtcagcagaccttcaagaagcagctagctaccacctaagaggagaggttggaattaatacaacttggaagtctcagaggtgggagtgtgctgggacccagaccaaggaggggcatcagcaggctagtgcaggtatctctgcagagactgcgatgaggctggtcctgcaaatgctgggaaaatggagaactggactcagctgctgctacaggaaggaactgccactgccagggtgaagaagctgtctcagtccatttgggctgctgtaacagaatgtcatagactgggtaccttataaacaacacaaatttatttctcactcttctggaggctgggggatccaagatcaaggtgccagcaaattcagcgtctggcaaaggcccacttcctggttcatagatggcacctcctcactccgaactcacatgctagaagggatgagggggtctctaaggtctctttcataagggcactaatctggttcatgagggctctgccctatgacctaatcacctcccaaaggccccacttcctaataccttcaccttggggtaaggccttcaacatatgaatttgcaagggacataaacattcagaccacagaaggattgctggggtggtgtggacaagagcagaaagcaaacaaaagccagcgagtgccttcttcctcctccagactttcagtcttcccccagctcccctctaacagcacctcccagggagcagctggctaagcaggacctggctgcagagtcccagccccagcatcactgggtagagaggggcaggtttgaagcaagagacaggagcttactatccttcctgcgacaccaccctaacaaaccgcctgcacccaagacctttctccgggtctgctttgggggacaacccaacttcatccaaacctccttatctgttgatacctaaccttattacttagcagttatctttggggttacaagcaaagaaaaccaactctaactagcgaaaacaagtaagcagtatgtcaaaaacatgtggtgtagccctcaggcctgaagaaccagccaacaccatcctagaaaaaagacagtgattggagcaaggctggggacccggaaacacagcaaggattggcaggcaaccttgccggggtctcaggcggcaagtgccagcacctgcagcctgcgctatactggactcagatttctaatttcattgagggtgaatctgattgggctggtccgggtcactggcccaccctgaggccagaggaaggcagaatatcttgatacattagggttgtatccagtgtgggaggagcggctactcaatacaaaatcagggctgtcacctgagggacgggaggtaggagtggcagatgttagtctgctgtctcaggttgggtcctccagaaggcaaccctgagacaaggagtgaagggcaagtcatttatgtgaaaggaagcatctatatcttgagaaggaaagtgagacacgaaaaggaggaggccaataccggaggcactgatcagtgcatttcttcacaggcatctgaggctcaaacccactggggagctccaagagactatgtagaatatgcctaaaagttaccctaacagcagagtgagagggctggggaagagacctgctcctccaggtcccgtccacccttgattgagggctgctcccgggagcatgaactccccaggacaaccaatctgcccaggtatggaccaagcatgtgcctgtggccacaggaaactctaaggcagagtcgcacacgcctgccgcgagaagctggagtgcggtgagacttgggggatctggcgagacaccctgggtggctgatacaacagcagtgacgggtcactgactcaagtgctgggaagatgagtggggcaggggctaccacacagctgctgtatggagcaggcactctgggagagtcttgctcccaacagacccaaagctgcctcagggaagaggagaccgaggccctgcatggatgctgtcgggaccctgcatggatgctgtcgggaccctgcatggatgctgtcgggaggcctgctctgactccatgttactaacaagaaactctttatgaaaccaaagatttcgtgcgtgtttcaggaccctggggagagagaaagcccagaaatgaacccattctgcagctctacagaagaaaacagaactagattgggaaacagaactagattgggacagtggagtgtcaagaaaatgagcaagtgagtcaaatccctgggacccttgcacagtcagagcccaactaggctctaaagcgtgcactgcagccagccctgcatttcacagtatgggctcaaccttcaggctgaggtgcacctgccaggaaatggtgcttacctggtccctgcctcccaccctcacctcacctccttccattgtccccctgcagtcccctttatgtctccttgaacaggccgagttcactcctgccccagggcctttacacttgcagctctctctgcctgaaatgctctaccctcagctctgtatgtgatataccccatgttgtcattcaggtcccacatcaccccttcacagggtcttcccttaccacccaatccaaactagacccccagtcattctagcaggtcacgctagttgagtcccttcatggtagagtctctgactttctcttcgctacccgcttgcatggcgtttccttcctcccccactagaacatcacatctgtgagagcaggaccacgtcccactgttccttgctgtctcccagtgaccaggaccatgcctggcacagaacagatcccaatccatttttcttgactgattgaatataatataaaaatgacctttctttctaaagcaataccccctgccttttaaaataatataaactgaacacatagttcagaaaataaaaagacccaaggaggaaaagaaaggctttgcagtggctgttgaagctgaagataatagacacacaggcccaaagcctagtacatcctgggctccagctaatggtttctatcattctcccttaagcttttaagttataaatatttcaaaactcagtggaatgggttccccattcatcttttagaaaaaacaacaaaagcctaattctttcttgaaatccaaacctcaaatgaatttggaacaagattgtttcaagctctaaatagaaaggaaaggtgactccatttagtattatattatttgtaaccaagaaataacagaatgtaatttgtgactctgtcaatttcctctaataatgtgtagttgtctcaccagatgctttttgtaggccgatactataacccatttaaacacatttactcagctcccttaatgtactttggtgaagctacacagggaaggagactttttttaattggcataacttatttttggactgtgagtacaaagatagatactggagggcaacatagacatttgtgtaaagattctggttttgagtaatttctgtgttttaggatgtgacacagtaagtacctgtgtgcatgtgtgtgtgtgcacacgcaagatcatgcacactcacatggccactgctatattatggtaattgagagcattgagaagtctgaaaaatcgccccttaatggcacagcacactgtcaggcacatagtacatgttcaataaatgcttgctggactaattaactcacttctaaacaaggaacttacacagtgacacttcaccttgcttcttgaaacctgacctaggttgcaatctctgagtgagaaaattttaagtatctcatactaagtacatttggtacccatatggtggcagatgacactggtgcactgcctatgaccccttgacccttagtacttccttgtatttccaggcctgacttccaaatgccagcacctagacatctttgcctgagagctttcttggcccccagagagcacacctcccactgactgccaggagctggaggattaataccccagctccctcacccctcagggaggctgactctgaggcacgtgatctatgctgtctgccagagctcctcagtggcccctggtgtgagctgatttggtggtaacgtcctccttattggttcccttctcttccctgccttctccactctcctacttgtgcatcctaaattcatcttccaatgaaacttcgcattctctgctttgggatcagcttctgggggaatccacattaagagagatgcctttaataatttcatctctagcaaaacactcatccacataagcacacacttgtgcttgaaatggaatgaagatgagccgatgtcatcaaccagcatgtttctgtgtgaaatccagatgctatctgagtctctaacgagacttatgaaccaggatgaagagcatgtctctttcctaaatgaggacggtatggtggccatttaacagagcatccctgtcctcatgaagctgacccacctacattcccaaggtccctattaattagacaaaggatgtgcaagcaaagaaaacattttaatgaaggcttcgttggcaatgccagatgggtcaactatggtctaatccaaacaggaaccctcacccttttatcatttgctctaaaatatcaaagcattacccctacagtggccccaaatacattttatcccatcaagcctgggcattttaagagctcttctctcctgatttcttcttgtctgactttgtctttccaatcatggtctccacgatcacagcggtttcttcatatgtctgaatgctctccgtggaaatcttctcgatagattccaccacttccactgtcttataggccaaagccttgggagggcctttttctggcaggcttctgctcctagtcccaagcacctcagctccatcctgatcagccgcaggctttggaggctcaggtatagatggttcctctgcaccgggtgtgaccatggcacagggtctcctggactcttcgtcccgctcctcaccctcacgtttctcttcagggccttccagctctgcaccatctggctcaatctccttgtctataggctgctggtcaattggttgtccatcttctttctcctgcagacccacctgcccattctctaaagggggcttgggtgactcaggagagggctccacctggccgtcataaagcacagagtcttccgcaaca

SEQ ID NO: 339 - DNA, 154432 bp, Homo sapiens
aaccacacaactacatggaaattgagcaatctgctcctgaatgaatgactcctgggtaaataatgacattaaggcagaaatcaagaagttctttgaaatcaatgagaacaaagaaacaatgtatcagaacctctgggatgcaggtaaagcagtgttaagaaggaaatttatagcactaaatacccacataaaaaatctagaaagatctcgaattgacaccctaacatcacaactaaaagaactagagaatgaagagcaaacaaatcccagagctagcagaagacaagaagtaactaagctcagagtggaactgaaggagataagagtcatgaaaaacccttccaaaaaaatcaatgcatcccgtagctgtttttttttttaaatcaatgaaatagaccaccagcgagactaataaagaagaaaagagagaagatttcaaataaacaccatcagaaacgataaaggggataccactactgacgccacagaaatacaaccaaccatcagataataccataagcacctctatgcaaataaactggaaaatctagaagaatggataaattcctgcactcataaacaccctacaaagactgaaccaggaagaagttgaatccctgaatagaccaataacaagtcctgaaattgaggcagtaataaatggcctaccaatcaaaaaaagcccagctcccgatggatttacagctgaattccaccagaggcacaaagaggacctggtaccattctgaaacaattccaaacaattaaaaaggagagatatctccctaacccattttatgaggccagcatcttcctgataccaaaacctgatggagatacaacaaaaaaagaaaactgcaggccaatatccctgatgaacatcagtgcaaaaatcctcagtaaaatactggcaaattgaatccagcagcacatcaaaaaacatccaccatgatcaagttggcttcatccccgggatgcaaggctggttcaacatacacaaatcaatacatgtcattcatcacataaacagaactaaagataaaaaccacatgattatctcaataggtgcacaaaaggtcttcaataaaattcaacatcccttcatgttaaaaactctcaataaactacgtattgaaagaacatacctcaaaataataagagccatttatgataaacccacagccagcatcatactgaatgggcaaaagctggaagcattccccttgaaaactggcacaaggcaaggataccctctctcactagtcttattcaatgtagtattggaagttctggccagggcaattaggcaagagaaagaaataaagcgtattcaaataggaagagaggaagtcaaattttctttgtttgcagatgacatgatcctatatctcgaaaaccccatcatttcagcccaaaagcttcttaagctgataagcaacgtcagcaaagtctcaagatacaaagtcaatgtgcagaagtcacaagcattcctatacaccaacaacagacaagaagaaatgcaaatcatgaatgaactcccattcacaattgccacaaagagaataaaatacttaggaatacagctaacaaaggaagtgaaagacctcttcaaggagaactacaaaccactgcttatagaaatcaaagaggacacaagcagatggaaaaacatccaatgctcatggataggaagaatcaatatcatgaaaatggccatactgcccaaaggaatttatagattcaatgctattcccattaaactaccatcgacattcttcacagaattagaaaagactaatttaaaattcatatggaaccaaaaaacagttcacattgccaagacaatcctaagcaaaaagaagaaagctggaggtatcacactatccaacttcaaactatactacaagtccacagtaaaaaaaaaaaaataaaaccagcatggtactggtacaaaaacaggcacatagaccaaaggaacagcatgcagagctcagaaataaaactgcacatctacaaccatctgctcttcaacaaacctgacaaaaacaagaatggggaaagcactccctattttaaaaatggtactgggagaactggctagccatatgcagaaaattgaaactggatcccttccttacaccctatacaaaagctaactcaagatggattaaggacttaaatgtaaaacccaaaactataagaaccctagaagaaaatctaggcaatactattcagaacataggcatgggcaaagactttataatgaaattgccaaaagcaattaaaacaaaagcagaaattgacaaatggaatttaattaaactaaagagcttctgcacagcaaattaaactattatcagaccagacagacagcctacagaatgggagaaaatttttgcaatctctccatctgacaaagggtgaatatcaagaatctacaaggaacataagcaaatttacaagaaaaaaaacaaccccattaaaaagtgggcaaaggatttgaacagacacttctcaaaaacagatactgcagccagcaaacatgaaaaatagctcaatatcactgatcattagacagaggcaaatcaaaaccacaatgagatactacctcacgccagtcagaatagcaatgattaaaatgtcatgaaacaacaaatgctggtgaggttgcggagaaataggaacacttttacactgttggtgggaatgtaaattagctcaaacattgtggaagacagtgtggcaattcctcaaagatttagaaccagaaatatcatttgacccagtaatcccattacagggtatatacccaaaggaatataaatcattctattgtaaagatccatgcacgcgtatgttcattgcatcactattcacaacagcaaagacgtggaatcaacccaagtgcccatcaatgatagactggataaagaaaatgtggtacatatacatcatggaatactatgaagccataaaaaggaatgagatcatgtcctttgtagggacatggacgaagctggaagctgctattctctgaaaactaatgcaggaacagaaaaccaaacaccgtaagtgggagctgaacaatgagaacacatggacacaaggaggggaacaacacacactggggcctgtcatgggagggtgctgggaggagagcattagggaaaagagctaatgcatgctgggcttaatacctaggtgatgggttgataggtgcagcaaaccaccatggcacacatttacctatgtaataaacctgcacatcctgcacatgtaccccggaacttaaaagaaaatgtagaaaaacgggtagagaagagtgatttacatacttcattttccaattagtgcatgtgaaaataattcatcttggtagtattgtccagatactatctcttcctgtttaggtccaggaacagtctgcttgtgttttttattgtcaaatgagttgttctctaatttcatctctcactgggagaaaaagaataacaatactcatactcaaaatgctgtggctgtttagaatctgtttatatgaaaataatatagatcttgcctctgcagttccctaataccattcattgatgttgtttgtattattcgtgatgctgtttcatccattgtgttgcctgtgaatattggtttccaatgactaaaggtttgttagtgtgctttgttgatggtcatcacaaatgcaagtgttccatggagtaggaagaaaaaaataggaatgataatttctggtcatgttaaatttatttttcagaattttataacttagaaacacatctttcagttatacttttcttgaactcattagatcatattcactgcattcctaaaatgtgatccctttcaatgttgacctctcttctgtcccctattcccccatacagccaccagcagaaaggagagatgagtaagaatgttctcattggcacaaggaatgtttgtccctagaatggcacagcttaagacagaaccaggaaatcacaggtttaccacattgatgagaagcaggagaaggcttgattggaaaggcccattggtgttgctgatcaacaatctagaaagcccttagaggacaggcatagttaacctcagaaaactctgtgacattagctagtgtgctttgtggagagagtcaggtaagtaaggggtttggagaacatgttcaggttcaggaacattctacacttaaatgggcttactcttaccctctgcttcaatccccatcccttctacaggttagatcttgggacagcccacatacctagacaaacttaggctttccagcttgcactggaccagggtggaaaggtaaggaaaagaaacacatccgcaacattttactgcttttttttagatcaacctcacccatttaaggagtgtggactgacggctatcacattacaaacagactgggttgaattagaggtggagaaagaggctgagaatgtcactttaggggtgctcctccatatggagacacaggagtgaggaatcaatgatttctcccaacagcttcaaacagatagatctattgtgtgaatttcttggggatctgatcttagtcttgtgacttctgacttcttacatgttgattgtttcctcgtgtgtcttgaaattatgaattaagaatttttcttaagtagtgtaatttctgtggaaatttgatgggcctgtttgaggatgtgttattccaaagacattctgcctttgcttttgccagatgtacagaggacattactggcatgagacttctttttgtgcttacaatttaatgtgggtagttccagatcatattcaaactcaaatctgtgtgactatgaggataaacccaatgtaaattttttgttaaccagggcccagattaagacagacatgcttcctttatgtttccctgtgaatctgagtgggttcttgcctccccatctcacacatattcattgaggatgtagctcttcagaggtttcagccttactgggagggccattccttaaaggcttcctggggtctcaagaccatgtttcctgtgtgaaagttgtctatacaaaaatggagtcacttctgtcaaaccgtaaggaaagagagcttggagaccatgaagggaggaccttcttacatgtttgcatgataacagaaactatcacaacagattgtcaaaaccacaaccttgtacaaagattacatctataaggatgcctgcccagcagctgtctgtccactaatgaactgatgccactcttgttattaatccttgtagccaaggatatcatttcaaaacaacgaatgtaacctccttcgttttgcctttattttcatattgttttgaattatgtgtaagtaataatataatttctgggttattccaaattcccttttgtaagttatccttaagttatttcgcacactgctaagtttaatttaacctagctagttttgtttaataggttaaaaggaattaaattggttttaaaataaattatgctgtgaataataaaaacgctaataggaaatatattccattaaaaaaaccccttgtcttctttgcttctctggatgcacctatggccctctatagcatgtatatctgattacaatcccctgctattaccagataaactctgatctggaagccagtctctctgctgtttattttaggttgacaccagctggggtgggcattaaaccctttatgatagaggtctgcaaattgtcccaggtctgttatagcatcgcttacatgctttctacttggatatttaattgtctttgttttggcctctgggaatttcccttactttcttaagagctatgtcaaaggatatttgctttattttataaaacataagtatgaaatatttatactttataaatatacttttaatactcatcattcataagtataataattttgtaagtatttaaataagtagtagtagatgtttcaagttctctagtctgctacttttagatctttagatattctaattcttctgcctggaacgctcttttcccttttcacttgactaaaccagaggtcacatccttaaggaagctgtgagcttcaagtttgaattaaataccctccactctttaccctcagtgcatagatctaatggcttgtttgccctcgtgtgtttcctccactgaactgcaagctctgtgagcccatgcctatttagtgtaccctagcttgacacttagtagagaaccaactatttgtgaatgaatgcatgtcttctgttgacatgtttgcttattattattttttttaatcctgcctcttggcttgaagttgtttgtttccatagatttttagccttccgcctttatgaattttcgttggtgtctagcaataaaagctcccactgggagtaacttcacactggttgtcaatttattaatgaaagcctggcaactaacatgtttttcacagtagaaacagaaatatatttttctaaaaacttttttattattcagtcagttttttcatattacatttcagctcttgttcaactgaggattcttttaaaaatgctatattgatttttctattgcccttcactaaaattaccttcttcattataaaaaactcaattttatgtcaggtaagaaacaatgggaatctattcttttactccataggtatttgttgagtcccttcaaagtacaagaaagaatgcagagagatgctggtagttcaggaaggctgtgtaattcaggtggggccggggagaactgaatgtttctcgaggatggagccagagtagaaaaagagcagcagaggctccagaaaacaaagttacagtcctctcctcatcttccaaggagtgttactgatttactgattcttttctataggttttatttttaattgacacctagcaattgacacctagcaattgcacacatttatgggatacagtgtgatatttccatatatatattatatatatatatatatagcataatgatcaaatcagggtaattgtctaatccatcatctcaaacatttatcatttctttgcagtgagaacattcaaaatcctctcttctagttatttggaaatataaagtacaatattgttaactatagtcaccttactgtgcactagaacaccagaacttattcctcccatgtatctgtaattttgtatctgttgaccaatctcttccccttcccgaccccccaaccccagcctttggtaaccatctacagtgtacttctatgagatcggtttttaaaaattccacaaattaatgagattacgtggtatttgtctttttgtgcctggcttatttcacttaacataatgtcttcaggttcatttatgttgccacaaatgacaggatttcattcttctgaatggctgaatagtattccattgtgtatatataccacattttccttattcattcatcctttgatggacaattagggtgattccgtatcttggctattgttaatagctgcaataaacatgggaatgcaggtatctctctgacattattttatttcttttggataaatacccagtagtgggatcgctggatctacttatttgtcctttatttaaaattattttattttttagcgataaacgtcccactctatcacctaggctagactgcagtggcttgatcttagctcactgtaaccttcaacccctgggctcaagcaacccttctgcctcagcctccggagtagtttggactaaaggcgtgagccaccatacccagccaacttacttattctcataggctcagtagagcaactttagtagctatttctgtaggcttttctggagagagagagagaaagagagacagatagagagcagttgtagctgaggtagagttgatgaccacgtttcatggcagatcagtgagaccagagaattcctgactttcagagctgggtggtaaagggggaagtttgcttcttacagttacatgctgattggtgtcatataaagccttaaaacactcctattgggtaagacaaaaatgatatgaagtggaaatgtgaaaaatagctttgcaggtagttagtatcaggtatattaaagttagaaactattatgaaggttggcatggtggccaatgcctgtaatttcagcactttgggaggccgaggtgggtggatggcttgagcctaggagttcgagatgctgtctctacaaaaaatgggtgtggtggcatgggcctgtgatcccagctacttgggagactaaggtgggaagatcacttgagcccaggagacataggttgcagtgagctgagaaagcatcactgtacccctgcctgggcaacagagtgagaccctgtctcaaaacaaaacaaaaaaacccaaaccctgttattatagttcatgttcagtgtttttttctttagctatgcaagcttgtccctgagattccagtttaggaagaggaatcctaaaattgggattgccgttagataactgaaagaaccaactcagttcctgtggctactgcctaaaatccctttgtccaccataaacacacctttgcacaggtgtgtgcacatgcacacaaacacacatacttaaaatgaggaaagccaggaagagaaatcacatatgctagtcagtcagatttcttttgattaaaataatcatgatttttattctatttgtaacttgtgggttttattttgaacaaatggtttgtgaactggaaacatgtttttctgagctataatctgaatacagcttaaaactgtgaagaatattttcttcaagttttaagtatttcttctaatttaatgttatgtgccttaagaatagaaaatcataggctgacatttccatatatcaaatgtaagaatccctgtttgctaagaatgctacagaactaagagcaacaaagcaggttcaagagttgtcaaatgtgtcccttttccataggaagggtagatgtctacccaaatggaatattgagtatcagagacttcaaatgataacttttgtttgtttggagaaaatcttgaggacgtgatcactgtacaaaaggtaataagcaagtcttaaacaattttcccccctaccttttattttctctattgatttttttccatttatttttatttagccactaaaaatcttaaaaaaaaacacacagttttattagttctttatggtcaggaaggaagattacttctttaaatataactaaaactctggcactctctagtggtcagagaatctaaaatattgttctacatgagcttatactttacttcttcctttagctttatgaattagacataacctagatattctgccccacatgaagaaggcttgtctaatggcaaaataatgaaatcagaaattctgcatttactcataatttcacacctctagactagaagcactgagatacagtggtgtgggagtctgtgaaggcattttcttagctattaccagatgaactaaattaagaaatgttaactgtaaaaactcagacaaaccaaacctgctgggtgagggaattcctgtctctaatgcttccagatagcccatttggcttgtaagagtggatttgagacctttataaatttaaattcaaaaagagaactaaggaatagaccccttgctttgcaactagacagatctgggctcaaatccagctcatgccatttggccaagtattcagctccaagcctcagctcctcatggagcatcaggctggtaataatcaccctccaaagagtcattattgacttgaagtgagaaggagatggaaaacattgcccccaaattggcaacaaagagtattaataaaaggaagactattattgagaagagtctaggctaaggaaaggattacttttcttcggctaataggatcacaggttagcttgattaaagtctctcaaagtattgggcccattctctctgcctaaaatccaaactcccctattaattcccctcccttaaaattcagagtcccctaataatcacacagtattcatacctacttgatcattctttttatttttacaaagcatggcaaaatgaggaaaccactgacaggtgaagaatttgcacaatggaaaaccaccttgaccatctcatgactttatacaggaatcggaggtaagtgttcctttaaagtgattttgtcatgaaagagtcatctgaaatgactctcgtgatggaggaaaggaaagtaatgaaatcaacattcatggttatttaaaatgccttaaaagctaagcataatatacatagtaactccttttcctagtataaaaatagtgccagaaactatatttgttcaaatatattgaaaaggtataagaatacaaatagatattaacagtggctagtgatgcctcataaggttttcttaaactgtaatataaatttatattttcaactatttacattgctttcaacaacattcattaagacatgtttacacaggcttttagtaagtatatggaatggtaaagtgagctttaatactttcttcttcactctctgtagtagagcagaaggggtccaaaaccatgcacaatttaacagtccagaagaactgtgtaatctttacctggctagcacatggaaaaaataaactatatacaagaatacaaaactcctaaagtgttcttcaactatcagcaggttaagtgattcatacttgcaaaaagacaggatgtttgtttactggtagattcttagtaagtttcaggtaaagaaggtgcataaaacatatgttattgatgaaaatggaaatgatgcagtataccccatgttctcacattaaattggcagtatcagaagctaagtctcttctctagcacctccttcagggaccgtgagctccttggggtcactgctctgtctccacagcagagcacggtacctaacatgtggcaggactcaataaaaggtgggtcagtgtatttctgatacaaaacaattaaattgtgccaccttattttgactacagttgttcataagagaggataacgatgacattttgtatcctctcatattaaatcaatcttgtaaacaaaagacaattgcttgtgatggcctgttaagttttaggagtacaatctggtgaaaaacacagaaaaaaattgtagatcaaattggaacaggtctaatatttatttgctatgctgaaaataaaggcacttcactgctaggcaagaatatatctgtgactgaacagttttctccaagaatccaatatttccagtatattttcatatactttcttatctctaatactcctattaaaggaaactattattcaaaattaagagacagtggtgacaacatcatcatcctgggtttgtaccttgaagcaatatactcaatgagctctaaatctcacattcactagtgatctgcaagtgaagctgaataaatatattctctttgttcagtcatggaaactcaacattagaaatgacatgtgggaatagatcaccttctctctagactaatatcccatttctgacagtggtctccatggcccattggggcttataaagtagctgccttctgtgacattctgcttgaagacaaaggctttgcccaaacataactccttttaaaaaagcacaacttgtttaggcacacagaggttaagtgacttacacaaatccacccaggattgtgattggcacggtctaatctactgaaaaatataaggccaggcaattatatagatatcttttaacaagttagtaaaatagtggggacttttctggctaaaaattgtaattaaatggtatgttactctgttataactaaacaaacaaaaaatctagaacaagaacttcttgctagttatgggtaatataaatacagagtaaggtgaaggaggactgtatgtatatttttccaacttgagaagatactagaaaggaaattaaaaattatttgaaccaattaaccagccctaaagaagtactctgctttgtatgaactaaaatatccaacaaagaaataaaataggcattgcccagcttcctttaatgtctcaactagtaaagtaaaataaacaatattcaaaggcagaccaaaccatttctaatctaaatatatcttcttgcttattaaaatgacacacatacaaagcctctaaacacgatctaccatgtctttaaaaaatttctcagtgacacatactagaggggaccaaacaaactactaaagcataagtacatattttagcataactgctaaatcacaatgtaataaaaaggtttattaaagattgctattctttatgcaatttttctatactaaggatttatgtatgcatgcataagtatacacctgtatgtatatataactattattttagtgatagtctgtgtattttacacaccagtgccacaaaggggcaaccttacaaattttatctgtatggcaaaaaaaataaaatatcctgaaaatacaagtatacaatacatatagcattaaacagttggtaacttcctagattaacctttaccaaatacaaaataatggcaatacaatgtgttttgcttctattttttgtttttttaccagaatgataaaaataaaactgcattatgtcaagatatttgtacacactcagaattttaaaaacttaaggaacatactgaattttaggcaaaatttaggggaatcgggacatagatggaaaacacattttggcgaaaggtccttgagaatgctggattaccatgtcccttagaaattttctatccaaattagtgatagaaactcagatcaaatatcttttttgtgggttggaggtagaagttaacaaatcaagcaaatctctccttctactctccccaaatccaaacattcctgcatatttgaaacaaattttcctttcctagaccagttgcttaattcattatctacttctccaatattgagtaaatgtgtctttaggggcacacatgtagaatattaatccacttaaatgggctcaaattctaagaaaatattaactatactaaatgttatgggaagaaaatacattgaatgtgagttaagggccagtgtttagcattcacatccaggattctctggatctcagttgacttgtcctatacatcaaaatatggcaatttttcaatcacaatactgctaaatgttattcaggcataaagtttcttacccactgttccctcaaattcatttttgaccctagtattggcaatagccctttgctatttatataattaaaacttttctttaaatttcaattgacaggaaaaagagtcattttgtactctcttatctataaccatgtctcacttcaagtcaatgctacaattgtcacttttattttgaaaaggaagctcagaaggaaaaaaactcttagagagatcttctaacagaacatttttcttcactgatagacatccaaggccattccatttctaaatcacacttatccctcaatcaagtcagtgactggatcatctcctaaggtttcacctgctttgcatcaggtaggtgagatgaaagtgattttatgggtagctttcagaaaaatgtactgcactgaagtgacaaagttctgtcttgcctgttctctcacaaaacagcatatcaattaaataatgttttctttacaatacagtttcataggactttccatttgtttcagagtgccttaactttttaaaaaaagacactgttaacaaatacaattatttctcttaaaatccactcagccagcatttttcactatcctataaaggctttaaatgtcacagaatgtatgataatttgctcctaacctacttttgaaaaaggaaagattccaaacattcttgaaaaaatggtaattcagaaaacacaaaaaccaattatttaaaataatccccaagcaaaaaaacctcagtgcaagaatactgcatacactttgcagtacacgaaatatcacaaacaatgcttttatcaatgtgctaacagtggatgttgttgatcctttcagttcagtagcataaaacaaatatacaaaaaatatgtaatagtcctctaaaaacattcatgctatactctcaaaagttgtgcaaaaataaaaatacagcagtggcaaagtatataccaaatacagacactatacagacagtgtgtaagaaactaggcatattgcagaacacaccatctctgtaaacttcaactctgcatgaaataggccactcagttccgcttggcctggccgctttccccattaatcagcatcttctcctgctgttctgcaagggcctgccatttctgcctgttctttctgcagccatctagcaaagggaaacagtcctctgacacgtgggtcagggcctaaagagaaaaaagaaagcaaacagctagagagaagccaggaaataagtcctctcccacaggcctgttacaaagggccacatcccacactcatttcataagcagactcactgttgaaattttcacaagctttgtgagcacatacacagatcatttacacatgattcttctaaaacactacagataaggagtacatgctgagggacagagcaaacacacacattccaaaataacattactgtgctagggagacagatctgtgtggaatccacttttaggggaaaaaagacattttgtttctatgtagtacagttggctcttcctaagtgtgactgcatcagggaactgcttagtttttgcgtttttctagggaatggtttcatacaatgtacttaaataggcttttatccaggattatattataataaagattcataatttggtgtggcattattatgtaccaattatagtgccataaatatttagccaccagaatgttcatttcagatttcttcctaatagtgaaccacttaaaatgacaaatacccaacaataggttgtcactgtaaaacctcccgcagaataaaaaaataaaaagaaacctcacagaaacacatttgatacataaaatatggatataatgacattatggattgcaaaaggcaattactgaattattaaatgaaaagtatatgaaaatgtcataaagcatatacattgatatgttatctgtagttttctctgggtaatggattgtaactggttttattttcctttttgcttctcagtaattctgatttttctttttcttcttttttttagggcagggttccactcccattgcccaggctggagtgcagtggcgtgatcttggctcactgcaaccccctcctcccctattcaagcaattcttctgcctcagtcttctaagtggctgggactacaagcgcgtgccaccacacccgcgcttataatagaaaataatttttctgtttttttgtagggatggggtttcaccatgttggccaggctggcctcgaactcctgagctcaagtgatcaacctgcctctgcctcccaaagtgctgggattacaggtgtaagccaccatgcccggcctctgatttttctatagtgagaacataactatttctgtaataatattaaaaatacttgtcagtatcacatagaattttcaacagcagattcaaataaaatgaatccttgtgtgtgtgtatatatatatatataaatgtagaaggataacatctataataggtgattactatgttgactgtatttacagggatggagaaaactcaaaagagccattagtatttttaatggagaaactcttaatccaatcaataaggaaagcaactgttatggaaagaatgagatgtccaagtgtttgaaacaatgctctgaacacacttcatacttctgaggaagagctttgaacaaaggagtaaacaagtagaatgctgagaaaaatagggagacgacagtggcacatgacacctagtttttttttttttttttctccatggttcttttggtatctctccttcctttccctgtcagccacagttctttatattaaattcttttgatggcgagaatcctggagtaggagtgagaactggactgtagatgcacctctcccactaaccacctgtttggggcaaatagtctgtctcgttgggagatgaactttacaagttcaattactaaatctgaaatatctggattagaatatttctaggttttttttctgctcttgacattctatgataactccatgacaaatgttctttttccaaataattaaaacttaaaacatttccgtttaaaccttcaaagacaaagacaacttcttctttctgcatttgagtcataaacatctaaactaataagttagatgttttagggagaatctatttgcctacaataaccaccccccctccaaaagccaagccagcagatacgtggaaatgggaacctgcaatattctacctccttccttttaatctcagaagaatttttataactagagtaaagccacattatgacaatgagaaaaagttggattacttttctttatttaggctaaaatttagacttaaaaaaagaatatgctaacgcatagtatatacagtattgctccttgagggtaacactggcacataattcttcttagcatccccaaatcaatttgttggagattagcacatagtaggcactcaatagatattagtatgtgttccttgttcaatacaaacatgttcatcagtaaaagaaaccatactgctaataattttatttcttgatttagaagcaaaatataggcgcctaatattaatctcttcaattttaggttctaattcacaacagtccaagtttagcaagtctagtagttttcatataaatacctcatacagttgcaagcagatggcatctatgaacccaacttgcatacttgggattttgtttttcttctccctgttcattagatcctgaaaatacaaatacagaccagacacacagatgtgcatttatttatttagttagttattactttattattttttgagatggagtctcactctgttgtccaggctggagtgcagtggcaccatctcagctcactgcaacctccacctcccaagtttaagctattctcctgcctcagcctccctagtcaggtgtgcagtaccacgcctggctgattttttatttttattagcgacagggtttcaccatgttggccaggctggtctagaactcctgacctcaagggatctgactgccttggcctcccaaagtgctggcatcacaggcatgagccattgtgtgcatttatttaaagaacacaaagctggctctagaaaggtgaatcagtgggttagcctaggaaggtcagacagcaactaatacaaaaagaaaaaaagaggaaaactcttatgttttatttcaaggaaactcattccaaaaaacagaagtgggctgagaggaatctttacttgtatctgagatccatactctatgtaaaaaggcagtatgtatcaaagacctttaaattctgtttgcccttcaacacgacaactttgggaatttatgctaacaagataatgaagaatgaggtttggcggtttatctattcccttggtgtaatgtttgcagtgttcactattacaaacagcactgtgataaacatctatgatagatgaaacactgctctgaacacacttctgaggagaactttgaacaaaggagtaaacaagtagaatgctgagaaaactggggagactgtggtggtggcatgacatctggtcatctttcctccatgtttcttttggtatctctccttcctttctctgtcagccacagcttctctattaaattcttttgatggcgagaaccaaggagtaggagtgaaacatctatgatggatgtttatcacagtgctgtttgtaatagtgaacactgcaaatattacaccaagggacgtaggtaaattatggttacatcgatttcatgtaatcatgataatacataagaatatttgttaaaatgaaaagtggtttctaatacttaagcggaaaaaaacaaattacaaagaacactgatacaatatgatgaacccaagagtctttattatgccttttattggttttgctttctgtaatgaacatgtataattcttccaatgagaaaaaagttttaaaaaataaaatgagaaattgtggtcctaaggaaagatcccatagagccataaaaaggagtctacaattaaaaaaaaaacaatttgaataattcctaccaacaaggtttcatacttacagtgggttctatgttgagttcttttctctctctgtctccttgatcaaaaaattcagttgctacaagttctgctatctgaaataaataacagactcagttttgacaatgaaaagcatatcattctttaaaacagagaccgtgaatgaaggccctgttaggagctgtatatctccattttatagcaaataagcagcagcttgatacccgaagacaagtagtccatgtccaaagcgtgctctcttaactattacattatactctttttcacttaggtacatctctctgtctttggtagcttccaacatttttcccttttaattttatttaaaaatgttttcttcatttattttctccccataaaacagtatgtacaagggtttgattcaggggagagaaaggatatatgaagacacattcttccctcttctattctcttacctggttagaaataaataggcatatagtcctgtttattatgggcaggaaggtaggtaaagatcacctaagtgcttatggcgtgttggctttggcacatggagaatgagtttttgatcttgttttctcggcatgtctgtttcatgagatgagcctgtaggaagagttactaggctccctgactaagcagcccggagtcttgaccaacagcaggctgtcaacaatcctaaatagcatatttattacggactcaaaatgaaatcttgaaaaacaaaaacacaatatatatgtcactgcatggacatccatcactttttctgagcctgtattgcctctgcaaaacattatagcagttacttagagggaaggatttttttctagcctcctggtaacaggctccattcagaactttctcgacatcttatatcaatacttcctacatctacaagccccagaaatctctatgttctacttgttaatgtctatttagagctgaggcacagcgtagaaggctaaccataagaaaagtaattttgcttcttctaattttcaaggtcattaaagggatgaccttaagaaacaagtaagccagaagtataagttatattccaaatccaaaaatctgaaacctaaaatgctggttcaatgagcattttctttaagtgtcatgtcagtactcaaaatgctttgaattttggaacattttgggtttttgcattaagtatgctcagcctttcacactgaaatgaaaactgtgctaatgtagatgctctctttcttaatatatcttacaaatattatgtgcaaatgcatcttctaaaaagaaaagcctttgtatgtccaattatctgtttttaatactacttaaaaattccaaaaaaaattccatacttacttcagaagctacctttaagagtaaaaacttacttaaaaaaattttttttattttagatttagggggtatatgtgcatgtctggtatatatgtatattgtgtattggtggggactgggcttctagtatacccattacccaaacagtgaacattgtacccagtaggttgttcttcaccccttgttcttttcccacctttcccccttttggagtccccagtgtctattatttccatctttatgtccgtgtgtacctactgtttggctcccacttatgagtgagaatgtgcagtgtttgattttctgtttctgagttagttcattaaggataattggcctccagctccaatcatgttgctgcaaaggacatgacttgattctttttatgcctgcatagtattccatggtgcatatgtaccacattttctttatctaatcaactgttgatggacagttaggttagttccatgactttgctattatataataaatggtgctgtgatgaacatataagtgtcttttttatatagtcatttatttttctttaggtagatacctagtagtgggattgctgggtagaatgttattttgactttttaattattgttattgtcactaagtaacatacccgttgttgaataggccagggttttgtaattgcagaaagatcacaagctgtcatcagcattgccctgttatggaaaaaagaaacccaaaactcctatttacttttgtgttattatataccctcagtaaatagttactaataaaaaaaagttaaaaccctctaaacaatggaaatggcagtttataaagaccaaagaaaaagaaacaatttatatgaaagtctaactaatacattgataacagagcatcattgtttcagtttccctttgaacttttggaatttgtcctcaaactgcctcatttagctccagattggcagactgaaaaattattaaccttgggtaaaatcttgcctgcttttattatttttgtcaccttagtattccattctcagcgacagtatgatgaaagtacattgattactaataaccattaaagtacaacatcaggtatcatactgataaaagtcttatatcagaaattatagtaggtcatcctaattcactcaacacacatggtaacttctaaatgaaaagcctttgaatgattaatcatgtttttcagctttctcctttattgtttctgcatgttgaattatagttaggaaagttttctcactcctaggttatagaagaatccatctatatttttatttaatgcttgtatgatttaattctctacattgaactctatgcttcagttggaatttaagtctgtagagtagatccaattttgtctttttccatttggttatccacttatctctctctttcctccagtcactggaaatgttatctttattatacactatatgtcttatgcagttctagattttcagctgtgttccactggtctgccaccaatatcaaactgttttaatcatagagacttaatagtattccttccatgtctggaccctgacctcactgctctaccttttcagattttctttaagagaagtaaacattttgcagctatatcttacttccacaacatttataattccattttcagcacttccattacaatgaattaggaaaatgaataagggaaacctatagccatatattgatactctaccacattttaaaggtttttctagaacaaaggaacagttcattcacttggatttgcaaatgcatttcttttcaagtaaatattcaaatttactctttgtacaaccctctggagaaatctgaccgcttttaagatcatcatattgtaacaaataattgcaataaaaactaacagtgaggaaaaaatagtgagaaaattaactgggtaaaaaacttcagctttaaagatagtaaacctacttacaaaaacaactccttttgatgaggatcttccaaattgaattgattttttcttataagttcaaaaaattctcctcgcctcctacaatgtttaaaaaaaaattgttagttataatgagtacccagggtcttatccctttggtccacaaagactcatggactaaattttggtgaaaaaaaacctctgattttttttcccatcttagagcccactataaaatcatcatttacaaatctttaatacctcactttcccccttctatcatttgctttcgataaaacattaaacctcacctaatttttaactatagatcacaaattatggtaatttcaattcttgaatatttgttattttaagaaaaatgaaacagtatgagttaaaaatttgatgctgagaatgatttcaggtattttaagtgcatggcataataagatctataggtttcagtttatcatttatttcatggtaggggataaaaatatctaaagttgtgaagtgcttctgaagtaaacaaagactaggtaaagtttaaaataaaataatatttgttattattcagtgaatataataatatttggtgtacagtgaatacctctttatgtgcccagtattgttaagcattttgagaaggcataagacaaaaatttttcttttcgcagtgtttaatatctacctggagacacaagactcaagaaaaacttacgtaataaaactgatagtatatggttataaaaaatgaaaagtatgtttcataagggttcaaaggagagacccatgtggcctgtaaagcttagaaaggcattgtggttacaggtatttttcaaattcttggtaatttgataatccttattctgcaattatttttaataaactgaagtttactattaatatatattattttgtcttaacctcaaaatgctctaaaaaccaattaagtaggcacatgcagttacttctagatgtataacagtagatatctggcagatgtttttgtgttttttctatgtgtttttacttctcctaagagtaactacaaccatgaatgtgaattccttacagagggagagagactcatgttacaaggaaatcctgagagtgattccctgactcccctcattcccacacatgcgtcaaagatctcagctaggagttggaaacttatgattgctcaaatgcaggaaagtattttctagcttttagaaaggcagtttaatcatgaaaatgcataatcacagagacaactctaatgtatactcttattttagaatcaacaacttcaaagttctacataaatattcttctcctgccaaaatcaaataaaaagaaacaagagttacttgcttggcagtaactccttttcctgcccaactaagcttgaatgacggtataaaggagtcatgaaatggtcagaagttgtggggagcaagggaaaggaggaaaagcaaatgatctatataatctttggacaacatggcttggaatgactgaccttgagatggctattagatttgtatatagtttcagagacacagtggtagataaacatcagaaataataggtattcttaattttcagcagtataagccaaaggagtagacttttctggctaccctttcagaaactgctccgtattctgataagcagttttgccaggacatttctgctttgaaatttctcaatatggatgtcaaaagtttgaaacaatgaaaagacttcaaatacctatttctcaggttatttcttaaaacttacttaatgtacagtgctaggtctgtagctaaaatagcttgcttgattattttcaacgtggtcttatattcttcaatggagaggccactgagaatctgattgccctttataaaaaaagaaaaccagtattaacatcctggagaagctgctgacaagaacaaaatctagaaatatattcacatatcttaaacacatgcccagtattctaatgaatgtggaggacacacttaaataccatgaaataaagtttcccctctatgttcccacccaacccctctgtcatacatgtaaaccgcttcataatgcttcatctgcctacatatgcatgtttttccaactcttatactccttaagccttagtccagacttaaaatctaatagctatccttttccgtagggcagactaatcgctataatttaacagcatgtaaaactttgaaaaaaaagccatattaatggatatgaagaaagaagtggtaaaatttttaaacttctctatggcattttaaataaatccagtaacatttctggtgcaaatttatataattttaacttggtcagttatgataacagtgcatattccttaggaacatcttaatatagatgggtaaagggcatgagccaaagggtgcttactggtcagtggtgaaagaaagcgtgggttgaaacatctataaggaatatttaaaaggtagctaatccatgtgcaaatcattcaaagttttcactatgtaaccattttttatttcttatctgtaatttaaagcatagtggttctctaatcttgaactaagtaaaatacacagaccatgcactcagaatacaatcaaaacaacatctgtaagttgagtcagatgtgcttcctatatcttagggccaagaaaaaacccagacgcttaggaatgagatctgaaggcaagggatttgttatgaagacaggagaacttctgggtatgttaggctggggccaaaacacattgattaaaggataactagatgctgaaattgtggcatggatctaattaatgacaataatctataattacaaccataaacattatttttaaatactaaatcattttagattctaggctaaacagaaaactattcagaaaataccttctgatacttactttaagataaaacaatttcaagtggaagatgaaatgtcttttggtgctatatttttattttttactctcaaaagctgaggatataatttcttgtgtaattatgcttacaaagatagaatatatagataggtcttataatttgagccagccatatagataatcagattccttatatattaagtaacaacatattacataataagttatatagtaacaggtcagttgataggaatactgtaaaatatgcttttaaaaaagcatattttctttctttggagctaaatttgtagtgggatactgaaatgaaagttttagtggaaacacacagatagcaaaagtacagatgttcctactataacatgacatatacattcctgagaaatttcagttctgaaaaaccgtacactaaaaataacatggattttgtgaaaaaatggtattgggaaagaccactcaaaacctatgcaactttgtaaccagagcacaaactaaaccaagaattggttcctctggaagtaacttggacaggccagtctggcaggtctggaggctgcttctgaggacattaaagatggacaaaaacaatcaagtagaaatgctggtttgaggggccctgcaataatgcatatagaattgattgttgagacagtaactctgctattaaggtgggcattgaaagaagagcaagctaccaagaggctacagcagtccaaagcgagggagagagcctcaggtgcaagtgctcatttttaatattcctaagatagaatggaaagggctgtatatgcacgagccaaagggagggctttttcctttattgctgaaggtcagaattcaacttctataattctggcacctcttaccccagagaagtcgtgtatgaaatgatagaacgtctatagtatactgataccattcttctacctcccaatcacacatgatataattcacattaaacagtcacatgttgtagaaaaacaatctgtactagaccatatacagattttataaggaggttgccaaaacaggctatataactcttaattcctccccgacactgaggtgttgagggaggcgtgagagtgtgttcccctctacctcaggtaagagagaggggtgtggagttcctgtgtatgtctcctatcatttagtgggtggaggtggggctagagtagacttgtgtctgactcttgtctggaaagtctaaaagcaaggcactcatatcagtaccagtctgttaagaatgttttgatgtttcttacctattctcccttcccattctccaagtatgaagaggtaagaaaccacatggaggttggggagagaggaaggagttagaagaaacacaaggtagggaatgggagaagcctaccagtgcagtaacagaaaacctgaaactttaaatcatgttcaaaatttggactgctacccaggagtacacatttttgtttctgagttgagaactctatactatatgttggaacctaaagtaactagagggcttttacttataaaatagtgaccagaaaagtgatgggaatccctgaatttttttccagggctcaggaaagaattagcccaactgagtaaacttagcaatattgtaaaattgctttaagattatatgtcatgcattgtgtatgttcaatgtaatagttaaaactttcattttttcttattattaaggtaatacatacacacagccgacaatgtaaataatgaacaaccatcccccccaaacaaagattaacaatttcattacaccagcacagccattgttaatatcctggtgcatattatgttaatcttgttttccttaacataagtatgtttagcatagcatagcatatgctttcttatgttgataaatattcatttcaccaagtagttaaatagctttattctttaataaaatcctctcttagtgactggaagtttcaataaaaagaagaaagggtattgctttgtgaaagcaaatgcttgagctatagaaaccacttcattcgattaaacaaaaaaagcagaattaactgagagccacaaaatacacattttgtttgtttctaatttggaatagccacgtagagtagaataaccaaatttcccttattgggcaacatgtagacagttctggttgtctagagaagtgaggctgtgaggatctcaaatgttttggcttcgccttccttacccaaaaaggaataaagtatgtgcaagaatttatgatgctgggaataaatccaagaactaaaaataaaactgaatttataaagctctcttttaaaattccacaacaataaattaggtacttactggactattaagaatcatcaggcactggtcaaaatgatggtgttccatgattgaatggcagtaaagctgggcaagtggatgttcacttctgaaagtattttgttgaagaaaggaaaaaagatcagtttccttaatatgccatttatcagtacatttttattactgtttaactacaaaagaggctacttcacaaaattaatcaactaacaattttctctccttttactgagaaaagtgtgagataatctctgggaaacaaatacaaagagtcaaattgttttcaaataccaatgtgaccattgccagagtaaagtatgaacaatttcattggttttaatactgattaaaatagaagtaaggagtaaagacaaaaaaattaatacctccaaacatggaaaaaaaccctctgaaatagttgtaccaattatatttttcaatttcaaaactgcaattgatataaaatctgaaacaaattcatgttagcttttcctctgaaataatgctcaggctgaaggtcagcttattcatgtgtgcctgcaaataagaaaaggactgactgagatggaattaactgaggtatgattgatgaaaggcaagaaaaagagggatagtcagtgtacatgctcccttggaaggaaggaaggaaggagacggctgagttggaaagttccccatgtaggatccaggtcattttagtgcagaatatcctgctagttctgctaattgaacttggtgaagcagtagagaccctttggctgagtgaagagaaaggaaaggatattatactcagttcattatatctctgagacagtcacaaataaagctttaaagcacgacaagcacaatcctccacctcatgtttctcatgacccttcacacgtgaatattaagcatagttttcactatttcttcataagaaaaagatgaagtttctgaaagcctctgttcataaaatttataggaaaggggtttgtgaattgtaaagctccatatacaagtgttggataatacaactgatttgttatttcttcctattactatctgaacgattattttactttgcatttaatttgttgaagatagagaagctacctaagactgaagaaatgtaatgtgggggaaaaaatgggtaaagtgagagaaatctgagggaaaaagaaaatagtaaagtgaaaataaaggtaataggacagataatctcatctattcttattgtttaaagtgttgtttatatttactgttgtcctaacctttcccaaattaattcttgcccttcttgtcttctttgctccttccatatttagtgagttggactatggatcaggtactgtgctcagcatcagaaaatgggatgacaatgaacagagtaacaggactatatttctgaaaaaggatgaacttactggaaacaggattgcgtatgtatcgagactatgggagttagttaggagactactgggaaacttctagtaatctaagtcagagagagcctggattagagtggtagcagcccaaaggaagagaagcagacatctgagagctgtttaagagtagatcagataggaactggtaatgactcctgactaggagtgggatgagggagataaggggatgagggagataaagggaaaaagtatgaatgttaaactttctgccttgggatgctgacctcatttactgacacaggaaaagggagaagatgattaaagatgggggatgaagcaggggaacctgactagctgaatgttggatctgttcattttaaggtgcctgaaatatatccaaatggatataaatgtcaactcagttctgggctggagatatagatttggaatgcaccaacaatgcagatggtaatcctggcatgcgagtaggtgagatcatccagggagatggcctataatgagagcctacaacatgtcaggtagtttgctttaattttttttagtttattatatttaatttttacaataaccttgtgcagggcatgcccatttacgacatcaaaaccctcaatcccacctcttactcatccactgatgtagtgtccagtttcatgcacgctttaacagacttcatgcaagtaccaattagaaggtgttttgtcccagcctatctttaatacctctcacttctgccttagagctttctgaccccacaactggtgcccagaggaatgttctctgcactcatacttgttcatcctgaaagtgtcaaagagtgaaggcctgtggaccaccttggaccaggggggtacaaagacctagggacaactgcctttgtcttgccagtcaacagttctgggtcttatttcataagactcctcaaaagtgcctgggaagactaagcaccagtatgggtggacatctggatagctcatccctctactgcctttcctttcttccctgcttccttcccagttctgcattcctgctccctggggtcatattcacaaatagcctatatgcacactgactttcatctcaggttgtgtctccagggtaacctcagctgagacctctctaaagttgccatctttttgctttctagacaatcaaaggctcagtgaaaaataatgtgctcaaggttgatataaatggtagagctggcattcaagtatatcctcttcaacccatcacactgtcttaggataccaaagtactttaaaggcacacagtatccactcattgacccacttaggggctggactacgaaatgcaattaggtggttatttaacacaaacaagttagaacttcaaacacacattacatttttagacgacgcagaagggactgtttcacattagagaaaattcttggcttgagatagatgaatgcaaactgtgtttgcctttacttacattctaaaaatacagatttatgaatccataacagagtgacaaatgactcgaatttcctgtatataaaaacattcatggaaaccagtgtattctctatctgttgtattttcctctttcaaacacaaggctatgtggcttctttatttaaggttgcatcagaaggacccatttaaaccactactgctacagaattttgttctcacactgctgtcagtgagcactaatggaccagcatactcactttgcattttcctctgttctgcacagttgttggtccatctctgacagtagtattaggatgtccaatgcagaaatcagaccaatattttaaaaatagaaagccttagaaatctatagaaaatgaaagccccatgggggtgggaaactatattgccaccccagtcttcctatgtcaccaagaacaaacaacatccttggttctgcttcttagccatatatattactctgggctcaattctctaacaacctctttgtaaccttcaatcccatttagttctttacttcatcatttctcttcaaatcatcactattgctttcttctcccaatcaacctttttttttttttgccttctcattgtctataatcatattcaatgacataaatattcataatgatgattcatttcaccttttgacctcagaattctctgacctccttgacactactgattatctctttgcacataatgatggacagggctccgcttctttgttccacagctactaggttctactgggcacagtatttttgccactccctttattcaccacaggacaaagcaagatcttgaactcctatctgttgctaagaacattcccctgtgaaaatagctaaaacctgtagagcatttaacatgtgccaggaaatgttctaagcactttacatctatttatacccctttaatccttatgaaaatcccagaagataggtattttcattattccattatacaaagaaggaaacagggacatagagaagtttaatgacttgcacaaggtcacagagtaagaggagagagaagccaagatttgaagctaggcatctggctcaagttggctcttaactaccataaccatcacagccactgcatggtggtataaggactaaatgaactaatatataaaaagtgcaaaaacgtttcaaatggcataaggcctatataaagttttagcttctattattagtatttactactgacataggactaattgaattgaactttcactttattcatagtcagatctccaggctctcaagatctccaacctgaccagagatcatctcattcatgggtaaaatggactttacccagtttgaacttcacacatgattttgtgctgtgtgtagtgcccttttaagtctctcacatcctgctgaccctctattcccactgtgccagaccatgacttcagctcacttctgtcctctattagagcagagaagacagtcatgggatagaacaagttctcccaggacaaatatacagtgtgactgtggctaccaggagatttttctccccctgattgtattgcatctctaaccttgaaaaaaacacattcgttcgatcattttaccacttctaactaccaccctatttattatcttctactggacttattgccaaaactcccataacttccattcttgccaaccctctctctcagtgcacacatatacatatttcccagctctttcattttcatcaatggcaccatcactgttccagtttcttggaccagaagtcatatctccttccttcatgcttatatataactagctgctcattattaaattaaaaaatttttttctccttcagtctcttcctctctctagccagtatgtgatttttcagcttatacttgacttgctgtaacagctttctagttgagctctgtggttctaatttctacccattcaccttgtagcttacattcagacttccttcctaaaactgtgcatttattacacactgcagtggctcctttttcccacccatatcaaatctataatgcactggttaattttataaccctgcatcaaaaagtttccatttgttcattctcttctttttcattcctaatcagtgtgaaccttctaactctagtcaagctagccatcaccactattccaagaacatgcttacctcatggtgctcctgaaatatatttatcctttctcctttctaaatcctacccacattttaagaccaagtttaagtctcatttcctccattaacaatggagatgtactacatctgtcttgaccagttttctctgctgaacacttacagtccatgcactaaataactcaggactagatactttcttgtagtgatcactattacttcatgagactatgacaattcttaatggcaagaatcacattttatacttctatcactttctttctgccttgcaaagggcaaaagccctagtataataattattcattatctatctgcctagaatataacataatttcactgcattatttatcaacaccaaacttgaatctaaccaaataaatgcatctacaacagtcttcttatactgaatgcagacctaatgcaggtaatctctctacataacccaaatgctacaattgtgttttctctagtggttgtctgcactttagctattttgttcctattactgcctatttttaaaataagaattcagtatctatctgagatcattcttttttttttgagatagagtctcgctctgctgcccaggctggcatcagtggcgagatcacagctcactgcaacctctgcctcctgggttcaagtgattctcctgcctcagccttccaagtagctgggactacaggcacccgccaccacacccggctaatgttttttgtatttttagtagagatggggtttcaccatattggccagcctggtctcgaactcctgacctcgtgatccacctgtctcggcctcccaaagtgctgggattacaggcgtgagccaccgcgcccagccctcattctcttcttgattcacccaagtgggagaagtaagcatgagcagtgaactcttctctcatatatgccactggcatacctgtagaactcctctacgagggtagtttcctaatcaaagaaggcatcaaataatcaaatgatgactcaaggggcaactttctattggagaaatatcttcttccaaggtaatttcagggtaattttctgaaaagatgttcaagaatgaatgaggaaaatctcagtttctaattttgccaccacatgaccatttttctctttttgataaattactttcatctctgtgcattgttttattttttgattttctctaaatattagtttgaatatctgatgagggctggacacagtatacctttttagaagatagtactttacatgggaatatttatggtactcatagtttcctgggtctcctggctaagaaaattctactttaagtatcactcatttaccaacaaggaaagaaaaaaaaagaaaaatccctggaaaattcttggtttcctctactgaaaccacagggatgtaggaagaaataaaaatctttgaaactgctttaactttttttttttttttaaagttgaagtctgctttgtggtgtgtgtgtgaaagcaagattctgcagtcaatgactttttcccaggatgttttctttttctttttctttcttttttttttttggagaagatgacgtttctccagatgtttttggggtaattatttttaaataaacaaaggaaaaaatagttgagtgttttttttttcactctaaagcagggcaatatagcatcttagagcaatccatacactaataatacacatactaataatattatgttcagtgtagcacatgcttattctgatcttttggttgtgctgactgtggagaggcgtactatgtggcttgactctgtactatacatcttttcatatcagtgtcccctttcataattattctgtgtctgtgtgaggctcaggattgcaatcacatgacaaagcacaggggacaaaggacatgtcacccagtcagttctccaaaacatgagatttttcaagaggaaacagccagactctgatactcaggcaagagcttgctatcttttcccatcaaaggtcagcagaggacatggttgttacatcactacaattctttctacatgaagttttccatttatttagataagaagaatgtgattagagagctttctgaaattccctctagatatcagacatctggaatttccttgagagatctgcccattagttgaatcacttgtgtacttaaaaaatgctcagtagtaagagatcttgcacttaaaatgtagacctttcaactaaattcctgtaagaaaataaaaatatcacagtggctcaaacatttgatgaaaagtgatgtcacctttatcctctcatttgtcatctcaaatgccacttaagtatggctcttaaaggagcctgacacttgtcctaacggatagtgtctcactctcaaactcagtcaatgagcagacatctgatgacagtacatctctagcatctgcttctaatatttaagacttaaataggtaccaagcattctgcttggtattgatgtgcattatcttttacaactattatctccattttacagatcaggacataacggtatagagaaattagacagaggaccagttttccaacagagtgctatgtagcttccactaagaccaaaagcctccttctactgagcacttaataagtatgtagggccgagctaagcacttttcaaatattatcttttctactgtagggtaaaatgttaccttttctaaactagtcttaatagttttctaaggaagctgttaagctggatatatataaactaaagtaaaactcctggtaattatctaatgaaataagattctcaacataaatatgttttgaacttcagggctgaaaaattataaacataatacttaacctgcattattttttccatttcctttaaatataaccagagtatgttatgggaccttgaccatcaaattttgctgtggctttaacttaaaaaaagacagccctacaattaaaagaaaacattttcttgctttactgggaaagtcttaccgctgtatgtaagagttattcacaccacggtgatccaaatcgtggcttagtgcagcaatcagcaatgcaagtatctccaggtcagtcagcttgttctgcatgaccaaagacattggaggaaagagagaacaaatataatgtggtgaaggacattatattacctcttttcagtaatcttttttttcccctcagtgctttacatacatacttctctatagtcacaaaggactaaccctagaatcctattcttcagggaattagttgtcctttgtcattcagaatgggatcaccacaaatgtcacttatcaacaggaaaagctgaaatgcctcaataaattaataatctgtccacctatagtaagtattgctaattcttaattattatgtgaaataatcataataaactttaaataattgtttttttcctcttttaattccctgcagattctgttcactctctgctatcagttgctgtgtccttaaggaatgcagacaatgttaattcaagcaaaacaatagaaagaaaatgatttgaaatgaaaacttggctttaaaaagttacataatatactctcaagctaaatataggttattttttagtatctgctatgagtattatcattaatactgttccccttcattcgcaaaaaacacaagttaaaattatcatcagctgtattttcctagaactctcagtactctaaataggttttacaacaaacacaaaaatcatcattttgttattcctcacagagaactaggacagttttcagtgttgataatccttgtgaccttccctaccccaaaataagtttacatgatttcttacactggttgagtatccctaatctgaaatccaaaatgcttccaaatctgaagctcttggagcaccaataagtctcaaaggaaatactcattggaatattttggatcttcagattaggtatattcaaccagtaagtataatgcaaatattccaaagtctgaaaaaaatctgaagtccaaaacacttcttgtcccatttcggataagggatactcaacctacacgtgtttgctaaggtaggaaaatactactattgtatttaattgcacctcacttctttaataacaatcacttcttttagatttagccagttaaaatgtgcaccctatgaaagtagagacagagaataacattttaagaatttatttacaaaaagaaaaaggcagggaagctctgaattaaaaacagttatatgatggatgcctggaatcacttacctagaataactagtcgattcccactgaagttagaatctaaggacagagatatggataaaatttggcctggaaaggaacgaattacttgaacgttttctgcattgatcttccttttaaacagtctctggtcaatgtatatgaaaccaaaaccctttctatgaaacagtacttacaaaatttactgagtgctccagagaaaatgcgatacagacccctaacttatcaatgaagcaagttcaggaactaggtggtttttgaggaattctactatggagcaggttgaatgtgaacaagagaaatgtgatactttttcttactttttcttaataaggcagtgttttcctcagaaggaaatatttatttgcccaaagactatttacgtgcaacatgaagttattttgaaggttttctaatatgccatatatatcatatatggaagaaaattagcaacgaagtagttttgccagattagtcctctttaattaacgaaatataacttattatgtaagtggcagcaaatattattttaaatcattgtgcaccttaaagtgaaattgaaagaatatgctataaattttactactaagcaacaaaatgtattagatatatgaatggctctaaaaagtacctgaattttgcctgcttttagagcagcaaacatgcactgagctgtattaaaggcatgtctccaattatgataggcaacattcttccgataattcttcttaacacttaaaatccatctgcaaagaacctttagggaataaaacataagtagtaacaataattgccaacatcttcacacatttactatgttccagacactacaaagcattcacatttagcctgatactccgatttggatcatcttacagacaagaaaactgacactcagagaggtaacttgctgaaggtcatattgttagttagggatggggccaaaattctaacttgagcaatttgactccacagcctaccatgttaagtaccatgctaattaaattgatataaaacacaagacatccctaagaagggtatttttggcagggtagggcactgggtaggttttttttttttttaataaaaggtccatgtgtccatgtgccatttccatgtgtcaccaactaggagagtccaaaggttcacataggtatgaattcaccatttgagagccataaaagcggccactcccaagttcttcccatgctctcatgttgtatatccgtgaaggtatttagtgcaaggccctgggggtggactagtaacaaggtatatagcacatgtccgaggacaaattggagctacaagacaatgccgtcattagctctttgtccttttaaattatacttattcaggtagttactgcctggttacaaagaagtaattaaaaaaaaaatgtgccaaataaagccctggggtccatataaaaaacactttaaaagatggccgggggcaggatagacttcagcaagtctcaagagttgggtttaattcaacttctaagtggtgtattaaataaaatccccagagactcatgggccctaaacatggtctgtgttagcatcagaatctgcctctcttcaaatctgagtgatttactatacttttggggatttgtaaaataaatatgtgattctccctacatgtatcactggagttgcttcaaacacaaagaacattgccctgggaaatggaaaaagtaccagggaaaagaatgttgctttgacaatattcaacacaatacgattagctacagaagtaggccaaaaacaaggtttcttcattgtcggtagaaactgcttataaagaacttggtgggaaatcaatgcttccatatcctcccttttcaggtcattttattcctgttctattgctcagtttacaggaaattctgataacaaagaacactaatgtctcctaacctttttacccactgagttgccatattccaagcggaggatttctgtgtgcctaagattgaatgtgttcaccccaagcatactgcagcttcttacaccattttttcatatctgaatagagtctgtcaggaaggtgatggatgaatcttactgggagactaatcttactgagagacttttaagtaagatctataaactctctttgatatgtttagaaaatatgttgcagaaaattactggtgattaattaaagcagcaagaaaaaaaacaggaaaacccagaaatttaaactttggatatatctttttactaatcataaatgtacagatataattaaatatataataccatatattgtgaaacaatgaccaaaatgactctatgaaacataattcctaatggactactctattttccttttattaagacggacctaatagaattggataacccaatggacaaagtagttagtacctatatttaagtacagttttagattctgttaccaggatgttctcaacagcatacaagaaaattatggtcatatctggtaagttctcagtggatatgctggacaccattaaaatttgtaagacagtattttgtacaggactactgagtacttatttgcagtttggatgactctacagagcatgttcaatacgttgaatcagtctctaacaattatggaaggtttcctgagtggtgaactcaagatgccaccggagaaaaagaagaaacagaaaacagcttagctcctgcttcaagaaactcaatcagtagtgaaaaataacaaaattgcatatataaaggaaataagtaaataaacataaaattgagagcaagtttatacattgccaaatagcaattgaagcagcatgaagtcaagcctagggttctcttacaaacagatattcttaagtcaggctctgaagaagagaaatgtttgttgtggtagagagtggaacagacattattcagggaggaatgagatgtaaaagataaaaagtgaaaataagcacagcacatgcagattggcttgagcagaatgaagaatctgtttcagagatcagcaagaggcaatggttacagtcattataggagaataactaaagatttagaagccatgcagagaacatgaagatctttcaatatgaaatattcttagtcacaacagcttcatgatgttaacatcctctctagcattaacatttttatttcatcatcctaaaattatactgacaataatatctgaaagaaacaaaacagaagaggcactaaggaaggaaggccagccagaatgatggcaatgttcaagtttgatgttggccagaattagaataatagttattcaaccagaaaaggtaggatgatgaatcagacattaagaggaaatattttcctcatggataaaaacccaacaactggtaagaataaagatttctacagaaactttgagtgattatcttcattacctaaccctcaaatgctatctaaaggccaaagagaaataaatcaacttatatgaatttcatttaaaagtacaagaatcacattcctctactctagccaagtcctttcaacagaatcattattagtttcaagaatgggagtactcaggaatggaaaaggatttgagatactatataggtttataaagtcctgtaactagcaagaagcagaagtgagattcacatagaacttctggctccaaatgagatcttcatctcatcaatagatacggctttaaaaaaagagccttatgacctactattgagaaatttgatgagtgatgtaaccagtcaaacttggcctaagaatgggataactgacatggactctacacctgtttgttaaacagaatattatagataagtacatacatacacatgcatacaaatagataatcacagatgcacgtataattctcgtaagactcccatggggagaataataccattacccctaataacagaaaaggaaactgagaatatgagtgattaattgcccaacgaaaaaagagctaaccagtagcagaggtatgactcaaaaatccatgatctttctactctaccatgctgtcccaatttcttcatttgtaaaatggggataacagtaatcccagtaacagcctttctagagaacttgttgaaataattaaatggcatgatatcccttaatcaacgcactctaacaagagtaaagtattattaggtaagagtctatggacaattgttctttattttcacctaagaaagagtaacataaactttggttaaattcaggaagaaccagatttgggcctccaataataccataaatgacaatgtattaatcttagctatattcactcttagttttcatttctgtgaagcctttgagagcagggacaactcatcgctgaaatgtgcccctggcagagtcctgaattaatacaatgctaaatagtggaggccttcaagatatttaaattttcagataggaaatctgtacaaggagactagacattcaactgatcagaaaaagtaatttttaaaggcaagattactgaattcttttttttaaatagtcctttctgctgcttcttattctttgatgctatatattataatacatagccattatgaaacaacggaattccctagtatctccaaactgatattagaagatatttaagtttttctattttctgagaagtgaataaggtaagcaacagaggttaaaatcagttttcatcttcacccatatgggtgaccctgttccaactaaaagcttggcctcccatcaggcccctttatttcctccttcattttcaaaggagttcactctgcttcggtccttccctgtacactattgttataaccattgcagtgagatcatgctacttctctgcataaaattcctgtgactcaccattgttttcagggtaaaatccaaattcatctgtacggcttacaaggttccgtatcatttgcttctcaccttcttccattgcttctcttgccattcttacccctcaacagtactcctggccctcacccccaatctctgctgtcatgcctttgaacatcctgctcctatttttaggaacactctcccttagtcttcaccctgatacttgatacatgctaggagcccattaaatgtctttttgataatgataatttttctttaaaagtctcgggtatatattaggtgacagtatattaatcactaaaatgtaaaaatccctattccatatttgcattcaaaaccaattctctctcttacatacacacacacatacacatagacttttccaaaggatgttgctgcattcctacctcatgtttcatctggaagttctgcacaaggttgaggtcagtaaacatccgaattgtacacagtgctgtttccagatcagacagctcaaagtcactgaagctaaagtcagtaattttaagggtctgggcagatggcaccacagcagccttgggtaaggaaagaagaaaaaaaaaaatgctgttaattaaagcagcagtgatttgcaaggttttcttgttttgctgcagagaaatagcatattgtggcttttttttcctttttaatgaaagacactagaaacctttttgtacagtggcaactccactctctgcatttttaaaactgagccacataagggtaattaatatggttcaaagtaggctaagtggagaaaagggagttgtcacccttagactgtacctggaacagtgagcaacactaagaactcctctagtgatctggctcctttatacctccccagtcttattcactcaaaagaaatttataatttattgagtaaatattctggaaccatcccagtgctctgggctgcaaatcatctggtaagaagggtaatgataatgttctaagcattttatggttagttctcaggacagccttatgaagtggacactctagctccatttttcaagtacaggaacttaagcacaaagaggttaattttcttgccagtggcagcccagctagttaaggaatgaggatgccaggcctccagtccaggaagactatcctgtgcccagactagcagaacctgcctcccaccatacttgcctcacacaagcctgatcataagaatcacctgggtgcctattaaaaaacattcatttggaccaaggagccctggctccctcagactgagcagagcgcacaggctcctctcctagatgttttgctgggccctgtgggatgggaatttaaaggaacctccactcctctgaccttggaccatttaccctgtcagcactttgttaactgttttagctagatcaggctattaactggaccaacggaggcctttacgtggtttgaagtagagggaagaaaaattaaatttcagccaggttctcaaaccccttaagtttcctatgagtatctgagatagcactactttgcttttgggaagtcaaaaggtcaaaataataaaatcttatggagcaatctaaagtagatttccctacaaatctgaaggcacttgcacattctcctttttattctggacttcagatttcacttacatataccagacttgtttaaactttccatgaatgtcaccctcttcattcaagctaagaattttttcccaagaccaaaactgaccagaaaatatgcattctgttaagtcaattccataggctaatgtgtgggccgaaataggggaagaaagaaggatttaaaatgtttagataaagggcttagttgtttattccagcctccaacatcagagatggagcggtaactcaagtttgggaagtgtggaggtggggaaaagcccaccttttaactcaaagcagataacagctgctttccttaaaatacagtgcaatggacaggagaacagatgttttttccttagggcatcattattcttacagcaggaagttttctttctttcctttcacaaagaacattctaaaagctacaggatggaagccagcatagcttgtgcctctttccattatctactgtaattcctaatctctctctctactaagagaaaagaatcttttcttttgattgtttggtcacaccacactacaactcaaacattctgagctgacccagtggggacatgcaaacattttccataagagccttgtggtcagtgatatacaggttcagaattctgggatctattattaacaagccatgagaagtcagaaatcctttcaagctcttgtactctgcttctttgaccatcacaagagaattcaactttctgtttaacttagaaaggcttgggataaaggtgattttaagtaaaacataattacctattatttttacttatcacattgtaggataaaatattgtacattttactaatagcaggaaataaatttactaagcagggaataaagtatgtggtatttctggcataggatgtatatacagttccagattttcacagtttcttgttttagtgacttttattcattagaattagcaaatttagatttctgagtttgattttcttcaggggattttattattgcattacggttttgaagcctaacagaaagaacatattttacagagtctgtaaaacaataaggtactataaatataaatatgtatatgtatttttatggttgggtaatccaattcaaaaccactggaactgtgataccacctaataccacccaatattgcttatttatatgagagcacaatgtctctgaattcttggacaaaacagttagtttagatattagtgtttaattcaaatatggttaagctcttacaggactatggttttaatgtcaaattaaccaaatatggaatgcaaaaaaaaaataaaaaaacaaagctcattgggttaaagattcaatctgacaaacaatttgatggtatatgtattcttctgagttcttcaattgtatctgccactcaaactaataaactagtgggcctctagtgactctttaaaggaattatatcataagtctttttatgatccttttctaataccatggccctcttttcaccattcttgcaaaaattaaaaattaaaaaaaattcaactctggacatgaaaagtcactaagagtggaacgagagttaatctttgagtgcaggaatgtcttgagttaaagcagtagtgagagttataaaaatattttaattttgcagtgaccttaaaactaattgttctaaataccatctaactgatgagctaaatagtaaactgatgtgcagctgacaaaatgctagatcaactaccatatttacatttcagcatgagatgatgatcagaaacagaaacttaaaaggaaggtgaagcaagtgataaaaaggaatgtcggctattgggggtgctagtccagatgttccactgactttgtcaccctgaacaagatgttcaatctctctgcctgcttttttgaacgtgtaaaagaaggaagttggagtagactatctctaaggtttaacattctctgatatattaatacatttatctctgtatccacagggctcaagcacctcttactgcctcctcactctggaaccaaatgccttactgtaagtggcatctagatcttgccagtgactttcctgtacagggcctaaactcaatctctggttttctcagcatttaaggtacatggacaggtgcaccttggcagttaagattatgttgtatttttcatgctcgattccatacacatcactttggtcctgcttcctcacaggtaggaggagggatatttcacagctcctggcttaaatggaggacactagcctctactgggttaaagtagtggagggttagactcaatatgtggtagcctctcttcttattgcaataatgttctaaattttaaaaactgacttttctgaaattgtcatttttttttttcagggatgggggaagtgtctatgtatttgtcatctgtttttaaggttaattaataatctctctcacaagagagaaaaagaaggctctcttccaggcctctttgtttcttctctgcctagaatgcatattcccatgttttcacgtagctaattctttaactttttttatgtctcagctgcatcagggaaacattcactagtccttgtgatagcaaggctccattaacatctgtttcaacctttttctagtgagtcttcatcttccgaagaggctagacagctaacaaaaatacatttccttgactctcttgcaacttggattccagatagatttggtttcggcaatgaggcaaacttgagtgagacttgaatttcaaactaatgtagtgacacatgggaaactcattattttggggggacgtgactctagagggaatactgcagtcctgcagcttgcagttctgctagcagctttctgactctggcctatgtatgtagaagtttccatagtgagccagaacagcaattttgttctaggacttattcctgggatgacttacctaccctttccaatgatttgaaagtacttagttaaattcttttctgcttaaaatagctacagtagttgctactacctgcagttgaaccctgttgatgctctattttgcaacgaaagcatgtgtaggcaacagactctcaaaagtttgaatatttgacctgatgagtttgaaggcagaggggatccgtttccattagagcagcagttctcaaagttaagttcctggaccagcagcatcagcatctgggaacttgttaaaaatgcaaattcttgggtcccaacacagacctactgaatcagaaaccctgggagtggggctcagcaatctgcgttacaaaaaccttccaggtgattctgatgaatgctgaactttgagaaccactgcattagggataggttattggtagtaaatagtagttaacagtcattttaagtgaacagtttagaaaaaaatgcctttttgtggacccagtggtgactgccatatcacagtgtgatgggcagaaactgtaagtgggttggctgcttcttgctgtgtcagagagattaaagaaagaaaatgaagggctctgggctttaaatttttggctcaaataatggtctgaaaactagagaagttttatggctttcctaaaacagcctatttcttgtagtactgatgtagccaaaacccaagtgtagtcttatcctacaggttggtgaattacagtgtaggttgaaatcacagacttgccacatctcctatgtgaaagttaaagcactgattaggaaggagtggagcaccaagaaatgaaattgagacatatgaaaagatctggataatgacatgtatcttagaccattcactctagaatatgtttctatgtaatttcacaatgttttatactttacagtcccacctctttttcctaattgtaattatacaaattgtataattatcttatatatgactttttattcactgttatatttggagcacctaatataatgcctgcatagaataggggttaaatattgaatgaataaataaatgggtttttaaatcatctagtacctaatcagtttctccatattatgcagaactatttcatataaatttaatttggcatagagctatagtacagtattcatattagtaatgaactatactatggcggaaacaaccaatatgttgtggtacatgcctttttctcttaaagttcaattattcaatttattttcttttgaaaaattttaataattgagtttcttctttcatctgcacaacaaatactccattgctgtaatttttaaaaatcagttacagcttgtcttaataatcattaagatttgattctctcacttccaacaacactgaaaacccaggatgagaaagcagtgaccaaaaagttttccaatttttagctgctttcgtaggaagttactgaaaatggtgaattccagattgttccccataagtagagaactggttatacattatgaataaaaagtttacactttttttgtgcttacaaaatatgacatattttcccccagtaagctttccacctacctaattcaacttaagctaatttaaacatgagtgtataatttcttttttttcttttttcttgagacggagtctcactctgtcatccagactggagtgcagtggcacaatcttggctcactgcaacctccacctcccaagttcaagtgattctcctgcctcagcatcctgagtagctgcgactacagatgcatgccaccacgctagctaatttttgtattttcagtagagacagggtttcaccatgttggccaggctggtctcacactcctgagctcaaggatctgtccaccttggcctcccaaagtgttgagattacaggtgtgagccaccacgcctggccaaaaaaatgagtgtataattttttgagtgcttattattggaatcgctagtgcaaaaaggcttggaacatcataggaacataaagatttcaatggtattgctactagatattgaaaattgatgttccctcccccacctattgccactatgagcaataactaatacttaatggagcaaatgtaccaggaacacatttgctctgattctgtgaggtaaattcttttattatcctaattttgcagagaaagaaactgaagcacaaataagtcacatatttgcctgagatcacacacctggaatttgaacctaggtatctctctctctctagtacccaatgctctccatcttgctacagtcacaaatatgaaagctgacaatgaaaatgttatctcagtgtccctcaacatggctggctctatcaccagtttgtaggctgttttatatatttaatcaactctcaaattatttctagtttcttcatcattttaagggaaaagaaagcaaaatcttattaaatgtattgaaggagcttgatctgtgtttctttttccttcatgctagattataggctttctaaaagtctgggttttccagaatccattcattgattcattcattgattcaatcattagacaaaacacataaaccaagttcatgttaagcaatcactaaatgacagctattattattatcaccaagaactaacagcctgaagggaaagatagatacataaatgaaatacatattttttaagtggaataacagaaggaagtatgttagtagcttgcccaagtgatccctaacaacacaatgatagagaatgtgagtccacattttacttttttcattaaagagaatctttcctgagctttatcaatgcctcacttaagacaaatgacagcccttcttttgttcaactttttatcattataatggccattcacacaacaaaagggacatacttgtgtcccttttacacaagtatagagagtgcctttttgtttattcaatagagaagaaactttatagaaaataatacatttataaaatgtatggtctccttgaagaccataaagcatgtgtttgtagaaaataatatacttgggtaaagtaaatataatgatcatttaaaaattattacgtttctaatttttagtggatgcctcatgagaaaggtctatatttaggctacagcaaagtctctggtaacttcagcagaaaataaagacatgtggctacatggctacgcaatttgctcaattgtgtaatctttgtacaaaaaaaaggtcatactgctatcaaaggcattctgcttgccttaggtctgaagcgtgaaatcttaagagccaaaataaaaattacggaaactggaaacaattcctaatagccaactgctaagaaaagaaaaggctctttattcagaaagttatttattaaagtagtgtgaaaagaatggcagtaatggaacttggtctttcataaaatgtcaaattcttccaattagcctcagtgttgtataaaggtattttgttatattgctccttggtatttattcaatataaatggtccacaggaaaaaaggtttcaatctcaataatccatttttaaagaaattatttttattatatatttgatgggttatatcagtggctgtaaggagacatctcctgccaggtgttttaagcccttcttattggctctgaccaccactcctacctcacaggatacttcttaatggagagcagtttaattccaggtctttgaataaagccaccttgacagctgccacattacaccttatggaagaccattatctcttttctccactttccgcatgcccaagaggggtgtttttaaagaagaaaccacacaattagtttataaggcttttagaatttatctttttcgaagagggaagtgaatccaaagacagataagaaagaaaactacttttaaaacgggaatgagtatgaaattcagtaaatcttgcagacagtaaagaaatgaatcaggcacagtgggactggactagtatattttctttaataacagcatcaacatgttatatgatttttcctttttttctaacattatataagtgaatccctttaaatctcaataagaaagaggcaccgactatagaaagttttataatgtgcttatagtttttcaaaatcatatagaaagcatgtaataatgttaagattctgatataatatgcatacatttataagaaaacttttagagtaaatttatgattgcaattgggaataatatacacagatctgattaccatcttggttattgagttccaaataaaaaaaatgacactaaaactatggtgtttagaactatacacagtagttagtaaagaagaagctcaagaacagtgccctcatattttggagctaagcttatcactggaagtaacccactagtaaaatcaaatcaaaacagacaagattagcttgtcacatgaaggcagaaagaatcaaacagaaaatctagtaggtcttgccaatgtgaaaaacatgtagcccagttaatgttacatacatctacaaaaatcaatgtctcaatcgatggtgtacagaaagtccaaagtattgtttcagaggatttctaggactgtttgaggaagatgatgccttggggcttcccaaccactgagttgtggactggtacccgaccgtggctggttaggaaccaggccacatagcaggaggtggtgagtagtgggagtgagaattactgcctgagctctgcctcctgtcagatcagtgacagcattagattctcataggagcatgagaactgtacatgtgagggatctcggttgcatgctccttatgagaatctaatgcctgatgatctgaggtgaaacagtttcatcccaaaactattcccatactgactatatctccattccgcccgccccccaacccaacccctggaaaaattgtcttccacaaaatcagtccctggtgccaaaaaggttgggtaccactgccttactggatgccataggtaattacagttcagtgatagtggttatcaagatagtcgggccaatacttctttgttaaattatctgctcaaaatttttccatttataatctggccatccatacagagttttcaaaaaatgaaggaatatgatggtcatcttgacataaggaacttgatcagtgccataacactgacttaggcatcagagatttgggtcaggtacctggctccgccccttactgctgtcacctgcagcaatcacacacatgtgtgatcaagacagggtcatgggaagtttttggctctgaaaggttaaggtcaagatgaggaaaattctggcctaagaaatcctgcctaaatggtcagctaagctataaggactgaactgaaacagcactgcctccgtgacaaaaatgagaagctattttataaaaccaaaccctggtatatattttactgttctaacaagaaaggaaggttgccgggactgacccacagaccctgacagagcaacagatgagaaaatgcactctgacccagatatccaatgaaagagcaggctaggggaccaggtaacccacagaaagagttgtagcagctgcagccctgacaagctggggctgcaggcatttatttagtacagatttaatgacagaggccttgagtcaacacacttgtgggtaattaacatggtcacccctcatcccctttctatctaacctaagcttttaggcaccggataagagaatctggctgccttcagccaaatccttttccgaagcttttgtaaaacctcccagccttccaagaaggtttgcatctttccacagtttttcccgccaccctgactgatctcctacagaaggcaaaaaaggctgtcaatcaatgaatcaaatatttacttcctagtttttcagataataaataagcacttattatattctgataattaattaactttctaataaccataacaggtcagccggggtccttttattattatctccgcaacttgcaactaaggatcattaaaagatatatgcaaaatgctcagtttaacacctaatttatgctacacccaattttaagccaagagaaggttagatttataatgggatacaacactcaagcaacagaagtggaaaaaataaagattctgaatttcctatccactaattactttgttataactggagaaatttttctggacacaggcgtaaatatttagtagatttaattctcttaagaataaatttgttaaaataaaaattaagaaaatatttgatagcttttccatttattttgggttttaaattgagataaccagacaaacgacagcaattttggtgattgctggatgatacaaacacctgtgtagctagggctgtacaggcatttttatttggttgacagacaactagaactgaaatcagttgctgaatttcaaccaatttaagtgaattacttgacctacaagctatgtaaccctaaatttctcaatgcagctgccagaaatctattttctaaatgcaacaacagctggttttgaacaatactggaatatagcaattttcagttattcaaaagtatttttctcttgctaaaattataaacattgagaaaataattttcagatttttctgaaagactactattttcaaagtgaaaaacaaacttgaatatcatctttagaaattattgctagctttttttttaacctagaacaacacatataatgatagagtgtaaccctcaccttcattttagaaataacttaaccctgcagtgcctgcaggaacttcaatatgtagacaatttctaaatcaccaaacatattgctcgaaaactacatccttctaggaagaatagacaaatgggccaattaagcctgaggtgaataatactttaaacctgtaaagctttgtaaataattgaaaaactgttcatcacttcaaatactgtcatcaacatacaaaataaatatagacaattccatatgaggttaactcaaaaaggaccttaacctttcaggtgcaattagtatctaaagttcatagaattgttcttggcagttaactcagtttcactggcaaatgactcagtttcttactcatggatttaactgaaaatgtttacaagtcctcattttactttgttctgtctaacttactctctctccagtgctgtgcaatcttgtgtgggctctggatccagactgcctggatttagtactggcaccattccctccttacaacctaatgagatcctgagaagcacaatagaaactctctaagccacaaattccctcttacaaaatgctaacaatactgatcatttaggttgtggattcagtaaacttagttgacttacacaaagaacttaaaacacgctcggtatacaggaagtgctcaacaaatgtagctattattattatctgtatcctcttgtttgggcaaaagaaatgttgctctttcatgcctagccctcttcaaggtccttatctcttcactgtcttgcattgttattctcacactgactcctgtgcctccgcctttgcctaagaacattctgcctctcttgcttgtgagcaatgccagctcacacattcaaaacctaaccaaacaataaaaaacttcacatgattcgggcaacatccttcatagctgctcctccactctgttttacacaaaacattacaatttttgaatagtctatattcatttcttccaccatttacttttaccttttgcagtttcacttccctgaaactgcgttctcaataatcacttaatcaacgaatccacagcagctttttcacaatcctcatatttctcatccttcctaccactgatgagatctcctccctttttgaaactactttattttgccttctgtgccactgcactatcctaaatcttcctccttgtttaactaccacttctctaccttcttggctgttttcttttcctgttccttccatctaaggctatattcacaggagttctgttctcagtctctctacctctctgcattctctcccaattgatgcacccctatgatttcactaccatgggatgttaactcccaaatctccacctctagttctaaacaccaccacctcatcgcttgagtcctgccttttctgattgctgaagatgttcacttggttgttcaaccagcacctcaaacttaccttgtcctaaatcaaacctgcagtttcagggaagtgaaactgcaaaaggtaaaagtaaatggtggaagaaatgaatatagactattcaaaaattataatgttttgtgtaaaagagagtggaggagcagctatgaagggtgttgcttgaatcatgtgattcttaatattcatcttaatatttccacttttatgaattaatgtcaccatcattctttgaattgccaaggtcaaaatatttggatcatctttcctgtctcagcacagtgttctgtgcacaagctctggatggtgaacttgtatcctcattctttcactgcatggcagtgaccttgagcaagtcactgggcttctccaggcttcagtgcggccttcataacatagttatgaagtttacatgagaaaacagttgtgcagtttacatgagaagatgtacataagggcacaaagagtttagcatgtggcaaactatgatgaggatgacagaaaaagactctcaatgatctgttcacacttttctcattccttacataactgttgtcacaactcacatggcccttacctatgtcatcgcaaatacatttaaacacaggaggacaacctaggttgtaaagtgttaaagtgcctcaaattttcattaatctcaaccaagccattccaaaccaagacctacaacatacatctacttacatatccatgtgcttttctctcattgtatgctaaataatgcaaagagaattcaggaactgaccttatttgaccccaatttcaaacagcattttataagccatatggtcagaaattaaaatcactctcaattcttgataatacagagtaggtatcagtaacaaactataaattgttttgttattaccctagccaaacaaccacctcatggtccccatttctccaggaactaaaagaaaagtaaatttaattttggccccaaaaagatgtaatgattataacaattactggaaaacaaatatcagaatcatacactatattacacagtcagtataagttatttaatgccttttgctttgtattatcagtgactttgcatccctgcaagaaagcagagttaattaaacatttttataagtatccatctaaatatttaccaaatttggttaaattaggtgtctgtaattagtaatttttaaaaagaaagaggataattaccgctaacgactgtagctctcttgtttcttcctctgctgctgaagcatgatacgacagaacctacagggtaggaaaagaagtccaggttacacaggagagaactaccacatgtagactagaacttcaagcttggaattctgctaagtcttcttggagagataattagactcctcagaatgccaaatcttgtttgctgttttcttcaacagtgaaaaacccagatttagattccattgcttgttttggaaaacaaaaagttatactccctatgtttaaagaaaactcttgtaacttccagtctgacattattgctataacaaacacattatttataagccagcctagaaataacttttggctcaaactttggcagaaaatttattttgttttttttttttaagacaatattgactttagctatttctgcttgtgtacagaattaaagagaaaatctctgcataatctgacattttgatattaatatttggaaagaaagtagtctacaagtggctctcagatgaggcctgtaaccattctagaattcacacagaaaaactggatgcctgggacacagtcatgcagatttaaggatccctttacactcctacaatttaagaggtgagaagagagtagtgctggcctgtaaagccatccattgacagttggggacactgagcctcagggagtcacatgatttggctgtaagctcacacctagtgagaggacaaggagatttaggacccagctttcaattcctaacctatacacgttccattacttagagttaaaaaatcaggcttattaacttaatttccattttcaaaagcaatcatttctaattacaagttgagcatcccaaacctaaaaatctgaaatccaaaatcctctaatgagcatttccttttgagtgtcatgctgctgctcagagaattttggattttgaaacatttttgagtttgagatttttggatttggactgctcaaccattaagtataatgcacatgttccaaaaatctgaaaaaaaatgcaaaatacaaaacacttctggtctcaagcatttcatgtaagggttacccaaactgcaatgggattttttttaaacattcttttaaaccaaggtagtggttgtatttaaagtatctatcatgctttgaaagcatatttttttaaagttcatttttgagagagacaacacagatttacaaaaaaaaccccaaaagcttaaaaagcattgatgaaaaggtagctcattttcaaactttaaatggtgagtaaagtaattcagcaacccaaaccagtatttcttgaaccagtctttaaaattttaagtaattaaaaatttaaagccaaatgatacatatttgtactatcttatgatttagaactgttaccatactgcactacattgcatctttcttgccatttgaaccattagtcactaggaaacctcaagaaactcacagctgctctctcctgcacgtgtgaaattgatgggtcatggctataacctgttgctactgagactacagtggtggttcccaagaaaagctaatactgtgtccatgagttagactaatattaacaagtgcagtgcaacatggatacatgaataaagaaatgacacaatacattctaagttaaaaaaattttatcacacacaaaagataaaaataacttacacatggggcataaggattaactttgttaatacatgtaagcattagaatacaattgaaacatctgataaatttagttacttttattgtcatcattattttattgttattagaatgatcacaacttccaggtcaaaataattcactgtcttttgaagacctgaggggtttgtgcccttggcttttgtccaatggtctcataaagaaaggaccatttttttcaaagttatatctatgatcatagaaatgactacacatatgacctgaaatcaaaaactttttatactaggtaaaagcctaattatccatatatttaactgaaagagagctacaaagatagaaataagtctcaatcaggaaaatattcagagattctgaacaaagtaatacaatgtctgggattgcttcaaactaagccagtgggaggggaagggaagtgcagaggagtgcggtgggaatggatggagtgataatggtcatgggttgataattactgaatggatgatgagtatgtgagggcttattaagctttctgtctacttctgtatatgcttgaaactttccataataaaacatttaaaaaagaaataacttctaattgatagctgacttagattaaatttttcaatgaaaaaccatgaaactgaaaaaattagattaaaaattatatttatatattttataataaacacatatatagatatatgtatatatgtgtatctgtatatttaaagctatttgaacacatatgtacatgtgtatatgcacctaattgaaactatatttgaaatatatatttgtgtgtatatgtgtacatatatatttgaaacagatttccactggtttatatattcaaagtcttttatataatactgtagcaaacctattagtataatatattcagcatagaaagtaaagggtaccatctggtatattttatataatatatgtctctctagctctttaaggttagttatgtacttaagagagattgagggaaatgttattatatcccaaacactgattttctctaatttcaactagataagaaatctccatgttacatcaactgaataatttcaaggcagttagtgaaacatatatagaaaggactgaccctgttggagtcggctggtcctttgtgagaaagagtgttcctcggtcagtccctgggagccagtggtttcttcactcgctacctgcacattcagagtcacctgggggagcttggtagtcatacagattcccagcttctacccaagacttgctgaatcagaactttcagaagtagggtatataaatttatagtttgaaatagtttctcagatgattccaggagttaaaactcttcctgcttttcgttgattttattttttcttttcctcacttctaattctcttaagagtgcctagggtttctgttttttgtttgtttgtttatttttaatttttttccacaactgttctcacggaaagatggggaggctcaggcaatgggaaagagacagataattggcagtagtcatctgtgtcaatggattattaaagtcaatattgctttctgcagaaaaagcaaaggcataaagggataaacatcctgagttgtggtttggttatatgacatttgacaagtttcttaaatattctgagtcttagtttctttcattctttagttgaggacaataaggatctcatcatctaaatcacataattttggtgaggacacaatgacggaacacacacacaccatgagtgattatgagggaaaggtaaaagatgagggtttggctgtacagtgtgagaggtccctaaacttcacccacctccaatgtgaccatttgcttggccatggctctctccactgcttcatacatctgcgtgttctggatccccaagccacaaaagatgacaaaagcttccagaaactgttcgtcatttcggttgaaaggcttaaccttgccagtattctcctccatcttattaacaagttggcaaacccctataacaatccgagaaattgagcaaatgttattgttgattatcatagtttttgtggactttaacaaacacacccaaagattgtcttacacttttctcttaggaatgcttagtatgtcgaaataagcaaattaacccccacaaatataagctagagaagtaaacagaatttatatgagaactagtttcatgtagttcaaaatgtacattgctggcgttcaaaaaatcctagagtactattttcttccagactcggtcacgaattttagatcagttgagtccccaaagacaatttgtcctttggaagctaattggatttttgtacacttgccaagagaacgattttgatgcacatcagaattttgggtcaaacagatctcctttccttactgagaaaccagaagttaaacatacacacacacacacacacacacacacacacacacacacggttacatacaaaatagaatgcagaaaggaggcaactgacataagcagtctcaaatttcaaatctacacctctgtatccaacagaatcaaatttgcagaaaacttttgattctgcaaataattatgcaaataaaaatgactacttagaaataaaagttaaacacgtagtcaataaaaatggaagattacatcaacattaggataaatcttaactggttgttctatgagtttctgagcctagtggtctctgtgaggagtgacctcacagaggtcactttgatgacccagcctacctctgtgtaaacaaagtgttgttaaagtccttatcacttctgtctctgagtatataataacaaacttctaccatgtgcccactgtgggataggcattgtgctaaatactttggtagacacatgatctccagtcttctcaatttattctgtgaggtagatgtgactattctcattttacagatgaggaaactgaatctcagaaagttacatcatttgctcaaagccacttagctggtatgtgtaggtctaaaattcaatccccagctcagcctgccacaagggccactctcaactgccatattacctgtcagatcattgctatcagtgccctggttgcatcttgcttgcccacacctttgcttatgcttttccacaggtctgcactgctccccattgccttccctcccgcctcaccagttgatccctatacctccttcccaatgacctccaggaggcctctaacttacaggtgaggcaggcatttttctattcccttaacatgaccagttggtgtatcatggtaaattttatttctctctctctttctagactgtcagtatcttgggcttagagttttatttatttttttcagctccacttcagctggcaaaacgcctagcatatagtaggaactaaaaaaatgttttccgaattaatgaaagaatgtagaattgcagctctgactgtaactagtttcccatgaagactataatagtctattatcctttatttttcctggagcacaaaaggatttcatagagtctggaagacggttgcacattaagcccctttaccaccatcaatgttcactttctttacttttcatactataaatgatctggactctcctttttgctctttttgtttgtttatctactttaaacagtaaagacatctacatgcttatctatttgcaatagtgctgcagaagttactttatcaattattccatagtcaagggaaactttagacaagatataatgaatttggacactgcaagtaaaagccatatactaaatggcaatcagcgttcattatcttaaatgtatatatcctgtgtgtggcaaaaaacaagaacaaaaagcaaaaaacaaaccaagggttatgtccttcaacctttgtgaatccccaaaatataaatatggaactgtttatacaggcttctgtctcctaaatcttattttcttgagagtcacatttcatgcccttatcctcacatcacaatggaattgcctttcagttttactaaagttttctcctacttgatagcctttttcataaacaagattttaaaaattacttcacaagaattactacacgtatagcaagaaaagtacaacacagaggggttgagatgtgaataccaggcaatctgcgaggcttatgacctagctaagtatctctccagtacagcagttcaaatctatgccttggtcaaaattcactgaatgaatatattaagagtcattaaattatacctttggaattgcccgcaagtcctttaaatggaatgttatgtgtagaaatatcaaggttctgctataacaaatacagctcagagcagaacaactaaagtatatccatgttatgatctaccattatagatatagatctataggcacagagttaagctctggggaaaacaacaacaacaacagcaacaaaaatgggtactgaagacaaatcatccatctaggcatataaattaattatctttttgaaagtgaaatgagcagccatatttaaatagcattcatgataatcccattgatctctttacactcttcggaaagtttaattctatcaagcaaaaatacccatgtaaaaacaaaaagttataaagaaaaagagggcttataacaaacagggttccctgtttaagaaaactaaaaacctgggcacatttacagatagagtgttcacaacttcttccttaatgatctgaaagattaaggagtacaataatgaaatttaaaactgaaatttgagatgccacgttactcataaaccatacaaactcagaataatttatatttaaaaatgaaatgtttaatgcaaaaccaaaaataaaagagaaccattcagcaaaaacccattaataagtgcaatcacaaaataaaacaacattcaaaaatgtattgggggaaccaagaagtagtgaagttagcaaactatcagtgttacctaatattattatagagttcataaagtactcagaatgtggtcatcacagtaggtctgagagttggttagcattgaaggcacctctggaaattatgctgaagggactagatggcttctaaaattaaacagttatattttcttttccataattcttgggatcggatgttgttaccaaccacagtcttcctcctggctctttggcagaacagggggtcaatgcttataccctgcttgcagtcttatgtcctctctaccacataacatggactccaaaattagcatcctgccttattaaaatgtaaaacgaacctttatcacctatcttgcaaatacttttgtttctgcacttttcatttgtcaatcatcttaatttggagaggcttttgctgtataaaagatttaattttttaaggagccagaataattatccttacaatattcaactatagtgccttgcttttaaaagaggcttcctcattttaatattatatataaacctatattttccctagtacttttatagatgtattacatttaatcttataatcccacttaatttttcccctaactgctattggagtcttataacatctgaagagttacccattctttgatgatctgaattgtcaccatatactaaattcatatttgtttcaactattacatactttttccacattttaatatttttgaaatcagtatgcatgttatgatcaatagcttgacatagtaaattgaaatcatattttattttcttggagatacataaaatggtgtctttcattcaaaagtatcttacttaaaaataatgaaatataccctactctgttacatacagtaacacaattatatatgccagactatgggtctacatttagactttctgttctgtttcatcaatcttggcatgtcttttagcacctataccatatttttaattattttacttttatatcattttaatttctgaattaaatctaaatttaatttctgaaagggcaataaccatcagctatgattctttttacacctccagttgtaagtattaccaatgtttgtaaatgttgatcaggaacaacctccccacccccacccatgtctcacaaggataataaaattgatgcaaatctaatctgggagacttgatatctcgtaaactagattttaatcatttcagaaatgtattcacttcttaatgatttttaagtcactcagaattttgtagctttcctcatatagatgacatatatttctggccaagtttattctttgttactgtagtaaatggttttatttttttccattgttttctaacaaatttgtcttggcatatattaaaattatttctctttaataatttgataattaggcttcttataaaactcttactagacaggtactttcagctaattctttttgggttttccatttaacactaatataatttgtaagttattttattttgcctcctttttttctgtgtctcatcttatttcaaccttgcctcccttctaattgctttggttagaatttctttgggcaatagtttttttttttttttttttaaataacaaattctttctcagttactcccatgaacaattctaaaatcctcttgagttagtattggttattaccaatttttatagaaattccccatttcaccaaatgttaattcctatttgctacactgtaatatcaagtatcttttaaaatgtctttgatatctgtacttacattccctctctcattactatttgtgtttctctcttaatatcctcattatccgttggaggttcatctattattattgtgtttgcccattatctcttatttcttctcatttcataagtttattttttcaattttttcttctactttctttcttctcatgtatatacttatttggggaaggcaacagagtgagaaagagaaaggtgctgtttttctaatttctacggttgaatgcttagttaaaattttttcattatttcttaataataataaaatatttaaagctacataatttcctctgagtatagctttgaccatgtaccttcagtttttatgttatgttaatagaacaattacttttctaaaatgctgtaatttaattatgacttttgatttcttctttgtcatttaggagaatgcgtttcaggttctaagtgagttttttccttccaatttatcttttaattatatattaacagttttaatgcactgtgatctatgaaagtggccaacaattctgcttttcagaaacgactgactttatgttgcatatcaccaatatttgatttctgacatatattttagaataatttatatttttaaattctgaaacatgaaagtaaagctatatatgtcaattaaatccacttaatttttatcaattctaatgtttattttttcctataatttaacactgacaagtatatttcaggcccactgtgatgatcactttgtccatttctccgtgtattttttttttttttttttttttgagacggagtcccgctctttagcccaggccggattgcagtggcacaatcttggctcactgcaagctccgcctcccaggttcacgccattctcctgcctcagcctcccgagtagctgggactacaggcacccgccaccgcgcccggctaattttttgtatttttagtagagacggggtttcaccgtgttagccaagatggtctcgatctcctgaccttgtgatccgcccgcctcggcctcccaaagtgctgggattacaggcgtgagccaccgcgcccagccttctccgtgtatttttaacagctttagtttttgtatgtcaatgatgctatttagtttattagcattcacagcaattacattttcctctatgagttttaattttactcaatgaaaggtgattctttacattatgttttaccataaattctactttgtttgatagaaatattgttatccctattcaatttttgcccatgttgtataaaatgtgtctttacaaatgacgtatacttcacaggttccaggaattccttagtgtttctgatccactaaagactacttctctgttttctagtgctactaaaaagttttccttatttttgtctttcttcagtcaattattaaatctgtaatctttacattgtttttattatatagatcttcacttccataattctaaactataatatcttaattctatttttttctagttttcttccacctattactgcccttacaccctacagtcttatttccttgtgctcattataactaagcataatttacaattctctaactgggaaaaaacctggatactttaagtaatacaagcaatgtataccatggaagacaatgtacaattataaacaaatgaatagtgatattgccaagtgataaaatttaatatgaaaagtacaatgaagtagtagtcaaacttaagcgatataacattagaatacttatttatgccttggaattctactgcaacacacagatgagcagcttatctctccatgtattcacctatttaaaggtccacccgagtaatttattaaataaagccaaaataaattaacagagtaagataagatgacgtggtagtgacaatcaatgattcaaaaattcattaaggcctactcaaaaaaactctgcaggcatgcaggtctcccaaattttattgatagaaaggaactaaaataaggtgccatttggagcattggaatgatgtaggtgtttagccagttcaaacaggctaacagaacaagtttgaaagtgtaagagacttagaaaattcattgtggaagtaaaaaacagaacattcttacagtgtacatgagaagggattaagatagtaaccagttgacaaatacatatttctttctcatatttctctgtcaaacaatgtgtggtacagcactgtaatttttatttttatgcttttatttattaacaaggagatgaaaaagtaagctatttaaagtggagatgttctaagtatctttttttaaaataaattttcaatgggaataggactagtttctgcaaaatttatcctgaaattgatatggaaaaaataggcataaaaatgtctggtaaatataatattggaaaaaggcatttagcataataagcagggaaaataattagttaaaataaatgaacgttcaatgagaaatatatttccttaaaagtactggaagcaaagtagtggaaacactgtgtattagccagagcactaagaaaacatttgatacgaaacaatacctcagggaataaatgtgatgggacagcaggccccatactggtctaatgtctataattccatctaaatgtcagtaatggaaaaaatgagaagaaggaagaagattacaaacaacacatgtgtccgtctgtctttctgcatgtaactctatagggattctctattagaattacataatagtggaatctggtctatgacatgtaagacaaattatccacaaccatgacattttccatgctacaactgtaggtacataagtatagtccagaaatcaaattcttagttttgtcacccttgtaaagcagcaggaacactggaaattttcccccttatatttgggatctacttgagaacctcccttcaccccacacaaaacccgactaaagaaatcatttcttttcctttctttttatttacaaagaatttttctctccaaaatctacatttgcctacttttggctctgtcatcaagtagggtgatacaaaatgtatgccaagaaaagtctgattgtttcattttttatttttttcttacttgtctgacacagtgacaggatcacagaatgtgaattttgaacagatctgaaaagttattaagttcaactccacagaggtgagtaatgtgcccataagtgtggctgaagatgagtggcgctaacacaatgctgtgagtccgacccccagtccagcactctttccatgtcgtctaactcgctctcatttaccttcacataaagtgacaaaggggcctgatgcgtaacttcctccagccactccccgttcccagttattattccaaagaaatgttgctggggaaaagtgaagatgtgacttgatggggcaagctgccactctgccttccttcctatgataacttactagtaaataatgcattccttctggaatttaatttcacattttcaaaggccaaagacagcttgtagtaaatctttatacttataaaaaagcattttaaacagcataacatttataatatagttttccccttgacctccctaagaaataaaattttataacatttacttggtatcatattgtaaggcacccttggcagttttcttttattgcttatgttagagatctgatcagtgacaatctttaaaaaagatctcacagattcattagcctccacttttttctctgagaactgtagaagagttgactcaacagcccagcagggggttggcacgctggtttctaagcggctttaatgcacaattcaccagggtcaggagctgaccctcaaccttttagcttaggcactagattagcatactgaagactgctggggtggagtcacagtaactaagttgacaagactgatttataaaaccaaaatagtatcaatgttcaaaaagaaacagatctgtcccagaaacagaagtataagcacctgcagctccagcccattgcctcaagtccagttcatacaataagaaacaactgtcagggcaaccagtatatttgagaggacatgaataatgcattctcttcccatgagctaacctacactggaaaagaaagtaatcagtacaagttggattggtgggactggaatcagaacaagggaaatcagagtcagagaatgttgaattgtgctaagctgatgtattcctttcacaataaggatgcattctaggcagagggactgggaattggaaagatattactggctataatctgatgcatccattgcacctagtgaaggctcaccatatggtcagaatactcgatgcacactgatacaactctctacatccatctctgtgttagggacaaatgttactttactcttgcacagaacttggacagtcacttttaatatctgtcttttctttttctattttcattactgatataccctctgccccttctttctgactaaaactctcattcaataaaattatagtcaaatcttgcaattggaaaagtattcagacttttaaagttatatttatatatctaaatgttgctccattagggttttaattctaaatttaacctttaaaaagttatcatattttctttatttccaggttcctaggagaatgttaacagtccagacctttttcactacatcaaccacggatgattggcatataaaatcctacttaacctttacataactgcaataccaggaaacaaatatgtcaataaaaggaaacatcattcaatttttctgagaatgcattcttccatcattcctgaagtagaggtttttctataatcatgttaagaacataagctcctgagggcaggaatttctgctttgttcattgatttatcccaactgccaagaacagtggagtgctcaataaatattaaatgaataaataaatataacctataacctaaactacattcttaaaaaaagtcaacatccaggaaataagactctaaaacaatacacattatctacttaatatctcttatacagtctaccaaatttcaatacatcatcaatcattcttaaacaaaaaattctgctgaaataggataataattataaaagtgcaccatagtttataagatatttaacaaatgtctgttggtatttatcaattattttaattattctatcattccaaattttatcttttttaaaacattttattctttacatttgaaagaaagaagtatagctgggaatacatttttaaaaataagtttagagtataggttaaaggaaaggttttacctataactttattcttctttccattttttataggtgtacaaagcaaacttctaatgcactgctggtttacatttcctgtattttcagtctaaacaaaaataaaaagaacaaaacagctaaaatggtaaagagattgatttgtccattagatgccatataaactatatgacacatttgaaagcactatatattcaacttttatattagagagcattggaaagcagaaaatgtataaattataatgaagttcacataaatgcaatataaagcaatgtctactttgttaaaaatatcggaatttttttcactttaaactttccaagcagcttaataataagtaaaatataaaaataagttaaaaaaaataagtaaaagtacagtatctactatactagtgtagtaaatgccccaaataatttaacgagaggggcagaatctaaacgccacctaaaatgcaccgtgttacaaacctgtcctttaataataccactgttgctattgctatattgctaaagttctaacaatgtctccaaataacacccaaataacaaaatcatccaaataacaaaatcaaggcagctgcctcaaagtgcaatgctttcctgaagaggtgagagaaaatactataattcaaatttttcagtgtctgagaactagatatttgtagctttgaggtcaagaaaaacagacatccattttcccagagctactcactatgacagattaccaattgcatcagttcaagccacacagaaactaatttttgcaaataaggcaaaaactctagcaatattatctaaggaatgtcattgacattatgtaggtaatagctaaattacttcaaaaatagtacggtaacttattaatagacatttaaaaaggtgaaaaaagtacaaagaaaaatgtccagctacagctctcaatagatgttatgatctattttattctccttcctcagatgagggaaagcacagatcattcctaaacagtcaattctagagccagtccttcagttcaagaataactgtaagtacagatgtgatgggaaaacagccttctagcttcaagtctaaaattgggttacttactgtccagggaaatcttttatccttactgacatctgggatattaagtggttccatagtatttttgacatactgagcatacatgtaattgattttgtttgcatcatgttccctgtgaaaataacagatatgagttccctctgtgcagttaaaaaaaagcatgggcaaacagttaaataaatgattaagggagaaaaataccagccttaaattataaggcatatatacttatttggaaaatgtagctttaaatgtgtttgatgatttacaactttgtcagttaccataatttaaatgttttgaaaaaacaaaatcccacaaatttccaacaagttttataagtgtgaatggccttattctcatcgcaaatgggcatggtgatttttggtgtcatttaatgtaaactcatatgtcccctcatatcttattttcccatcagattatagaatgcctaaggtctagtgcttgtttcacttcctcattatttggtttctctatccattccaataaaacagtatcttacacattttaagaccaagggaaaaatcaaacagcttagaaaaaatttttaaagctcttctctctagttaagtctattttctttctccttctgtctttttgtcgtgtcttccttagcatctttccctttgttcagtttcctctctacaccttttttctgctttgagatgctttaagatacttttaaaattaaaaatttatcttcctcaagaaatttttatgaacttacaatatttttaccagttatgttccagtctcttgcttaacagagtgaacatgaaagattaatctgatgccagggggtacagtgtcagtgcaagggatggaaaacagaatggaacatgttttttcatcaggaaactccgtatgttcccttgtggtgatgataaattcagcaaagagggtcaggttatgggaatttattctatctataagaacatgcttattttaattgtaatatcactaaagaagtaggaaaacctaacaatagtagacatttcaaaataaaatacagttggccctctgtacccacaagtccacgtctttggatacacccaactgcagtactgaaaataaaccaaagaaaaaaaacaaaaataaaaaataacataaatttaaacaatagtacaacataacaattatttaaatagcatttacattgtattaggtattataagtaatatagagtggatgtgcataggttataggcaaatactacatcattttatacaagggactttagtgtctgcagattttggtatctgtaggggttcctggaactaatttcccaaggatactgagtgacaacagcatacatctcaggaaaaatgtccacttgttctaagtttccaaagttccaatgttttgctatcttctgtccttcccacccaacctgacccagctgcttcttgggacagtggtttcatatggcgtccttcagcgctagtgattccacaaagattcctgaaccctgtggcctggttcctggtcaaaatatttcagtcttccctttgttgtacattttactttaagtgtaatttggtcaaaccaagtactgaccacttgtctagtattatgtatacatgaaaaagaatgaaaaggaaatgacagaagagtgacataatagtaaatgaactttaaattgaatatttcttgagactaggctgagagtctgtgaaggcatgccagttaccatacacatcagacctaatacactcctgaggtcctacttcatacatattatttgagtgacactcaagaaaaggttatataaatgcagggtttagtttaataaaacaatgtttaaaactacaaatattttataaatagcaacagcctagagagaagaaaataagaagctatagtgaacaaaagaagaaaaatgaaaaggtgaccaccaggagaatgaagtatattggagaagtaagtatccttgtaaaatctcttttaaaatgataattatcatatcaataactattattattcttcatcatcattattttaattatcatcatcattattttaagagtaggagccaggaaaaaatccaaaatggttaagcaatttgtcagagttcataaattcagacttacactagttaatatagagaaagagaagtagaaaaactacttctaaatcaacaaatacctgataccttatttaactccttgaaatttttaggttttcctgatggttactttaagtgaaaaatgagcattagatttattaaagttacatgatactatgtttgtttcttactctataagaaatgttgataaatttttagttcctgaactcaataaataaagattgaataccttctccatcagaggcacccttagcagtatatgggcgacaaacttacataggttagtaactgtcataggagcttacaatctagtagaagactgaaacagaatgaataatgtgtttaaattacatggactatttgggtagagtctagtgcagagactgccagttgtccttcaataattctcctccccttctgtttgtctggacatatatggccacccagaataaagaccacatttctcagccaccctagtggcttagtattgccatctggctaagttctagacaacaggatgtaagagtaaatgtctgtgatggcttctagtaaccttcctaagagacaggtgatacatgctgtctgtcccttctttcccagtcccccatcctactgtttaaaatgtggatataatgactggagctgcatccttgaccctgaaggaaagggccatatcctagggatgtaaggtagaaagtccaaaggtgtcttggtccccaaggtctttgtggagcacagctacagcaccgagcctgagctggctacctctgggcttttacaggagagagtaataatactgtgttcttgtttaagctatttttattttgggttttcatgatccacagttaagcctaatcctaagtgatacggtgtaacaatgcaagcaccacacgtgtggagaagatggacaggtagcacctaaatggagtggaatagggaagaggtagcattagagaaatgaattcacagttggttcagaatttttaaaggagagacatcaggaatgaaaggtagagtattccaggcaggaaaaaacaaaacaaaacgaaacagtataaaacacattgctgacatggaagagttctatgtgtaactgggaaacactaaatagttacagattgtcaagaataaaatgatgatttcaggctgaaaatgttaggctaggacagatagtgaaagattttgaaagtgtaatacaaggaatatggatctcattcttttactgatgggaatattatagtgtcctttagaatgtgcctcagagctccaattgtagaaagagtagctgaccaatgtctcaagttgctgtgctctggaagccatcaacaagtttgcactgaggtcacctctaccagggttgatcccagagaaaaagactgagcacactagggacactaaagtaggcctaatcctgggaggcccagtattcttctcacagtaaatttcagctagaggacttcccagcagccttgccaaaccttccttagaactgttcagctgtctaggatacttctgtacaactttccttccttcttcctctccttaactctgggtcagactttcgtgttggtctgatggctttcctggctccttccctctggttctcacagggtgttttctctaataaatttctgcacatttaatctaatcttggcatctgtttcttggaagacctggactaactcacacatctaaggctttttgtacaatgtgtatcaatgaactgtatatgagtgcattgttgggatgagagaattaggtacgtggagcttgaaaagataaatttctgtgctttagaattaaatgggagtcactgcaggtaatgtaaaccaaagacaaataaaaaaaaaatcaaagagacatggaaataatagctaacacttactgaatgccagaaattttctgaagcattttatatacattatcttatttgattcttagtacaatcctactaccactacagatgaagaaactgaggctttgagagattaaataatttacatgaagtctcacagctagtaagcccagtatgtggtgcaacttaaatacttacatttaaatacaatcaatctgacttctacattcttctacactgtatccacaattttttaaagtagtagtctttacttatttaattacacttatattttctaatatgataatcaataacaagtataaactaatatgtatattccaagaaagtgacctaaaaggattaattctatgtatttatcattttatgacacaaatgtgcatttgtgaatgaacataaagttaattagtatggaattatagcactaaaatatctacttcttaaagagctaacataaacggcacaacattatactcatttttttccttctaattgggtggctcttgaattgaagcacaaaaactctaaaacttcccaccatgtggaaatgagcctccctttggaaattcctgggcaactcaactcccaagagcttactatgctttatcccttttatgatatgcttctaataattatgtgtaatgttcaccctgaatatgttgttttacatttaacatttcaaaaccatcttcagtatattaatttatgaggtcattagtggattggttggaaaaatctcgaatgagctatactttttaattgataaataacttcctgaaaagaatgatttgcttactgctaacatcaaattgcctagtacttcatcaaattgagagatggcaaagtttggattggcaaagtttttaataatgagaattggagtcctaaatcctaccaataatcagttttaggaacaaaataaagaatttgctggtgaaaaataagtatcaatattagttttgccctttttcaaaatgttaacattactaaacaccattttaaattcagttactgcaaatttaggcctgttacctaatttttattaaaataaaaaaaatctcagaggccttttactgtatcactataataaaagctaactttaccatcccagctaaaaacagtgaaaccccgtctctactaaaaatacaaaaaattagccgggcgtagtggcgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaagctaactttaaatgtttagttaacataagctattactgttgaaatgattttcattattgtaaagtcaattaataaatcagttaaaatgatccatgtaaattagtctcttttaaggtaatcacactgacctatttaacctttataaaaaatatctttatactaagactgtcttggaatcattaaatcaataagtggaaagatcctttccatttttcctacagagagggaatgtggtatttagaaacaaatatatatatagcaagacatttttgtgtttttttaaatgcatatttaccagtagaggtcactatcacaccaattcactggatttgtccagctactgctaaaagaaattagagggcctggctgaatttataagaaaaaaatcaaaagccaatacctaaaatataatacacagggatatgctgctgcacaaatattaaaagataatgtagataattcatcattttggacttttaatatgattatcatactgatgttcctattgtcccatggaggtaaaggtaaatatataaacagagatgcctatatttctatttatgtataggaactcattatttatgcaagccaaaaagtaaaatattcaaatatttacatatgtcctacctagaaactttctaaaatcttctttccaaaaaggaaaaaagatattacagcatcataaaattaaaataatatatattaatgtgcacattttcagacatttcaaaaggattcaatactaactaaaacaatgtcaaatctgctagaaaatgcaatggcacaggagcttaggacagaataggtgtggagacgggatataatcttcaatgcatgatcagcaaagccaagaaggaaataaaggtcagcaattcaattatgaccatgtgaaccccaaattccaggacatcagaaaactctctggttagacaatccatggtttatctcccttgactactcacttcatgcccaagtcagcagtcaaggcttaaagtcaggtctaccttctgagtcaaatgaattccccatctgcctccaagttacaccccaccctttgctaattcctaaaatcctttaataggagaaaaggcccttccttgtaccacattgtcaaaataatagtctagtaatgagttttgatttaaatataaatacttaacaaagtaacaactttaagtcactgtggtcaatagtctctccatcttgatggaggacgacttaggaccgtaaatgtgagaaaagacaagagacaataaaataatctgtagcttatatttcttaaatcaaactggtcatgaaataactatttagccaatattatatcatgtgataaagacaagtagagaatacgtgcttttaccttgttaatgtatcagatgatttttctaattcctcacactccatgtgaaacacactagaaaaagaatcctaaaaacagacaacacaggctgagaaataagtttgacaaggtaatgaaaactatctagatacagacatacatgctatggaattgacaaaagaccccaatacttgtagtatatttttacttattcttggacaaaatagacccaagtactcattttatgacatcctcaaaactgcttcccatttaattaaaataaaagtttcgttcatataatttctgattttctcttggaagaatgattatatgaggactatttgtttttttctaggtgctgatggatttattagtttcaaaattttttacacttattgaaaattctcaagttttggcttttaacgcttaagtacattgattgttgttaaatcccaggtaaagaatcccttcttaaaaagatgtttcattcagtaatactttatgtgattattaaaataactgtgaaaattttaacaacatagagaaatacttttgaaattacattaaaggtgtggtggttcatgcctataatcccaacactttgggaggccaaggtgggtggatcacttgaggccaggaatttgagaccagactggccaacatggcaaaacccctactctactaaaaatacaaaaattagctggatgttgtgggcatgcctctgtcatcccaactactgggaaggctgaggcacaagaatttcttgaacctgggagaccaaggttgcagtgagctgcgatggtgagatcgtgccactgcactccagcctgaatgatacagcaatactctgtctcgaaaataagaaagaaaaaaaattttttaaatcacattaaaaagcagaacagcacattatgcccatgctctatttatacagaattggaagaaaacagaaaaaaaaaatgatagtttaatctggggatggaagaaatctgtacatttctttccttcttacattttcacctttgctcatgttgttgatgtacttttaaacaacaaataaatgtaatacaaatgaatataaagtcacctaattccttttctaaatcctacaacttaagtagtcaaaaagtaagcaaaatatcttaataagcatattgttgcgctatacttccaagtagcactgatccaaatcagtgtactaccataacaggtgttaactggtagaagtatccattgagtgcgaattaaagtgatatttaagttgtgtaaaaaaaggagtgcttcacatataactttcaaaaattaaatgcaaaaagtgggtcatagagcaaaaattacagattaagtgacatactacattaaggaattctgacctgaagtttaaaatgatggcatggctactatattaaaatcacctctatattaaggattttataactgattgaaaaatatgaaatagtatctatgaaaatactgattaccttttagcctactgagttctcatttgatattaatcagaattttgtattaaacaatgcattcatctgacacatatacacatcccaaatggttgagatgttgggtcatacagtatagtccttatatctaaatcaactaaaatttcttaatataaattaagtactgaataccttttattattctactttgccccaaaacataacttcggatatcatatgtagattataattgacctatacaagtgatagtgcacgctctctttcctattaatccacaaatgaacaacctattcttagggactaaaggaaaaagaaaacaaacaactacagcaaaaagaaatattccagaaacagtggttcataggttgagaagggagagaaagtgcataaagaaaaactgccttaggccaggggccctgattctactggcaaactcaagacagctggcctggctgtaactagcactctgtgacaacagtctatcttaccccagacacctgaaaatgtttcttcacattacaaaatcaatggactgaaatctaccagttagaacagcttagtggttttccactgttggtaaaaatatgggacttatggggaccattagtaatactcctactggctatgccttttggtttctatacaatttctagtaagaagaaatttttatacccaacccatccagaatgaggagtctggtctgcctgttcatagcaactaggtcaccagtattcctgaccatgaaaagtcagcacactgtaatgacaatatatttctccatgaagacagtgtagccattggtagaagcagcacacagacattcccatggtaactattttcaggaggttgggatggggacatgaacagaggtaaaaaaaggctgatgaagacaccctccaccctccacccctacctgtcttcaaccagaacagctcataccctgattagttttatatacatattcatacacatttgggtttgagagagggttctaagaccaaaatgaggtttaaaagtagtgcttatagaaatataagtttctgtctttctaaaaataaaaaagtcatactctgtactcacggagcaatcttcatccactatgaaaatggtgcatttctgcacttgcatgaaagagataatagtggcagctattttcttcaaaattacttctaatgattgttgttcttcaaaaattaaactagcaaggtcaagcagcacctagacaaaaaaattaggagctcattatttagcaattgattgtaattattaaagcacaattatttatatgggttataaattgtttatataacctagcaggttatgatcaagtctgcattcaaatataaatacgtctccacttattaacaaaatcctttattgactgttaatatagttaatatagttgttaagatcacagcctctgaagccagagtaatcagtttttaatcctgacttcctttactgctagctttgagactgagggcaaatttcttcaacatggggatattaatgacattaaaatcatagggctgttaggaggattaagataatatttataaagtattttgaacactatctggtacataaaacgcactgttaatgttgttccaaacttttcagatcaacatttgtcaacattatcaatatttttacagagcacagtaaatattacccgtcaaagtaaacaaagttttaagaatttcctttgtgtttttttctggtagatttctctttcttctgaacctcataagtattaccaaaaacttagtggaggtgacgctatcctagctgaggtctgaaagatgagcaggaatcattcaggtgaaatagggaagagaaatatttcaggcaaaaataatagaattcagagaaagtggtatactgaaagttttgattagattttataagagcacagactataaagagaagaactgggagatgaggttgcagcgttaagtagaaaaagaacctgaaaagcactgtatgtcttttgaagcagtttcgactgtgatgcactgcaggaaggaagtggtgtgatcccatctgtttgtaaaaatggggactggatgaaaggatggcaagaatagaacagggagaacattgcagttaaagtcaatggaaggtcccatatcttattaacacagattctaaacagagaaaatagagggtagagaagatgaattatcaaagaaataatgaaaaaagaattacacagaagtaaacagtttgcttaaacctccaaagagatgaaccaacatacagataccagcatgatgaatgaaaaaaaatactgtgaaattaagttacaaaagcaaatataaataatctgaaaagcttatagacacatagacaaaaatagatataaataataatataaaaatacaaaatatgtattatatgccatgttatatatttatattgtagataataaatatagctacaaaagagctaagaataaggacaacatggatgctagttagaagacaaagcactacttctaaattctgagaaactgatttttcagtttagaattttatacccagccaaagtggcaggatgctacaatacatattttcatacatgcaaggactcagaaagtttactttaccaatgccctttcttaagtagttaattgagaatgtgctgcaacaaaataaggaagtgagaaagaagtaggggatccaaaagatagtggaatctaagaaagcaatgaagaaaagttctatgatgacactagtgtagcaggcatagggctaaatagtgtagcttggaagaagaaaggttggagaacctcagtttggacctctgcaaacagaagcagaaggggaactcaacaggatgcctaatataatggagtttggggagaggaggaaacaagaacatgaggctatactagagcaaagagttcaaggaaaaaaattcagaaacatcaggaaaaatgaaaagttctgtaacaaaggtagtatgaacaacatttacataattatagtgcttataaatagtttctttagaattgcaactttagaattaacctagacaaagcccaggaaaagttcatcatggttgtagaacagtatatattaccaatgtgggcaattgtaaaagaaaaagtccagatggaaaaagcagggctaaggagcggtagttgggaaaaagagataaagagaacaggggatgctaagacacctgtcttacaaagtatgaaatcaagagtaatatctacagttgacagagcaagaactaaaaccattatttaacaacacaagtgcaacccatacagtgacttaaaacagtgacagaatgattccagtaggataagagtaatggcaagtaacgtgtggtgtaagtcaaataaattctcatctcccaagttaatgaacattgtctaataagataaacaactaagcatggaaaataggaaatacaaatgactactagaaaaaataaagtattgagaaactgaatctgtactatctaaatttttaatcatctgcatacattacttggataaaaatgtaacaatttttaaaaagtatttctatgcactttctttagtaatcagactgacctgatttctcttgttctccagcagtgaagtctcatagagctgagcattatgaagaacaataccacaaaatgccaaataagcagcaaagtcctaaaaaacagataatagacaaataaaaacggtacataaaacagtctagttacattgcctgaaatacagatcctcaaatatttacagttagaaagccaaaagaatagatgtttgttctacataaaattaggatgatataaactaagtcttagctaaaggtattggaatagtctcctaaggtataaattaggtataaatcaataaggagaaaaaggagaggaactaagataaagactttatctctttataccacttgaagttacaatttattccatgcaaaatttggtttagcctctccatgatattaagacttggatctatgctgaaattattatataaatagcttgtaactcattactgcagcaaacaacagcttacatacttgttaaaagaatattcacaataaaagcataaagttaaatattatataaagttgcaaacattaaatatgtcatttttaacatggatctatcatcctcattaaactatactagggtaatgtgtttctaattatattaattattgattgactattaattattattaattaatattattataattaataataattaatagtattaattattgattgaaataaatatttagacagcatatcttatccacaatgtgatagagccttaaaaattcaaatcaattcaagagggagttatattaatggattatagacataataatggaattcaaagccaatccaggaaccatgttttcacaccaaatattctcaagtgccatgaacagaacaggagcctagatgtctattactcgatttaaaaagtatttgctatgttctgaagcaattataacaaggggagcaacacaggtgccaacctagcctatagcatagagataaaaataactgtcttgtttgaacgtcttccaaattcaaaagctcctagtaattttcaggggaacaacataaacagcaatgggctttgaataggaataattcagtaggctatgatatacacataattacttattcaataggaaaaataataaaacctactcatagaatgaatttatcgacaggtttacgggcttttgtccttaaatggaaagcatgtcaatgaggcgtgtggaaggtactccttcagagttgaacgagaagtataataaaataatgctggctgttgctctctctgaagctaaatttacatcatccagcctgaattcataccttggcgccccactgtctgtgcgcaaggcttataaaacattcagaaatttgctacgccaggaggcaattccaatttttagtcaaccaaaagtgctgaacttggagcagtgtttttatggggttttactcaaggttggatctctatagcagtgatgaaaggtaaatgatatagttaaaataccataagtcaccctctgtgtggccccaacatgcccagtgcaggcttggcagcacagcaaggagggaatttgggggtttctgctgactgaataacacaagtactcagatgtgaaatcatcgctttatttagcctaagatacacttgaacatttcagatcatttttaactctaatttttttgtgtgaccaacaatttcagcaacagctaaacctagaggtgtatatactataaagagaaagcatcttcctaaattggctcatgtctgacacaagttttggtaccttttcatctttttcagtaaatgtcccaccgtttcctgatttcttgttgatggcctgggctacaccaacaacctggtataaggagagaaaagcgacaatttttttattgactgaaattacttgtaaaaattcaccaaaatgtatttatagaagatatcctgcatgtgctttaaaataacactagtctacaaaacaaaagcaaaacccctcatcagcatttgagcaagctttacatcatttaccacattctttcatcctaataagaattcgaatgtttttaatttattagggcccaaactatgtttgatcctgtgatttcaccctgcattttgaatgaaattattttagcaatcacattttaagtatatattttccatagtttttaaatataaacaacacattttgattacagttccaataaagtatataagaatatgaacattttatatgggttttaaatataatattccaaaacggctaaatgctcttttactaaaaatgaaacaggacctagtggccaatcatggaaagaatgcaggaggatcattagggcaaaaataattcttaatgtagggatgcagtccaacttcttttgaaatttctgcccttgaaaattattttaccttcaacagacttatttttgggaaagagggtactgaaaaatcaaaacaggaattaacatgctgaggcttatttcaaatagatcagaaggcatttggaagttacttaccttttagttccaccttcattttgagttattaccttagtcctataaagaccttcaacttactcttctctcctctttattacttattaattctactctttcctttcttctgctatttagtatcagtggaataagctattatcctctaactggctatacttcagaaatatgtatctttagttctatgtggatggttcactttgttttctcagctcattatagtatcttagctttaagaaaaagatataaaattctcctctaggatagcagaacaaggaaggggaaataccttcttgtcttatgtagttttctagtcttcttaacatttttctctctctctctcttttttttttgcccatatggtaaagggatattaattgtttttaaaagcagaattatgcaattatcctataccttttcatttcccttagagcaactctctcttatttttacatgctctttagctcttgaaaagagtggcagatttctagatgctctaacctcagtgactaaatttctagtaaaattcctctaaggtcaaaaatgtctggattgtagttacgaatgttcacgggaactataataagagccacttgaaggtcattggggtctaatatagagtagtataatttggttattttaaatgctcaggtattcattcatccactcaacaaatagtgaagtgcctattacgtaccaaaaagtaataaaaaactggggaagtgattactctgaacgagctcagaatcaagaatgagtgatacataaacatagacttatagcgtagtaggatggtgggatcagtttcatgatacagtggccatggattgctaggagcactgaaggggcacttaatgtgggtaaaagagaaggagtctcagaaatgacatttaaattttttttctctaataaatagttttacaaagtaaagacataaactttaaatctgtgttttaagaaagatgagtttcaaacagatatagaaagtattatgcaaagtttctgataaatatgcagtacaaaaagtatacattgatatgctatctgtacctggaactgtatgaagcaatgtactaagcaagaaaataaagagaaagctcctgctcactcaaaaatataagaagacaaaaaatcagctgcttattaaatgatcactaatcaaactatattaacattttagtccatcatcatatcaacataaatttacagtgagatgatgattcctttcagtcttttttttttttttctttttgagacagggtcttgctctgttgcccaggctggagtacagtggcacaatcacagctcactgcaggcttgatcttcgaggctgaggctattctccaacctcagcttccaagcagctgggactacttggaaggcatgtactaccatgcctggttaaattttaaaaatttttttgtagagatgaggtctcactatgcccaggctggtctcactatgccctgcactcaagcaatcctcctgctctggcctcccaaagtgctgggattacaaacatacagtaagatagaagaaataaattaaatgttttatagtataggagggtgactatacttaacaaaaatgtattgtattaggggtaatagacaccagaaataccctcatttgatcactatgcattatatacatgtaacaaagtttcacatataccctgtaaatttgtaccaataaataaagaaatattaaaaaaaaaacaagttctgtcaagagactattagaccaggaaaatatagttggtcctttgtatccaactgtgatagaaaatgtttgacaaaaaaattttaaacccacagcaataaaaataacataaaataaatatagtaggacaattacgtacagagcactcacattatattaggtagtataagtaatctaggggtgtgctcagagcagggggctgaagaatggctcctctgtttataacacatggaacaggcatctgaggtcactgtgacaaggggcacaaaacttgtgactccctaagaacaaatgtcctacaagtgtaacaaaaaaagtaatccagaggtgatttacagtgtatgagaggatgtgcataggttttatgcaaatattatgccattttatataagggacttgggcatccacagactttggtatgaggggatggagtggagtcctcaaatcaatccctctttgtatactaagagacaactgtatatctaacatgtatatgtgcctccatccccagaaggatgacatttgaaaaatgacactgataaaaacagacaaaaaatagaagaaaaggcatagtgttcatccagggttgcatacacaataaaagacaaattaacagtttaattctgactttaaggatcctgagcaaaactggcatcctctgccctcatgttcaaataaattcagtccttctttctgctgtcatccattgcttctttaaacaaattagatcattgtctttaaatcaagtaactgttaactataggctttgaaatgtccatttttaatgacagcttttactctaagtatatctcagactccatgtgagaggcagcacccctaaaagcattagcttccatatcagaatgtccattcacttttgcctacctgctggctaactgtactctcagatatgggcactccacgctatttctgtaaaagcgcaaaaaagcctttctgttttctattttactggcactatgcacagcacaaatggatgttatgtcctcacagggtcgagtgttcttttaggaatgcaaaggccaagacttgactctcactgggcgagcagtatggaatgtgacagctggttgtttcagggcaactgatcattgccacagtgagcaatttcttcttcaataagcagctgccccagacatttactgaggtcatacatcaatcccaatacatttccccatccccggttcaggggatgctcagcatggaaactaaaagcaaaggaggaaaggacagactacaaatcatagctatccctctctctcagcctcagaagatctccactgcaatgacaggactctagacagtctaatctgagccaaatacaaactttactaagaaaactagaacttaacaatatatagaggagttaggggagaattttccctagtgctcttttcaaacttttctttgactcatttattcattctgccataaatactttattcaacagctaactactaagtgcctttatgtaccagtagtgaacaaaacagatgaaaatccctgtcctcagagagctgacattctaatcagtgttaggcttgggaatcccacccccacatcctctccccacctgctttacagatgagaaaactgagagtgagagagttgacataaccgatccaggctttctgacttctcttctgaatcctaaggaatcatcaagttatggtaatattccatgtggtaggcaaataatggcccccaaagatgtccttgtcctaatctctggaacctacgaatatgtgacccttaaatgacaaacggggtttttgacatgtgataaagttaaagatctggagatggggagattatcctgaattatctaggtgggcccaatgtaatcacaaggtccttgtaaggaaaagtggaatgcaggagaggcagagtcaaggaaacatttgatgatgctgttctgcagattttgaagacagaggaaggggccatgagcaaaggggtacaggcagcctatggaggctagaagggccaagagaacaggtctgtttctagagactccacacagaaacacagccctgtagatgccctgattttagcccactgggaattattttagactctgaagtccaaagcttcaaataatacatgtgtgctattttaagtcactaaatttctggtagtttttttacagcagcattaagaaaccaatacattccattcaattgtgattcttatattcttgcattatttttcttcttctcctcacctcattttatctcttctgtttcactatgtaaatcctcactgtctttgaagaacttgacatctcattcctaatcatcttcctgccttcagtccatctttgacaatttagccaaatttatattcttggggcactgttgtgcatacacagatcatctcatttctcaagaattttaatggtttcacccatctacagaataaaaattaaagactctacctaacattccacactctcaacttaactatatcacttacatgggtctttgggttagaataccgcaatgtcctgtgttcacataattccttgaaatatcacctctctactgaggccaaatctccaaaaaatcttcccttcagacctacccctctgaaactccatgtggcagttgtatacgccctatacgaggcagggtattcctttttaacctaattttctttactcacatcctagccctgcaattagattgctttctaagtacttgatttatattttatgctattatcaacactttgcattattttacatgtactcaaaagttgaatagtatgtgttgttgatgataatgggaaaaatgccagaaagaataaaattttttagggtaatgtactaactgaacaatgcatattcaaataataattaattatgtcttcccatttttggctctagcctttgcttaatattaagaaatccatccatatctgagaactttgtgtggcagtaaaaactttattttcttaataagccattaattatggagttgaaacttatagcctaaggcgacactggaagagagaagaaagaaaagcttgagattatttaatttttaatttaaaaagtatagaaaatcacaaagaatgagacagtaaacatccatgcctttgccatctaaaacagtgttagtgtgagacttgttaaaacacagtttcgtgggtctaccccccaaatttcagattttgtagatctagactggggcctgtatttctaaaagttctcagatgattacaaatgctgctggtccaggcacaaaagacgcattgacaactactgatacagaattactaaatgttaatatttggtgatgtttcctttattaatactattaaattaagataaaattaaattggacttcctctttccagtctttcttctcccccctgttcctcctaccatagtcaaccttcttcattatactgttaaaaatacataaatctatacacaaaacatagtacttttatctttcaaaaaggtttcttaaatgaaataatatataggaatcattttgcaacttgcaattatattcaatgttgttttttaagatcaattcatataaatctggttcattcattttatatacaatattgcattccatatcaaactgtattcatttgatctccaaagaatggatgtttgggttgtttgcaactttttgctactacaatctttaagaaacatctttgattttcttcttgtgcacatgtgcagcaacttctctggctaaatcttcaaaaagattacagaaatttatacctttactagcaaggcctaagagtctccattaacctcacatccttatcagcatctggtgttatcagactttttcaatgtttgtcaatctgatgggcataaaattgcatctcattgttgctttaatttgtattttcctgattactggagagaatgaacatcttttttattgttattggctaagctggtatcctcttctgtattgcctatgtgtacattagccaattttgaccattttagttatggttttggggtgggctcttcttaatgaattttagaatcaaagttagatatttctttaagtgactggtaagattgattttatccttctgtatatacaggcacctttatacctatgatttatctcaagagaatgtttacagatattccatggttgggggatgagacaaggataaacagaggagaatgatgcttttagtttactctcacagccttcgtggctacgaatgggcagccaagtaggttggagagaagcttctaaggaattgcaagatataagaaagcagtgccctgaagataactggcatcagaaataacatgatcaatgccattgtttctaatacagttaagaaatctcctcctcgctaaaaccagaaaaattcaaatgctaaaaagcttgccattaaaaaaaggagaagggtgggcttgccatgtaacaggcactttgtaactgttcattcatttaatccttgacataattctttaattttcattcccattttatcacagagcaatctgatgttcagaaaacttacataactagttcaagaatatgcagacccagacactctccagacttgatcccaagagctacaattctttctactactccccacaggaaaaagtgaaatcagccctagtacaaaatataggctttttttttttttttttttttgagacagagtctcactctgtcgcccaggctggagtgtaatgatgcgctctcggctcactgcaacctctggctcccgggttcaagcaattctcctgcctcagcctcctgagtagctgggattacatgtgcccgccaccacgccccggctaatttttgtatttttagtagagacgggtttcaccatgttggttaggctagtctcaaactcctgaccttgcgatctgcccgcctcggcctcccaaagtgctgggattacaggtgtgggccaccgcgcctggccaaaatataggctcttatggactcctcttttatactcaaggaatcatggagaccaagatccagtacatactaacgcttagtctttagatctcataaggatgcttatcttcttaatgcacattttcatcaaagggaatggaacaatttcaaaattataactctaagaaacaaagacaatccaaagtggctgctaaaagctggtttcttggacttaggttataagtctcgtaacaagttttcacagccaagaaccacttatgcaacattaaaaaaaatcctatgtatcaaggaaaagtgaataataatgcagtatcaaaaataagtagattcttcaagaaaaagcaaaactaatttgtggttatagatatcagaacagtgttgcccatgggtggtgaggactgattagggaattagttatacagatatatgtacatttttcaaaactcatcaaattgttcattaagatctgatgaatggctaactagaataaccaatgcagagaagtccttaaaggaccggatggagctgaaaaccaaggcacgagaactacgtgatgaatgcacaagcctcagtagccgattcgatcaactggaagaaagggtatcagtgatggaagatcaaatgaatgaaatgaagtgagaagagacgtttagagaaaaaagaataaaaagaaacgaacaaagcctccaagaaatatgggactatgtgaaaagaccaaatctatgtctgactggtgtacctgaaagtgacagggagaatagaaccaagttggaaaacactctgcaggatattatacaggagaacttccccaatctagcaaggcaggccaacattcaaattcaggaaatacagagaacgccacaaagatactcctcgagaagagcaactccaagacacataattgtcagattcaccgaagttaaaatgaaggaaaaaatgttaaggacagccagagagaaaggttgggttacccacaaagggaagcccctcagactaacagctgatctctcagcagaaactctacaagcctgaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctacaagacctcctgaaggaagcactaaatatggaaaggaacaaccggtaccagccactgcaaaaacatgccaaactgtaaagaccatcaaggctaggaagaaactgcatcaactaacgagtaaaataaccagctaacattataatgacagtatcaaattcacacataacaatattagccttaaatgtaaatgggctaaatgctccaattaaaagacacagactggcaaattggataaagagtcaagacccatcagtgtgctgtattcaggaaacccatctcaagtgcagagacatacataggctcaaaataaagggacgcaggaaaatctaccaagcaaatggaaaacaaaaaaaggcaggggttgcaatcgtagtctctgataaaacagattttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagacttagactcccacacattaataatgggagactttaacaccctactgtcaacattagacagatgaacgagacagagagttaacaaggatatccaggacttgaactcagctctgcaccaggtggacctaatagacatctacagaactctccaccccaaatcaacagaatatacactcttcagagcaccacaccacacttattccaaaattgaccacatagttggaagtaaagctctcctcagcaaatgtaaaagaacagaaattataacaaactgtctctcagaccacagtgcaatcaaactagaactcaggattaagaaactcactcaaaaccgctcaactacatggaaactgaacaatcggctcctgaatgactactgagtacataacgaaatgaaggcagaaataaagatgttctttgaaaccaacgagaacaaagacacaacataccagaatctctgggacacattcaaagcagtgtgtagagggaaatttatggcactaaatgcccacaagaggaagcaggaaagatctaaaattgacaccctaacaccacaattaaaagaacaagagaagcaagagcaaacacattcaaaagctagcagaaggcaagaaataactaaaatcagagcagaactgaaggaaacagagacacaaaaaacccgtcaaaaaatcaatgaatccaggagctggttttttgaaaagatcaacaaaattgatagactgctagcaagactaataaagaagaaaagagagaagaatcaaataggtgcaataaaaaatgataaaggggaaatcaccactgatcccagagaaataaaactaccatcagagactactataaacacctctacgcaaataaactagaaaatctagaagaaatggataaattcctcgaaacataccccctcccaagactaaaccaggaagaagttgaatctctgaatagaccaataataggctctgaaattgagcaataattaatagcttaccaaccaaaaaaagtccaggaccagatggattcacagccaaattctaccagaggtacaaggaggagctggtaccattccttctgaaaccattccaaacaacagaaaaagagggaatcctccctaactcattttatgaggccagcatcatcctgataccaaagcctggcagagacaccacaaaaaaagagaattttacaccaatatccttgatgaacattgatgcaaaaatcctcaataaaatactggcaaaccaaatccagcagcacatcaaaaagcttatccaccatgatcaagtgggcttcatccctgggatgcaaggctggttcaacatatgcaaatcaataaacataatccagcatataaacagaaccaatgacaaaaaccatatgattatctcaatagatgcagaaaacgcctttgacaaatttcaacaacccttcatgctaaaaactctcaataaattaggtattgatgggacgtatctcaaaataataagagctatctatgacaaacccacagccaatatcatactgaatgggcaaaaactgaaagcattccctttgaaaactggcacaagacagggatgccctctctcaccactcctattcaacacagtgttggaagttctggccagggcaatcaggcaggagaaggaaataaagggtattcagttaggaaaagaggaagtcaaattgtccctgtttgcagatggcatgattatgtatctagaaaaccccatcgtctcagccaaaaatctccttaagctgataggcaacttcagcaaagtctcaggacacaaaatcgatgggcaaaaatcacaagcattctcatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggacacaaacaaatggaagaacattccatgctcatgggtaggaagaatcagtatcatgaaaatggccatactgcccaaggtaatttacagattcaatgccatccccatcaagctaccaatgactttcttcacagaattggaaaaaactactttagagttcatatggaaccaaaaaagagcctgcattgcgaagtcaatcctaagccaaaagaacaaagctggaggcatcacgctacctgacttcaaactatactacaaggctacagtaaccaaaacagcatggtactggtaccaaaatagagatatagaccaatggaacagaacagagccctcagaagtaatgctgcatatctacaaccatctgatctttgacaaacctgacaaaaacaagcaatggggaaatgatcccctatttaataaatggtgctgggaaaactggctagccatatgtagaaagctgaaactggatcccttccttacaccttatacaaaaattaattcaagatagattaaagacttacatgttagacctaaaaccataaaaaccctagaagaaaacctaggcaataccattcaggacataggcatgggcaaggacttcatgtctaaaacaccaaaagcaatgacaacaaaagccaaaattgacaaatgggatctaattaaactaaagagcttctgcacagcaaaagaaactaccatcagagtgaacaggcaacctacaaaatgggagacaatttttgcaatctacttatctgacaaagggctaatatccagaatctacaaagaactcaaacaaatttacaagaaaaaaacaaacaaccccatcaaaaagtgggtgaaggatatgaacagacacttctcaaaagaagacatttatgcagccaaaagacacatgaaaaaatgctcatcatcactggccatcagagaaatgcaaatcaaaaacacaatgagataccatctcacaccagttagaatggcaatcattaaaaagtcaggaaacaacaggtgctggagaggatgtggagaaataggaacacttttacactgttggtgggactgtaaactagttcaatcattgtggaagtcagtgtggcgattcctcaggaatctagaactagaaataccatttgacccagcaatcccattactgggtatatacccaaaggattataaatcatgctgctgtaaagacacatgcacacatatgtttattgcggcactattcacaaaagcaaagacttggaaccaacccaaatgtccaacaatgatagactggattaagaaaatgtggcacatatacaccatggaatactatgcagccatacaaaatgatgagttcatgtcctttgtagggacatggataaagctggaaaccatcattctcagcaaactatcacaaggacaaaaaaaccaaacactgcatgttctcactcataggtgggaattgaacaatgagaacacatggacacaggaaggggaacatcacactctggggcctgttgtggggtggggggagtggggagggatagcatttggagatatacctaatgttaaatgatgagttactgggtgcagcacaccaacatggcacatgtatacatatgtaactaacctgcatgttgtgcacatgtaccctaaaacttaaagtataataaaaaaaaaaaagatctgtgagtttcactgtacgtgaattttaaaacattttaaaagcaaatgaatatgtaattgctgaaggtatgtgaaagtggaggcccatgtgccaagttcccagctgtctgggtaatgttgaagcaggctgaagtcctgatcatttgttctgtgctattagggaggacgtcgctccccagacggggccagggcaaatccagcctctgggggtcagtagctgtcctgccccaggaacatcctgtgggactagagtcaacctgagactggggttcttccccacgagggaatgcttggcataattattgatcctagtgtttatcctcatccctttgaacaattaaaaaaaaaatccccctcctgccaaatactaaactctctgccacactagcttttaagtaatgaggtaaagctcttaaacctagaactaaagggactttttgcctgcttattagatctttctgtcccttgagatacagagattctgtccagagacagaacagcgcatagccattgcgagcaaagtctccaaataagccctttaaaaactgccagagacacaaaggttacatagcagaaaacagcctgctgtctttcccatggcagggtacattcagtgtttactgttgttgtttaactttccattcctccatttgtctggctttgcaacattctcataaggaggaaatggacattttctgacccccaagaggtgagagctctgcagtaggcactgtcacattcctcatctcactaggaattcaaaaccaccctgtgtgtttgcactttatgctgaaactttacaaaccagtcgcctaaagcatggagagaagaaacttgctcaaggaatcactgctcctaagccagcacaagaccaagtcacttttgctacaaagtcagacctctttctttcccactctgcctctctgcttaagtgagagtaagcccaaaatgtcaataaaaaattttgtatatcaacataggttatacaagttgtatttcatatcagaataattccaccactgtttatgttcacctttacacaatacattgccaaaaacgacttcagagccctggatctatttaataatgaagatttattttaagggtggtatcctgcctgacgccaggtgttggcctgcaaagcataggcttaccccggacggtgtttttggatttggagtctgttaaatcaggatcaagcttgttccatcattgcctgtacttattatgagtccatgtctctatagccttgtaaaatgtcctgccaataaagcttcctgataattacagtatagagtggtgtgcccataatgggcacctactacaaacataaaagaagtaacacagcaaaaatggtaaaaagcaagttttgtgcatcaaaacactaaataggctgaatagaatttaaaaattaaagttggtatcaaaggggttgagagaatgccttctttactagagctgaactaagtgtctggatcactgctgttgcctctactggtctagctaaccacatatgtagccactgaaagctagatatccatataatttaacataagatattcaagaaaaacatgtgtgtgtgcgtgtatatatatgtacatacataatttctttacattctaagtccttcatatggagaacatagtttattatgttctcatagccaaaacataatttcatctcaaaatattttccctccaaatggaagatgtgcctgagaagctaatcatgcatgaaagcacagatgcagacatctgtctcactagcgaaactcctagttgtaggtgtcaccagcaaaaaaagacatgacctcttctccatagctgtgccagttaatatacaatgaagtatttgtaggcatgcctcagagatattgtgggtttggtttcagacaatggcaataaagcgagttacacagatattttggtttcccagaggatataaaagttatttttagactatactgtaatttcttaagtgtgcaatagcactatgtctaaaaaacaatgtacataccataattaaaaaatactttattgctgaaaaatggtaacaatcaccttagtctttagctagctataaactttttgctggtgaagggtcttaactttgatgttgatggctgccgaatgatcagggtggtggttgctgacggacggggctgttgtggaaatttcttagcataagacaacaatgaagttgccaccacggattgactcttcctttcatgatagattcctctgtagcatgtgatgctgtttgatagcattttacccacagtagaacttctttcaaaattggagtcaatcttttcaaggcgtgccactgctttatcaactaagtttatgtaatattctaaatcctttgctgtctttcaacaatattcacagcatttacagcagggatagagtccatctcaagaaaccactttctttgctcatctataagaagcaacagttcatctgtccaagttttatcatgagattgcggcaattcagttacatcttctggctatatttctaattctaattctcttggtatttccacaagatctgcagttacttccaacagtgatgtctcaaacccttcaaagtcatccatgaaggctggaatcaacttcttccaaattcctgttcatgttgataatttgacctcctcccataaatcacaaatgttcctaatgggatgtagaatgttgagtcctttccagagggttttcaatttactcttcccagagccaccagaggaatctctatttatgtcagctatggccttacgaaatgaatttcttaaacaataagacttgaaagcagaaatcagtccttgatccaatgggctgcagaatggatgttgtatcagcaggcatgaaaacgacattgatttccttgtgcatctccatctgagctcctgggtgactaggtgtactgtcacagagcagtaatattttgaaagaaatcattttccctgagcactaggtctcaatagtaggcttaaaatattcagtaaatcatgctgtaaacaaaggtgctgtcatctaggctttgttgttccatttgcagaggacaggctgagttgaattagcataattcttaagggccctaggatttttagaatggtaagtgagcactggcttctgcttaaattcaccagctgcattagcccataacatcagagtcggcctatcctttgatgctttgaagccagacattgacttctcctctctggctatgaaagtctgaaatggcatcttcttctaatagtagtctgtttagtctacattgacaatctgttgtttagcatagccaccttcatcaatgatcttcactagatctggataacttgctaaagcttctccatcagtacttgcttcttcaccttgcacttttgtgttatgcagatggcttctttccgtaaacctcacgagacaacctctgctagcttctaacttttcttctgaagcttccttacctctctcagccttcacagtattaaagaagttagggtctcactctggattgggctttggcttaagagaatgttgtgactggcttgatctatccagaccattcaaactttgtatcagcaataaggctatttgactttcttagcactcatgtattcattggagtggcacttacagtctccttcaataacttttcctttgtgtccacaacttggctaactggcccaagaatcctagtttttggcctatcttggctttcaacatgccttcctcactaagcttattcatttctagcttttgatttaaagtgaacacttgaacacttagagaacactatagggttatcaactggcttaattataatactgttgtctctcagggaatagggaggccaaaggagaaggagagagacaggggaacatgaagaaggtgaaagctttggtgaagtatgttcaagagagaatggaaggaaatggaaatggcaaacatggcctgtataactctttcaaagagttttgttctggtgatgatcagagaaatgaggtggtaaagcagatgtgtggtccaatgagtgttctgcttttgttttcaaaagcagatgggagaaatagcagcatgtttgtatgctgatgagcagatttgatagcagggaaaactttaatgattctggacatagaggagagaactgctgagctaatttctttgactaggcaaactgagatgagatctggcgcacaaatgggaggctggcccttgctggttcagacagttcatcccaagaagtaaaagggtaaccagagtatatggactcagatgctggagcaggagaaagaagtaggggaagttctcttgtggaaatattcttctaattgtgttggctttcactgaaacagtaagcaaggccatcatctgaaagcggggatggggaggcaatgtagagatttcaggggagaagagaaaggattagtctgtaaaacaatacatgcaaaagaaaaagagctaactgttttgttccccacaaaccaatgacttattttaggaaatatgacaactctccccctttataacctacctacaaagctagaaagtatttcagattcttccctctccctcattcctccatcaaatcaatcactaaacctactaaacagaagtgtaacaaatccacaaaaacctctttagcagctttcctgcctctaaacaaagtactctctctgcttatgaacaaatatggaagttaattatcaaaatatatcaagtgtcaaattatgtggctctgggttagaagtgaagaaaatggttcaaacttactgctgtagccacccagatttttaaacaataggaaatatttcctggcattaaaaaaaattcagtacctcctttgcatgacattagaaggctctgcttgatcttgcctctgtctacctgtctgacctcatttccaggcacttccctccttctagtggatgctcaaacagtgtagcaaagtaatagacatattccctctgctctcagtctgtcaacagaggcagaaaacgatggtgcagaaagatataatagagacagaccaatgagcattccctgtgaatattaagtagtgagtacttatattacgtgcaaacagagatcttatgtagaactgttagtatttgtggcataatattttaaaagtcttggccgggtgcggtggctcacgcctgtaatcccagcaatttgggaggccgaggtgggcggatcacaaggtcaggagtttgagacctgcctggccaacacagtgaaaccccatctctactaaaaatacaaaaaattagccaggtgtggtggtgggcacctgtaattccagctattcgggaggctgaggcaggagaatcgcttgaacccgggagatgggggttgcagtgagctgagatcatgccactgcactccagcctgggcgacaagagtgaaactctgtctcaaaaaaaaaaaaaaaaagtcttttaatacctcaatagtttgccaccatacaaagaggcaaacatcttctcttttttccttagtgttccctttttcatgctctacttcctcttttccctctgatttaagacaaccttgaacaccaatttttgtataaacctttgtgtaaacccagtctatatcgcttctcctctggtagttcacaacattttttagtacatgaaaggtgagaactcaaaatgattttaagagatcattttaattaatgagcagagttcctcttttatcctctggctagttttaaggaaagagaaaaataaatatggatatatatgttctatataataaataatgaaagtacattagtactatgtctggtaggttaaagtgtctccacaaattctctgatactactcctttcaagagctggagcctaattcccttcctcttgagtcgggtgtagaacctaaagcctcactgctaaagaacagaacgccgggaaagtcgtagtgatggacaactttggagacgaggttatatagagcactactgcttcctccttgctcattttttctcaaattgctcactctggagaagtcagctgccatgatgtaaggacactgagcaacttatgaagagcccacatggtgaggaatgaagcatttctcccaagaacctcttgaaaatggatgatcaagcataagtcatgcagcccctgcccacatcctgaccgcgtgagatacctgagccagaaggaaccaagcttgctaagccactccagaattcctgaaccacaaaaactatgagataataaatgtttgttcagaatcacttagtgtaatttgttatgttgcaagagataaccaatacggcatagtactcatgattatcaaataatttgtaataatcaaatagatctagacttctaaatccaggtcattttcactccatttcattactataaactgatgcaaaaaaatttaaaaatttttgtaagatcctcatctcttgctctttgatttacattcagcctggactattaatttccattctatgatcaaaagcaagtggagatttagcatagactattaatttccattctatggtagaagagaagcaaatggagatttttagataagcatttaacaacaaggaatacagggtatttaacacttgataaagcactttacctatggaatcttagacattaatggatgagtatagatgtttgtacatatctattgagagcagcaatttcattaacaatcaccttaactcttcaagaatacatgaaaacatgaaaattattttatagtcaaaattcaccccagggtgcaattatatgatgtcgggttagatattatacaaagaaatgttttatacttctctggttccagacccctaatacccattattcagggactatgtaaaacttctcaaaattaaatttataaatcatctattaaattaaaaatgtaatgcattccaaaaagtgctggaatggttatcttgaaattaccaatgaagataagcttcctattgaataaaatatagcactcagtatgaaccaaattttcttatcattaaaaataggataccatttgggtacacaaagcctaccacattaatttaatcttcagtttcaagtttttattcactttctttttcttcttgatcagtaatgtagacttggggatttcacatattagcacagtgtttttcatctgctgctcttaagaaacattcttcttttaggaaagcagttaacatcttcataatatatactttgttatttaaagggcagtgtgcagaaggaaaaagaaaggattgtcactatcacaacctcaagtccagaacaaacagaaactctgcgcagcacttttgtttctaaaacaaaactacaagaaagaatactgtggggaataaatgcagtgaacgatttgtaacttttcctttttttttttttttttcaggctggcatgcagtggcaagatctcggctcactgcaacctccacctccctggttcacgcaattcccctgcctcagcctcctgagtagctgggattacaggtgcatgccaccacacccggctaatttttttgtatttttttttttttttgagacggagtctcgctctgtcgcccaggccggactgcggactgcagtggcacaatctcggctcactgcaagctccgcttcccgggttcacgccattctcctgcctcagcctcccgagtagctgggactacaggcgcccgccaccgcgcccggctaatttttttgtatttttagtagagacggggtttcaccttgttagccaggatggtctcgatctcctgacctcatgatccacctgcctcgacttccccaagtgctgggattacaggtgtgagccaccatgcctggccaatttctaagttttcaaaaacatgtaactagccaattctttaacactaaaatagatctagatcaactggtagtctgctattaaactctgcttatttttgcagttatattttcatctattttgactgaaaattgaaggattatgaataaaactgtaacatttatttcctccaagtttacttgccaaatttaagaaagcggcagtcagtactgtgagtgtgagagatcatagacaaggactccttggcctccacactccatggagatcaagtatttgtcatcaggagcatttatgtggttcctctcttgaggctgtgagataaacacagcagggcactttcatctctccccagggatttctctagcttccctagttcagtctttccttcgaacttgtgtgttgaatattggactcatttaacatttatcttgtcaccttatatagatatttaatttttggtgtacaagagctacctctccaattttttcttttttttttttttttttgagacggagtctcactcactctgtcacccaggctggagtgcactggcacgatctcagctcactgaagcctctgtctcccagccaggttcaagcgactctcctgtgtgagcctcccgagcagctgggattgcaggcgcatgccacacacccggctaatttttgtatttttcgtagagacaggtttcaccatgttggccaggctgatcttgaactcctggcctcgagtgatccaccccccttagcctcccaaagtgcttggattacaggcgtgagccaccgcgcctagcctacctctccaaattgaaaaaaatttaaaagcaagtatcttctttgcttcattaaaaaaaaaaaaaaaagaatctacaaagtgcagtgattcagcagttacttgtcaaaacaagataatttaggagaaataaatgaaaatatttttaaatgagcagacacaatcataaaacttaaattctaaaaaacatttatttttgtattttgtagttggaattacatatctgatttcatgaatgcctcaatttatgagtttcggtaggtgttaatcacttggattcgccaaagtataaatctcataaaaattagctgatactttttgaatctttttagtttttaaaaggaagatatacgctaaaatgctaagatattagctaaaatgatcttttaccacgttgtaatgaatttatcctaaattcttgattttaactgccatatttgcatcaaagaattgcaagtatatcactaagtatgataaaataaaatcaagatgataagataaaaagagagaaggaggaaagagctctgattccaaactgaatttctacttaataactggagttgacattcaacaatggtggttcagcctagcctgaaagacattattggatataatctctagttcatatcagtaagaaattttcagagaaaattcttgaggaattcagagaaatttcagagaattcagagaattcagagaaatttcagagaaataagaaatttgcattatttcataaagtcctgctttctaccccttatcctctcctccccaaataatctagagaaaaaaaaaaatcagtaggcccagagtgacaaatagggctctgagtaagagttaatatttagggttggttatatcagtgaagccactataaataaaaaagaacactcatcttcactatgtcagaacaagcaatacttcaggggagggcagtatttcacaaacaggtcatctgagctagggggaaagatctgagcttctctgtaattctttactaaacaaaaaaagaattctgtctggttatagaaataattaatacaaatgacaaagataaaaactggtctaagtgcccaggtctgaaaaatccagaattaactttgaaataaatttaatagcagccgtaaaaattcacatacctgtaactttttttttcattatgcttcatttgtagtcatggttcttctctggagcagattggctcagattagtatgaaacatgctcctgtaactcttttatctctggtaaaaattttcttataaattcctcttaaggcaatacagaggatgtgactatgatctctctctttttctctgtcatctcatttttcatcttaaaaagtctgtctgcagagcggtttaaacactaacattgaagggccagcagaatacaggcagatctccttgttgccacctcaagtcctgcttctgcatgtagccacattaaacacatcagtgtaccttccactccaacaaaatcaacaataatttaagtgcttactgcagagtctcaagaaaacaccaatcaggagggaagcagagtgcagccatcatccatagcagacttttaagaaatgctcttctctctattatgacccctacagtccgaatgcctgggtttgaatctcagctttgccagtttttagttatgtgactttgagcaagttccctatatgtttcatgtctcagtttccttttttgttaggtaggaataagataatgggttacctcttatggttgtcatgaagattaaatgaactaatacttgccagatcattagcacagttttcacaagatttgcttaataaatatcacacatgtttactgtctcctacatacaaggcagttatttccaaactcctaccccatactcctcaaactactccctcatagacactctggactggctctcttctctcccttgatcacttttttctttctgtctttattcattttctccagccagtagctctttgaccttccaaaataaattattttagccttctaacacttctccagtttctttttccactttgcccattaactccattctctagaagggagtagggagaggggaagattgcaaaaacttaacctctatgatttttttcaaaaattaccatcacagatgtttagtaatatctatgatccttacttgtaaaaaaagcactgctgtatctataacagttatggttataacattaatgaaaagaactcccaaacatttttaattagttgaaatactttacaagaataagaggcaaataaagagcttagatatttcagtgaatcttaaaaatcttcctgcattttccggcctatgttataattcagactttagtattcagcagtcaactactccattaaaacagctttccagagttggtaccaatgtctttaaaaaccagtgtcactgaaaggtaccaggatattttgtaaacaatcaatatttaatgattcaataatcacagttctttttaggttccttggtaattagtcagaatgggtattggcttactcgataagggtggacttagaaaaagagaaaacaccaaattcattttgccttatttatgaggaaaaatagagaaaaacatgtttctcttaagtttaaagtttcttagagggtaatcaatagactatgtcaggggctgtgttgggatcccagttagctgagtactggctttggtcccagttagctgattattatgtggctaatgacctcttcatgcagctcttattccttgtctctctttaaagctctattagttctacatctccttttaaagaatagtagctgatgcacttccagtgtgccaggaactacgttaaacccttcactcacatgaatgcatttaatcttcccaataaccctttaaggtagatccttttattgccctcattttgcagatgaggaaactgaagatcaaagggattaaccagttccatcctggtttgtcagccagcaactaagtggtaaagatgggattcaagcccagagcaagcaatcttaataattagtccccaaagcctccctgcaactttccattttggtttaaaattttcacgacaaagagtagttatgtgtacataaaaagcaaacactactctgagtttgtttatacagatataaatttaaagataattctggaagtcaaatattgcaccttgttagtggcctgggtttattttttggccagccaaattactttttatattataacagccacgcttgatagtgtgtctgttctgtctctcttcattcttttctctgaaaacgttaattctcaggagaaataattttgaacttggcagtgtgaacctgggaggaaagggagcaagatgagaaggaaggagaatggggagggtcagcaagatgtttaaaaagctgtgttctgggccgggcgcagtggctcacgcctgtaatcccagcactttgggaggctgaggcaggcggatcacgaggtcaagagatcgagaccatcctggctaacatggggaaatcccatctctactaaaaatacaaaaattagctgggtgtggtggcgcacgcctgtagtcccagctactcaggaggctgaggcaggagaattgcttgaacccgggaggcagaggttgcagtgggccgagatcataccacactgcactccagcctggtgacagagtgagactctgtctcaaaaaaaaaaaaaaaaaaaaaaaagccgggcgtggtggctcatgcctgtaatcccagcattttgggaggctgaggtgggcggatcacaaggtcaggagatcgtagctatcctggctaacacggtgaaaccctgtctctactaaaaatacaaaaagaaattagccgggcgtggtggcgggcgcctgtagttccaggtactcaggaggctgaggcaggagaatggcgcaaacccgggaggcggaggctgcagtgagccgagatcgcaccactgcactccagcctgggtgacagagcgagactctgtttaaaaaaaaaaaaaaaaaaaaaaaaaaaaaaagctgtgttctggaagccctctcttgaataaagttacagattgaacatcccttatccgaaatgctcgggacttagaaatgtttcaagttttagattatttttggattttggaatatttgcattattatcagttgagcatccctaacagaaaaatccaaaatgcttcaatgagcatttcttttgagggtcatgttagcactcaaaaagtttcacattttggagcattttggattttcaaattaggtatactcaatctgtatttagtccccagtgaagctactgaagattttttcatctcatgaaatgcttagtgtaagagtccaaggctcatattaagtcaccacaaggtaaaacagacaccagcaggagaggatgtgagagcacagagagagacatgagaaagctcaggaacccagcagaagtctaaaggagagagcttcgggctatttggggatctgtggccaaacccacttcaatcagatctgtaagaaggcagcaggtccttggctaagagtggggttacatattcatgtaatgaaatttaaatcatctctcagtagaatgcctagaattaaaaagactgatacactatgtgttgccaaggatgtgatgtaaggggaactctcatacactgctgataagaatgaaatatggtacagctactttggaagagtttggaagtttcttatcaaattaaataaatacctaccatatgacttagcaactgccctcctatgtatttacccaaaagatgtgaaagcataagtccacacaaaggtctgtatgcaaacacactgacagcagctttgttttgtaatagacacaaactggaaataactgaaatgtttatcaactgatgaatgcataaacaaattgtagtatatccataccatggaataaatcactcagcaataaaaaggtacaaactactgatacatccaacagtagggctgaatctcacacccattaggctaagtgaaagaagctacatacaaaagaccacatactgtatgattccatttaaatgacattctagaaaaagcaaaacaatagtgacaaaaagcagatcagtgcttgtcaggagctgtgggttaagggaggaggagatcaactatgaaggggtacaggggaacatttgaagtgacagaaatgttctatatcttgattgcagtggtggttacatgatcgaatatacatatctcaaattcatcaaattgtacacttaagctgggtaaattatattatatgtgtattaatctgttctcacactgttctgaagaaatacctgagactgggtaatttataaaggaaagagatttaattgacacacagttcctcattgctggggagtccccaggaaacttacaatcatggcagaaggcaaaggagaagcagacaccttgggcggcaggatggtgtgagtacaagtaggggaaatgccagatgcttataaaaccatcagatctcatgagactcactcactatcacgaacagcatgggggaaaacgcccacatgatccaattacctccacctggtcccgcccttgatacgtagggattatggggattataatttaaggtgagattttgggtggggacacagacaaatcatgtcagtacgcgaattatatctcaatatagctgtgtttttttaattttttatttaatttaaatcatcctcaccggcagtcataatatggaagaatgtatatcctgaggatactttctgtagaaagggccatcctactcacttcttcctagtgattctgttgcattctcatcagttcccccaatcctgactgttggagaaattgttcacactatctagaaagagaagcttaatcagggcataattcaggctgaatccctttgccggtacaaagctgttttgggggccacgattttaaaatatccttaataactaaaagctgaacattgtcttcctaagtgcacggaatcttagtctgtggtttataactaggcctgccagatgaaatttgagttggatttgagttcagataaacaacaaataatttcttagtataatgatgtcccaaataatgcatgggacacatttctttaaaaatttgatatacctggcaaccatattaataacacaataatgatcagtccatgtatggccttttcaattttatgtattcattcacatacttagttaattaaactaattaattaatctcatattacgtcattgctgcaggcatttttagttactactgctggaactacactttttaagaaaccatgtggcaactctaaggcactgagaatgactactgagaagtaactgacttagggccttgttaatcaaattgtgatcagcagacccaggtaatcatcaacttggtacttgttagaaaagaatctcaggttctacccagacctactgaattcagaatctgcattttaacaaaatccccaggtgattcctatgcacaacacagttttagaagcactgatttagaaagctgtgttttaggcaaatttccaggcagtgatatgtagaatggactaaagggaaattgactgcaaggatagaaacaccttacaagaacatttaaaaaccttaggcattacttcaaaatctgaatcatggtgcatgcaggtagcacgaataaaaagaaaaaaatattgaaatcagaaacattctaatgaaaaaaatcaatggggtttggtaacacactagatggaggaaggagaataaatgtcagaatttgaatataaatcaagtagaagcatcaagtacttctaatatgattggcagtggttctcaaccttggccacacactgcagtcatttgggagctttaacaaatactaatacctgggtcccaatccctgagattctgatttaaggtgaaacctcggcattagaatttttaaatgctatacccagataactggtaaaacatttccgcgtgtgtctgtgagggtgttcccagaagaaattagcatttgaatcagtagactgagtgaaaaagattctccctcaccaatgtaggtgggcatcatccaatccactaagggcccaaacagaacaaaaaggcagaggaagagcatatattgctctctcttcggaagctgggacatccatcttctccctcctctgagacaacagaacttcaaatactcagatccttggattctaggactcacaccagcaaatctcccatttctcaggccttcagcctcagactgaattacaccacaggttttcctgttctccagcttgaagatggcagactgtgggacctcttggtctccataattgcatgagctaatttccataaataaatcccctcatatatcctcatatatcctattgattctgtttctgtggagaaccccaattaatacaattggtaatcttttagacttctccagttggttgtaatacacagtcaggattgagaatgctcaattgaaatattcagtttaactgataatttattaactcttttttccaaataagtgtaaaatgaagagggaattcagtgataacagaatccaaatcttctagttaggtgaaatataaactaacatattttcatttgcctgttaaaatttcaaattgaaatttacataattagaattagctatgatttccatttttttcaaaacctcaatttgaatgaaatccgttaatgaccactgtagttggatgagcatttatgaatactactcatactcctaaaacataatatgcaatgaattgatcctaatcacaaccataattacatatcttaagatagaataacgccttcaggaagaggggaggtagaatatgacatgcataaaatttatttctaagtaaatgggcatagtaaagcaattatcagaattaggccctgtaactaaaaatctaaatagaaaaaaaatcaagcagaacatttaagaactttatagctaatttgtcactaaagcattatttcatatatatgcaaagtaaatacaaaatatttttcaaaaagaaaaatatttccaatgaccttttataaaatggaaaattggcttacctcttccctatgattcttaattggcatacaaagaatgctttgtgtcttgtagcctgtaatttggtcaacttctgcattgaaccgaggatcctagtatggaaaaagaaattcaatttaatgactgacctgttcaaagattgatttgatttttctgatttattagattagagaaatctaaccttggacttaccttgttactctgagtaacaattttattgttgtgaaaggcatcatcatgtaagtacatattatatttgacaaagataaattgaagttgctgagcttttttataagcagctagtgtttaagagaaaaaaatacagactcgaacaaatgttcagaaataaagaaaattcaaaatattaaccactttagatagctgtacttaaattcaggaaaaagtggcatctctccacctctgtaatatcatctcacaacctgattctattgtgcctccagaacaaccttttcaataaatgactttacttcccttgtaagggctcttttacagttcttcagtattctgtacttctatctcaagtattcctaagagtttaaattatacacatatatacacaatctcattgagtcagattgtaaacaatcctttaatcttttgaatttccccttttacaaggcacattatacacacccaataatcataaaggacttctgaggtgttaaatttctaagtatgaattaaagaaacaaaggtaaagtttaattttccattacactttagattgggaagatctcaaattaggctgtaaactctgtgagggtttttttttttttctttttttgttcattactgtattcctagcacaggaactcaatcaaaagcatgcgttaaatcaatgaaggaattcattaacaaataataccacggttatcaaatgttatcatttttaccttaccatatagtttaaagcaaatcttgtcagtaaagggaaaaccaaagtagaggaaatcaatagctacaacaacatgaggttagagtggaatggaatcaagcattccaggacataaacatctgaatgagtgctgttcccttcaaagcgatagccttggggagttacatgcttaatctaataatagcatcactgctccaaaaactacgcagttggaattcccttcagagaatatggaatatccacactggaaaagctcatcttttgatgagctttgaaggtcatttctttttaaaaaaataaaaaataaattagtcacagtaaagctgtgaatgaagtgattacactagattccatcaattggggtcagaaatgaggccaattttcaactgagagggcccaacttagcttaaagataatttcaaaagaaaaggtataaaatggtgaaaaatcaatataaatattttatattataaacactactacatttttgctttttctgcaaacatgctcaaagttatatgaattgagatgcagagaaaaactttagctgaatcttcctaataaaattcttattttatctttagatattgtctaaagaaagcagacaagataatgttgatgaattaaagaagtgaaaaattattgatatatagtgaattattttacaaaccaataagtaaaacatgaataaaaatacatcctcagtgttactttgttaataaacatttgaattatgagacaatttataaagaagacttaacccaactacctaatcaaagcagtagagtttgacagattaaatttagtaggactttcacatattttttgtgtctactgttagtttaaaatcaacagcagttctgaatttcactctccagtgaagagggtgggaataaatacatccttcaaatttcatttgaggtgaagttccaaactcctgacatctcaaggagttctcctttaacaatgtactcagtgcaaagacaatatacataaaggagttctaacccctctaggtccagtaaacatcaaagaaaaaaatggaacactacaatcattgtgattattcctttcactgtttgtttacaagaacatgacagtatgaaagaacacaagccttggatgtccacttgccataacaaagtatcaggtaccagaattccttcctgctgaagacatctataagactagacaaaatacaagacaacaaagccatgggcagagcaaagaaaaagacaacataagtaattgccattcaacattctggctttctgcctgagggcgttttcctgctttagagaaggcaggtgctacccaatgagagcaacgctttgaaacagaattgaatggagctccaaacttctgaagtggttggaaagtataaagcacaggggctgtgctggggggttggaaggaagatggttaggaagcagtgaccaaaagatactgagtttctagtcactttgggcatgtatagggcaaaaaacctaaaggactagcaaaaattacctgctgaaggctaaaaactgaatgtgacaccaattagtgaagtgtttggagacaatggagttccagcccagccagagtagagaattcattcagcagcgcaggcattgaggcaggaaaagaccactccttaggagtaaggactataccatatagttgggggtactccctaagactaaattcaaaagatccactctgacaaataataagaccaagcctgacaggatcaaaagaatctgccagtaattttactgcctgcccgaacaaatctcatcccttttttaaaggaagaggatataatccaaatgtagtgaaacagactatgaccagcagacaatacaaaatcaccacatatgtaaagaaacaggaaaatgaaacccatagtaaagagaaaaagtagtcaataaaaaatgaccccaagatgattcacatgttggacttcacagataaggactttaaagcagctattaaaaattaatgtagggatttaaagaaaaatatagtaataacttctttgcagagataggaatctctgcaaggaaagaaaaaactattaaaatagtcaaatgaaaattctagaactgaaaagtatagtgtgtaaaacaccaagttcattaatacatttaacagcccaccgaaaacagctgaagagtcagtgactctgaagataaatcaacagaaagtatccattcagaaggattgaaagagaaaacaaaccataaaacattaacaaagtttcagtgtcttttaggatactatcaagtgtgtatacacacacacacacacacacacacacacacacacacatacatatatttggagtcccaaagataatgaagctgaaaaatatttaaagacttataaagaaaaatttcccaaattgatgaaaaccttaagcttacacacatggtgtgaaaatgatatgtagggtgaaacatataagttgaaaatgatacaaaggatggctgacctctcccaagaaaaatgaagacaagaaaaaaatgagaaaactcttttttaaaatattgaaagaaaactactatcaactgatagtggttcatctatccagtgaaaatatccttcaagaatataggcaaaataaaggcattttcagataaactaaaactgagagtatttgtcagcactgtatgtactataagaagtgcgaaaggaaattctgtagtctaaagagaaagatattaaaatctagaaagagctagaaatgtggcttgagcacatgagtatatatatatataaaaagagtaaggaagcctagtctttcatttttggagaatgaaacacccaatagaggaaaaaaagaaaaataatgcatctttagttgttggatgaaattggaagtatcagtatgaattcagttgtttttattataataagtagatagatacagaaataaatacaatatagatgtgtatgtatatttatatgttattttcctagctctgtctgctaatataccagcaacaataagcacatctagtgccttaatcttggtttcttaataccattccccccactaaaagaaaccagggctccttgggaaaaaagaatgattctagggctagggcacggaaagtgtaagataggcctcaaacattctgattagccagaaagtgaaaaaaatgccccaaaattaataaggacataacaaaaaggactcagcaaatttgttataatttgaacatcagcataaagataataagagaacataattgactaaataaaatattacacgagtccataattgatgtgaatgcatgaatgaaggagaaggcaaaactctctcttacattagaatttcagctaataaatataagaggtatgatggagttagaaaatcagtggatgctaaagctggtcaataggttgttgatgaacacagtatttacacagtctcaaagtatctgcccatatgatacttattaattacaatgggaaaaactattggagaaacctggtagatatcactttaaaaaagttatcaaatttaacatcatcaatacttacatcacataaatatgcctccttataagatacactacgaaggtgtgtggtacaattaaacatgtttctgatctttgttcccagttcctgacacagacctcctaaaggccatgggatttcttgagtgatactagtgtatttccatatttgcaacaagcccttttcaaccatacccgaattcacactaatgaggtgagccctagaaggcttcaggattaggggtgggaaccagaaaacccaaccttgtgattagaggtttagaacttccagtcccacccccaacctctggagaggggagactggctggagattgaatccactcaccaatggccaataatgtaatcaatcatacctacataataaaacctcaataaaaagctgggaaaaatgaggtctagggaagcttccagggtggtgaacatattgatgtgctgggatgctggcattctggagaaggcatagaagctctgcacaccaccccaccccccgccacctcccataccttgtcttatgcatctcttccatttggctgctcctgagttgtatgtaacctttttaataaaactgtaatcataagtgtagtgctttcttgagttccgtgggtcattctatctaattactgaacctaagcgggggtcactagaatccttgaattggtagtcagcctggaagaagtgtggtagcctagggatcccacttgcagctgacgtctgaagtcggggcaggcttgtgggattgagcccttaacatgtagggtcagtgctaactccatgaggttaagaatcagaactgaattgggttgaactgggttgcagtgtcaaagaactggaaaattaaatagtcgttgcttagttaaggtgtcagcattaacatatatggtattccagctaaaagggcctagcttgaatctatttgtgaaggacattctacaaaataacaggcctgtaccctttaacaatgtctaaatttaaaaagataaagaaatgctgagaaactgtttcagatggaggggagactaaacagacattacaactatgtgcaatatgggatcctgaatactatcttggattgggggaaaataactctaaagcttattaataggatgggacaactgatgaaattttgactatggactgttaatagtcttgtatcagattagataatagtattctatcaatataaaatttcctgattttgataattttattatggctgggcaagagaatattcttattagaaaatatacactgaactatttagtaaaaacatatctttagcttattaaatctttcagaaataataagcatatattccttatatgcattatagagtgaaaaagaggaaacgataaagcaaatggggcaaaaaaataactggagaatctgggtaaagggtgtatggcagtttcttatactggtcttgcaatttttctgtgagtttaaaattatatcaaaataaaaataacagaaaattttaaaaaggaaacaacacagatgacttgacaaattataaggctggttttcttccacagagtggaatttttaagacaatgcctgaaacattgaacaagcatagacacagcagttcccaaactgtgttcccaggggcacagttacacttctattaggagatttgtctaaattacaacaattgctaggggttttctttttcttctaaaattcatctggaaataatcatctgaaattcagttgaaacaattcgtatttctttagaaaaatatattgataaatagttgaaatagaaagtaagaaactgcatggtgaaagaaggtgaaaatttgtttctctggagaaataaaaatgaaagggaaagatgaagtggggaaggaaggaataatagctacatggtcaaggccacataagtggcaatttgacccttccctaagaccctctaagttttctctctagaaatcatggttcacatggagtgtctgtcctggagtagaaacaggacatgagtctgagttttgcactctaattgacttgggagaaggagagatgttttgacaatgtaaatccttaagacatatgaatcatgggaaggtttaagacttcctcaggacatggaatggggttcagggcaatcctgtgtagttattggatgttatctggttttcctataaaaggaaaataccaagcacatttatatagtagttctgattatatatcttactattaatagcttcttagtataagtgttaatatcttattaataaatgtgttaatatcttcttgttattcataaatgccgtgccaagccggctgcagtggcatgcacctgtggtcccacctactcaggaccatagccacttctcgtgcagttgaagtgagtggatcagctaatccaggactccaacctgagcaacacagtgagactctggcttaaaataaatacatacatacatacatacatacatacatacatacatggtgtggcacattgaaggtagttgcatgatggtgggctgatgcatgagaccgtgtgtgactgaacatcaatgtacaggtagcatttaccaactaatcttttcattggtatttatgggtctacatgagaatcactggtctgagtagtggatcctgtcttgtattttgaatatacgaatatgttttcttatcagtaataaaactatagaattttcaaatttatatcagtttatatcattttctgttacaaagttttaaaagtgaactaaatataggtcatttgttataattaactttatgagactttaaaaaaaattctcagcatcaatctgagtattattctgtttcacagacacctctcttggtttcccacagtgacattacatcctttaaagtggtctacgatcaaataagcttaagaaacactgccatacagtgtcatttttacagatgcatgtttaaagagctaggactcagaaaacattagaatatattttcatatcctgactactttcaaaaaacatagtattttaattattcaaattatggatggtgcttagtaatgaattatccattagccaactgacttccactgctaatatcaatataaattagatcacaatgtaaattagatcacagatcaacccccacaagttctaatgaaattcttgggacatgaaataactcctgcaaggctactataaatacagatcaagggtaccaaatgtgaagtagcaacatgacaaatccacaggctaagaggcatcaccctgggagcagtgcaaatcaaggacactagctgttttaaacaatagtacaagaattaaatcattatcaaatgcaaaacagaaaatacattgtcaaaactttgaagatggtaggcagattaaataaaacacatataagtgaagaattctcagggctggagacacttaggaccatgaagacaaataaagactttctcaacaaagctagagaatatttatgatcctactgtactcttgggaccatagtgccattgaaaagtggatacccagctgtcacttaagacaggaaggggattctgcaaacttggcagcaatccttcagctgtgtccttaatacccctcttggaatctgctacagtgtgaagttattacagagctcaaagaggtcatagagatactctatgaagaccagtaaatttttccaagagaatcaaaattgaacacattgcttatatagaatggattctgaaaaaacatttcaggacttaacctagatgaagtatcacaccccaaatcccggccctcggtattactcactagtagtaccattattcatttacccagcttcaaaacctgggtcatcttcaactcctcttttcccttcacttgcatctcctgttagctgccaagttcagcagattctattaggttggtgcaaaagtaatcgcagtttttgccattaaaagtaatgacaattacttttgcaccaacctaatacttcttcatccgaaatccattccctccttttgatctttaaggccaaggtccttgttaaggtccttacttcctcatacttacttagactattaagataatcttctatcctcccaacttgtagcattttcccctctaattcattttatgactactgtaaaattaatccttccaaagcacaatttaaatcatactggttcccctttcaaaacatcttcagttactcctcatgtttctaaaccaaatatatattcctcagcctggcattcaagacctctaatttcctggctgtgctcccacagctccttcatgtccagattcttatccacacacttacatggtcctacttgcctatctcttctaacttctctttacctctggatctcaccatgcacaaatctcaatttattcaatttattcaaattttccgggatctgtaccagacattgctccctcaaagaaatcttcctctggccaggcatggtggctcatgcctgtaatcccagcactttgggaggctgagacaggaggatcatctgaggtcaggagttcaagaccagcctggccaacatggtgaaactccgtctctactaaaaatacaaaaattagccagatgtggtggcgggtacctgtaatcccagctactcgggaggctgaggcaggagaatcacttgaatctgggaggcaaaggttgcagtgagtcgagatcgcgttactgcactccagcctggatagcaaagtgagactccatctcaaaaaaaaaaagaaattttctctatctttcccactagatgtcctatcctgcttctctgaagcttatcacatttttcttggcatctgttaatgacctgctctctatgctatttatctattgcatgtactattattttaattcaaccaatatttactaagccctatgtgccaggcactataaggcaccaggaacacaataaaacagctatgactctctgaattaaatgaactaagccagaattaccactgaatctttatagtgtaccacacagtagaaagctagaacaattgttctatcaagatgctgtaagatacctcataaacatataaagtgccattcagttaagatgcttggttttaaaactaaaattccattaataaaaaggattattttaaatgggaaatttgaagaatcttacagtgtaacctttaagcccttaattaaagacttgtgcataggtatagcaaaagtagaagaaataacaaatctttccattgaaaacttttagagcaaaaatttccatttttttgaagacatctgtaagtttatctgtttaaaaaatgaaagagaggatagaaagaaagaaaaccagactttggtatcaatgggactttgaatgaatatgattaattgaatgaatgaatgaaaagagactatgagtttttttttgtttttgcacctatcattttagaatctcagtaaaatcctaagaggttcatgtggggataacatagatggggatatgtatagtgatcagataaaaagatgggagaatataaccatgagatgagctatattaaattatcattaaggagaaaaacaagatgagatttccttaaggctcatatcctcaactgaaccaccaggaaagaaactctggcatttaaagatgggaaaattcttagcatacattccagttttaaataagtatgcaaattattacatctcagtttcaaatatccccaccattcatgattgctatccaatgccccagccatagtacccgccccagccatagtcccctccccagcactggtcctgctctcatgctcccctgtttacctcatatgcatctttgatgttcaagggctcaccaagcgctgccacatgtcccacaatgcctttgttccattctaagcggatacagttatttgaaacttcttccagtgttgaaccttcagcaacatcaaagaggcggctgataagaaacttgtcattggagctgtcttcacagacaaggaacagggaatagcggtcagcagatatcagtccatggatatgcaagaaaattttgtgacataaggctgtgacatccaaatgactagaaatatccttcactaattccaagagtcttgagcactggtccccttcatcatgatcaaaccttggaggggttagaggcatctgttccttcttttctgagtcagagaggaagctcacagttccctcagaatccttgacaacaatgggtctaagaggccggtcaaattcagaggcagagattttcctggttggtgttccaggggcactgttatctgcacgaggactctgctgcaagggacaagagcaagattcggtgtggcctctgataccttccttgcacacagggatggtgtgaactctctcagcaaaccatgcattgaccatttctctgcagaacagaacgtgcagacacattagatacttgaagaggaagggtgctatgcctgagagctcctaaacatcttctcatggtaaactgatgagataataatttgatatgttatagaaaataaaaacaagatggtttacttaagacatatgattttggccaggcacagtggttcacacctgtaattccaccaccttgggaggctgaggtgggaggactgcatgaggccaggagttggagaccaacctgggaaacctagtgagaccctgtctctaggaaaaattaaaaaattagctgggcatgatagcatgtgcctatgatcctaactactggggagactgaggcaggagggttgcttgagcccaggagttcgaggctgtagtgaggtatgatgacaccactgcaccactgcacttcagcctgggtgacaaagtgagactctctcaaaaaaaaaagacaattttattttggaaaacaatagaggacaattgctttaatgaacatcttaataaaggctgacttctatatacataactttatatatctgattgcagcataccaagcataaagtctgcttctctcaaaattagcttatattaaaaagtaaaagacactaaatttgccaatagttttaggaaaatataaatatgcacattaatttgatgtttaaaacacataacttgttctgaagttaaatatttgaaaactaaaacaaatatttgtctaaatttggcttgctactatgcctattttagatagttatatctatattgcaaaagtagataagtttagaaggattaatgaaagaaacaaataatttaatcttgtatagaaaaatcagacttctgtaaatattatcccaataatgtttgtttaataatggtaaaaaagatctatttttctagattatctatgactattttaaagtaggctttatctaagtttaaaactgcagtccaagaaaactgaaggcatttatgtttttaatgtaccctactatgaaagaaactcatttgagctaaagccatcacagtaggtgactttttaaaacaaacataccagatcatacacaatccaaagcatgttgttcaattcaaataattccccttagaacgctgtagtcttacaccagttaatggtgtcattactctagacatttttggaactcttcttttgaaacaaacttctgaaacaatttataatccaaataaaaatactaattttatctaaaaattagaccttgtttctcactaactcctcctcccaaaatgaacaaataaaacaaaaacaaaaaaacctatggtaacagctaacttaattctctatcttctgataagacatgacgctttagaaaactcaaacttaccttcaaaagataaaaagttgctataactgaggatatttcaaataatttgcctatacaaaaagcaatgtaatctcaaatctacaatgacataattgactgtttataccaaacaaaagtccaggataaacaagtttgacaatgtactattttggagatagtatagggatgtagtcactctccaaagtttttggttgtagtaacaattgatattacttaggccaggcgcggtggctcacgcctgtaatcccagcactttgggaggccgaggcgggcggatcatgaggtcaggaaatcgagaccatcctggctacatggtgaaaccccgtctctactaaaaatacaaaaaaaattagccgggcttggtggcgggcgcctgtagtcccagctacttgggaggctgaggcaggagaatggcctgaacccaggaggctgagcttggagtgagctgagatcgcgccattgcactccagcctgggctacagttcgagactccgtctcaaaaaaaaaaataaaaaaaaataggcaatatctaacaaattttaaatgtatgtatcctttgttccagagattttacacatgtgacaaaggaaatacaagggtatttactgtatatagtaagtacgtttgctacagcagataagaagcaaactaatatcaccaatagaaggctgactaaatacatcatggcacacttatacaagagaacactaggcagacattaaaacataattatatgtactgatatgtatgatatgaattaattaagtgaaaacagaagatgtaaaagagtttgaaaagaacacactgtcttatttctgagtctttactaagtctttcatttatgggatgttcccctaattatttcattttgaacaatgatgtattatttgttaaatatacattactctgaaatgataccccatctagaatgtaatcggtcaaaatgaaaagataaaaatattaccccccttataatttcaagagttgaatacagttataaaagtctccaaaaagtttaggagaaataagttcaagagatccattgtaaatatggtgactatagttaataataatgtattgtatatttaaaaattgctgaaagagattttaagggttctcaccacaaaaaacgataagtatgaggcaatgcatatgtaaactaccttgacttagccattccacaatgtatacatacatcaaagcatcatgctgtacaccttaaatacataaaattcttgtcaattaaaaaataaatttaaaaatatccaatgagtaatttaaaggaaaacaacctcactggccttatgaattgactgactttctaataaagaggtattacaaatttgaagaagcacaaaagcaatgtggtaggtaagtgtattgtacaaatcacaagcatatacctacacagatttttaaaaacatataattgtcctaatgtttcatagatgcatgctgtgacttaggacaaaatttccggtgaagacaacatacattaattaaaataattcagtatctgaaaaccttagaagtgaaggtgacacactctgggatttgcttatgtagcccccagaattgcactaatagtgccaaagacactgatgctaaaaatgcatgtgaagctgccaacagtgcataggaagctttcaaataaaactgtttggaaaagataagacaggaaaaaagcaatatgtctaagttaacatatctgatgtgattttaaatatggacatgttactaaactgttaaatcatataaaaatagacattttaacaatttcagccacaaacccaaaacttagccccaacttatttcttatcttctcaacgggaaatggagatctccttttgaattttaaattaaactgcctacttgacaactccacgtggatatctagaccacttaaaatggtgaaaacagaattcctaagaccctacccatctcaccttgcctcatcttacttcctgccagttttcccacatatggagtaccatcacctccacagttactcaaaccaaacacgtaggaattactctaaatttctgtttccttcaactctcacattcagttgcgcagtcaagttctgtcaacctgacttccaaaatcctatatcccaatctgcttatttctatctccattactaccaccctggtccaaaccccactatctctcagttggattgttgccatagtcccctaattaatctctctgatcctatacttacccccttgcaatcccattctccacacagcagccacagtaaattttcagcaaagtatgtcaacatcttagctaccctacttggcttttcattgaactgagaataaaacctgagctcttgtaatcccctacaaataggttcctctcgcccatgccagcatccttggcgctcctgaagcacaccaagcactaactgccctgtctgggatgctctcccctcattggcacatggctgatccacttccacatcccctgctcaaacaagtcatctctgactgctccacctaaagtggtcctgacacatcatgttcttatcctacataatttaaattctcactatctgctatttttcttgtttatcaatctgttgttatatcatctatcccctctgactagatatttcattagtgctacgtgttcactgctgcatctcctgtacttagattaatgcttaccacatacagtagtaggtcctcaaaatatttcttgaagtaaatgaataaataaatgaagcctcctgaagcatcaaaaggtacaacagtcttttgaatatctaaatgctggtgtgtttattacagaaaatcaacgttgtgttttagcgattactgttcatcaccccttggatgtgtaagtctcacaactgaccgtgactaatttatgcttgtatacttgcagtgcctggtgcagcatatgtcttaagcagagccagtgcctaaaagttctacattatgtgtttgtgattactctatttgtctcataaatgttgcttacggatattttcttagagacattaactcaatattaaatgacataggaaaagcagatgtagcatattcagtcagtcaatcaacaatccgtattaaccaccagtggtagggaaagagagttctcatgactacattattgattatctgagtccctgtaattacatacttgcagaggaaaacatgttatcataacatcaaaatcactgatgaaccaaccacaaataaaattaaatcatttctcacacatctttccctttgagcattccttggagttctgcagtgcacaatctatatggccaaatgaagtgggcctttgcccttaagactaatatctatactccgctgatttttaaaaaatacttcagtctgtatgcaaatacaaatcacctgcaaattgaaattaaaattcttatataagacatatgctatggtctaaaatgtatgtccctacaaaattcttctcttgaaccctaaccccgaaggtgatagtattaggaggtggggcctttgggagggttctgccctcataaataggattagtgcctgatgtagtttggatgtcccctcaaaatctcatgttgaaatgtaatccccagtgttgaaggtggggcttagtgagaggtaattggattatgggggcagatccctcatgaatggcttcacaccatccccttcatgatgagtgagttcatggccttgtttaaaagttgtttgtttaaaagtacatggtacctcccaccatcccgtccttgttctcattcttgctcctgctcttgctataactttctcaccatatgatatgcaggtttccacttcactttccatatgactgaaagcttcctgaggcctccccagaagctgggcagatgccaacaccatgcttcctgtaaagcctgcagaatcataagccaattaaacctcttttctttataaattacccagccttgggtatttctttaaatcaatggaagaacaacctattagagggcccttataaggggcctatgggagcttgttaactccttttgccctcctgtgaggacacataaaagttgacatctatgaggaagaagcctccaccagaatctgctggtgccttgatcttggacttcccagcatctgaaactgtgagcaacaaatttgtgtttataaattatccagtctaagctatttgttatagcagccagcatggactaagacaatatagattttctagacatagactaaagtgatgttggagaatccttctactattacacaaagccactgacaattaagagttatgcccaattaaagaccagttaacaattgaagaaacaatcaataaggataatgacatagcagatactcacaaagagaatattagtcaaataattatattctgaattaagaaagccccttgggcaaagctgatgaagccttcaaatattaattcaaaaaactagtttagggagaaaattatctttatgaccctgctgcaaaagccaaacatgaactgaagataattgtttatggctacactctgttacaatttatttaacagagttagcagagtttcatcctaagaattagcagagtgtcattacaatctcaattttattattaatagctcaaatataaacttattttcataatctgtggttctatttttcaagataaagctccaaccaaaaccttctcatgaacttttttctattttgatagaattaactttaattgtctttttttttctggaacgaattattcccataagacagagatttccacaaggtactatattgggcaccagggacagaataatgagcaactccagaaaaattatcatgatctttcctttcaaacttaaaagtttatattgtgttcagaagttatatacatattggatgtttctggcatatgaagttaggtaaatgtacacaaataagtaacggaaaagatgattgtgaacatgtccaatataaaagtagaaagcaacggatggaaatccagaaacctcagtagtagttctgactgggtaatcacttcgatggtctaggataggacctctattttcctttccctttattaattctagggggttttgaaaaatattcacattagtgctactgaaaaaaaaaccataattttatttaaacctggtgaggcaggcattaatggtcctactttctaaaatatgaagctaattaaatgtctgaaccacacccattctactatttggtggcaacaccaggaatcaaatccaggtttcctattccaggtactataccctattaagaatataaaagttcccagagcatcagtgcttgccatgaagaaggcactccgtaacatctagctgaatctagaagtaaaaatcaaattcaagcagagaaggcatagagaaagatgacttacgacacatgttcaaatgaaatcctttacctccaggtcataaaaggaccacacactgttttcttaaggtaaaaacactatttctaaggactcagggaacaaagattcttaaggatagtgtccataaaaaaaaaatctaactaaattccaacatatctatgtttctctgaaaacaggtcacattttataagtctaaagcaatgtactgaaaagaagtataataaatgtgttcgagaaaaagtcatccccagagttgctagatttagcaaataaaaaagacaacctgctaaaaatgagtttcagataaataatgaataagttttcagtataagtagtatctgaaattcaagatgaactggctgtcctgtatttgatctggccactccagtcattctacatagcttttcctaactgaaattgttggcggataggcaacaaagagaaggcaggttctatgcagcatactagtaagttccaggctatcaaatcgctcattttatcattgagagcgcacaaaggactaccacaaagtaatcctgtgtatgataattgaaccttttgaaagcacttggattcataacttgcaataaaactagagcataaaatatctccttaaatcaagttcattcattttgctctaaaaccatcccacataatgtattgcatagggacaaaacaaactgcaaactacttataaaagggagatttactaattgacaaaaattcttgggattacaaagcattgagaggctgcactttcagccatgagtcctgggttctaatctcagcatttgttactaataggatgtgtgactagcactaagcaattttcttcccctgagtttccattttatccctgataaaacaagaaaaatagcaccagttctggccttttatgaagtgtaaggtgctgactgtcttcagcagagtataaagtcaggaatattagactaacaatcaggtgataattctagttccagctacaacactacatggatctgatgctaaaacaattacaacttctctggagttcattttcactggagtttgagatcttcagtggtaaaaatgggctgctgtattaacaggctattaagactccccaccacagtttgcagtatgaataggacaagaagtggtccttgggtctgtcaacttaacttctttttgcccttcaacttcctcatttttaaataggggaaaagtcttctggctccttcactcactgcacagggttgatgtgtgagtcaaattagaaaatgcacatggaagcatttcaagatctcttcaacatatctaagaatttgctatctcttacacccttagtactcattccaatgaagacaaagggctgggttaaggagcaatggctgttatttcctcaaaaaggtcagccaagagaatcagaaaaaggatgagagtaaaaaggttgtttttggtgatacaagcccacaggttgaggggccctaactgggttgggatataggccagcaacatgcaccatgaacactcaaaagtccttggccaaagcaaatacttcagaatggcattcttgacagactcctactaagttcaaaaaaaaaaaaagaaaaaaaaaagagaacagtttaaattacatcatagccatctgagcaaaaacaacaaaacagaaacaaattccattgaagcatctgtagcttttaccacaagtactaataatctggactctccactttcatgtataagtgtatctttgctaactgccctgcaaacctggaagcaatcagaagaaagcctagctgccctcttgaagtctttcagttaacttttacaaagctattaatgaaagacaacaggccctccacacttcaaagaaagccacagccatggaaaatgcaatgaacattgaagccaataatttatagtcaatgataagagcctgagttttacatcacatccatatcttcctctcttctcaccaaaatcttttattatcctccaatcacttatttcctacatattttattacacaaaaaattcttacccataaatgagttgtattacatacccttttaacaagagtgaatttagttttgcttttaaacttttacaacacatcctgagatacgaagaaaccctggtgggcaccccaaaatcaccgttggaagttattcctttcagataacactaatgtcgatataacctgttatttcaaacttgcatattccacagatgatacttaaggctcacgaagatatccttttccatacggagcaagcaaagaaccccaaaattcatattaattagatggtaggacataaaaccaaatggaagttgcctaaaaccttttgagctcttgtcataaatgtgactcaaatcttactctcgaaactctttacacaatgaatcaaatcagaagtttattatccagatattctactttacagaagactcttgcagctcaaactgcttataaaataatgatttaatataaaaatcagtgtcattaagcataatgtttaacacattttgatttcatgaagctaacagcaccgcacctgtcaagaggatgatgttattgtgtgagtagagcacccagcaaaactaatgagcatgtgcactaccctggttccagcagctgctgcaggaaaaggcgaaagttgacagacattttgtgtctttagtaatacaaagggatgaacaaattcattcgtgaatgataaaaaaaaaaaaggaattctggaggttaggaagcttagaaggtgaatggttatcaacttttacaatagttttaacaaagagtttattttatcaaaattacacacggcaaaaatacaatgctatttcattttacacatactatgtgctcatattttgtaactaaatgaaaagtgtggcactcttaaaatgatggactcaattaagttaatgattaaattaaatagtgccaagttagtattgtaatacatttttatggatatttaaatagatttgtattgcatattgggtacacttcatctcatagtctctaaaaagtttataaattgattaataatattcattgaaaaaaatgaaatgtaactgtatggcatataatctgggaagaatcaaaaccttcccccctttccaatttatcgcttccactcaagattgttataaacctatcacaaaatagaaaactacaccttatgttttgggtttttagaaattttccactaatctacacaagtcacggcttcttccaaatgccctctatctagaagtattaaataggactacaaaacttgttgacaggatgcagggatgcaagccctggaactgcatttcaaatataattagctaaagggacacacacacacacacgcacacacgtgtctgtgtccgaagggtctccctgtggcaataactttactttctaccaaagtggaactgctcactcacattacaaaatgaatcttgaaaaagacagaaaggctttaaaatacatattcaatattccagatgtcttgaaatggaaaattaattaaaatattttataaggtttatagaatatttcttggcttctagaaaagtaaggaaaagagaagaaaaattgacaaggcaaagtaaacttttgatataaacataataaccctcacgagttaaaagtataactaggtgaaacctactcgtagagcaactagtttaatacgttttgcactctggcctaaaataatgtatcaaaggataaaaatcctttgaaaatatactgtactagggtatttgtgttctaatgctaaaaagataattataatggcctagtaccgaaattttcaaccactctattttaaaatgtcatttgagatttcccaatttttatactctgaaattatatatggaaactaaactcacttgggcagtctttaggcacatcattaagtaatgtgcttccacagaaagaggccgtagaagaaaatgttaacctcttcctgagttagaaacctcatgacattaaatctatgagcctttgctttgcttgcattaatattgacactgactttcagtatagcacagtgattaagggccctagatgagacagacttaggctttaaccccagaatcacctctttctaagaatatgaccttaggtacattatttactctctttgtaaaatggagatcatgataaaagtaaaggaaatgatgctggagtcagatacacagtgtttcattcatgatagttattgtttttaagttaactgaatattaagtggagtatattttttaaactgattaagtttttggtttttttaaataaagaaaaattatttaatggatttatacagcagaataagtagatgttggctcttgcttcttcctaagcccctaatttaaaaacaataacttctctacagaggtatttcatattaaaataaaagagagagggctgttttcatgtattttttcaaattacaatttaaaaaatggactcctcagactaatatctacacttacatataacaaaattttctgaatttcatattaagattaggtgataaacatttaactgaaaaaaataaatgcaagaatataatttgtttttttcagtactacttagagactttttttttgtcaaaaataagttatagatttggggactattttttcccaaaatataaaagttaaaactgtttgacaacaaatgtaaaaaaaatacaataattacctatgatgaacaccatagcaatacttcataattctaaactggagcacagttttaatatctgataaaacaacgctttaacactctgctataggtaatttatggattaaattggctgttttagttcttatccatgggtacttacttgggtaaatcctaaaagtagggtgataccaatccttggacctcaaaaatgtccatatagcaagtccattgagcagtaacttttgggggagatttgcagggtgtatttttgtgtttataagtcagctactaaaatgccatcctcttttctcttttcaatgcctttttcattagtcatgtgaattaatcactaataccagcattgcaaagagtatactaaattttctgactggaaagtatgattgataacttatatggaaatctgctaaaattagggaaaacacaaaataactcacataaaaaattatgttggctacttttcctgctcttggatccttattttatacagtttcagttacgttgtttgcataatttgacctggatccactactcaaatttggaaaaatacttaaaagaatgaaactattcaatctgagaaactgatactcggctctcctggtgagaaaaaagaactcttacagctgaaagagatttttaagctcacttatgaatctctccgccttgagtcttcaccctctttcacctcccgtcttaaagtttgaggttcattaacttgagccagtcacaaagttagctaatagcaaagctggaaacaaaatctgggggtctgggctcccattccagttccctttccagtaccttacacaatcccacaaaaacttctgttcgaaccattaataaaattcatctaaaaaatgaaaatgacatttaaagtctatgaaatcactatgctgtcagaacttaattcccatctaccaggataaggaaatgcctatcaaagtttgtgattacatttaaggcactgatgatgctcaaggtaaaatggtaaactactgaaaattaccactaaaaagataaggaaacacgcattatttcctttaattttctaatgaacactatgaggtaaatgacattatctccattttacagagagagtaaataatgcacctaaagtcttcctcttagaaaagtaggtctggggttgaagcctaaggctgtcctatctagggcccttcaccataaacagaaatcaatttcaaagggttcacaacagtggctcctaatcaagtagtggtgccaacccttgaggggcatttggaaatgtgtgggaatagattttccatcacatggatgggggtggccctggcatttagtgtctggagttcagggatgttaaatgtcctgctatgcactagacagcctctaacaacaaaaaagtgtcaccaccaaatgccaacatcttcttttgagaagcaatggtttagatgattaagagattaacagactattattaaacaaaacgggagattttggacacctctaagtgatatcctccaataacctctactctgatgttacagtgagtagttcgcttgggtctggcatggtaaggaaatgaagagtctgcccaaagttatttagtatttctaagtttgctccagctatgaaaacatctgagaaccttaaaatgcagaattgcttcatatgattttaacttcaaatttgactgagaattggaagggacaaaatattttgtaattttctgtacattcacaacacatggtataaaagaagttgcttaaaggaaaacctaccacttctgaaagaaaacaataactcaaatctatgcactaaacatgtaaatcagttggctttgcagtttagatatgggagagactggactacaatggcatttatctgaggtttgagagcccacagaattcaaaacaagtatgttttgaagatctttactttgttctataaaatgttctaattttatattttcacaataatcataatcaaaacaaaagaaagtgaaagaaattgctttcagttactgggaagaccatcttattaccaactactgccctgcaattttagttctaaggtttatatttgtgttaatgagaaaataaaagacgtaaatttaatatgcatatatgccttcatagcaagtaaaaaatgaaagctggtatgctgtgctagaggaataagtttcatgattgttcagagagacccagtgggagaagtgaaatcattataggccaaattgtagcaaaggccagctgacttaccatactgtttttcagatagttagaaccatatctactttgcaagagtgttttaatgaatgctgtaaatctgcatttggctgtggttttatcattttgttcgtaattaactgagaatgtattttggcattacagttgcataaatgttgtaactatgattaaattatatctgcttttatttattctacttctaagaattccacacttcactaacattaaaataaaaggaagtcaacactagttatggtagacatctagaacttctgggtctgcccacatcactttcttttgggaatgtaccctccccaatgatatatcaccttatgggctacgtgccccaacaaaacagtcaaacaaccctactctcccgaatacaatgattggttcagagttgggatgtgacccaggtgagaccagggtaatctggggaagactgatatggataagaaggcacctctctaatatcagaagtttaagacccacatacagttaacaagtagaaactctcagcacatgaagaaagcatgcaagaaaataaagccaacacagcacagggccaaaagatacatggatagatgaatacatgaacaaatggatacatggacagataaatagatgcaaggaagggcaggtaaacagagtagatagatgaaaagataaatagagataggtagatacatagatagatagacagacagatagatagttagatagacacagagacagacagaattttggcaacattatttgattagctaaattcacagctaacccaatcccgcaagcaattaaaattatgtgcatcaattctctatgggttcaagttgagtttctgtcacttgcaaccaaaagctttctaatatattgtaaatcaaaaagaatgtctttctttaataggagtacattacttaagtttgaaaaatgagattggccgggcgcggtggctcacgcctgtaatcccagcactttgggaggccgaggcggggggatcaccaagtcaggagatcaagaccatcctggccaacaaggtgaaactccatctccaataaaaaaaaatacaaaacattagccaggcatggtggtgggcgcctgtagtcccagctactcgggaggctgaggcaagagaatggcctgaacccgggaagcggagcttgtggtgagccgagatcacgccactgcactccagcctgggcgacagagcgagactccatctcaaaaaaaaaaaaaagaaaagaaaaatgagattatatgatccctactaactctaaatttcagtgatcctgtgtgtgtgttttaattatttcatcagctcagaatgtcagggtcttctctctttgtatattttcagtataggtattcaactaaaagtagagaagataattcttattttttataattatcactatgaacatgatatcaaatggtgatcctttctctcccgattttaggtaaaatacaattattcagagaagaaaatttgcaaaaagttaatcttactttataattcagaatcaagggaaaagtctcccctctcctgaagattaaaaaatctaacaatggtacataagacatttaaaagcattttcattgcaaactaaaaaccagagaaaatatatctttaaaagctttaaaggccgggtgcggtggctcacgcctgtaatcccagcactttgagaggccgaggtgggtggaccacgaggtcaggagatcgagaccatcctggctaacatggtgaaaccccgtctctactaaaaatataaaaaattagctgggtgtggtggtgggcacctgtggtcccagctactcgggagtctgaggcaggagaatggcgtaaactcggcttgcaatgagccgagattgcgccactgcactccagcctgggtaacagagcaatactccgtctcgaaaaaaaaaaaaagaaagaaagaaaaaaaaagctttaaaatatttttagaatttttatcaaaatgattcttataaacttaacactcagtttgctttacctaccttaaacatttggttggcaacaaatataaattcctaccactcagagaaaatgaattaagcacttacattgcaaaaaaaaaaaaaagtaatttaaaatgagaatatcagtcagtaaataagattacagagctaaatatcaaatgaatgactcatatggaaagactttcttcaatttttattcctaggtatgtggctcacaggcacttttccctgagaacctggtataacagatatttccaagccacattcaccagctgtaatagtggccaactgaatctacatctatgcagctaaactaatttcataggaagtcctgcaaagtcagtaactagtctgcatcctaaattcacaaattagtcatttttcaacccttcactatcaatcaactcattgatttatttaattgtcctacagtccttactaaaggtttttttatcctaggaagaggtttttatcccacaattggctgttggaacaaagaacaaatatagcttgacacagcaattataggtttaacttctaagttaatttgtattttcaaatctagaggaaggggtgcctcaaagtaggacacactccctataatcagataagggcgaagctacaagctttacctatacaaccttaacagaattccaaatatttcaaaagaaataatacttcagaccagagtcaaatcatttatttaagcagaataatttaaaaaggaaatttggttgcatagcataatcaaaatactaaaaatttcctcatcttgaggtgttgaggacataaacgtgtgaaaatattgacaatttctacagatcatcagatgacagactgaaaaaaagctactgaatgataccacaagcctatttaagtttgtgttatactaagcaaatcgatttatttgaagatatccatctacactaattgccattgcattaattctaccacatttttaggaatcatgtagtttaggctctaacatgggtctgaatttgaaactttgaaaacactagagatagaagagcaatgagaaacattatttcaggggctcctatggatttctccaggcaggaagaatgcaatccagaagagtgcttcaaggacactaaaagcagcttagagctggttatatggaccctggttatgaacaacataagaaaaaaaggccattattgcaccagaattaccattataaaaatactataaacaatatcaaagttagactgggtcaatgctcagagggttttattatcatcaacactaacaactgcctcacaaaatatgcttaacaattcatttgtctgaaaattgtggaaagtttatattcctatataattatagaaacaataatttaaaaaaatacatagcaatatttatatacataatctgattgtattgtaaataccgtgcaataaaaatgctacagcttttagaagtgagagaagaattacaaggaaaaaaaatgaaggacggaattccaaacacaggaccaggaacctcaattaattcagcacagctttgcagtatcaaataaagtctatcatagaaagctatatgggagtgtaaaacgtctgtttctggactttgatccaagctgtcataaaaacttgccctcacttaatatctcttatttccagtatatgccaaatattctcgagcttttgcctgtacaaaacaaagcaataaagtcaatcatgtcatccttaacaatattaaatgacctaaaacatcacccacaatcacagagctgattagtaattaatgaaaggtaactttattctaatatgctgtcaagaataacaacagctgttaagcagcattagcaccaggaaagcttcagttgtaaaaggcatacgcattaaagccctcaattaacacagtagctgaggccttcaggactgcaaattgtctacaatagtgacctgggagttttccagatgtgatttattggcctcaaattaatttttatgccaaccgactatgttctgaatcattcaattgacaccttcaaatggacataaacaggttgtgataactaaaaagctccaagttatagctttttttttttttttttgagatggagtctcactctgttgcccaggctggagtatagtggagcaatcttggctcactgcaacctctgcctcccgggttcaagcgattctccttagtagctgggattacaggcgcgcgccatacctggctaatttttgtatttttagtagagacggggtttcaccatgttggtcagtcaggctggtcttgaactcctgacgtcgtgatctgcccgcctcggcctcccaaagtgctgggattacaggcatgagccaccgtgccaggcccaacctatagcttttaataagatgcgtagctctctacttgaagacagtgatagtaaacaatgtaatataatggcataaatgctttcaaggtcaacccaaattcacaggtgtttgagaatttaggaatgccagaaccttgatgttcaataactaccattgagtgtagatcatttagtctgagaaaaggatggaaaatcatgcatgaatgtcgaatgacaacaataatgcagaaattgtttttatcagcaagcctgattactggtgcagatggacgatctgggtgaatataaatatattttaaatcttaaaacatgccgcatgcatctacagaactattttgtttcatgggtttcctgaatcacatacaatattcattttacacttacaaagtgtaaaaagaggggaaaagcaaagtaatgtgagctcctacttttaaaaaaaaaaatccttagctgtaaagttaaaacgtatgcaataagtttttaccacaaaatgtgaaccacactggggttagtggtttgcatttttataatcaacaaatgtccatcctcttattcacattttaagtctcctgttaatgccaccaaatataaaaccaaattggaatattgtttcatgaaagacctctggctacacacaaattcttaggttatattctttactctgacaactctcagcactttattataactcttaaaattgaggacctgcactattaaatattttacactttcattttccaacttacactcaacataacctcttaagaatatgtatacacacatacatatatatatcacagaaagtgttcagcctgttgccaacatcaactgtaatttaaaaactctaaccgaaaattttttaaaagtttttttagagcctcagatgatctaaattttacagtgagcatggtaaatttgagaaataggattttgatcctatgctgcttgggagaaaaagtaatgggaaaagaaatgtaactcagctctttccatttattttccattaaaatgttgctacactttcaaagtgttggtaggttctgaaaatgcagtgttcctatctatgactagtcaaaaacgaccaacaagccatccctagtttacatctttaaaagaaaaatagggaacgaagaaaggacatttatgctgatttattaaacaataactttttttctttaaactgtttataatctgcctaaagaacaggtccaatacatacttttaaaaatcggcctggttctctggccccctgatcattctatgcgctgtaattcaaggagagcagaaggctgggaatgcgcagagtgaaaggaaagtgggtgcagatggcctcagaggggcaggtgacccctgaaaactgttagtcgacagcaaccgatcattctagacctccatggccttagtgtctcacgctaaactcgcaaaaaagtgccctttcagggctatcctctgggcgctcaagatttaggattttgaaggaagaaggtgaaagcgggggaagacgattttaaaagaagggctgggttattaaattgaaaagattaatcccggagccttcccctctgtcaaaaaaccctgaaagtgactaaattgacaccaactctggatgttccttaggaaaaaaacaaaacaaaacaaaacaaaacaagattaaaaagggcccaatttaagacccttattaatacatctgcaagagagcaaagaataacaacaacaacaaaagttatacagtcaattttcaatgatacatcgtcccactggtgccaccggggcgccaccacccagcacccgagacccgccgcgcccccggaaaaagtgggaagggacgtagggggatgctgaaggaagtaccttgttttgtctccaaagggcaacatagcaaacgtgggaagttcgttttcgaactccgccgatcctggactccaggaggctccgtaggggcaacaacgcgcgcaggtgaggtgaggtgaggtcggcgactcagaaccagctccctcacggccccggcctccgcgccgccgcccgtcgcctcccgctcgccccgcgctgcgccgccccctggcggggagcgaccggcagagccgcggccgcgcgccggcgagtgggacccgggcgtcgaacccgggcgggctcctcgaccatcactgccgggcgtgtgtcaccctcccggccaagacggccagcacccgctgcccgacggccgctgcccagagcaggcggcagcggggcacggactctttctgcaaaggggcgcgtcctggagtccacgcaccccgactatgcatcaattcctcaggcttcggggcacccgcccgccaagcactctctgctccactcttcttgtccctctgctcccagtctcaattcctccccaactctcccgcgagcgtttcccacgagcgccccgactgcccgctgcgcagccgcctccaaaaggacaggctccctcctccccgccctccgcaagggccgccccggcgcttggctctggaccagaaagagctggcctctggggtctgcgctgccccttggggtccgctccaggcggcgcctcccctgcgccctttgtgtgcacgccgcaaacccctctgcagagctctacttttggcggcacagccttcggcggaaaagcgagtgaaaggaggcgcgcgggacaagcaggagactggaaggggggaaaaggcaaccgcactcactttggcaaggttccgtcatgttgcctttgggctgtcccgtggactcgtccctcaccccagcttccccgcccagccagggccagggcgaggggggacgggggaggagcggagccatcaagaccgacttggaaatggtgcttccggagctgcagggaaggggctcagaaactgtttgggttttgctgattggattttggggaaccagagggctagagaggggctaggggaaggcccgtgagcacggatgtatgaaaataatcatgttcccggggaataccaagagggtcgggggtgagggtgggaggtcggcaagtacatttttgtatttgaactttgtgagcaagttgtatcaaatccgacacttgagtttttcgactgtgctcgcttagagttgaggtttctacctcgtaacaggaccgaggacctacttcaaaagcaaagggcctgggaacaggggtgaacgaagggcacaattcaacaggggagagaaatcagccccgggtcttccgtgggtcctcttcttacctggtggcttttctaacaaagtatgagaaggtaaagtcccagtgatcgtccagccatgcttcgaccgagtcctgatccctctgctgctgcttctgctgctggggctgctgctgctgtcgctgctgcccgaagctggggccggcccgctccatggttggcaccgcgcgcctcggaggctctctggtactgcttttccaccccagctggggtccgtccctcagaagaacaggactcggcctcgagaccctcccccttcgtcctgctccagtcgggccggctttcgacaaagcggccggagcgccaggccagcctcctgccccgccccgccccgcgcggttctacgggcgcccaggtgtggtgggcggggccaggcgcagctgctgcgccccccccacccggggtccggcagtgttccgctctcgcaggctcttcagtcccctggttcccaggaggcggcggcggcggcggcagcggcagcgcccggcgagctctccggaagccaagtggcggcggctggaaggaggccgcgcggccgctggggtgcgctgtgtgccaagccgacttctggggagcgcgctaggtgactgggtgtgttctcagagtgccccagggagggaaggtcgcgatgtgggaagttttgcccgaaagtaagagatgatgagaccctgggcccttttcctggggcctgggagtgcaatgaccttcccgcctagcttttccctagccctacgcttgggtctgggaggagcgggaccgacctccttcagagcccagcccgctcagtgacttaaagcggtccagccacggaccactgcgggtggagagagctggggcgtgtgctagcaagagagatttgcaggtgtaggtgggtaacttgcaacaaagccatacccgtgcttaatgttaatgataacagcaataattataacttaagtgcctttaaccattgcctcaaacttcccttatgcataactggaaaaagatttacttggaaaagaaaaagcaaacaaataatttccaatgctttgtgcatgaagttagaaaacaagggcacctctgtacaattaggttaatccgagagcactggcgcaacccaggtgcagtcgagggcaaccagttatcccaattttaaattaatgcatcattttaattaaattggaattaacactccctcaaaagtatccattaaaaatggctcagcctttttgtccaatccctatcttgcttctttaaaaaaggaattggtgtcatcctttgctttgtctgcatccccatcttcctgtcatgcattggcagttttaatatggcattttgcaatgacctatattttttggtagaattaaatctggaattatgggttgcacaatgtgtgaatgacaccattagcagtgatataaaaaaaaatgagttagctgatatacttctgacaacttccttctaaatactcttggcaagaatttaaggcattattcactacatagaaacacatcattaaattgataatctgagaacttttaaaagtatcttctagtcccccaatgcaatggtttatctttccttcattgagtaattgaccttttgcgacttcagtttttctgaaactttactgctgtatgcaggtagccacaaccaaagaaaagcaatcaaagcagtagagtatgaactaatgggtgataaattatattggatttagaaatgagaattctctcctaatgtgttactatgatagtgattatagtgctcatggaatacagtcatgcgtcaccgaacaacaggatacattctgagaaatgtatccttaggcaatttcatccttctctgaacatcacagtgtactaacacaaaatagatggctcagcctactacacacttaggctattgctcctagaccacaaatctatacagcatattactgtactgaatactgtaggcaattgtaatgcaatgatatttgtgtgtctaaacatatctaaacatagaaaaggtacagtaaaaatatagtattatcttatgggactcatatatgtggtctgtcgttgactgaaaagtggcacattactgtggaaagtttctcctcagtacagttttttcttgtggaaatccatgcattcctcctaacaggagatcaatcgtaatttaaaactctgcttatctactaaagatgcagtgaatttggggcttgaattatttgcttttgttggatacttgattaaataaacacgtataatcatttcaatgtttgtattccctccaaaattcatgttgaaacttaatccctaattcaacagtattaagaggaggtgcctttaagtggtgattagaccattagggctctgcctttgtgaatgcattagtgcctttttaaaaaaaggcccaaaggagacagttggccccttctattctttccactatgtgaagacacagcactgacccttgctgaggatgcagcaacaaggtgccattttgtaagcaaagagcagccctcaccagttgccaaatctgctggcactttgattttggagtttccagcctccagaactgagagaaattaatttctattgtttataaatatcccagtctgtgatattttattacagcaacacaaatggactaagacagtgggtaatatcaaaatgttcatttttctctcctaacctgaaagggttaaattatcagaaaccaggaaggtttctgaaaaattgcttcaagaaaaacaatctataggctgggcacagtggctcattcctgtaatctcagaactttgggagggagaggtagaaggatacttgagctcaggagtttgaaccagcctgggccacatggcatgaccccatctctacacaaaatttttaaaaattagccaggcatgggggaacacacctgtaatcctagttattcgagaggctgaggcaagaggattgagcccaggaggtcaaggctgcagtgagccatgatcgtgccattgcacttcagcctcagtgacagtgtaagacccccggctctataacaaaaaagaaaaaaaaagaaaaacagtacatagattctctcaatagtgaatctcaagtctgtgtggtatatatgatagtttgggagttactgtgaaggcctattacctgagaaacatatcacaagggattggggaacagaagtgtctcaaacagttctagtctctgggagattcagccaaaatgtgtaactatacctcctgtaaatttaaagtagttaaaggtaagcatattttgaactgacattacctgggcctcttgtttttcaactccattttattctttatcccaatttgcccaattattttgttttaacttggcatgaattgttctaagcacctcaaatcttgttatggaattagttgaagaataagtaaatcataaacactcccaggatataacttgaaaaatgctgttaatgctatttataacaaacaaatgagcaatgatgtatgtatgtgtatatgtatgatatatatatgtgtgtatatgtatatatatatttaatttttgtaaatgacccagtctgtggtattttgttattgcaacacaagtggactaagatatatatatatatatatataaaatcaatgatatatatgtgtatatacatacatatatgtcattgctcatttgttgctcatgagcaacagcttaactaaagaccttcaatgtattcccactgtgctaaaataaaattcaaactctgtaacgtggcttatggggttctacattatttggttgttacctacctgtactgctaaagattttggtcatacaaatagaaaaaacaaatgcaacaaagcaaaaacacaaaaaagaaatataaggcataaaaatgaaaaagtaaacattctccatttgcagacatgagtatctatgaggaatacccaaaggaatgcacaaagcaactacaagaattaagaggtgattcagcaagcttgcagcataaatggtcagtatacaaaaatcaattgtatctctgtatactagtcttatgggctgatttgtttccccagattcatatgttgaagccctaacccctagtaccacagaatgtgattgtatttggagatagggcctttaaagaggcaatcaaggttagatgaggtcatgagagtggtccctaatccaatctgactggtgccactataagaagagggaatttgcacacacaaaaaagtgacaccggtgatactctcccacagagggataaccgtgtgaagaggcagcaagagaatggccatttgcaaaccgaggagagacacctccaaggaatccaacctgctggcaccttgatcttggacttctagtccccagcacagtggcaagatcaatttctgttatttaagccacccagcgtgtggtactttgttacggcaacactaacaaactaatacaactaacagtgaacaatttgaaaacaatattatttataatcgtgtaaaaaacattaaatacttagggataaatttggcaaaatatacataagaaatatacactaaaagttataaaacattactgggagaaatgcaaaaagacctaaataaatggacagatacattcattgatcggcagactcaatattattatgatgtttattctttccaaaccgagcaatatgatcccaatcgtatttcagcagacattttcatggaaagcgaaaatcagataacaaattttctatggaaatgcaagagatacagaatggcaaaacaatattgaaaaagaataaaactagagaacttatgctacctagctttaagatttactataaagctataataatcaaggcagtatggcatttgcatatggttagtcaaacagaaccatagaatagaataaagagtttagaaatatcatttatacaactagttgattttcaacaaaggtaccagttattctttaaataaaagtaaagtttttttcaataaataatgctttaacaactggatctttatatggaaaaatagtatcctcaaccaatattttatattatatataaacgttaattaggaatgaaacagatctaaaaactaaatgtgatttctaggaggcgacatagaagaatatctttacaacttgggagcagcagggatttcttaggaggacacagaaatcaattaactgtacggaaacaacaacaacatctagattttattaaaatcttttactctttgaaagacactataaggaaaataaaaatccacaaactagaagaaaatgtttgcaaaacatttatctaacagggacttgtatccagaatacatagagaactccacagcttaataataaaaagataaatgtctcaataggggaaaaactagcaaaggacttaagcagacacttaataaagtaagacatgtgaaagttcactaagcacatgtaaaaatactcaacacctaagtcttcagggaaatgcaagttaaaccaccgtgagatctgcctccaccctctagaatggtcaaaattaaaaagactgctaacgccacatgatgtttggtgttagatatgtagcagtcagaactctcacacattgctggtaggaagttaaaatggtataaccacttttgaaaaaggttttgcctttttcttataaagttaagaataagccctttcctctattaatttcatttatagatatttacccaaaatatatttatccaaaaacttatatctgaagataaattatataaaaatgttcaaagtggctttacctttaataaccaaaagttccaaatctccaattatttcatgaggagaatggataaattttaatataatgattaaatagaatataactcagcaatagaaaggaatgaaatattgatacatttaagaatgtggatgactattataaacattatactatatacacaaaataatatatatgattgattccatttgcatgaagctctaggacagataaagctaatctacaatgaaaataattcaaaaaatggtttgctctggcagagaagttgactgcgaagaggcatgagggaacattattgggtgatagtaatgttctgtgtcttgaaaactggtgtgggttgagtatgtgctttttttcgaaagttatcaaattgtgcataaatgaaatcactatgtaatttttaccccaaaaatctattaaaaatattgaaactagttagtagggttgctttttgtagggtatgagttaaaagttctgaaacttctttatattctaggcttgagaaaagtgagcaaatatagtgagatccaggtttctggttgttagagaagagaataacatatatggaaaggggaaagaccaaaagttacattgtggtgttgaaatgaaattggaggttaaaatttttaatttagtttaaattttaatacatgcatcatgtggggaaaatccacttgacaaggaaatataggcagtttgtaagagctgtggacggcctccagctgatagcctacgatgagttccagcgaggaagaaaatgaaggtcctcagtcttgtgaaccacaaggaattgaattcgctaacaacctgagtgactcagaagtggatatttctccagtcaagcctcagatgagaccacagtcccagatagtaccttaatcgcagccttgtgagaagctaagcagaaaacatcttaataattgatgttttaataatattgagttctacaatccatgggcatagtatatctatctgtttattcatgtttttaaaattgttgtttttacagtaaatgtcttgcatatattttttcaaatttgcatctatgtatattctgtctatcatcaagaactactagaagcaataacattccagtagcagtgagtacgcttcatacccaaatttggtttctaagtatcagtctccactaaaagcaaccaggagtgtttggagtaaagattccaggtctgggggcagagaaggtataagatatgcctggaaaatcttgttttgccagaaaataagaaagccttaaagaatgatggaaacatatcagaaagatagatgatgtactctcagtgaacaaatctggagcaatctgagcatcaaaatgcataaaagtaacaaattataaactatcgactaaaataaaaaactatgattctatactgatataaataaataaataaatagataagtaaataagagagagtgaattgctccttagagtaaaaggcccactaatacatataaaaggaatcacatagtttagaaaatcattaaaatagatgctaaaaataatagatgagagtttgataatgaatgggatatttacatagtcttaaagtttaaaagttactcatctcctcacaagttacttattagttaccatgggaaagtagtagctttacaatgaagaaatcttgtggataccaccctaaccaagtaatagatttaatatcacttaatactgggacaaaccaaaactatataccttttagtagaatgtactgagaaggacacaacatcatttccgcttctgtgttattcctccccaaaatgtcaaatctggatctaatcataaggaaacatcattcatactgaagggctttctataaaataactggcctgtatgcttcaaaaattttaagggcaagaaagaaaaagagagactgagaaactgtgtattagttatttattgctgtctaaccttaccacaatcttagtggtataaagcagtatacattcattatctaccagtttctgtgaatcaggagtccaggcttgacttaggtggggtctcacaatcaaggtgtcagccagagcttcagtctcaactgaggctcaacagaaggaagtatccacttccaagctcattcagactgctggcagaattcagttccttgcaatcgcagaagtgagggattctctttattgcagggtgctggctggagaccttcataggatgttggctagagtctgttctcagcttctggaaaccacctgtagtttcgtgccacatggagttcctcaacattgcagctagcttcctcaaagccagcaagggaggaagacttcagcaaaatgggcactacagtcatggacaagttctgagaaatgcattggtaggcaattttataattgtgcaaacatcactaaatgtacttacacaaacctagactgtatattataacccagcagcctccaacctttttggcaccagggactggttttgtggaagacaatttttccatggactggggttgggggatggtttcgggatgattcaagcacattacatttattgtgcactttatttctattattactaccttataatatataatgaaataattatacaactcatcatgatgtagaatcagtgggacccctgagcttgttttactgcaattagatggtcccatgtgggggtgatgggagacagtgacagatcatcaggcattagattctcataaagagcacacaacctatatcccttgcatgtgcagttcacaatagggtttgcattcctatgacaatctaatgccatcactgatctgacaggaggtggagctcaggttggtaatgtgagtaatgaggagtggctataaatacagatgaagctttgcttgctcacctgccacttacctcctgctctgtggcccagttcctaacaggccacagaccagtactgggggagttggggatccctgatatagcctattgcttccaggctacaaacctgtacagcatgttactgtactgaatactgtaggcaattttaacacaatggtaaatatttgtgtagctaaacatagaaaaggtacagtaaaagtatggtattataatcttatgggaccactgaagtatatgcagtccatcattgacctacatgttgttatacagcacatgactataattgtatgtaatatatgcacacaatcatgtacagataatcacatatatccaatcacctttgccatattctattttttggaagcaaatcaagatcttgccttcacacaagcagaagcgataacaccagggtaggaatcactgagaccatctcaagagtttgtctagaatatcactgtgtgataaggcaaagggcctgggacatagcatacgttggtagatatttgttgggtcagtttaaaaaagacacgtggatgtctactctcttggagtaccttgactgtacttctgagtattgtatataaatatgtcagcaattaatctttgaggaagggttgtttcttttagtggtcttagtgagtcttatcacacttaataagataaccctttacatttaacagcagtaggctcatatgaaagagcggttttctgttgatagtgctggagctcatatttcaagttgttgcacagcagagatcagcctaatattttaaatgcagctgtataggtctgttttcacattgctacagagaactacctgaggctgggtaatttataaagtaaagaggtttaattggctcacagttctgcaggctgtacaggaagcatggctggggagacctcaggaaacttacaatcatggcaaaaggagtgggcgaagctagcatgtcctacatggttggagcaggaggaaaagagagaagcggaaggtgccatgcacttttaaacaacaagatcttatgagaactcactcactatcataagaacagcaagggggaaggccacccccatgatcgaatcacttcccaccaagcccctcctccaacacaggggattacaattcgacatgagatttgggcgggaacacaaattcaaaccatatcagcagcctaatattttaaatgtgtgaatttaaatcaaattctgattctcaattttagggacaccttatgaataataacactttgttatagtgcaacagttctggtgagcacacagcattccctttcccaaatcaaaactgggcttttctacccaagtctcttgtagcaaccaagaattcagttgatatacaggggcttatccatctggaaaagacatcacacagaagatagtaagcagctgctctccatatcaacgaagttcacacatagaggaaatgaacttgcattaagacaggagggattttagacagatattaaacacactttccctacaaagatgtaatacagatggatctatgatgaaaaacaactgtggaatttttccctggagacatggacaaatggggtggacaaccatctgttgataatgctttgaagtcctgtctaagaagcagttcaacctcaggagctcttgaagtgccttgctgccctttcacctgcatatggattgtatgttacacagaggaattaggttgttttattgataaataatattagccactcaca

SEQ ID NO: 340 - DNA, 223675 bp, Homo sapiens
aataagacttttaaaatagaaataataattctatgtaatgatggtttcaattttattcataataaacataaaaagcattgtaacaggctaagcattgaaggtcactatgtttaagtgttatacaaatagaacgtatcatgtgacatatttagcctccagtattttggtgttcccttagcacttgtataatttagagaaactctcttgtctccacaaaagttagtgtcctagcagtctagaatacctcattaagcaaaacatgattgaactcagtttacaaagtaagaaaattggctaaccagatgtgccaattatcagtttattgcctcagctccaaattcatattttagtgcctgctttgtgataatatagactttaaataggttttctttgttatctggctcaatgttaggctttaccagtggaggacttggagggagtttagaggaagaaagtgtcattttcttcctggtcccagtttgttccgcctgccaggatcctgcagcatggtttctctagtactgggcttctcaatgcccagctcctgcagtgcccagttcctgcagtacacggtgcccagaagcactcactgaccaacagctgccccatggagccccttagatggttttttcagcaaggcacccatgaaggggcacatctctgtgcacagttttccctgaaccctcttgtgcaacattgcagcaaattctgagacattacctctccctctggatggttttcttcagagagcagactgccatcaggttccaatggcacagcatctcagccccttttctgacatccagtgagccattgttttgccctccccagtgaagtatgaatctcagctctttgggaagttcttacttggatgctgtacttaagccctaagggtgagtattgctccttatttctgctattcttatattccttgtagttctccttacttcatggtagcctgctgagaccagctcggtcagggagaccctaacgcatcagcgctagaggaattaaagacacacacacacagaaatatagaggtgtggagtgggaaatcagggttctcacagctttcagagctgagagcctcaaacacagatttacccaagtatttattaacagtaagccagtaataagcattgtttccatagattatagattaactaaaagtattccttatgggaaataaagggatgggccgaaataaagggaggggtttggctagttttctgcagcaggagcatgtccttaaggcacagatcactcatgctattgcttatggcttaagaacgcctttaagcgattttctgccctgggtgggccaggtgttccttgtggtcattccagtaaacccacaacctttcagcgtgggcatcatggccatcatgaacatgtcgcagtgctgcagagattttgtttatggccagttttggggccagtttaaggccagattttggggggcctgttcccaacagtagccaatatcccatttcttcaatcctctgttacagttaataattacatattaaactttatctgttcaacttagtgtggtttctgtctcctgtttgtttctaacagaaacaccagagtctatctggtgctatatgagacaatgagagagcaaacatgttctgtttaaatgtcacttttaaatttgttaacacagggttcattctgttatatctcttgaagtgcaatgttttgaaaaatggtaaaatttatttaaagaaggactattgatcatgtaatcattctacctgagaagaggtctacagaaaaatgcaatgaagagaagttgtagaaaaaatagactatttgagcagagtatacgaaaccattattttttaaagttacttaaaaatgtgagaatgtttctgaagtccaggacttgtatttctttttatattttcagcattgtaagaaaaaatatttcaaatgaatttttatatactaataatttaaattctatttcatgctattttgatttaaattaagttcactgaacaactaacctactgaattgtagaaggatctatcaaaagaaagatggatgatatatattattttgtaacacatggtgaatatttcagcatttctttaggttatataccgagttttagtggtctgaacagtatccctccaaatccttgcataccctgaatctcagaatgtgacctggtaaggaaatatggtagtttccccttacccatgggagatatattccaagacgcccagtggatgcctgaaagcaggaatagtactaaacactgtacatactacacacaaatttatttttccttctttataatttcatggataggagatgcattcttgccatagatcttagcatcctcatcatacaacttatttttcttaagaattttcacctttttgcttaaaggaagcactttatggcttctcgttggcatatatgaatcatcagcatccctacccttgtgctttggggccatttttaaataaaacaagaaataacttgaacataagcactgcgataccaagaaagtcgatctgatgaccgatcagatggggacagagtgagattccttatgctactcagagtggcaggaaattcaaaacatatgaattatttatttctggaattttccatgtaatatttccagaccacagttgactgtgggtaactgaaacctcagaaagtgaaatggtgaataagagaggactgtaggatttttacagatgtaattagttaagatgaagtcatactgcattagggtggtccctacatccaatgactggtgcccttgtaagaaaaggagaggacacagagttaaacaccaaggggatgatgtaatgatggcagcagagattggagtaatgccttgacaagccaagggatgctgagaattgccaacaaccaccaaaagctggaggagaagcatgggatgtttttttttttcctttgagcctccagaaataaccaataccgttgacactttgatttcagacttttggtcttcgggacagtgagagaatacgtttttgttctttaaaccatccaatttgttatggaagccttggggaactaatgtgcaattaccatacgaagtactggggattcacaggtaaataagacaaacattcttgtgctcatagggctgctgatcatattttgatattttcagtattagtttaaaaacttatttttattatgtgcttttgattaagaaggtctttttcttataactccataagaaattgtaactgctgaaatagtgaccagaatttgggaatgtggccttgtggaaggccttattagatggaggcatctgaattagatttaaaaaatatcttttaagagaaaaccctgcagaaaatcctatggagcatctaaatattaacacacacacacacacacacacacacatacacgcacaccccacactatatttcatccactttcctaattcagcataccttatctcaggtatcaggtagatgtggttctgccaactattttaatagtgaccctgatatggtttggctgtgaatgagttacaattctctcgtaactcatcaggtcaatagtgaccctgacatggtttggctgtgaatgagttacaaattcatcttgcactgtaacatccacaattcccaggtgttgtgggaggaacccggtggaggtaatttaatcatgggggcaggtctttcccatactgttctcatgatagtgaataagtcccatgagacctgatggttttaaaaatgggagtctccctgcacaagctctcttctcttgtctgctgccaggtgagacatgcctttcaccttccgccatgatcgtgaggcctccccagccacgtggaactgagtccgttaaacctctttttctgtatagattacccaatctgaggtatgtctttatcagcagtgtgaaaacggactaatacagaccccaagaactgaactgatgacgggatctcctgcaacttgtattcattggggaggaaataatttggtgctaccaaggctgtaattttcccccactgttgaaccattaatttgaccatattggcaccttcttctgaaagttgtctcagaagaattgcctgttacttcctccacagtgagaattctagcctgcatcttattcagactaaacagcccacctaataccttctcacatattatacatgatcgaaactttcttttcccctctttttatataaaccattgagtttctttttatattctctgtggtgctttagtataatgtgaattttgaatgaagacctacttcattatatgaatgactgtggggatataggtttttaaacttttcaattctgacctcttaattaaaaatttctttctggaatgtgaataatcatttaaaagcacactgttttccagatgataagttaacattgaaaaaatattaactaaaaagtgactctgaggaaaatatatatggatgttttctctaatatttttgcaacttctctgtaagtttgacataatttaaaattaaaaagcaaaagaaaaaaatcaaaaaataagagttaaaatttgatttaatgttagtttttactttttaatctcctctgggattcagaactgaagtcaaacaatcaaggccaccctaaagagtaaataaatgcaatgcccacctatatggcctggtttcagaggtattgggaaacttatgtagatgacatctgctatttgtgcctgactagagcaccttctaacatcttgcagtagcagaacttaggtttttcttgtaagccccctcttcctcatttgcagttcactcatagggatggggctggcaaagtctcagccaatcagtccattctattctcatacccagtgcttgtttgggcaattgccttcaggcccacatcagatcagtgaaactcattatgtttctaggttgaaactattaggaaaacgtatctttggtcatcttgactcagtatggaaagatcctccttaaggatagtcagtgcagacagaggaaaataaaacagatggagaaaactcaagcccggatgatactgtttgagaccccagatccagttatccccaaagctgctgctttttcagttccaattagtttgaaaagtgtctccctacctcatgtttttggttaaattgattttagttgggtttctgtcatttgcaaactgatcaggttaaaattagattggaactgagaatgtataatctgcgtggccatttatcaggttggaataatagaaagatatagataaagccaactctgcaaggaaggagacattcacacgaggacacattgcagctctaaggtgtcaatacaacccccttcttgaatgagtatggctgttttaaattctatcagtaaaaataaaacattccacttgtgcatgtgggacttaagtcactttgacacagagaagcagcctcaattcacagcccaggagcagagctttagataatgagcttctgcacacaacattccatagctacatcactttgtagggtgaaaagaagcaggactctgagtccgctttgcagtctagactccactagactttacaaagccctactttgctttgagtctatcaaaatactgttttgtttaaatttcatctaaactccactcttacacagaactctgtaacaacctatatttttctttggtgagatgaactttgcagtgggtaaataaacctgattttgttagacttcaagtagttactggtggttttggtttgactaggactggaaacaaaggggtttttaattattatagctctctctcccacaataattgttgcattcaaactgtttttataattagagatctggtcatttattcatctgcaaagcaaatctcatgaacatttgagactatgaagcaggttttttgaagctggactccatagcctagctactgacagtgggatgcctatgacagtagcatcaatatcattgggagcttgttagaaaggcagaatctgggaccagtctctgacatgctgaatcagaatctgatcttttatgaagatcactatgtagttgtttgcacaataaagtttgagaagtgctaggagtttccatagagcctctcaggaaagctagggaaaggggacacaaagccactggcctttccctatgacagccatcctgtaatatattgctttgtgatttcatttttctgtaaacactcttgtatagtaaaaaaaaaaaattgaaaaactgctattttaagccacattaaatacttcattgtaaataaactcatcattttgtgtgtttgtgtgagggagagaataagttttgtttggggtggacaggggaaggaagaattctactaaggaaaaacttggaacccaaacacaaagctccctactcaattttatcgtttgcctgtctgtgtggagatggctgctagcaggagctgctggttcttttagaccacacacatgtggggttctagaatgattctaaataacagagctgggagggtgggtctctcagagccctatttttataaaaattaagaaatgaactaggataatgtcttgagagaatgagaagccaggaagataaatttgaccaagaagaaagctctggtcctcaaaggggagtgacaattttgagaatagtacagtggttgtcactggaattcatttctgtctccaggccatagatgagagagagggagagggggaggggaataggtagtggaaaagagggagggagagagagagaaccagatctaaaaatgatatgcctgcaatcccagcacttgggaaaggtgaggcaggaggatcacttgggaccaggagttcaagaccagcctgggcaacatagtgagaccctgtccctaccaaaaagttttaaaaattagctgggaatggtggcgcatgcctatggtcccagctactaggttggctgaggtgggaagatcacttgagcccaggagcttgaggctacagtaagccatggttgcaccactgcactgcactgcactccagcttaaggaacagatggagactcttgtctcaaaaaaaaaaaaaaaaaaaaagaaagaaagaaacttccactcctctgatcttgggtaatttttaaaatgtaagagccctatatctgagcccctgtgttagaatataacataaagggaggagaagcatttcctcacctagctttagttggccacaggccagtcacccctttagtcccagaagactccacctttgtaggatgcccagctgtggataagcagtgctaagtgggcagatcactgggtctggcagagaccagagactgcagtgggcatcaagatgagaaagaagcacaggcagtagccagaagtagtggagtttaatatgaatcaaacaggaaataatggcaaaaacggaaattatttttgcaactacctagtatcttctgggcactcagaaaagcatggggtaagaggtagtcttccaaaagggtatgtgagcagcggtcttctgtgggagcaagaatctgtggaattttagttaacagtttatgcaaccccatatctatctatgagcgaataaaaaatttaatagggattttgggaaaatttaacaggacattttgttgaagctcaaaatgtaacctccttcccaactctttttcactctttttagaatagacaagccaaattcccatggttgaatattcttcaacaagattgagagttgactttagagcctaagagacagggtcttttactcttatagagaacaccatgcagtgtattttcccctaaattctcctgactttctcagtatttctccaaggaatacaacaggtagggatactgccttatggttttttgagccctcattaccacctatcaatatttagcatgtatgtggcccttatcaagcaactgtccacagtttgattgggtcacaatcagctgcactttgatttcattgtttccaaacatgttttaatacctgctacgcgctaggaatacaagaatattttaccttcaatgcttaaatcaaaggctaatattcttatagtcctaagagaaaaggattattggttctaaattaaaatgttctgccttatccccatacaatgtagaaaccagtctacaggcacattttttttttctaaagtgaaagaacacaatttaataacaactgggtagttgtgttgaggcaaaagattttctcttgtttctcagtaaaaccccaggaggtcaagcttacatattcctgtgaagaagtaagtgcgaatagagtataagggttctgccaagaggtgcttcgggagctgccagcattggtgttctcaaacaccttcctctccctgtcactgtggcactaaggcccacttgttagagtttaatgtggttcacctttgcttcacagatccagatgtttccaggaatagttctatccacaggactgaagagtgagtatggtatcaatgcccatcacatttagatttacttcttgctacttaattccagtgcagccattattatggcttatcgctaagaacatacattgaaccacatgtcgagagccaatgatgaaacctcttattgtcctacagtatttttttccacctgaaaagaattatctccttcaattccagatgatgtttttacccctttgatgtaggaagcaccattatttttactttatatggaggagatacctcttttatttatggggtcagcttacctgagatgcagaagtctactagttaacatctcagtggtgctatcagcctctcctgtggagcaaaggcagtttcttctgaagtctggaggtgaggggagaaaggaaaagggatagagctctgctttttctgttttaacgctacagataggaagtggccaccagcttgcacacagtgccctgtacgtagtggcaaagtttgtgtcagggagagaacaagagtctactcttcattgcctgtggtcatgaccaacctatttccaattatacttattttagaagttgtccctttcttctcaggctttcaggaataactgtgctcaaaccattttattatctggggatattactttgaaaatgtcattgagaatgaatgctttgcttggagacaaaatagtgccacttgttagctcaagtgagagactaccaaaggtgtactttgtccattttcctaggaaactttttagaaatgttttatagtgcttagcggggaagctgccacaaagtaggcaaatgtttgctgaatgacaaaataaatgaataagagctctgatgaagctatagcaatattatgttaaagacacacagatatagttatgtggattattatttgcagacatacactacttcttgaatgcagcaatcattacagctttataaatagaaatcctctagtgtcatgaatctttggggggatttagtagagtctttgggaggatttatgtccatgctcagccccaaagataatcttggaccatatttatttgcttgactatttttataataatattacaatgcttaaattttgttttaagcatgatttaaacccagcaggtagggtttacttggtgaaatacaaaggcaattccacttctgaaataatgtctcatgtattaggtaccatgcaggctcaataaaagtagatagatttccttcacccgaagcttttaacaaaaaaaaaaaaaaaaaaaaaaagaaagaaaagaaattgtgttttatattaatatgctatgttactataatactgctacattgatatgggccttcttcataatatcagaagtgaagtgtattggacatcagatacctaacttttatataattgaaggactcacagcactgactttattggtagatagtatacatatatatttttatggtggaaaccctaatatgatgattcatattgttaaaaaagaattacattttttgatgctctgagtcatgccctatttaagagatccatttttgagcttataatgaagcactgataaatattaaaataaaaaataaagataattggtaccaggactttattaggcatttcactgaatacaaataaacttttattttttacattaagaacacaatcttatttaaaaaattcacattttctatacagactgtagccatggattttctttacaccacatttattaaagtatcaataaccagatcctaaaaagagaaggcacagatctgtctctctctggtgaatttctggtgtctaatgaaggaaatgtcaccagctctgcaaattcccatcctccagaaatgaagcaaatcaacacaaatgtgtgtaagcaggagtcatgagatggacatgttatattaaaggatttggattttcctctgccacttataggaatttcaggagaggaggtagctactgaaaatgtttcaaaattccatctgcattcagtctctgtcaaggattcactgttggaaacagtagtatttgaaagctagaatttaggaattccaacatggttctattttctgcattgttttagaaaccagcctttgatctcactgttcttattttagggcttcttgggttttcaattccaaaaaaaaatagtactggtcgttataatttgctttgacgagtctctctgccaggtgatagctgcatgtcagggtcagattctatcccctacttgcgcctgcctcccctgtcccccaacaatgttctgagaaggtgtcaccagggcagtgtctatacctcagactcttttattcttccagcagtgaagacagttcctatgtcacctttctacaattccgtagatgaccagttttaacctgataaaaataatttgtggtaagatgtgaatgggggaaataatgaattcgtttgttatctctctgaaagaaaaaagaaattgaatttaaaagaggtcctggtactgagttaggcggtgttgccacttttcaggagcatttctaatatgtcggtgtgtttttggttgtcccagttactgggaaatgctatataagggattaatggggaaacttggacctcacaacaggctggcaaagggaagtgttgaacatggtggcattgatcctatgaagatatttacttgattatcccatctgtatttgagttcgtccttcaaaaagcatttgcaggacctagagctgaccaatgttttctttcttgaaggacattatgactgcagatattcataaggtgtctgaacacaagggtatggagggaggtagatctcgccccttatagatagcccagctgaaaaagatagaaaggcagtgtggatagaattgtgagatttaggaaaaaatatataggacatacccagttacatttgaatttcagataaactttttttaaagtgaaagtatgtctgattaaatatatgagaaatatgctaaagaaatactgtttatctgaaatttaaatttcactggatatcctgtattttacctggcaactctaaatattgaaaaggaataactaaggatggagaaagaaaggaaataagaaagttaattaatattctgtaatcagatccaagcccaaagaaggtcacagaatttttgcttcaagcatgaccacatgtgtagatccttgtcagtcatgagttttctattgctagactaattctacacgtggggcagaccagaaaagtgtgtgggttgcatgcttgttttctcgagaagagaaccatgttggaaccacctagtatggatgggcctttaaaagctctcctaacaccaaggcagttcatcttacttgggaagattgaattttaaaaagtaatggtttggagaaacaatttttcatggaaaatttatcattaaagaaaaatgggtgccatgttgggaaggtcaactttaaaggtgtactggttctattgttgatgaaaacaaattagtctgtatgaaaatgaagttaatatatgaattgatgtttgattattacgaaaagcaatggggtacctcacaaggtggacagtttgcttgtgggaactcagataggttctaaagcccattcctcacaaaattaaaagacaccatttttaacaaaaacttaatttctgtttcaattttaaatccaaattgcaaaaacaacaaaaaagtgttaataaattaaggctggtcacaatgtgccctttttctttaggataagtttgatttttgataagatattatatacttacacacacataccacatacaagcacatacttttgactcatacaaatatacgtttaaaactattacctacaaaatagtatcacaattgaaataacaattacacaattttcaacagattcaattgacatgttttacaaattctacagaacactttatcattatcattgggaaaacaaacaatttagagcattatttaaaactgtatgtaacacaggagccaccaataagttatggcagatatagcatttacaccatagtgtcactgaaatctagctgaaaagactaaagtgctgtaaaataaaatgctcttaaaaaccttgtttagcatatcctgaggacactgtgcattattttctattagcaattcaaagtgagcactctgcctacggaactcctgtttggttgagtgaccaaagattaaaagattgtgtcgttggatctgtaaaactgtgaaactaaaaaactcatggaaacatgcatttcctgagacttccaactttccagtctggaatcctaacaaggaagaacctgaacaaataaccctggctaaaaacatgtcagaacttcaaagaacttaaaacaactttaagtgaagatgtgtgtatgtgtttgtaatttatattctagtccattatggattctctaatttgaagtgaaattgagaatttagatagactgttcgtgccaggcattttctatttctgatggcctcacttttcattggttttctagttacttttctcctcttaaatatttaaatatttgaattatgtttatatctactaatgtaggagatattgattttaagagttgaaacagcaatagactcagattgattagagtgcagtttcaacttgaataataagtatatgtgtgtgaaatgtgcattctgtgtgtgtgtgtaatgtgtgtatgtgcacatacaggtgtatacatggcaaacattttatactctaatacattcactgttaggtggcactccatgaaaagtaagttttcccagtatggctgaaagtcaatattgaggtcatcatatagaatatcctaaggcttttaaaagatgcctcctcattctctgcatttacattattgtgtggtaaatagggagacataaatgataatggcagaagaaaaatttgctatattagtccttgaaaattacagacaggaaatcaaacttaaaaatgatctctttgcatattttctctcattccacccactcctttgatttcctgctgtagattgggtaaaagttagattgtatttgtttggttgttttgttttgttttgtttttttgcctcacaggacttgtgaaatagtcttaagaaacaagtaaaacaaaaagtgcaccaaggtgtatctaccaccatcttggcgcccatgtgtagcccttgtgctacaagctctctgaaaagacaatgcccagctgagacaaatgtgcataggctaaggataagcttcgattgcatatcaccattttttacttttggaaggcccgcagcctgcttccccagtgtgctccagggcagaactaatggatagaagacagtcaaaggcaccttctctccattcccctttccaaggactcccttttagtaaactccccctctagctggaggacccatggttcccttctacctcttccctcctttataaattaaggcaagtccatttactctaagtgcctgctacataggcactgtatgtccacatggaaaccatagcattggcttgaaactgccttttgtctaacaaggtttctgggtgcatatcattagcagcagtacaaagctttccctagttaaaaaactgcacaattattcaaaagcttcatcatgtttgtttttttccagaacccagttgacaaataggacaaagttaattctaagcaaacactatgagaaagtatctaggttcaagaaaatacaacatagttacctctatattttattcatgatatgatgaaaaatctgttttccattatatttataaaattaaattcatgtgtcattgcaaatattcttggctaagatcctcctgaaggatgaatgaatagccagttagagagaaagtctgcccaaaaaccaaatttacgggacatacatttcaataatcctaatcattttaaaaggattcatatacattttcacataaagagcaggtgtaaaagacagaaagataataaaactacaagggaagggaaaatggaaagaagagaagaaatatattttaaaaataattaagtcctacactagaattcttttacaaaaatactttgatgtgatcatctactctactttcaaaggttttattactctttttcacacaatattaagggtttcagtcttaaaattaaattatttaatattatcaatgtcttcatttgaaaagaagaattgtactgtgtccatatctgtgtgtgtttctgtatgtttgaatttgtatgctatcacaggaatgggcatatgtttgtatattgtatatggcaagatgtatacacacaacccaaatgtatacacacatttttgtgtgtacatgtatgctatttggtataccacaggtacatacacactcctcataaacattctcttcagtataaacaatttcttttcctccctttaattgctaataagtactattttctgatcatgagtatttataatcttgaaatcaactcttgattatttgtggtcttgacatatatggttttgaattgaactcccttatctaagtctaagagattaagccatatgtgctacatttaagttcattaaaagctgagggcatgcttttatttctctatgaccctactttgcatggactgtattatcctaggaaactattggggtgtgattatttctaaacatgaaaataaaataattaataattgtaagaatttcatcaaattttataattttataaacacctcacaatattcctgtgaagtacataggcaaggattattgtgctctaagttttttttttttattttttagagttgtcaaatatcacaatgacacgaaggaggaagtaacgctcaagctgtgtcattgttcttccctgtagacccggactattaaacgttaggttgcagaaactttgtgtgaaacttttgcctctgccttaatctcatccctcggataggatgaaactcagaagtgaggagtcagagccaattttaaacaagtccattcagacctcataaatttcaagtttcctaaagatatttcagagatccctgtgatttcatggacataatttcaaacacattgctctaactgcttctaccagccttcctctttctttccttcaagtcaaaaacttgcagtttcttgaaaaatcttccttaaaatctggaatttagaattaaatatttgaaaatcccaaattggcaggaaagcttgcagtctttttcttcttccttcctctcttcctccctccctccctctcttcctccctccctccctctcttccttccttccttcctcccttccttccttcctcccgtccttccttctgtccttccctcccttcttccctcccttcctccctcccttcctttcttcctttccttccttccttccttccttccttccttccttccttccttccttccttctgtctttttctttcatcaagagcatcattaagagggctttttaaagagttattttcagagttttcaattttaacacacttgtaccttaccatttactgggtacttgcagggcaatattatttaagagattgccaaattaaaatgccatacatctctttcacccctcaaccatttttccctctgaaattggcattcacagctctccaaaaacatttttctcctatatttatagctgccttaaatagaaatactgtgaaacactattattttcatataacaaaaatcactgattatgaccttcaatattactgatgcatggaaactgatttgatgcagattttctatgaccaaaaattagctatgattgcccaactgtggatgactatagagcattataacaagtcccacaaaactagtaagttttaagacaacaatgtaatacacaaaatgttgggcattcaattgttttgattcccatacagcatctgattaaaaagagcgagcaagagagggagcagaaaggttgcagggtatagacagcgtaggagtcataggctggaaatagagaacctaatcaagtaaacactcatgaattctatgttacaaagactaattttgaaaaacaaagttactggtcttttttttttattcctaacactagaagtagattttgctcatcaaatgggaaatgaaatatttatagtaatgaagagtatgattgtaatcactgaagaaacagtttttccccttttcccacccactaccagccctattcccttcagagactcagtggaataggaagatcagagtgtttacagatagtatgccctaatacaatgagctttctccatcttattcatggaaactccaagtagtgctatcaagtgttggcttctccttcatcaaagacatagttgagctttatgacagtgctgataaagtcaccaagttctacaaaatcggcagtgacaatattgatgccactctctcctggcttctgcgtgcggacccactgcatcatggcaggaagagctctgagaaaggaaacaaaaagaaaagtcacagaaggcaagatactatttttcaagctctacaattctcagtcttccctttagtttctagcttattaaaataaatgtttcacgtataggtacaggaaggggaaaaggccaaatggactctggggattttttaacctttgaagaaactctgcaggagaaatattcactatattgatccgtattggagttctcatctcggcagatcccagatactgtgatagtttataatgatgcttccctactaagaaaacaacatttttgcatttgtattctgatttaacatggtgtcatcacaaaccctgcaaaactacggattggggaggtcagagatgaatacatgcacttagcaaacatttattatgaacccactattatgaggaaatgtgctaagatattgtaaatagacataatagtaaaatcccctgccttcagaaagtacacagtttggtggtgggtaggcagacaaggaagaaattgtagcacaatataatcagggctcattccttcaaacacatttactgggcacctattaagttccagtcatcagtgtaggcacctggaggattcaagtgaacaaaacagataaaaatatctttccctgtggagcttacattctcataaggagaaacagacaataaacaatagtcataaaaatatgtagtttgatagaagggaataagtgctataaaaatggagcaaagaaaagaagattaggaatctgcaggtagggaggagagatgcagattgcattttaaaatagggtggcttaataggcctcagtgataaagggacatttgtgcaaaggtttgaaggagacaagggagttagtcatgtggctatctagggaaagcatcccagctattgccatggcactaatggggtagcatgcttaagcttagagaaaagaagagagtagtaaaaaaaatgaggatactgaggaaaagggggcagattctgtagggcacattaggccattataaaagttttgatgttcactctgagtaaaatagggggcctttgaattatcttgagcagaggagtggtgtgatttgactttcactataagagctcattcatcaccatgagatcatagtggagagtcacttagcatagcctggaaaatcaaggaaagtcttctgaaaacctttcagaagaatgcttgctaaaataaatattgaaggattaggaagatttagctggataaaggtgagaatggtagatggaggatgatgcaatgcactttcaggcagaggaaataccattttttcatttgctgacagaatcatggtgtgtgcttaggagcaatggatccaggcagacagatacaggtgatgttaatgatgatgtccagcatcttctgacagcatattggaatgagaactactataacttggtcagggcaggaagggaagtttccatgacaaaaggataaatgaacaggccagagacatgatagtgtattaataaagaaagtttgagggaaatacatgtgaacattaaattcctggatgaaatggagagggagagggagagaaaagggaagaaggggaggagagtttaaaaacctagaagaagttgtataaaaaaggtaaggtagttttgaaagatgttaaagagaaaaaaaaaaacccagacaatagagggccttgagaaatatataacaactgaattgggaggctgagcaagatggtggaacagaaggctccgcatacccctgcaaggtcatcgtccttcctgcaaggataccaagttaacaactatttacacagcaaaaaacacctttataagaactaaaaatcagatgagtacctttagtacctggatttaactttatatcgcggaaaatgccacagaagaaatagaaaaagcagtcctgaatcactgacaccctccctctcaacctccaccagcaatggcctgttgtggagagcatctctgggctctgggcaagggagaatacagtaattgtgaggcattaaactcagtgctgtcctgctagagcagaaatgaaaaccggacctaactcagcggacgcccagtcacacagggaatatttaaaccaggcctagccagagagggaatcacagatcccagcagtcagaacttgagtgcctgcaaatctcaccacagagggctatagtgttctgtgtctccaagtaaatttgaaaggcagtctaggtcataagaactgcaactcttaggcaactccatactgagacatcagcttaggtaaccaagggagtgctggcatcacctctcccctaaacccaggctgcacagcttgtggtttcaaaagagacccccttcttccacttgggagaagagggggaagaatggtgaggactttgtcttgcctcttggataccagctcagccacagcaggatagggcaccagtcagagtcatgaggtccccgttccaggccctagctcccagatgacatttctagacacaccctgggccagaagggaacctgctgccttgaagaaaaggatgtagacctaccagcattcatcacctgctaactgaagagcccttggccccagataaccagcagagatatccaggtactacatcttgggtcttgggtgaacctctgaggcttgcttgcaagtaagactcagcatattactagctatggtggctgtgggacaaaacttcttcttgttgagaaaagcagagagaaaagtaaaggggactttgtcttgcacctttggtaccaacactgccatggttgctagagcaccaagcagactcttagagtccccgattccaggacttcactgttggatggcatttctggacctgcccagggtcagagggagcccactgccctgaagggtgagtcccaggctaggcagcatccaccagaagcagacttaagagatcttggaccttaagggaacatcagtggtagtctggaagtactcatcatggctagggtggtggtggctatagggtgaggctcctgtacctttggaaaggacagggaagactggtaaggactgtgtcttgtgtttttagtgccagttcagctgcaatgtaattggataccagataaatttctaaggtttttggctctactccctgactccagatggcacttctggacccacccagggcttgggggaccttgccatcctgaaaggaaggatacagacgtggctggctttgccacctgctgattgttcagccccagggccttgagaaaccatacacaatagccagggactggttacagcaggccctgcatgagacccagtactttgctggcttcaggtgtgacccagcacagcacagtcatagtagtggtggccacagaggtgcttgtgtcattccatctgcaggtttaggtggttcaaaatggagtgggagactctgtatgtttggaagaaagtaaggaaagagaacaaatctctgcctggtaacttagagaattctcccatatctggaccaaggccatcaaggtggtacctctacaagtcatcaggaatcacagcattactggtcttggggtgccccctaaagcagatacagtttagatcacaataccttagtcttttcaaatttccagaaggcctccctgagaaggatggctacaaataagctcagacagcaaagactagaataaatgcctaactcttcaatgtccagacattgaagaatatctaactagcatcaacaccatctggggaaaggtgacctcaccatatgaactaaataaggcaccagggaccaatcctggagaaacagagatatgtgacctttcagacaaagaactcaaagtagctgtgttaaggaaactcaaataggttcaagacaacacagagaaggaattcagaattctatcagataaattcaatgaagatattaaaataattaaaaagagtcaagcagaaattttctggagctgaaaaatgtaattggtatactaaagaatgcatcagagtcatttaatggcagaatggatcaagcagaagaaacagtgaccttgaagacaggatatttgaaaatatacagaggagacaaaagaaaaaataataaaaaacaatgaagcatgcctacaggatgcagaaaataggctgaaaagacaaatctaagagttattggccttaaataagtagaaaagaaagacaagggtaggatgtttattcaaagaaataataacagagaacttcccaaacttagagaaagatattaatatccaaacacaagaaggccaggagagcatgacatgacatattcaaggtgcagaaggaaaaaaaacttttaccctagagtgggatgtctggcaaaaatatccttcaaacatgaaggagaaatagactttcccagataaacaaaagctgagggatttcatcaatcccagacccgccccacaagaaatgttaaagggagtacttcaatcaaaaagaaaaggacattaatgagcaataaataatcagtagaaggtacaaaacttactggtaatggtaagtacacagaaaaacaaagaatattataacactgccactgtggtatgtaaactactcttatccttagtagaaagactaaacaatgaaccaatcaaaaataaaaactacaacaaaatttcaaggcacagtcagtacaataaaatataagtagaaacaacaaaatgtttaaaagtggggggatgaagttaaggcgtatttttattagtttactttttgtttgtttacttatgcaaataatgtaaagttgttatcaagttaaaataatgacttataagatggtatttgcacacttcctggtaacctaaaaccaaaaacatgcaatggatacacaaaaaataagaagcaataactaaatcctatcaccaggtaaagtcaacttcactagaggaagacaggaaggaaagaaaaaaggaagagaagaccacaacacaaccagaagacacataacaaaatgcaaggagtaagtccttacttatcaataacaacattgaatgtaaatggactaaactctccaatcaaaagacatagcctggcttagtggatgagaaaacaagacccaatgatctattgcctacaagaaacacacatcacctgtaaagacacacatagaccgaaaataaagggttggaaaaagattccacaccactggaaacaagcaaacaaacaaatgaacaaaaaaagcaggagttgctatacttatatcagacaaaataaatttcaaaacaaaaactgtaagatgagacaaataatgtcactgtgccatgataaaggtttcaattcagcaagaggatatagcaattgtaaatatatatgcagtcaacactggaggacccagatacatataataagtatttttagagctaaagagagaaataggccctaaaacaataatagccagagacctcaacaccctactttcagtactgaacagatcttccagacagaaaatcaagaaacatcagacttaatctgcagtatagaccaaatggatctaatagacatttacagaacatttcatccaagagcttcaggatacacatttttttcctcagcgcatggatcattctcaaggatagaccatattttaggtcacaaaacatcttaaaacattcaaaacaatctaagtaatatcaaacatcttctctgaccacaatgggatataactagaaattaatgatgagaggaattttgggagttctacaactacatggaaattaaacagtacgctcctgaatgaccagtgggtcaatgaagacattaagaaggaaattgaaaagtttcttgaaacaaataataatggaaacacaacacaccaaaacctatgggatacagcaaaagcagtactaagaaggaagtttatagctacaagtgcctgtgtcccaaaagagaaaaaacttcaaataaacaatctaatgatgcatcttaaaaaactagaaaaccaagaaaaaaccaaaccccaaattagtagaagaaaagaaataataaagatcagagtggtaataaatgcaattgaaatgaaaaaaatacaaaagatcaataaaacaaaaatgtcatttgttgaaaagttaagcacaatggacaaacctttagccatactaagaaaacaaaagaagatccaaataaataaataaaatcagaaatggaaaagagacattacaactgacactgcagaaattcaaaagttcattagtggctactatgagcaactacatgccaataaataggaaaacctacaagaaatgaacaaattcctagacacatacaacctaccaagattgaactaggaaaaaaattcaaaacctgaacagaccaataacaagtaatgagatcaaagccataataaaaagtgtcccagtaaagaaaaccccgagacctgatggcgtcactgcctaataattctaccaaacatttaaagaaaaactaatagcaatcctactctaattattttgaaaaatagaggaggagggaatatttccaaactcactctatgaggccagtattaccctgataacaaaaccaaagacacacctaaaaacaaaaaaaagaaaaaacaacaactataagccaatattgctgatgaatattgatgtaaaaattcttaacaaaacactagcaaacttaattcaggaatacattagaaagaccattcatcatgaccaattgggattcatccctgggatgcaagggtggttcaacatatgcaaatcaattaatgttttggttttttaattttttaattttttgagacggagtctcgctctgtcgcccagactggagtgcagtggcgcgatcttggctcactgcaagctccacctcccgggttcacaccattctcctgcctcagcctccagagtagctgggattacaggcacccgccaccatgcctggctaattttttgtatttttagtagagacaggttttcactgtgttagccaggatggtctcgatctcctgacctcgtgatccgtccgcctcggcctcccaaagtgctgggattacaggcgtgagccactgcgcccggccacatatcaattaatgtgatacatcacatcaacagaaagaagaatgaaaaccatatgatcatctcaattgatgctgaaaaagcatttgatagaagtcaacatcccttcattataaaaaatcttttaaaaaactggaaatagaatgaacatatctaaacataataaaaaccatatacaacagacccacagctagtatcatactgaatgaggaaaaagtagaagcttttcctctaagagctggcacatgacaaggatgcccagtgtcactgctgttattcaaaatagtactggaatttctagctagaccaatcagaccagagaaagacacaaaatgcttccaaattgaaaagaaagtcaaatgtcccttgtttgcagatgatatgatcttatatttggaaaaacataaagactctgtaagaaaacagaagtgataagcaaattcaataaatttgcagtatacaaagtcaacatacaaaaatcagtagcatttctgtatgccaacagtgaacaatgtgaaaaagaataaaagaagcaatcccatttacaatagccacacataaaattaagtacctaggaataaaccaaaaaaagtgaaagagctctataatgaaatctataaaacactgatgaaagaagacaccaaaaaaatgcaaaagtataccatgtttatagattgaaagaatcaatactgttaaagtgtccatactactcaaagcagtctacagatttaatgcaatctactgtcaaaatactaatgatattcttcatagaaatagaaaaagcaaacctaaaatttatgtggaaacacaaaagacccagcatagccaaagttatccaaaccaaaaagaacaaaactggaagaatcacattactttaaattatcctgcagagaaatactaactaacacagcatggcactggcataaaaacagacacatagaccaagagaaaataataaatacagaagcaaattcacacatttacggtcaactcacttttgacaaaggtgccacaaacacacactggggaaaagacagtatcttcagtaatggtgctgggaaaattggatatccagatgcaaaagaataaaacttggccactatctctcacctctcaccatatacaaaaatcagatcaaaatggattaaagacttaaacctaagacctcaaactatgaaactactataagaaaactttggggaaaatctccaggacattggtctgggcaaaaatttcttgagcaataccccataagcacaggcaaccaaaccaaacatggacaaatgggatcacatcaaattaaaaggcttctgcacagtgaaggatacaatcaacaaagtgaagagacaacccacagaatgggagaaaatatcttcaaactacccatctgacatgagattaataaccaggatatataaggaacttgaacaactttataggaaaaaaagctaattaattaaaagatgggcaaaagatttgaacagacatttctcaaaagaagacatacaaatggcaaacagacatatgaacatatgctcaacatcattgattatcagagagatgcaaatcatgtcatccaagttaaaatggtttatatccagaaacaggcaataacaaatgctggaggggacatggagaaaagggaacccttgtatactgttggtgggaatgtacattagtacaaccactatggagaacagtttggaggttcttcaaaaaactgaaaatcgagctaccaagtgatccagcaatcccactgctgggtatatacacaaaagatagaaaatcagtatattgaagagatatctgcactcctatgtttgttgcagcactgtgtgtaatacctaagatttggaagcaacctaaatgttcatcaacagatgactggataaagaaaatgtggctgggcgtggtggcccacgcctgtaattctagcactttgggaggctgaggtgggcagatcttgaggtcaggagatcgaggccatcctggccaacatggtgaaactccgtctctactaaaatacaaaaattagttgggtgttgtgatgtgcacctgtagtcccagctactcaggaggctgagtcaggggaattgcttgaacccaggaggaggaggttgcagtgagtcaagttcgcaccactgcacttcagcctggtgacagaacaagactctgtctaaaaaaaaaaaaaagaaaagaaaaaagaaaatgtggtacatatacacaatggagtactatacagccatagaaaggaataagattcagtcatttgcaacgacatgcatggaactggagatcattatgttaagtgaaataagccaggtacagaaagacaaatatcacacgttgtcacttatttatgagatctaaaaatcaaaacattgaactcatggacacagagagaaggatggttaccagaggctaggaagcatagtgggagagctatggatgaggtggggtggttaaaaagtataaaaaaaagttagaaagaagaaatgagatctatttgatagcacaacagactgattagagtcaataataactatacattttaaaataacttaaaaagtgtaattggattgtttgcaactcaatgggcaaatgcttgagggaagggataccccattcttcacagtaagcttatttcacattgcatgcctttatcaatacatctaatgtacccataaatatatacacctactatatacccacaaaaatgaaaaagaaaaagaaaagaaatacatagcaactgaaaactgttagctaggggaatactatgattagattagtgatttagagattagtttgacttcagtgtagacaagtgatgggagagagcaacactaggggcagaaatcacaattagatgctgctgaagtaatccagaccagagatagtggttgcttgaattgcagtagcagcagtgtatatatatatgaaagacacctgaaatctagatgtcatctaaaatgacatctgatatgaaactggatgtagaaggagaggaagaaagggaccatgaattatgcctagatttctagaagtattctggcacgtggacatcattcactcatcttggaaagacaggagcgaagcctttccagcaagcatgataagttcagtctgatatatgttgattttgaggtgactttggaacacatgagttgagatctcaagtggcaggtaagtacaggtcttatatgcaggacagagagctgctcagaagtcatcacaaacagagaatagttggagctgtgaacgtggataagatcacttagattttgaggaggaggaagaaaagagaaaaaatcagaagcatttaagggatgggcaggaaaatggattccatagaaggcaatcagaagtagatgcagaagtaggaggaaaatcaggagcatatagtgtcatgaaaatcaagaaaagaaggaagccatgctccttttggaaactaagaagagctgagtgagatttaagcagggagtgtgataaatgtgcatttccccagatctcagaaagtatatccagtctaaagaaattcagcccgttcagacaacactgggtcaatgaccttgagctacactaatccccggctagtaccttaaaaatcctgatccataatttcagcatatacattttcctgtcagacccagatagaggaggactcagttgtttctaaaagagcataatgttgacctaaatggcccaatgcctttaggaaatagagcagcaggtggagacatttggtccccacagcaatagttttagaagataattctatcttaaaatggacaatctggatcccatgtctgaatatacagacatgagtgtattcaagttcattagaacgacagatactgtgacagtatgtgtgtagccactctggttgaacccacaactttctcttctggccttgctagaacagatgaagtggctctgctgtgcctgtcgcatcacctttgcatatatgagaagaccaatgctctttggaaatagtatcacaaccagtgtatttcctgggaagaatgatttttcaacagactcattcaccttgagaggtgagaggcggagtagataagtgtgatgctgaggccagtattgattctgtgttggccttaactgagtagcttgttcaccagatcccttgggtactacgtcatgggaggttcctgagcaaccatattcacgtctcagaaccttgattatcacagaaacagctccttagatgccgtctgttactcagaagttaaaatttctaggcctgaatttagaacaactaattgttatccccacggagaggttaggagaacacaagagtgttcttttttgtttccccataaaatagattgctttgagaattgatgaaacattgtttcaaaataacttgtagtccttagatgaaatatgaatattacatttaaaatatcattcctctgagtcatgggaatatttctattttctgttcaggcatacgttcctaaagtcaatatgataccagagacaaaacaagcaataatgccaagttaaatctcaaatactcagacagtctcaagtagaattatgttaaacaaaaagactcactgtactggattaaaactagcaaatgctactgaagttacaacaattatttaggatagcatttcttaatcttttatcattattacctcccaaggagcttttttgaatattgttttcctatttgtcctcctcctccatgaaattttaatactacagatatattgtataactgtttatatatctgtgctttacatgtgaaaagaaaacattttttgtttggtgtctgaagaactaatttttgtttttttgccattgataatgtatgatgtacagctaattaggacattgctggttatacttggtgttggacaggtaataagaatgaactgaaagatgactctggtggtaataaaatgccaccaatgtaacaatttttatggtataagactgtcttagtctgtttggggctgctataacaaaataccataacctgggtagtatataaacaacagaaatgtatttctcaaagttttggagacttagaagtccaagatcaatgtgctagtagatttggtgtttggtgagggctcctttcttgattcataaatggagttttctcattgtgtcttcacatggtggaagggaaaacaagatcccttgtgcctctttaacaagggtactaatctcattcatggggactctgccctcacaacctaatcgcctcccaaagtcctcacttcttaatgccatcatcttgaaggttaggatttcaacatatgaatttggagagacacaaacatttggatcacagcaaagaaaaactggttaaactttatttaagtcacctatctttctatccctccattcatccatccatgcattcatctaacaaagatgtattgtgcatcagtggtgctacctgtaacttcctagggccatttcagagtttagactttcctcatctctcctggagagatgttgccacagtcttgtgcctatgttccttttttgtgtgtgttatctacaccacagtcaggacaatgtttctcaaattaatttgagcattattattcctcttcatgaacaactacaaattcatctctcacctgcaagatatacccaactcttcagcagtgtgtatgagtttttcctatctccccatatcagctaccatctcctcctcaacctcatttattgctacttcctgttcatttgttctccagtgatactgaaatgcttgtattttccccaaaacatgctctgcagtttcatgcttatgtatttttttcaggcctgtcttcttccaatacccttcttggccaattgctccctaccatttaagatttggcctgggcattatctcaacccctcccatccaaatctgagtgaagatcctttttctttatgttttatgcctcttaagcatagttctgtgagtgtacatagcacataacattgattatccatttccatgccaatttttaccagtacctgcccattaaaatatcatattgtattcattaatacatcccctgtacctaccactccctaggatccaaagggaaaacaacacattcattgaactccaatttcctgggctcaggtggctcaaagtttaagaagcaaaatagacgtaaacccaccatgacaatatgatatggtacaatagaagtgggcataggattctatgggagcacagtagataaaatcattcattttacttgggagaaactaaggaggaatttaaggaccatttcacaaaacaggggctatttgaacttggtcatgcctaggccctcttaagataaagagaaaggggttccaaagaaggtgaaggaaggtatcataagaaaagggaacagcacatgcaaaagcatgtgggcatgaaagagatgatgcaactagaggggacatggggactagagagcaggggccctggaggtgtgggggaattgactgcagttgagaagaagcagaaaaggtgtttggccaggtcgttaaggacttcctttgacatgctgtggagtctaagcttgactttatatgcaaataaaggtttgtccaattaaagaaatttttaaaaaattttctcctgcaaagaatttgatattaattccatccaaaggctcctgagacattcaaacttgtattttcttcacctataaataaagagctcactgtcttcctttgaaacttctcagattgctgtgagagtctaaaaaagctttaattcattcatattacccctacctttctttatagccaagatgttactagtggaaattttaatattatccacaagtatcatgaaggaaaatatttctaagtgagttatgtaatctgaagagataattaaattccctttgaatttgtatattaacattttaacatctatttatagaatggtctactttagtatagaaggatgtgattatatagttactgtgatgttaaaaatgtcccccaccattctttaatctttcttttcattagatgttggattttttcttttttagagacagtgtctcactctatcacccatgctgcagtgcagtggcatagtcatagctcactgtaacctcgaactcccggactcaagcgatcctcctgcttcagcctcccaaagcgctgggattacaggcctgagccactgtgcttggcagatgctggatttatagtgtggattagactctgatggcttgcaagacctcagtgactaccaggagaatcatttcaagataaatgaaattaaaaaaaaaatttcatagcactactgtcagttctagagcaagactgtttctattcaggtttaagctccatttattatgagcaagttggtcatcactctaagcctcagttttaccatctataaagtgggcataataatgaggattaaattagttagtacatgtagaatgatgagaagagtgcttgtctctctgtagtggtgtcacattcaataatcactgagtgacagcctgtcaattcactgcttcagtaggggattctgagagctggggattaacacctgggcataatacagttgtgatataaaaatgagtctgcaggatttctttccaactttcacaattccaaagacagaaaagagggggataataacgtcctggtgctgtcatacaagactggtgatgaggcatttggggaagtattcttggaatggctttgtttcctgggcacgtaattgtggcacatgtccgagtatccttttcccactgcagcatctaaagtaagttggtacaacagcaggtcccaaatttggcatgtgaggtctcaaagcccctctggaatgtgaagctcttctgtggaaaggcatcttcaaactgattacaggattcttagaagagaaacagggaagcctacaggaatcagaaaacctccctccttcaaagaagccacaagaatgaagagatgtgagaaccagaggtcgtcttctcatatgctgacattaagaactggttttaaaaagatttaaagaaaaagatttaagagttggaaatgctgaggagttcttttgcaggtcatactattgagttcagtaacctgcaatgtgctgaccttgacttgttatttcatgtcaatctcctgcttagaatgtttcaattacctctcagtgcttttagaacaaaggtaaaaatgcttaactggcctacagggccctgaacaatggccactagaggtttcttcagtttcatctcttgtcattcttcccatcagtgaatgctagccccgttatcagtcttgctcatcttgaccagcctaattttccccagggaaacttctggtttgttgttgttgttgttcttatttgttttgttttgtttttccaaagatgctttatcttccctgccccgtcacttggtgttaaaagagaaatttcagttctggtcctgactagagtaacgtactttcatctttcaggtgaaagtttaaatgtcacttcttcgaaacactagtcagaattgtaatcgtatttatgcgtttgatcaatgtctgtctccccaactagactgtaagctctttgagggctgttttcctactgttgtagcctgggtgcttagcacagtgcatggcacaggctaaggactcagtaaatatttgctgaataaatgaacaggctttttgtttagaaacaaagtttacttttagaacagaagtatatgcagtaacataattcataaaaatgctactcagtattcctcatgtggctactgccacagattttagtttgtggactcactgcttttttgctgaataaaagtaattttttacaaaaaatattgacttgaagaattttaacttttacaaattttcaaattgaccagtcaatttgaaaggtgcctttccttgtgttgtacatatagtgtcaggaggttctgtgctaatgataatgaaagcagtaatcatcatcatcatctttataagagtaaagtttattagaattaatttttttatataatcagatgtatttaatctattttattatatattaattattaattataattatagttgattatcattttattaattagaattaagtttattagaaatgtattataaatccatgtcaaattcttttttaagtatatgtatttgtgtatatataatacctttataacaattgtatttcatatatgctacttctctaacacctctaaacttatattttacagttatgggcgaacaattgtggataataaaaaatttgtgtcttttaatgaatttgttttgaatgcatttaattttcaatgaagtgtatcttttattgaatgaaataaatttccaaaatcaattcattaatttttacagaactctctgatgcactgggggataaagattattataaaaatgtcaatgatagaccgctagcaagactaataaagaaaaaaagagagaagaatcaaatagacgcaataaaaaatgataaaggggatatcaacaccgatcccacagaaatacaaactaccatcagagaacactacaaacacctctacgcaaataaactagaaaatcaagaagaaatggataaattcctcgacacatacgccctcccaagactaaaccaggaagaggttgaatctctgaatagaacaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaaaaggaatcctccctaactcattttatgaggccagcatcatcctgataccaaagctgggccgaaacacaaccaaaaaagacaattttagaccaatatccttgatgaacattgatgcaaaaatcctcaataaaatactggcaaaccgaatccagcagcacatcaaaaagcttatccaccatgatgaagtgggcttcatccctgggatgcaaggctggttcaatatatgcaaatcaataaatgtaatccagcatataaacagagccaaagacaaaaaccacatgattatctcaatagatgcagaaaagacctttgacaaaattcaacaacccttcatgctaaaaactctcaataaattaggtattgatgggatgtatctcaaaataataagagctatctatgacaaagccacagccaatatcatactgaatgggcaaaaactggaagcattccctttgaaaactggcacaagacagggatgccctctctcaccactcctattcaacatagtgttggaagttctggccagggcaattaggcaggagaaggaaatcaagggtattcgattaggaaaagaggaagccaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacaaacagagagccaaatcatgagtgaactcccattcacaattgcttcaaagagaataaaatacctaggaatccaacttacaagggaagtgaaggacctcttcaaggagaactacaaaccactgctcaaggaaataaaagaggatacaaagaaatggaagaatattccatgcttatgggtaaggagagtcaatatcgtgaaaatggccatactgcccaaggtaatttgtagattcaaggccatccccatcaagctaccaatgactttcttcacagaattgggaaaaactactttaaagttcatatggaaccaaaaaagagcccgcatccccaagtcaatcctaagccaaaagaacaaagctggaggcatcacgctacctgacttcaaactatactacaaggctacagtaaccaaaacagcatggtactggtaccaaaacagagatatagaccaatggaacagaacagagtcctcagaaataatgccacatatctacaactatctgatctttgacaaacctgagaaaaaaaagcaatggggaaaggattccctatttaataaatgatgctgggaaaactggctagccatatgtagaaagctgaaactggatcccttccttacacctgatacaaaaattaattcaagatggattaaagacttaaacgttagacctaaaaccttaaaaaccctagaagaaaacctagacattaccattcaggacataggcatgagcaaggacttcatgtctaaaacacgaaaagcaatggcaacaaaagccaaaattgacaaatgggatctaattcaactaaagagcttctgcacagcaaaagaaactaccatcagagtgaacaggcaacctacaaaatgggagaaaattttcacaacctactcatctgacaaagggctaataaccagaatctacaatgaactccaacaaatttacaagaaaaaaacaaacaaccccatcaaaaagtgggcaaaggacatgaacagatacttctcaaaagaagacatttatgcagccaaaaaacacatgaaaaaatgctcaccatcactggccatcagagaaatgcaaatcaaaaccacaatgagataccatctcacaccagctagaatggcaatcattaaaaagtcaggaaacaacaggtgctggagaggatgtggagaaataggaacacttttacactgttggtgggactgtaaactagttcaccccttgtgaaagtcagtgtggtgattcctcagggatctagaactagaaataccatttgacccagccatcccattactgagtatatacccaaaggactataaatcatgctgctataaagacacatgcacacatatgtttattgcggcactattcacaatagcaaagacttggaaccaacccaaatgtccaacaatgatagactggattaagaaaatgtggcacatatacgccatggaatactatacagccataaaaaatgatgagttcatgtcctttgtagggacatggatgaaattggaaatcatcattctcagtaaactatcgcaagaacaaaaaaccaagcaccgcatattctcactcataggtgggaactgaacagtgtgaacacatggacacaggaaggggaacatcacactctggggactgttgtggggtgggaggaagagggagggatagctttaggagatatacctaatgctaaatgacgagttaacgggtgcagcacaccagcatggcacatgtatacatttgtaactaacctgcacattgtgcacatgtaccctagaacttaaagtataataataataaaataatataaaataaaagacaaaaacaaacaaacaaacaaacaaacaaaaacgtcaatggcttgtgactgcccgtcccaacccagcctaagaaatgaaggcttcattgatctgcaaagtttaaaataatgatcatggatctttcttcctttgagcaactgagcccccacagaccaactaattaaagtcaactgtgacagattttcaaatgtgttttcttgtcagtcttgtcatttttgaaagtttagaaatttcacttgaaaatgtaaagaagagaatgacaacatgaaaagaaactcttgcccagaaggttagtatttcatacactgaagcattcagtggtaaaaggcagggtctttgcatctataggttaaaacaatggtgaggggttcaaaataacctcaggtagacaaatgtgtgtcataaatcatagcatctgtaaacacaaggcttatggtttttgctaaattcatctctgtgtaggaagcagcatatctgatttatgtctgatgaaaacagttcatttaaaaaatatttttcccctaaaattacactcagagaaataattaagtcatatgaattatctgaaaaacaatactctagcaagcaagtcttgagcttttaggtgacctgggatttcctgaatagggctaaagtcctcctaagtcttactatgtccttcattatgtattttcagaactaatttattataactatttaggtgtaaaacagaaagtaattaaaggcacagctaaagaaaacattaatctgaattttccccttgttgctgcaaaaggaaaaaaatcccctcaccttgactttcccagattctctgcccaaatcaaattcaaaccccatttatagcttgataaagacatccgtttgacaaatatttataaagcaacccttatttgctaaatattattctgtgtgctgaggacacaatggtgatcagaaacaagcacagcctttgctgagagatttatttttaaaaccaacaaacaaaaacaatcacatcaactgaattgatgttaaaaatttgagttttggtcctgactagagtagagtaatgtactttatttataatcttacataaattatgcaaaccttctgagtctcaattttctccatttgtaagattagcaatgataatactttggggttactacaaggatcacagtcatgccacaccacctcactgccaacacatacccaggtgacaatatctttgatactattactcaaatgtactccagggtcattcaaaactactcagccacagccttgggtacagtcatattttgggagatgcaggatttgcatagaagagctgctgttgcaccaaaaatattgggcacaggaactgaccaagcctcaccctcatcctaacgacactggatgttttcagttttccaagtggaaaattccaagccctcagaagtacatgggacatatctcatcttatttacatgccaagaaggttgttagtttagtttagcttttgttttgtttaacaaaaagtaatgcagacaaatcaaagcaaaatatgccatccgtttcctttgataatggcaacagcagcccttatttttgttgtggcaaggaaaaccattaaaaatccattttcaattaaaataagttcatataaactacaagaaaaaatggtgtttaagagttcataaaatgcactctgtcctcaggctcatcgtttgctccaagtcagggtttcaaaatgagtcacaaaccctgccaggagacagaatgtgagcacagccagcccttgatgggggcctcctggcgtgcagggactattttgtcttctagttttccaggggaatgaaagaataaagaaagctttgcaatttttaaacaaagagacccttctgtatgttaataagatttcgattgccaggaaacagacaatgggttttctttcaagggcagaactcttctgtgtgggatcacatgttctcacttcacagtttcttcctcggcacaagtagcccctcactcagtgcaaatgcacggggaatttgggtactcaaagctcaaaagcaatttaccttcctcaaagcagacagtttctatcgctagcactgtccttcctttcccttctttggaaaaatttccatttgataagaaagagctgtgatgaaaggaagttttacatttctgattttgcttggagcaaatatctcaaggactatctaggtttatcctttggctctcagtagttagatccacttaagagttctggatctagtactattagaggcagtaatgttgaaacccacaacacaaatcaattacccttaatccatagtcacatgagttaacaaaaatgctacttcactgttggcaggatcgttttattaatccaggtttagtattgactacctactgctgattggaagttctagcgtattctgtgtgtctttaattttagcaatgggaaaataaagtattactttaaaaatatgcatttattaagaagagaagggctttgtggagagaaatagggaaataggtccttgatggtgagatcctggaaactgctggtctccatggcattcatacatttgctcatactgtcaacaagtgtttattgagtacccatcatgtggcatttgttggggtggatacagggatgaatcagatatggtccctgacttgactatgggactagttccagaattacttgaaatcctacagacagaaattgctgaattgctctgaatagccttgcatggaaacataggaaaaggagatgtccataaagcctcctttggcttcatgaactagctgtttgtctctttattggcacacattccaattctaaaggaaatgttccgtggactctcacaaattcatgaggctaaataaaaactactccccaaggactcataagtaagtgagtatttatcgacttttaatggactccctccaatcgattcaggaagatcaagagctttggaatcagacagagtcatatttgagttataataacatgtggcctttggaaggttatttaacttccccaattctcatcttcctcgttgtataatgacaataataatggtactacttcatagtgtttttgtaacaataaaatgaaacaatacattatagataggtggtatggcatagaggataagagtgaagactttggagcagagtgtctgaattcaaatcctgggtaagtcacttatgtaagagaataataaaagtgaatagtaaattaaatgaaataaagcatataaaatttcgtaaaatacccaagagataagaactcaatgcaggttaattgttactccattattagtgttaatgcttcaagtgcttagaacatagacagtaaatacatgtagttactttcattttttctagttctgagtgacttcaaggcaggtgactgaactctattcattcaggtatgtagtgaatgcttgtgatgagcctcccagagcttcccttccagatggagagtgctcattcttctagcttctgaaagtgttgttggctgtcaattcccaactaagtttctgtctgagaattgccctcggcaaaagaaagccacctcactcaatgccacacatgctctttggaataacttgcatgcaatgattgatgtctggggaggggtgggaggagaaatctgaagatcccccacagctcctgcagtcttggctgaggcctttgttctgactgcatcacagtccaatttcttcctctacatagttctgtttcctgtactctcccataggtgttgatcccaagagaattcgagagtaaaccttctgcacacaaatcttggtgtcttagagtctgctttctgggaaacccaacctacaagtgtaatctagatggcaggaaattctgcgatcataaaatttgtcctttagccagagtaagaattacgagtggcctctgacaaacttaataagggagaaaaattacaactacattttcatttccaaaatgccaccagggtaggttttcagctgctttaagtgtgttttgtggtggtcaaccaaaagaaattgcatttatgcttaggcagtgtaccgtacatacccacgtgggtacctctacttcctctggcaaaggtgaaaggccaccagaactaaatgacttattgtcagtgaccacagagtcttaacctcagccaggatttctctctggataccatgaagctatgaataatatataaaaggctcagaaaatctaaagctacctctcagaaaacatttgtcatgggcacttaatgggagacttttccagtccaaactgcccagcagaagctggaggatattgattacatcatcaggactttttgtgtacagtactctgttcagcttcatgtccccagtgcatcctttccaagataagagtgattatagcatccaaatttgagtttgattttgttttttaaaagccaaattcagaaatttcactttctttagagaaaatgctaacaggcagaaggaatgaatataagtggaatttaatttgaccataacatcccaggtgctaatatgtcaatgtgtctttggacacttgcaatcatgcataattatcagaggtgatttctttgtttttttcccctttaatcagtgacaactgcaggtgcaaaggatagagaaatatgtcatctgttctgtaagaaaataatattcattaagttgttaattctataatttcctcctgacagtgaccttatgaagtcagaatcttttaacagtaccatcagggagagaaattttaagtcaattagtctgagttagaagagtatttcccatgatgtcatctcttcattatatctttgggaaatcatattacctgacacttttctaaattgtttgaccatgttaacatttttaagcaaattcctaggaacttaataatgtacaataaatattgtcaagccatagaggtgccacatatgtgtcttaatttgtaatacattctccctcttccttgtatatttcctccttgccatgtttagaaaagtctcagagaatatcgggtctgaaaatgtctttaagacattataaagtagtcatattctctacaaaaaatgtttcctgaattaaattccatggaacaatgcttcatgagagattaaagatgtgcctaaaacaaaaggttttcttggccacataagtgtagggaatgttgaagcctctttgatgttcacaatacacataatagcatatggagaccattatcatattaagaacattgaaatgtcctgaagttaaggatttatttccctttttttaagttgggaaacaaatttatttgacctgagaatagccctgctactaccgcccctactaacatgcgtgcatgcatgtgcacacacacacaaatcaccaatgacatctagtggacttggtgttctacagaacactgttgaaaatattgcagtttcttttcaaggggctcaacttgagcatccttttccaggggctcaactctaacatatgttttaggggcttggaattctcatagcctccctcctactattacaagtttctttctgaccacccactagatctacttaggttaatgtaaaacaagtctattcctcttcaacgtgatattcctttaaatatttgaaaataattgatattcacataaccacaccatctgtatcttcccttattcttcttaaatacccccatttactttccttagatttttcagcttggagccctcttattgtctttgtcactcttttctgtgtgctccactttgtctatacttcctctaaaaggggtaaccggaaaataatgcaatgttctcacttgggtgtgaagtgtaacagagtatttccgccctcattctggttcttttattatggccaaagattattttggctattttttcgttaatgtttcccagtaatttcatgatcatctttttcctggaattccttcatggcttcttctgcagtgagtggcaggtattaggcagtattagaggaaggggtagggaggaagctgctctatctctggaagagtcaacagtagtttgctagcatatatattcttctccctctttagctcagagaatctcctctctgcttccaaagaagatataaagcatgcaggagctgagatcccaccagaactgcaagaaaagtcctcaagagtgatccaagggtagatagtggtcagaaactaaggaatgggagcagaggagaaacacgaaaatttggatattctaggaggtagctccagctggtagtatcaatggtgctgccaggggataatagccatctgagtaagtctcttctggctggctttagagtgaatatgtcaatggatacagagaaatcatactatttttttttttcaaaaattggaatcactgacgtatgtgaatagttggtcatgtaaattatctgcctgactgactgagtctgtacttatcaaatacagaagcagggtttccagggtgacaaaatgacagtagtgttgcccttcctcagggcttgtgctcactttagctttaagtaagtcattgattcactagctattgattctaatagacatcatagaatatgtcatatggaagagaagcattattaacaacttggtatggttgtattctagggaagcatttgaaaatgtcatcctaaaagaacccttgctatactttttatcttaaatcttccttcatattaatctataatgctataaaaatgaccttaaaaagatgaattaaaatgcttcctcataatagatcatatccagtgctgggttatttcaagggagatttgcagggataggtctttaaaagttacttacaggatttattctagatggaacaaaaggaaagacactcgccatagagagggccagaggagccttcagtcagaaacatggcgaggtgttgaaaattcagataaatggctctctgtttgtgtatgtgtttctggaatctcagttaacctctaaagttatatagattcacacctacaattgcattaactgcatgcctttgtatagatgctgctctcctgggtccttctctcagcagtgcctcttttagataatcaggagcagttttattcagggaatgaggtaaccagcattcaccagtctctttttatcagagcatttttctacactgaattttgcaactcactgcacgtagtgtccctaaaaacaggtaacatgatactgtgaaatgactaattaaatagctaatgtactgaaatatcaaaattatcctagaggcaacaaaatatattagtttcatcaattaactaaaagttgtaaaaataaatggaatgccatgcgttctcagtttctctgccctagaccagaagaaccatttgaaaaatcccattattcttcaccactccacactggaaatttttctttccacagctggggttcaaatttggaagacacccagcaaggggagttggtggtgagctagacaatgacactagagatggccatggtctctgatgactgcgtgcatccgttgctcatcacctttaccaacactgaccccagggacaggccaaggcaaggaaagagtcttctccaaagcagttaaagtctctcaggcagaactgtttagagggatagtgctattttcaagtgaaagaatgaataaatactttctaacttaaagttgcagtcggcaggaaagaacctaaagaattttgttgctaattttattgggaactcatgtcccactggaagtcattaagtggaagttatttgaaaatatttttaattgtgtgaccttttagctactaataatagaatgtattttataataggtcttactcctggcattgagttacattttaggagatgaaaaagttttggtattaaaaaagtacaaatatttgttaatatcccaccaaagtaaggtattctaaataaatgtaaaaaatgttgctgacaaaatacttaccagttttgaaagttgctctatttctaatgacaaaagtttataatgttgatttattttcttagctacattaaaccagtatatctagtggaattcagtgaaaaaccaaataataccatatatagttgactgaagaattacaaatacttgagtctaaactgggctgtatcactaatggagtatgtatggaagagagcaccatcaatatcgcatgtctacactgccatgctaatgtccagagtggacagcttcctagctgactctgcgaagtcattcttgaaaccaagactgtgactccacctaaatcacgtctacaaatcgctgatcctttctgtgcaacatgcagcatgaaaatacatcattctacctcatgattactaggaagcttagatataatcacgactatgaatactcatgcaaatttcaaagtgccatgcaaatttcaaagtgccctacaaatttaagttgttccaaataaattaatgattttggattatgtaaattggaaatagtcctgttcctcagctgaacttttcacttgtaaatggattgggttaccattgggtttataaggtttacctgtttgcaatattacctcttgtagctatgaatcattcctctaccttataaaaggccataaagggtgggtggtggataaataggcaaggccatggtagaaaaaaaaaagttcttatcacttatttttacatctcttggaatctccccgtgttgctaatctcaaataacttgaatctaaaatgaaagttgtcatctagttattgtgtacccatagcttataaattgtgatgccatcatactgcttaggtgccaaacaactcacctggattacaaaggagcacattcttagccatgctttacctctcaagatatgagtccacagtaagaaatttccaccatctacaagaaggctttgttccaatagttgtagaaaatgagactggatcatacggctgtgatctagtgagctcctgcctactcatctttctatttagggataaatatgggtaactgggaaaggatttgttacttttggaaatgagcacaggagtatgcagatgtgattttgaggatactgtggcctatagggtatccatatatcctttaattgatcaagatattatcagctcagagtatcctactttggaatccctctaatgatgtaatagtttttgttcaatccagttatgccaaatggttactgcctgccaggcactgtgttaggcaacagaggtgctgttttaggtgttgaagagcgagcctagaaaagtatgtgaaaggagagactaaactttctagtttaatctagaaaacctgaatatatattcaggaaatagtactgatttcaccatctgtcaataattagattttattgactctgtttcccaaacttgttaataatggaagagaaagtgtgggcctcaaagcagttgaggccaaaaggcagtttgatgattaaaatgaaggttcacaaatgatatcttcttggacatacaaaattgtgcagctgagtaccttccaaaactgaaataaaatgtacagaaagctttgtaaatttaatgtgggtattttattaccacttcactatctcattctttatctaggtttagtatatcaatatattgagtcaatagaacttttgtaggagaaatttcaaaacagaagcaaaatctccaaatgcagcataaaatattagtagaaaaggaggagctaattcattccaaaagttaaaaactataagaatttataacatacttagctattttaataagctgaaaatgcttgcttcacaatttgaaaaatataaacaatgatgcctccttttttgtggtggggataggccttgtatctaagaaggatgatttctagacaaaagcaagaataatggatgggtcctagaagtctacagttctcaaaactaacaaatcagcagcttcaaaaatctaattgtttgaatgcagtgggtacagattttcttttcattagaaaaatgtaaaagtttagtgataattaactcattatcatcaacaaaactgtgctatcaaacttgctgcaacttcgcacaagcataggatccttagagctaaacctaggtagctccaccttttcctgttctggctccttacccattttgggcttctaagtaaatgagtacatgaggaccactttattcaccataattataatagaaaattgaatgaaagatattaaaattatgattttttccttcaagtggaataacctttgtatgcaatctgaagtttttatgtttacttgaaaactagttgttttgcttcaaaaatctcttttacataaacagaaaaaaaatcaatccaaaggcaaagaaatcatccatatatttggtgaatatattgaaaatgaattactagtaggcaaaaggaaaattgtttgcttatatgcaaagtaagtgacttattttggctaaaataaatggtctattcagttctgaagtcagtcaaaatttctaaccccaacaggtggtttcacaggtactactactaaaatcacaaacttagtttgtgtctacatcttgaactttggattgaaataatttaaaatcataacagtgtctagactgagaacgtttgtagttacaatgaaaatccaatatacttaaacctgaagaaaacagagaatatcttcagctagaggagaattctgacattttttctgatcttaatgaaaacgtggtttaatgtcaagtcacagtcatattaaaacatttttttcctaaagcccaagcattatgtttgctatacacaaggccaacattttcatgaattgtgttatttacttgcttaagcacaattggatgatttgtttgtctgataagaaaattcttcacacctcaggcttccatttcaacttcaaataagtaacaactgtattgcttttttttcttacgttcttgtatttgctctaacttttaaatggcatctatgattctccattaaccataaaacattatcttgaactgaaaaagtaatctttctaaattgatgttctgaattaatgggcatgttttaaaggaacgatttcagatggacttctaaaacatgaataatacattggtcataaagagcaggcattaagctagcatttagaatcactccatgaacacagaatagaagaagacaaaagatagtttgtccaatattttgttgacatatttggccagaagattaagtgccaagtcatccatccagaaatgcgacttatttttagaaagagtagactcaataattaaggtttcagatttattcagctcttattcaaataaaaggtagaacttttcacatttttcagttattttccacagcaaaatgaaaatctgaaatccaaatgatcaactcgtcaattaaagaaatatttgaatctagaatgagaaatccattttcatttgtcacttaaggaaagttatttttgttataagttttatattcataacagttcccattattttgctcttataattttaattcatttgtttgcctagaaattgttttagataagaaatataaaaatgcggctgatatctatgactgacatcagttaacagaagatcatttatggacaagaaattatatgaattactaaaaattacaatattaagttcctgttggaaaatttttatttcaaacctacaaccatttagaaaaaaatatcctaattcagagcaagccatgtatcaaaaaatctaaattctcttttacttcatataattaaaaattatatttatgtttcattaaactaatataaagaatcattcattcaatatatatgtattgcccacctactctgggcactaagcactgaggagttaatggtgaataaaatcaaatcattcccttccttcatacaactcataatctagaggtaggtgggtgtgtgcagatgttagcaagtaatcacaaaaataaaagcataattacaaactggttctataaacaaaatgattctattacagcatataatagggagacttggacacagtcaaaatagtcaggatattgatttgagtattttctttccaaaagtccaaatagtaattgatgaagcaaggcaacattagatttgtgtccaaataatatgatctctgcagacttgggctttccttgagatttttccaaatgatgtctttggctaaatctaaccagacaagacaaaataacttgagagcaaaaatggaattcagagatctagtctaaccctcttattggatagatgtggaaacaaatcatgagagagggtgagtggcttgcccctgcttgttttcactcagtggcaaagatgaaattggaacccattatgctaaaatcctgtccagaggttatccttcttcatattattctgggtctggtttatctaacgttatctactctgatgcactaaggcaataactggaatagcaatatgatgataagaaagcctagagaatgagaatattcataagataacattgttttctgaacacagcctgtcattcagctcaggctagtagtgaatagaaaaaaatagcttatgcaaacagtcaaatatcttggtaagtgtccaattatttaccatgtttcatcctttactccaaatttatacatacatatgtgtacacacacacacacacacacacacacacacacacacattcaggtcactaaagcctctaactttacagatcccaactttaactcatttaactcatggttaactccatatttaatttttgctacatacttatttgcctttatccaaatgaatatttattagagcagtttcttttctttttttcttttttcttttcttttttttattttttctttttgagacggagtctcactctgtcgcctgggctggagtgcagtggcactatcttggctcactgcaatctccacctactgggttcaagtgattctcctgcctcagcctcccaagtagctgggactacaggcacccaccaccacgcctggctaattttttgtatttttagcagagaggaggtttcaccatgttggcgtggctggtctcgaactcctgacctcaggtgatccgcccgcctcggcctcccgaagtgctgggattacaggcgtgagccaccatgcccagcctagagcagtttctagtttacagaaaacttacccagaaagtacagagagtgctcatatacaacccttactcaccaacacctagctagtttctcctattattaacatcttgcattagtggagtatatttgttagaattgataaactagttgtaatatagtattattaactgaagtttagagtttacattagggttcactctgtgttgcacagttctatgggttttgacaaatgcatgatgtcctctatctaccattacagtaccacagtttcactgcactagaaatgctctgtgctgtctacctgttcacccaccctcccctaaaccaaaaccttacaactgatctttcgcctttactgtctctataattttgaatgtgtatgttgtggtaaaatatatattaatatatttattaatttaacatataaaatttaccattttaaatatttgtaagtgtaaagttcagagggattaggtacattcacattgttgtattatacaaccatcaccactctccaactatctctataaacttgccttttacagaatgtcatatggttgaacttacatgctatgccgtcttttcagaatgtctttttcacttatcaatgtgcatttaagcttccttcctgccctcttgtggctcatttatttttatcacggaataatgttccattgtatagatttaacagtttgtttatccattcaactaccgaagtacatcttgtttgcttcatcttcgttccttctaagttttggcaattgtgaataaagctgttatcaacatccacgtgcaggtttttgtatggatataagtttgcaattcattttggtaagtacctaaggttgctattactggatcatatggtaagactaagtttagctttgtaaaaaactgcaaaactgacttccaaaatagctgttccattttgcattcccaacaggaatgaataagagtttctgttgctccatatttggtgggacatttggtattgtcagtgttttggattttagccattcaaagtcgtggtatcttgttttaataaattgatattttaggattttccaaattaaaatgtcaaagagatgcctcagcacagtaaagttagaaaaaattagaaaaaaattctttacctattaaaatgatttctggttcactaatggcaaggcttgtcacttagtagatttggtttactctggacatttattagatcagattcatagatctttagcaatctctcactccaaggaaagtaatttatctctcctctgaaatctcacagcacctcaacaccttatagacaccattctacattgtaacagtgtattgctctgccaatctttctcacttaattttggagtcaaaaaggcagggagcttggtgtagctgtgtctgtgcaagcacaacatctgtagatactagttaccaacctatagttgttttttattatggcagctattaaaggaagacatggaagatgaatgtgaactcaccctggtcttcagttttactattttctctctaacacctttgtcctgagttataattgtctcagtctttccctactcttaacaccagatcaactggaggcgctattattcaaagaatcaccaaagaggtgcaggaaagactgagagaggaaaaacatatataatccaaaaccaggtaactgggcaataaaaaataaaatttagctgggcttcttactctttctcttttattctatacctctcttgttagcagctgaatcagtctctgtcataggcattacactctttgggatggtgagcaattgttctccaaaacactaagtaaaaatagttcagtggagattttttagagatgttctctggcagctccagtggatatttggagaaacaaatactttttccaagttattagttaacatatcatggaattccttattgtaaaatgcttctcacactttgaggtaggttaatagtattagccccgtttactaaatgagttagaggagtagctgctctggatgctattttcaaaacaaggacatcattgcttgtgtgacattatgatctaatagacgttctaaatggaccctaatgtaccattatcttaaaatatagatgagttagtaattgcgcaaaggtaggaggatgaaaagaagtaatcatggtacagctgagaattcttgtcagaaagtcatttttgttgttgttgttgtctttgtatctaatgtcagatgtcatgagagtaggattttgaatcagtgagggaaaccagaaaaaaacattcctggtaatattttccaatgtcaataggtagcactctagcttaactagttaattaacaagacaaggaagcttgtgcaaatataataataaaggtcttccaactttgaaaatagatgtttttcctacagaaatcccatcaccatcatataagatgaccacttacaaatacagaaaattactgagtttttttgtttgtttgtttgtttgtttgtttgttttagattgcaagaccatcgggccaggtgtgatattgaatatgtttggtgcttggcagcctccgtaatgcagacttattaagtacagaggcactggggaagagcaagacctgcagctgataccatgactgcttggcaaaggagaaggaagacttttaaacctcctgggaatgaaaataagccatttccttcagaaaaagcatggaaatacaggactgagctctggaaaatttgccaaaagaagtgaaaaatagtagggtctaaaaaggtcaaataataaccacacatccatgtacttgctctggttttccagtagttggatctaaaacctgcgattcaaaatttctggatgattttaatgtgatttactcatcttttctatgatttattgacaatatccatctacagatactgacagtgcaaaggattagaaagagtccacatatccatgtgttacaagttctgcacatgcaatgtgaagacccctagctctatctagtagttgtttaaatggtcagaaaattattcttaggttgggtcttttgtttccaaagcaagatttatttcttaaaaggatggctgcacttattagaggttgttaggatgctaagcatggctttaggatcaaagaagctatcagaagttcaaaattttatgtcaggataaaaagtttcatcatgatcatcaaacagctcctatggaggactgctactttcagaagaataacttctttcaaatttggagatggttaaatgctcctattgggaaaagggatggagttctttaaacttttccttgtattaaattctgccacaagttgtgttaaaaggacattatcactgagaaatcaacattcctttaaactgaagcaactagagcacatcccacttcatgcaggatgtggagttgaagatgaagaactgacaaaagcattccacactttcccctcatgaaatggtccaagagtttaaagcagaggttcttgtactttggaggtttaaataacacttcaaaatcctagaattttttgctccgcacttgaggagatttaaagactcacaaatgcactaagcaagccagtgatcattacaacacaattgcatgcatcacaggtctttaaattatcctgtagttacagagcactagccccttacttgtcctttagcactgtggatactctgcttacttccctaactgctgtacccataaattcccaaaggaaagttctggaatgtcctagtaaacatgcaggattggattttttttttttttggtagtgctttgcaacattttgttgcagaaaattgtagccagctattcactgtggtgccctacttgctcagctgggctaatatctgtggatgactccgcaatgggtgaagttgataaagacctctctcacacctcctgtgccagaaattttcactgtctcctgcatcacaagagaccataatatgcacacagctccctctctcacgtttttaagcccagtttaggctctcctcccacttctattctttcatagctcagttgtttcattttttaaattccgtcctctgttttctcattgaaaacgaatgaggcatatttgatttaagctaaatctacagcatagaggtcctcagagttctatttgctacagttcccactacctgaccccatgtctactatactcttcatcttctctctgattctttttctttacttgccctgtttctccattctttttcctttttctccatctgaagctctaagagtaagggaaacaatcttaggatattaggttctattcccataggaagagtatactatgaattttcatggaattctttcttcttagagtatagatgcattccattgaaagactccttcaaggtatggaataattgggtaattaggtacagattacatcattcttacatcatgcttaaaaaaatacaatagggtattctgagcatataacgtgaatcagcataatcaggtgcaattctttcccaagacaaggtcaagaaaaatttcccgagtgtccacctagaaaatagagtatggcaaaagttccaaagagctttatgaagtacagtaattataaacaaaattatttttcccaggaagttacctcttaaagtgtaataagtatattgcataagcaaaatctcttatatgttaaattccgttttatgtctttgttttttgtttcctgtttgtagaatctgggactggtaacataagcttattttgtacaactttatggctttgtcttcagcttgagtaaaaagctctaaaaaaaagatttctggtcttatagttgacagaagtcaccaaaccatactttatactattgtttgtggcaaggactggagaaagtattaaattatgttttataaagtattaaattatgctttataaactataaattatgttttataaactatcaaagaaaccacaaatcctcagagcagataccttttttttgaggcaaacttgttctaatttttggatttcttagatatttaagaaaacaaacaatcagggtagaagatatcctagctcactaggtccctctgacatgtgctttcatcatgccacacacctttctcactccccattccccacctcttgacatttcacatcagtgtgactttattagtatatcacacgaatgtctcttcccattggagtgtgagctttaggctagcagggttcctttcatccatcattgtattcccagacctggcacaggggctgagcacatggtaggcttcgaggcctgtaagggatatgaggctctcacctcactccctactgtgggcttgtggcagaacaagggcagttcaaatggattatctcagtcataaaagaagacacctagtagaaaaaaaccgctgaactgaaagcccaagggcctggattttaggtccaactctactaaattgcaccttggcttgtggtcttcagttttcatatatttaaaatgaagtttctataagaagagtgattaagatcgcttccagttctcaaatgttatggttctcactggtgccagggtagaagattgcttatcattgattcaatgaataagaaatattaatgatagtactattgcctatcatagatagataatgcctattgcactttaagaaccaaacagatctcagtttaaatgctaagtctagcttatattatttttcaattaattaatatcactcaacttctactcttcatttttctgttttgaaatatgtgggaaatatgccattaaaatatttgaataaaggagcaaaataattgcaatgttctggcaaggtgaatattaaatttcatggtgactattgcatttcaaaactatgtcatttttacttaatttatttactgtagtattaacttatgcaagctaacaaggccagaccttattggtgatgtggcctatcacccacatatttgaaattataaaataaagaactgtgtttcctttatcaatagaaagtctcagcatgcagaagacaccatcatctgacttttcttaaacttcttgtcacttcatccggccctcccccatatgagtttagtttaagacccattaaacactttgtgcatcttgcccatgaacatccttgcctatttcattcttcctccgacttgcatatagtattctttctgcctcaagagttctctttttccccaggttcacctggcaaatttctacttgctttaattctcagatcaaaaatcactttctttgtgaggtttttctggaaatccctgggttcatgagggcagggacagtatcttatttattgtaaaatcaattagcaacatctaacaaattttggcaaaagcaggttcgcagaaaataaatttatgataattagcctagtcttacatctctgcctatttttctgaatgtacttgattagaataaaaggtagcaatccattacataaaccacctttctctattaagcattctgcactagtagaatctaaaatttttaagacctagttgtcttagttatccaagtataaaacaaatacacatctgaagaattcttaacagctgaaaaattctttgttcagggagacaaatggttttttaacaaatcattctctttgtagctgagtaatttttttttaagtttgaggtaattttctaggagagttctaaagagtggagttaattacaagaaaggcccattgtgtcatcactgattgtagaatacttcccagggtttgacttatttgaaggacaatctccttagtgaaaaatcttaaagagcaagaaaatatgacgactttctcatatgatttaaagccagtgcctatcatggctaagaaggtttgctagaggtttgaataatcctcatggcacagtgaacttttggtttaactactggaatgttcagtcaaaaccaacatgttgcacactcagctttttttttttttttttgagacagagtctcgctctgttgcccaggctggagtgcagtggcgcgatctccgctcactgcaagctccacctcccgggttcatgccattctcctgactcagcctcccgagtagctgggattacaggcgcccgccaccatgctcggctaattttctgtatttttttttttttcagtagagacagggtttcactgtgtttgccaggatggtctcaatctcctgacctcatgatctgcccgcctcggcctcccaacgtgctgggattacaggcgtgggctaccgtgccctgcctacacactcagcttttaagagaaaaagcaaaacacaagaaaataaattcatatcaggagttttatataagtaggatttcctgggatatggtctgaggtcagtaaacaccttgtatgtatgtaggcttgatatttttattcattcaacaaatatttattgagcatctactatatgccaggaattgttctaggctctggagacacaagagtgagcaaaagagaaaaaaatccatgcctttgtgtagcttcgcttttattgaagggagaaagataataaatgaattattaggtaaaatatggagttacgttgtgtgatgaaatcactcactggggaagcaatagttcaggattcttttcttctgagtttgttctagttggagacttaggagttggtggtgtggtagagacacgttttctctgggctccagtagtaacttatttctctactgtgggtatcaatgactctgaattttctactgaactacagatagctgcctcaccagaatttgaacttctctagataagaactgtttcttttatctttatatctttggtgcctagaatatgtgcccatttttcatgaaataccttccactggtttctgagaatccatacttcctctagacttttttctattttcttccaacttttggtagccccacagcttttttgcaaccacttttcttctgcccaagcctaaaatgtgatgattatcagagttccagccaatcctttatggattctaattatctctcaatgatattcctatagctttaattcccagctagatatttacaacctcccaaactacttttgcagcccggacttctctctggatgctagagaaccaggctcttctatccaagcagacttatgatcagcaggacctgaatgtcctacaaacctctcagagtcttcatatttgaagcaaatggtcatcatccctccctcaacttgctctatgcccaatgtttctgacttcagtgaatggcatcagaagtgacctaagccagaagcttctctcttttttttctttgactcctcatttcctcccctttccctaaaacaagccaattgttcaactcctttagattctacctcactaacatattttaaatctctgtccatttttttcaattcctatgaccacacctcagtttagcccatagtcatatggtatctaaattacttgccacagcctcattcaatgacacacatgtactgactatatcatgtacctagatcctgggtagcaaaaatagaagcccgtgctcctttggggatgttggtgtgataactcctctttggtttccctacctgtaatattgtctcactcaaactcatttttttaaactgtagatagagtgatttgtctaaatccaaatctgatcatgttagttccctgcataaaattcttcaaatcctttaatttgtcttcactcttctcaggaaaaccctcaaatttcttagcatgaaatccaaggaaggccccttataatatgaaccattattctttctctagattaatcttttgcactaattccaaatgccacattacagcacacaaagccacttgaagtttccccaaatggtatgctgtcttacctccacagaaaacatgtagttttctatgactaaagaaaaatcttccatctgaatatagacacacatcaagcttccctttctccagttgttcctctttactccaagacaaacctcactgtgccaccatcctgctccttccttaacactagactgataccaggccttagtctaccaagagtgtagaaataggtagtctcttgattatatgacagacagaaaatacccgtggagttttacataacatatctcctaatctgatggattatggaatgtgaatgattcttctgtctttggagatcataaaatggacagagctacaaagaactacaaagtgtttagaacaacacttttccaactagaatagagataatgcattccagaacactgcagcttgcataattatctttctaggcaataagtacttgtctgaagtaagaaccataatatcataatccaacccctatgctcctgtttcaacctgaagccacacccttttcatgaactcagtcagccatcagttgtcaatgtccacttatgctccatccaagccctttccctgctactcctggagaggacctcaatatcagctaggggagctggaagactatgcttagggatttttttgtaactgctttgacacagactttatatgtttaaaggaaatgaacatctttgcattgccttcattcaccaaatgatgtcttctatccatgcatgctgccctagtcacgagagtgggttgcatgtaacatacttgtgattccatgaagagtgggcacaggggagtgctggtcaggctaaagtttgggacagatgaagatgatattaggagaagaagaaaataacttctgctcaccaccatcaaagatgagtttcccatgagtatatatttttttcctttgggcatcaaatggcctcctttggcttaaactttaacttatatgaaatgattttttataccaccaggccatttatctttgttacccaataacttctctaaaaaaaacccatgatcattgggaggctgaggtgtgtggatcgcctgaggtcaggagttcgagaccagcctgcctaacatggcaaaaccctgtttctactaaaaatgcaaaaaattagccaggcgtggtggcaggcgcctgtactcccagctacttgggaggctgaggccagataattgcttgaacccaggaggcggaggttgcagtgagctgagattgcgccactgcactcgagcctgggagacaagagcgaaactctgtctcaaaaacaaacaaacaaacaaaaccatgaacatgttcatgtgcctgagaaatgaactacaatgataactgttaccaagagttggctttgtatcggtgaagaaaaaactggggatggttacaggataatttggttctgggtaaaaattaataaggtgacactgggcaaatcatttcatatgtggagatctaggagtgtaggcatcataaattgtcagatgctgttattattaattgacttttaggttattccttttaactgttccttgattaatgcaaatgttaagcctcttattattggggatatcaacaattcccaaaatatgtggatccctgtttttaaaaatgaaaacggccccttattttaatccagtttatctatcactcaagttacagaatatcatatctgaacaaacctttttgccattaatatttactgaaacacatgctatgagctcttaacaaaacttcctggtgaagtgaccccccaaagataaaacacgtattttccctttcatctttttgctgagaggctgaagtaggaaagtctcactgggtcatccctcctggagggctgcatgttgttatcacaagctacagggcaaacaggaagggctccatgggggtgtgaagaactcacacatcccaggggcccactgttagctgctagaattagctgcacaattatcccggtcacaccaaatggtcaccaagggtgatagagatcctagatgcaacttaatgaaccatattcagttttatgataacaaccatgtgtaagcagacacgcttgacctaactctgagatgggcatatgcttacttgcaacagaatctgctgggtcacttgatgtatttaaataaaagaaatgtgattaatggcaacaaaacatgtctttctcagaacagtgccttgtcaacagtaaccagctagcctgacctttcaatggctccctgaagggtgggtatatacactattcgttaattgtggcttatatttgtaccttggtataaagcaatatagctgtcaaaaatactgtatattgaatttttaaaaagttgttatcaattaaaaaattgttattgccataatttaaggtggcattggccaattataaatttgttggatattagttctcacttcttagatcatgtaagactcagtttctgtttggaatatgcaacttaatttctcttttattatattctatgatatctgacctccaaaactactcagaaaatgcttaacagctttagaacaattttaggggctacagaattgaatagtgctccctattttcaaagagctgaccaggcagtcaaccagtgcttctcaaacttgacgtgacactaaaataacactgggatccaggcccactgcagaatttacacaagcttgagcaagtctatattgtaatgtctcactgataattctgattacagaatcgctacaatagatgtaagcttagttctaaaaataattatagccaaataaaaataatgatatgtataataaaaagctataatattagtgttagagaaaaacaaaaccccaagatatttgttgcaatggccatatagcatctgacaattagtgtacaaaattgttatatgtgcccacatctattgaaaactccgaatcatcataatctgtattacaatagggttctatttaaagtaaacctaattattctcaatgataaaatcaattcctagggaataagcttctcaaagaagattatttactctgttaatttagcagagcaccattgaatatccttacaaaaatatattgttaatgaaagctaacatttattgatcactcgctatgtaccagacagagagctaaaaaccttgtatgattgttactttatgcttcacggtagtcttgagataggttgaattttattttaattttacagaggaggaactgaggttcagagggtttatggaacttgcctaagatcacacaatggcaagtggtagtcaggacaagcccagctctgtgtccagagtgaatgctttgggctacttattttttttatttcttttatatttcagtaggtttttggggaacaggttgtgtttggttgcatgaataagttttatcgtagtttctgagattttagtgcacccgtcgcctgagcagtgtaccctgcatccaatatgtagtcttttattcctcacccccactcccgctctttcccccaagtcctcaaagtccaatgtatcattcttatgcctttgcatcctcatagcttagctcccacttataagtgagaacatatgatgtttggttttccattcctgggttacttcactttgaataataatttccaattccatccaggctggtacggatgccattatttctttcctttttatggctgagtagtattccagtggcagtttgacttcctttttattgatttggatgtcctttatttctttctcttgtctgattgctctggctaggactttcagtactacgctgaatggaagtggtgagaatgggcatccttgtcttgttccagttctcagggggagtgctttcaacttttccctgtttaatcttatgttggctatgggtttgtcacacatggcttttattacactaaggtatatcccttgtatgccatttttgctgagggtttcaatcataagggatgctggattttgtaaaatgctttttctgcctctattgagatgatcatgtgatttttttctttttaattctttttatgtggcgtatcacatttattgacttgcatatgttaaaccatccctgcatcctggtatgaaacccacttgatcatggtagattatctttttgatatgctgttggattcggtttgctagtattttgttgaggatttccgcatctatgttcatcagggatttggtatgtagttttctttttttgttatgtccttccctggttttggtattagggtgttactggtttcacagaatgatttagggaggattccctctttctctatcttttggagtagtgtcaataggattggtaccaatttttctttgaatgtctgagagaattcagctgtgaatgtatctggtcctggacttttttttattggcaatttttcattaccatttcaaccttgctgtttgttattggtctgttcagagtttctatatcttcctggtttaatctgggagggttgtatatttctgggagcttatccatctcctctaggttttctagtcgatgtgcatactatgtacaccttgttcatagtaaccttaaataatcttttgtatttctgtggtatcagttgcaatatctcccatttcatttctaattgaacttatttggattttctctcttcttttcttggttaattttgccaatggtctatcaatttcatttatcttttcaaagaatcagctttttgttttatttatcttttgtattttttgtttcaatttcatttagttctgctctgatcttggttatttcttttcttacgctgggttcttgtttctccagttcaatgactttaaataacctgatgactatgtgcctaggtgataatctctttgtgatgaatttcccagttgttctttgagcttcttgtatttggatttctagatctctagcaaaactgggaaagttttcctcaattatttcctcaaatatgttttccaaacttttagatttttcttcttactcaggaataccaattattcttaggtttggatgtttaacacagtcacaaacttctcggagcctttgttcatttttttaaaaaattcttttttatttgtgtttgatggactgggttaatttgaaatccttgtcttcgagctctgaaattctttcttctgctagtttgattctattgctgagactttctagtacattttgcatttctctaagtgtgtccttgattttcagaaattgtgattgttttttatttatgctttctatttcactgaatatttttcctttcatatcctgtatcaggatatgatgaatcaaaaattttttgatttaagttggacttcacctttctctagtgcctccttgattagcttaataatcaaccttctgaattattttttctggcaattaagagatttcatcttggtttggatccattgttggtgagctggtgtgatcttttggaggtgttaaagaacctcgttttgtcatattaccagaattgtttttctggttccttctcatttgggaagactatgtcagagggaagacttgggactcaagggctgctgttcagattcttttatcccacggagtgctcccttgatgtggtgttcttcctcttcccctaagaatggggcttcctgagagccaaaatgcagtgattgtttttcctcttctgggtctagccacccagtggagctaccaggctcccagctggtactggcgagtgtctgcaaagagtcttgtgatgtgatccatcttcaggtctttcagccatggataccagcacctgctctggtggaggtagcaggggagtgaagtggactctgtgagggtcctgggttgtatttttgtttaatgcattggttttgtgttggttggcctcccgccaggaggtagggctttcatgagcacatcagctgtggtaatataaggagtttgcaaactcaccttggggatacctggttaagtattcaggtttctcaggccatgggaagggctatagagctcctaagaggttatgatttttgtcttctgctaccagggcaggtagagaaagactaccaagtgggggcagggatagatatgtctgagctcagactctccatgggtggggcttgctgtggctgctgtgggggatgggggtgtggatctcaggccaatgaggttatgttcccaggggttacggctgcctcttctgagtcatacaggtcaccagggaagtgggggaaagctggcagtcacaggcctcaccccactcccatgcagccagcagtcctaaaggctagtctcactctcactgtgcccccacagcagcactgagtttatttccaggcagccaatgcccagggctgagaatttgccccataccatgagcttccctgctgagaaagcaggcagacccgcagttttttggtgtctcagggagcctgcagtagtgatccagtttcttcatatagtctgtggattgtctcagctttcctggaatgtccctgcagtagttcttgaagcaaaagttcatgatgtgagtctccacatgttgctccattcatccctgcaggagctgcaagctagccttgccttgtatctgccatctttcaatccctaatatccactttgggctacttaaaccccacaaaaaacatgaacaaagtgccaaatggaatgaacaatagaaacctacctcactcattctccaaataaaagataaataaaaggatgaataaatgaatggatagcctgctttgtcacactcttctagaagccacatctcagagctgtcagttaatctattgttttatttaccacattaaaataaaaagtctacatgatacagaagtagtacagttacaataaatattttacttcattgactgcttgaatattgaactaattatcacaattttaatatacaaactcttgaatcatcaaagctctcacagatgagagttaaaaacaaaactagagatatagaaagtggctctttgggcaggccaccaactagaccaccacgcttactttcatgttagcctgtcagttagtacattgaccaagagagataacctgaaatttggattggtttttgctctatccctgaagctttggggatttagaaatattctgggcaagaatcagtgacactctttggaagccatttttacgtgtaaaaagctactcatctgacaggacttttgtttgtccctgaatttggaagtagacaaacattttcttctttttcattttgtagttagaaaatgtgtgatactttcatattacttttttgagtcactgtgaaaagaattatataatttcagatcttcatcagagacaactcaaaaaatggagtgatgtgtagggggtgaaaaaaagcaacagagactttgaaatcagactgacacatgtttgaatcctagctctgccacagatgctgtgcaaggctaggtgagttggtttatttggctaaggctcatttcttccataggtaaaatagaaataaaaatatctgcatcatttagttgttaggaggactgaaataagaacataaataatatgtctattatagtcatgcaaaaaatattagttctaattccaatctcttcattttacaattgagaatgttaaaatcagaaaccgacaccttgaaagttaaacaaacttcaccttaggtttgtggatgtcactcctgttgtttaaaataacacaataatttaaattacaaaagatttatgagttaagttttaaatgtagacattttatttcgctttttactgcttgctattttactgggatacagcaactcctgatcaaccaaccatgtagtttattatagtgctgcgtagtccaggaagaagaaataagggcaattcacttggtttagggtcattctttaataatcaactaccagtaacaagtcgaatctctctcaacagttagtgttcatgaatgtctactttggcatctcttcctgtttcggtaataattcaaatgaaactagtgtttagtatttagacatcatatgatcagatttttttttacaacatattatagtacatatgtccatagaaactgtcattgttaccacagaatcagcataatgatgctagaagaggggacaactgccttttcagataaggaaactgaaagcagatgaaattaaatgacttctcctggcttacagagttagtcggtacatggcagcgctgggttgaaaaaccaggtaaataactgattttgacttatcttagaagttaccacatgatgtggaaataaaccgtttattaatttgtctctcccactgcagggtaaccatgttgaggataaggggctatgtcctaatcattttaaagtacagtcactagcatacactcagtaaatgttctgtaaatatctactgcttgatccaagtaatacagataataatatatttttttaaaaagactttctccaagaattcaggatattttctcttatcttattctatgacagatgactctaaagtagtggaattttttttaactgacatcccaatacttataagctgaagatgagctgtcattcagaattattacccatggagatgactgttcacttatcccatcaatgacagaatgactccgaatctttttaagactcctttattgaaattgactttagtatctgttcatgaggaaagaaaaatccatctcattattgtttcacctagattttgactccaaagagccttcattagctttgctcacttaccttatctgctaaacttgaatgagcctagcttgtttcaaaaagcaatttatcctgaaaggagaaggacttatccctgactaaaattattcttaaaattgcttcagtatcacttggataaatgagtaaattcccaaggtgactaatatgcaggtgtcagtagacactaaaaatgtgtaagctttgtcatatttgtttaaatgaaaaacatgccatatttctaagtattttatgcttctctaatccctggacagttggtatcatctgtttaatgtgtaaagaaatagagcatctgcaaaagtaaatgactgtcacaagattttttgtgcagtggcagctctagtccaccagtttccagccagggtcaactctgtatcctcctccaggggtgggcatggggggagggcatttggcaataactggagacatttttttcagtcataactcaggggaaggtgctactggaatccagtgggtagaggccatggatgctgccaaacatcctactatgcacaagacagcttcccgcaacgaattaccttgcttaaaatgtctatattgccgaggctgagaaaccctgttcaaggataagaattctcaccctcagtctcttcaggatccttcactacaatcagtgttaagacccctgtgtcctcatgtttccataagcaaaagtgagtgcatgtatttttctttggtaatcaaagagtaaaatttttttccatgctattttgccagcagaaaatcctatttgccttagattccttcaccaaaggatacgaaattgtcacaaaggttgcctggagatgggtttggcatcttaaaagcctaattggcaagaaaattaaagcaacttaaaatgtgtgtgctctttagggagatgtgctattcccactctatattattagatctcagagacagctggggcaagaacatctgggacttcctgcactatcattttgccaagttgctataaaattgtcctttctcattacaaaattgagaaggaaaagagaaaaagcagtgcaaaggccaaccacacttgttagaaggttgctcctcagctgtctttcagaagtcccagcagtggctcccttttttgtcaggttacttcaataagggagggaatctacttcatttgatgtgtacttttgataatcaaggaatgtatcttggcatgtaaactgtgcaggacagaatgtcaaatctcaaagcatatttttccaccttgaattttaaaaataaaatacgtaacatgcatttagcaaattttctcagggaacttgctaaattttattgtcaaaatacagacctttcacataatgctttcacttttctctcttatgtacatctgctcctaacaccaataggcacacaaagtgttgtaaatctgtggctggatctttcaagcctccagggaactctcacttgttagcctagtctaatatcttattgtgtggaaatgttttcaaatccaagcacaatttttcaccatagaaatttttcttttttaccgttttttggtggtcagtgatttagacaatcacaagagaatatcatatttgagtagagaaaatagacgtgcacctgatatatgggcataaattgccatgtcgcaatgaaaggtaaagttcagaaaaggtcagaatatttctgtcctaagatgctgaagaagtcacttttgccatctttctttccttggaatccctatggcatatgtcaactacagataattttagtacacagttgcaagcaatgtctcatgccattctctaggtttgccttttataaaaatctcacactccaaggagattgtcctgtaactgaaggactgcctctccagtccccactctaagcccacagcacattctatgttcttgttgcctaagtgactggccaactcaataaatggatggattcttgtttctatccctgggtaacctgaagagtgctgggacactgggaaacactattttggtctacttcaaagaaattaggattctctaaagtcataccataaataccatcctagtatcaagcggattatattactttcttccccacctcaattttttttagtattgtatctgcttcattttaatgtttcattcacttttcctaagttacatctactcacttgaaatatctcaagcggaaccctttttgtaaaatagagttttgaagctattctttgtccttgttctcaataggtcaccatttatttatttatttatttatttatttatttatttatttattttattatactttaagttctagggtacttgtgcacaacgtgcaggtttgttacatatgtatacatgtgccatgttggtgtgctgcacccgttaactcgtcatttatattaggcatatctcctaatgctatccctccccactctcccagccccacgacaggccctggtgtgtgatgttccccaccctgtgtccaagtattctcattgttcaattcccacctgagtgagaacatgcgccccacctcaatttttaagaagagtcatagctatacaaaagccccccaaatatcacagagataagccacacaatgttggaaacaaaatacaacttttgaaactacaatgccaaagaaatccttcaagaaaagcactaaaggaaaacatgaggttcagagcaagctaaaagaatgtaaatgcatgtctcctaggacaatcatgaacttaggtgaaaaagtaccacatggggtatctgagcactttcaggagaccatcatttatatcttcaattgggagataagatcacactgcatgtgaaactcttctttccttaataagcaggaagaaagcaatgtatgcttacaggtgtaaagagaagactatgttaatacttattttcaaactatttcaacacacaacatgcatccacacacacatgcacaaacacatatatgcccaagcacacatcaacatattctttttcttttgattccgaacttttaagttcagggctccatgtggaggatgtgcagatttgttacataggtaaatgtgtgcatggtggtttgatgcacagatcaatccatcactaggtattaagcccagcaagcattagctatttatcctgatgcactctcccgtgccccagtgtgtgtcattcctctccctgtgtccatgtgttctcatttttcctctcccacttataagtgagaacatgcagtgtttgcttttctgtccatgcgtttatttgctgaggataatggctcccagttttatccatgtccctgcaaaagacatgatctcctcctttttatgaccacatagtattctatgatgcatatataccacatttttaaaacttagtctatcattgatgggcatttgggttgattccatgtctttgctattgtgagtagtgctgcaatgaacatacacatgcatggatctttataatagaatgatttatattcttttgggtatgtacccagtaatgagattgctgggtcaaatggtatttctggttttaggtctttgaagaattgacacattgtcttccacaatggttgaactaatttacattcccaccaacagtgtaaaggtgttcctatttctccacagcctcgcccgtgtctattgtttcttgactttgtaataatcgccattctgactggcatgagatggtatctcattgtggttttgatttgcatttatctaatgatcagtgatgttgagcttttttttcaaatgtttgttggccataataacgtcttcttttgagaagtgtctgttcatcatgtcctttgccagctttttaatggggttgtttttttcttgtaaatttgtttaagttccttgtagatactggatattagacctttgtcagaaggatagattgcaaaacttttctcccattctagaggttgcctgtttactctgctgatagtttcttttgctgtgcagaagctctttagtttaattagatcctatttgtcaattttggcttctgttgcaactgatttttgcatcttcatcatgaaatctttgctgtgcctatatcctgaatggtattgcttaggttttcttttagggtttttatagttttgggttttacatttaagtctttaatccatctttagttgatttttgtatatggcgtaaagaaggggtgtagtttcaattttctgtatagagctagccagttctcccagcaccatttattaaatagggaatccttttctcattgctcatttttgtcaggtttgtcaaaaatcagatggttgtaggtgtgcagtcttatttctgggttctctattctgttccatttttctatgtgtctgtttttgggaatgggaataactttgaatctataaattgctttgggcagtatggccattttcacaattttgattctttatatccatgagcatggaatgtttttccatttgtttgtgtcatcattgatttctttgagcagtggtttttagttctccttgaagaggtccttcacttatcttgttagctgtattcctaggtattttattctttttatggcaattatgaatggtagttcattcataatttggttctatatttggttcagtcataatttggctctatatttggttcattcataatttggcatagagccaaattcactatgagctacttgcctgttgttggtttataggaatgctagcaatttttgcacattaattttgtatcctgagactctggtgaagttgcttgtcagcttaagaagcttttgggctgagacaatggggctttctagatataggattatgccatccacaaacaaagatagtttgactttctctcttcctattcgtatacgctttatttctttctcttgcctggttgctctggccagaactttcaaatactatgttgaataggagtggtgagagagggcatccttgtcttgtgctggatttcaaggcaaatgcttccagcttttgcccattcagtatgatgttggctgtggatttgtcctatatggctcttattattttgaggtagattccttcaatacctaatttattgagagcttttatcatgaagggatgttgaattttatcaaaagccttttctgcagctattgagataatcatgtgctttttgtctttagttctttttcacataaacattttcaatctacagctgaccaccctttgctaactggagtagaaaatggtggaccattgaaacagcctttctataaacaacccgcatcaggagacatggaaatgtcgttgctcatggtttacgatattgaaaagcctctccatctttattacttgtaagagttctcagccatattgtgtttggggtcttgttggtctgtggacacatgagtgatgtgttgaagtatatgtatacagtggcaataagttgtgtgtgctgcaagggtgtggaattctccttatgtcatggaagaccatgtagaaatgtctgtggcacttgctctgcttgtgaacggcagtagagtcaaatttattaaataaccacgtaacccctaaccagccaatgtgaaagtgagacaagaaaaaactaagttttcaggatacttaacaatagtccatcatgactcttctcaatcaacatatgctgtctgttaacagattgaatttagtgaaactaaactacacacttgatcaaattttcctacaatctattcattataagctagctttattttgaaaaacaggcaacctgaattaaactcttgaaaatgaaccacaaaaactgaaatatgcccattaattaatagcttttgtttttcattgtctttttttggttggttgttttttcttagacagggtcttgctctgtcacccaggctggagtacagaggctccatcagggtccactgcaaccccggcctcctgggttcaagtgattctgctgcctcagcctcttgagtaggtgggattacaggtggccaccaccatgtccagctaatttttttagtttcgtagacaggggtttcaccatgttggccatgctggtctcaaactcctgacctcaagtgattcacccagctcggcctcccaaagtgctgggattacaagtgtgagccaccatgaccagccaactaatagcttttgatagagttatcttatttattttttgactggttaatttttgaacctgagctaaattatataggcaacaacttttctgttcggtattcagacaagtagcagacaacacagtgaatttggtctgttttatattggccacatatcacatccatttccaaagggcagtctgtgcttttagcattcactaatgaaatcacacattacagtctcactgccacataccgcttcctccagataggatgtcacagccccagaaacaacttgtaagcttttttgctcttaacagctgaggctacagggaaataagtgatgagggggtggaaggaaagaatattttaaaggaaaagttcaagatacaattgtgatttctgcaaaaaaatgaattatgacaatcaagtctctagccattcttgtctaattattgttaatactttaaaataagttaattagcaataggctacaatcccagacatacagagcaagagccagaagatctgtgctgtaatcaacaaagccaaatattagtgcctgcaattgatgcatgcagtattttctgtaaaatcctccaaggtcaggtattctgagaaaattttatagttttaacttttttattgctgttgttacactgaaaatattatagaaaacatcattttatcaaccaaatgtggtaagttaaaagctgatatctcattgcctagagtgatgttagttagttatttaatatttctattaaatttggttaggtaggacacgcttacagcaactccttgcccttttatcttttttgggggagaggatttggcttatatcacctcactcgactagccatttatacttgtcagagtcacccttgtttatcagtaggtcagtctctgaaaactgtgtctatcaagtacactcaacacaaacatctggatcgcaagccctcaggggcacccatgcaaacaagcccaagaaaaaatatgcctccctctgtgaaagaggacaacaaaccaatttgttgaaaatgtgacagtctgcatcccatctcctgcttccttgtgccctgaatgaattgtgaaacctcgggaagacaaatggaatgttctcaaatcttaaaaaatcagcaattccctttacaaagaactatgttcttctatttttttcctgccctggaccccttctctccatcatctgggaaatttcaacagttttccaagggtagagggagaaatttaagatcacagagaaagaaagtcaagttgactgaaaatatagcctaatttgaagagtttgcattttcagtagccaatccctcagctaggatattatcaactctttgatttgcctcattatcaaaatggtctgggcttttgcatagaaacagcctcgactgttttaatgagaaaaagaacaaagaaaaagcacatggacagactaatttatactagaggcttttaagccaaatggcaataagtgatattcctcttttgacattttattgaaaaacggggaaagaaaaagcagcccctgacaactgagagctcaccagacactcacaaccaggccatgttattctcctgttggacataagcaatctcccacaataccgacttcagataaggtcaccacctctcttgactaaaatgagtgactgagactcctttaccaattacagtttgactttgctctagccctatggattaggcttgttgaaatatccaaatatagacttgtccttgctttctgacagcatctgatctacagcaaacccctgcttccttagacccttcctcaagtcacccaacctaagcccaatcttgtaagtcccttctagcatcctcttactgggatgtctcatgtatgaaccccatggtatgttctcccttgctgcaacagataataaatcctgcacgttcaactacatgtttgtgcctggggatctttggctaaaggacaatcacaaaatatttatgtctcttctcttggagcttttcagctgaatggacttgtgccccactcaggagccctgcctgcatagagcagaagggaagatctggcctgcaggcctccttctcatgaccttggaatgtgaactgagatttccacatctggtccattttacttcttgaatcagacaccttttactcattcatctactgatatctcatgatatggttcatttgaaattccaaacgaatctcccttttccctcagttgctgactaaactacacaaattattgtgtcactacttgactgagtaaatatccctgctgcctagatactccatccttattctctctacccccatcgacctacctcctttcaacttttttttgtgagtgctagctatacatactagttatattttaagctagtttcttttagaaattaaattcaatctgcccagcaattccatagaagaaaactgagatccagagaggtttactagagtgggagagtctccatcctatgccacagtttttcagaaaagtatatgtattcattctctctctctctctctctctcacacacacacacacacacacacacacacacacacacacacacacacacaccaggcactgaatagatatctgacttctcaacaacttggaaacttctttagtctttaacctctctaaaactgtgaaaattgcttgcctgtatttaaatgtattttaatcttctttaatcttacaacatcagcagaatgaaggagaaagagagtttttatgtgcactcttatttcaaaagttttggggtcaaaagttgttaaaatggagaattacagacaacgcttcctcttgccataccccggaggacataggatgaactccctcctctgtcatacagtctcacaactgtaagctggtacagaatcttcttccttctgagaaataaaaattaaatcttgagccccgccaccaactgagtgtacccccttcttgaccaaaaggaccccagagaaaccttaaaaactgagttcttggccatgcatggtggctcatacctgtaatcacagcattttgggaggctgaggcaggaggatcacttgaggtcagaaaattgagaccagcctggctaacatggtgaaactccttctctacaaaaaatacaaaaatcagccaggcatggtggcatacacctgtaatctcagctacttgggaggctgaggtggaagaatcaattgaacctgggaggcggaggttgcagtgagccaagatcatgccactgtactccagcctgggtgacaggctgtctcaaaacaaaacaaaacaaaaaaacaaaaacaaatgagtttttggccatgatgggatgtgagattggacatgcctcgttatacccccttcttcactaactgccactaaaagactttctttcccaagagttaaatggaaatcaatccatccaacttccccacttttttgtggtttcaacacaactgaccagcatttcttcctcaacagagacagcaaatcgtagactggttctggtcagtttacagaggctacacataacatgtctctgtgtcttctgtttcactttttgacacataggacctaattttaatgcatttaaatgttaagtctccacccagaagtgaacatgggacttatgaaatgtgcatgtttacttatttataaatgcaaacgtcccattttgtgaatattcatagattcttctgtaaactgttgaatatgtatacttagctaacccattcagcctaaatttttgtctcaccattcctttccttaaagtgcctttctcagtttctactggaggctacatttcccagcccatggaacggccagcccgcaggccgcaatcctttgtaagaaataaagctctctcctctctgaatttatgaacctcataattcttcagttgaaactcctcctcccccttttcctcttcttcttcttcttctgctttctcatcttgtttgaaattagcactggggaggaagttgggatgcagtgccataatgttaattggctttggtgggagacactgagtctagaaattattaagtcttcttacatgagaatgtgctttttagcccagggtaacaaataatttctcaccaaaggtgagaaattgtttatgcttattagtgcaataatcctagggtcaaactaagtaacacaagacagaagatgccaaaagctgagtgctactttttggaaatcattgataggtagttctacctgagtgatacagcaagcaaatatgaacttgaatctggcaggccctgtgggtagaggagctgtagcttagatttaaggaagaactaactgagcctagggaggagggcaccaataaatattggggtttatgttctttaggttaactaaaaccaggttattttgtcagtagggatgattaaggtgcagcttgtttgtgagtatgagcagtgctacttgaagtggggctcacttgagtctgttaagaatgaaacactttgagccacagactattaaatcagaatctctgaaagtggcatccaggaacttacattttaacaaaatttccataagagcattccagtttgccaagtcctaggctgggaaagggttgctttctggagcttccttttgatttacaagccagaatcccctttctagtgtttcaaaaagattctgaattggtcccggcactggcttataacatcatccgaataaattatttagccattctgaccttcagtttcttaaattgcaaattaggaataacacttgtacgaatgaagccacgtacaatacatacaaacagacatacacagacacacgtacatatatgtatctgtatgcatacatatctatagagacagggagtgacagagagagagagacagatcgaagaaatgaatcttatggtgaaagctttttgtaaataatgattattggaacactggctttccatagtctccttgttgttctttctcctcagggatatgtagcttgaggagatcgctttccctctctgttgaatagaatattccaaatatccattgtcagctgctctgctctgctgctgtgctgacctgtcttgggacatggcctagggtggaagggtggggctggaaagcttctctttatggagatgggtactgtcttgtgtctgactttaagccatttgaacagctgactttgaaccattctgagtctcaacctctaagtgaggcttttcctggctctccaaactgctaaaatgactggcactgcagctgaaaaacttccaagagactagacccatcccttccgggtacaggcaaggaaacggcaaattgggcagtaggagggttgtgagctggagtgtgtccccattggagagaaaaaaaagagtccgttgggttcatgatgcagagagagataaagagaggaagaaagagagagagaaagagaaagagagagagagcccagagaaagtaggcccagcacaaaatctgtggcctagacctttggctttacccgctatcctatccaggcaaggccccagggcaccatgcagtgttgagtgcagtgcagactgaaagcccttccatgttagtatgtgcagcctggtatgctctgcccccttcacccctaggttttctgtttatcctctggccttatccctctctggggtgtctcttcttttgactgggagccaggagtcctgaattttaatcctttctctgcttccagtcagctctatgtccttgggcaatcaattagcattcctcttggcctcaacttccttatttaataaaaaatggtgaaatgagcaataggcacaaggcaagaaggattaagcccagtcatctctaactcccttcatgttctatgtcaatgcttccttagggggttccatgctaacatcctaccagggtttgctttcttgaggcaaagccacacacttcaaaccttctcttctcttagctttgcccactctgtcaccagcataatttactttcctaaacccctagacctgactctgccttccaagatgacagagaatgtattaaatgcagccagtgctaagcaatattaattttacctaatctgcaacaataagcatgggacttagagtcaaacaaacccatgtaataatcctagcttattaattaaggaatgactttaatatgggattttaaagtaaggtattagacatctctcagcctcaatttccacctctaatggatttaataatacctaatttgtaaggatgcaaggccttaaatggacacaaatcatgtagcgctcttagcacagtgcctggcacataatgtgggctcaacaactacagttgtcttcctttgcccagctgggtaatattagtgtatactcacaaccacatcctgaaaattctaccttacactcaagatgatcactgtgatgatgagactaagtggccagggctgcccatcatccaactccaagggatgtcatccatataaaatgatactgtaaatggtattccaagggggcagcactgtcagtagggctgaagtcaaaccatgtcagcaatttttatctctttctttctaaacacttgctggcatgccactctgtttccccctttaaactggtggcttcttcttcagtctcttccttccttactcaacctacataattaggtgggtttcatcctctgaagtccagttctgatttgccctcctcaatatcttcctaatatatgcctaattcagctaaccataatttcccccttcactttttcctcgactcatcccccatgttcctttgcacatcactctgtttctgtaaccaaccctgatttctcttgtcctcaagatttcctacctccatgctttgctcttgctatttcctcatcctgagaagctacccctatccatctctgcctatcccagtgctttttgtcaaagccagccaaaatctttccagatatctctctcctctaagttaccatagaccttgatctttaattctcctgtttctctccaatttgtatttaggtattgcatgttcttgtcttttcaaacccacttgatgcttgatgggaacaatggcaaataccaattttaatatgcctcacagcacttaatgcagagccgtactcataggagctgtttaacagataaggattaaattgaactcggtctacctgaatgtactgccaaatttgatctagatattgtcatttaataagatgaaaacaaagttgcagtcacttctttggagtctcacaaatagcagggagatagcatgatgtaatggttataagactccatatctgagatcagtcacttgaactacagtgtctagaacagattaggcatttaaatgtttgcttttgtgaataaacggatagatagagtttggatttaaattctgaatccaccttttcttaactgtgctatccagctaggttgcttaacacttctaaggctcagtccctttattgttaagataggatggcaatagtacctccacttggaggttttataaatattgaacctaatcatgaatataacacagtaaaggatctaacagatagtgaacccctaataataacagttattattattattattgttatattaatcattacctaaactgttggcctgtacaaatatggtctaatttaactcagcatcactttacttgcaaagatgcattgctgcttaaaaattctgataggtagtatgactgcattttttaaattaagaaaaacctgtaagttaataaacttccgcaaattaggaaaggactttactcaagttgcacaccttctttttaagaatgtgtgaattgcatgggggtgaggtgcaaaaactggtgtttgaaaaagaaattaaaaataggtctttaagaaataaaaatctgtgtcttttggcattgctacaatgtagaaaacgaatctgcagtatttagaaccattggccagatcgaaagctacggtacctaaatccaggctagatttagtttccctgaaagccacccacaacttcaaacgctgttttctaaatgcatgtgctcagagttttgttaatccaaatattaggcatgattttaaaaattgtagagaaactagctagtcaaatggaggatcttggaactgtaggatttacaactcaaatggatcttggaggtaatctagctcaaactccaaactgtgcagatgaaaatatgtaaggcccagagcagtcttataattgcctggtaactttcctttcatggcacagaagaacttactacaccttttggtgccatcacaggactttatgaatgaatggcttttgcacaaaagcgaggacaatgtcagaatcagttcacttcataggcttcatcacttggtaagaagagaaagccaacaagttctggggagtcaagtgctccttcactgaataagtgataagtattaataaattgcttttgcaaggcatgaccccagagctgacaataagcttttcctataggctccatgcagaaggctggagtatgtccaataaccaaaccaaaccaaaacaaaaaactgagcttcacattaatataacattcagaatacagctttgcaaatggttaaaaaggaagtctttctagtacttctgaggctaaactccactggagagtgccagcacatctataatgacaaggttcagatatactggcaaattatttgtaagtaattttcataatcctatagaggaaagaattagttctctatatggagtcttcattcctacttttaaaatttctttttcttctcctttttcttgtcaatgatacaactctactattccagatacataagctagaggcaagtaggaagttctgaattaaagggctgagagcagtttttaaaaattaattccatgtgctgttaataagtgttatctgaacaaaatttaagtgcttggaaaacattgtattagttaaatttaaataggattcatcactaaaatattccttaggcattttacatgctaaagtacactgtgaatcctttgggagagttgtgtagaatataatgttcagcactttcctaactgatttgatttttttacccacaaatcctactttagtagtagggtactagagcatgagtaaccaaaaagcagtttaactatgacttgaaaacttctaaattacatcaaatgccataagaggaaaaaaatgaaaatcatttatccttgagtaaattcttcttcttggcttcttcaaaggatgatctctacacaggtaaaatgagggtaaagttcttggctaaaatgcaaagcaagcatttaatacaagcaagtgttttgctaagcatagaactatgctggaagctggaagaggtcataggaagacttgcatcatgcccaaaatgtaaaagttaaaaatgaagcttctttcattcaaggtgtggagagaatagagggagttggagtcagttccctgccaggctcctgctgccttttccccacctctagtgacccatcagagattcttcaaaatctggggactctgtgggatacagttaaaaataacacatttttatatgtacacaactccctcactttctaagtttgtgagaaagggggtaaattgttaattaccagaaaaaataacgtttgtagaaaatggtgctataaagcaaaaagccctcttgttttgatgaataatttgttggaactagctgaatttaggcttaggaagctggagagaggtgactagttaggcaaaatcatctagaaatgttaatctagttacacaatcatctagaacgttgggtctcaaaggcaattgaagggtaatgaaagaaaagaagtgaaaaatggtaaaggagaagattcagtcagaggatatgaggctgaggtgtacagtgttatagatgttgtcaggggctgttatcctagggcagaagatttgtaattaaagacaagtctaaaatttggttttaaattatgtacattattgtgattataagccattcctggcctcttcagatcttcagtaaaatctaaaaaacattgtggaaatgaacatgaagcaagtttcatgtctcagaatgggacatggacagactgcgtgggataattaagccataaaatgatataatccagtagtagaaagggacctaccatacaaatataagaaatgtagacattagcagaaatcatagagaaagtcatgcactttcatagagtatacaatgaatggttggtaatgttatttaaattttaaggaacagagcagtcccggctaatggaccattctgagtaacagaagaaagttatgattttatgtggaggaacatttccactccaatgacttggagttttcaccatcgagaaatgccaacaacccccaaatgagttggcctatatttgtaatgatcaattagccacatctacctgaatgccttactcatgctttaaattcagcatgaccctgatggtaccttccccacttcctcccaagtccctgtgtctttgtttcctgactctgtgaatgcttccattacctgtcctgcttatcctgaactcttttctcccattcatatcacatagccaactagtcactgaatcattttaattttcattgcttgcgtattatccccttctgtgttttttcgcttccccagtgtagcttgcattaccttgctgaaacagttctaagcacctattaactgctcgctctctccattccatcaatcctccaggctgcgtcaattattacataaaacacagatcatgtcaagtcatgctacttttaaagtttattatctagctccccattgctcacaggatgaggttctctgtagcctggttaaaagatttctggaaaatgtattcttacaccactccaagctttatctcctttcattccccatcctatatgctatgccacaaggtcacacatactattttcactgcctaatcttttctcttcatcttttgtctttttccacaaagaccttgggtccaagcaaaacattcatgctgtgtctctttagcataattcgaaatgtcagtgaaagataaaaataagagatctgataaggatttgtgttctttcttcagatgatgtttgcattgtttaatattttaactcaaaagaataaataatatgtacaattcagtatgttgtgtcacactcgcaggaaaaactgtgattgctcaaattatacctcacaggtaatgaacatcctacatgtttggctgggcttgaccaatgaagtgaccactttctcagggtaaccattccttataaggctgcgtatgtagtataaaaggcataggatatagtttaagaatagagtttgagtatctgtgttatcattcactgttgaaggggtcttaagaaaaatatatcacttttttgaacctcattttttaaatctgtaagacaatatctacttctcagtgttgttatgcatttcaaatggaattagggatattaaaagactctgcaaatggtagagaaaggatattgcaatctataaagcactacacaaatgtgaaaaagggtgctatgaaaagacaactagacatggagtcaaaatacatggtgttatgggttgatctgtggtccacaaaaatacacgttaaagtcctaacccctgctacatgtgagtgtgacattatttggaaattggttccttgcagaggtaattgagatgaggttattagagcaggccctaattcaatatgactggtatccttataagcaaaggaaaacacagagacacatgagaaaatggcatgagaaaaaggagacagagactggagtgatgcatgtataagccaagtaacactcaggcttcccagccaccaccagaacctaggagagaggcatgaaacagattcttttttagagtcctcagaaggaaccaaccctgctgacattgatttcagacttctaggtttcagaactgtgagataatatatttttattcttttaagaaacccaattagtggtactttgctattgcagccccagggacctaatatacataggtataatttcagcttcatcacttatgagctctataaattcaagttaaattatttgaggtttccccctgacattttaaagacacttacctttctgtgattgtttctctgaggccacttgccacccctttgaccacagtgctagctttgggggtcagcaccacctgagatataaaaaacgatcccttctttcttctctcagtgatggatgcttgaagaaactggatcagtttctcggggtctgtggtgttggcccagggtgctggcatcatctgcccaggccagagaaagggcacttccagagccactggactatggtagaagaccagcacttgatagtccttctcccacaggtactttaaactaacttcctgggcaaaaatcgctgggcacattttatttccatagatgtctttcagcatttggaccagtttttcatggtgatatttctgcatcccataaaagtggttgaagtccaagaacactacctccttatggtgatctgtgaggaatgcattgatctcctcaaggccttcattgactttggcactgaacaaaccatgagcaaaatagagttcattgtcggggtctctgggcttggtggaaattcgaagatcaaaataacgaattccagctcctagctggccagtaaaattcattgtctgagtggctaaccatttccgcatgagctttttggccacagttccaaacacagagacaaaattctggacagtttctggctgctcaggacctactggagaggcttcatcaatgtagaagctgaaggaatcatgagaccctaggagaataacaaggcatagtgtggttaatttccacgtctttgcccttcccaccttctttccctcttgcaatatccatacctctccctcaaatgagccacagaaaatactaagaaatgtaatactagttattttttatgccttaggagggtcctttatataaattgacataagacacagaacacttcaatagatcaaattggttattaaacaataagaagatttccttataattaaatttaaaatttaaataatcatctattctgtgaaccaagaatgtaatacactcactagaattggctttccttatgggtgacttaagtgatcattcataaagcgatatctatgaagactcaccaatacccaaatactttgcagtcttacccttttccttgattttgggttgattttaagcctagaaggattgtctcaatgaataaagatgcccttttcacaggcaatcagcatatgaagtgttacctcattcacttcggaaggcacaagaggtcaaagtgataggggaaaggagaaataagacaagaaggcagtaccatgctgacatatttaacttcattcctgaccttgtgtttgggcaattgtaaacttagatgaggtcaagtacttttcacatattgaataaatgatgaactgttcttgcaagtcaacagcatttaaaaattaacagcatttaaaaattgacagcatttaaaaattaactaatagactcttttcttcacaaattttctctcaacagcataaactcttttgggaattggcttctaaatttagaagaatttcttcctaggaagaaaaaggactatttatttgattatttttggcagttgcaaatttcaagactccagaaatgtagcaatgaacatgtgtgtgatttgtcacaaatagagagtgccatttgaaactctttattaggacccaataaagaaaagttatgtcaaggttgcattttatttcttaaagcctccttttattcttaggcataacccactgaagagctaaaattaaattaacatattctaaaaatttcatacattagagggtagatatgctttaaattctgacaccctttcctgtttcatgaccttgtcctagtaccatcattccctatctgatactcaggcttcctctgagtgcactttgttgccccattcctgatttcccttccttgaggcatatcttttcctagttctttcactccccaacccaaaactcacatacatataaatacacacaaacacacacagaaaccttaagtttatccatacaacacttcaaagccttggtcttataagctatttgaagcatttttttcagtgatgcaatatatacctacgtctatattccatatctatgtatatttctacatttatgtatatatatccatgtatctctctatccagctttaacagcccataagaatcacaagtgcctaaatttcagacactgtggtaagttgttaaagaaaataatttgtaaaatattttgataccctgaaaatcataacctttaaaatttagataagttctcagaatgatttcctttttcaaaaactataaaagataacccaaatatacagaaatgccatgtttaatttaatctgaaactgcatgccttatctttagtagatggtgtggcaagaaaatgtcagtcctttctgaataagcaaagctgggagttaggttctgattggcaaattttaataagcatttaaattgctgcatactgatttattagttgctattcatttgactgctaattgaagtgaaagctaaacaaatgatgctaaaactcaatatatacaaagaagtgtgtctacagatagaaatgaaagaaagtttaagaagaattatgattaaatgatctaagattaggagaggtaataaatacacttatttaaaaataaatttaaactctcaaaataagagtttaaaaagttagtttccaggcacatgaagggaaaggtagatgaaagtaattggttacttctgtaatctagtagaaattatacttggaggcaggcaaaaagggaattaagtataactagatttcttttactagaaatgagtggttctctgttttcaatatggctttagtttcacctttctatcacatggttatgtggcaagtaaaaaaattgtaaaaataaaattttaaaggcaaggaaatcaccacttttgaaaacactgtgaaaggatattatacttgctagagcacatgatttcttgatcttcatggaaagtagcttcttaaggtcaaaataagggaatgttaaaaataaaaataggcagaaggagaaaccaatggtggcttcaccagtatgtgttttgagccacatgactctgaggtgtagccacagcacctcgtataaaatggtgcttcacactgtaaatattattagacaagaaaataaaaccaatagatacaaaacagtatctatgcattttgtaagaaatatataatatagtgttggctaaaaaatgaatattttgatgacttttaattttatttggaatagtacttcccaatttcaacattttcactgaactagtaagttttctatttgtttgaatgtaaagcaaaaatacaacaggacttcataaccattcaataattgagaggaaaagcctaacctcgtgtctttaaagccaggagtcctctttgatcttgaacttttcggctatatctggtctgatattttgcttctacattgacttggtattcttgggcttctgaccttttattcttctctcatccacagtctcaaactcatatcttggacctggtacttaatgttactcctctgatgttgagtttagtttctcatctttagtttccatttgccctctctcctcagacaagggctaaccactcccattataaacccagtcccatcaagcttggttgctttggctctgaataaataaatgtaatcagagcaactatttatttcatttcttggaaataagcactttaatttgtttctcctcagtgtgataaattgtaccctcattcaggcactgtgggaagcacacttctaagatggcacctaacaatccttgccctcctgcattcatacccctctctgtgagtgtgggctgaacctatgacctgcttctaatgaattacataggacaaacatgatgggatgccgcttctgagattaggttacaaaaggttataacttctgtcttgttacttttttccttgctttgatgagtgaactgccatgttggagaggcccatgtgacacagaggttgtagtggcccttgaccaaaaccagctgggagcagaggtctttagactaacagctctgaaggaactgaatcctgttaacagccaatgagtaagcttggaaataatcctgcatgagtgagatcttgattgcagccctgtgagagagaccgaagcagggaacccagttaagtaatgcttagcttcctgattcatagacgtacacagaaactctgtgttgttttacgccactaaattcaggggtaattggttatacagcaatagttaactaatacaggccatagcatctctttgtagttaatgaagggacttgtggccaatagacccaactggctaaagggaggagttggaatttcaaagaagagaaattaactatggttatgttatatgcatgtttctatgcttgaaaactgtatcaggtatgagaaaaattttaaagatggtttaaaaaatattcttgaattcacaaatggactttcttttttccacatgctgttatggatgatctgagatatcatctggcctaaccaaatggcacatagcatcaattttattaccttatctgtgtagaatgtgtgtaatcatttctatattttatgatttccagtagtactggacttaacttctcattctgtcatttggtatggtaggaagattgcccccaaaacatccttctggtgacaagacctatataatccctccgcttgagtttcatatttttcttgtgactatgtcacattatatagaaatgagacttttaaaaatatgtaattaaggtccctaatcagttggctcttagttaattaaagagagattatcctgagtgggcctgacttgagcagacaagctcttaaaagagacaacaagcagcaacagagcaaaatgcagtgttgtagagaaggccatacggcaatggaagtcattaatagctcactaaagtggtataaacatcaatttaaactgacagcatctgaacaatcagcagcaacagaaaaaatattattcaaacttaagcagaccctcctgaaaatatagttgccattgcctccccttctgattgaaaaaaagactgatccttatcaccaggaagtgcaaatgtagctgtccataagcatcataaagcccagtagaccattccatacttttccaattaaaatcttaactttttgttaagtttagtatatgagcctttatttctggttattcagggagttactcctcactgagcactccatctgcatatcatgcatgtataaataaaccttgtgttttcatctgttaatctgtccattgacagttagtttgcaggccaccaatcactggacccaagatgaaagggaaaaggttttcctcaaaatatagtgactaagtagcctctaggagctgaggtctgagctcctacaactcaagaaaccacgttctgtgaacaaccagcaagcttgcaaaaggaaccttagcctcaaaagagatcgcagtcttggtcagcactctgatttctgattctagcatgatcctgagcagaggatccagctaattcatatccatcgtccttatttacagaagctgtgagaaaatttgtattgtttaagccactatatttgtggtaattttaatgcaacaatagaaaactaatacatttggacactacttaagatcatctctatatgtagtgtcatacgagtattacagtatagttgagaaaattattgcaagtattctgtaattttttagactttatgtgtaaagggatatgaatgacttgaggcaattacatcattctgattaaaggcccccagtaactggaagtaagttagtctctctgtgtaaaaaattatatgtactactagttctattttgtaaatgttttcttcaagtaaaatggtctaccaacctgatggaaagaaatgttcttatttttaaactaatgaatttctcattcagtaaaacatttatcaagcacctgctataagtgctgttattatgctaagtataagacaagcattgttctcatcctcataaatttacagcttaatatgtgatgcacatagataaataattataatacattttggtaatgattttttaggcactattgtgtagcatggggtagagaggagaaaatgtttgatcattgattattaatatcaatgggcttatgcaaataatttttaaagaactagactaaatgcaaaagtagccttgctttttgggttaaatgataaatggctcttgggagccacactaaacagggtacataatgggaccattttcatctggctaattttgccttagtttcttgctgtggactagttggaaactaaaaaaaaaaatacatacaatccttgccctcaagagtcttataatttaattagggaagttaggcatagagacaaacaaataaaaccttataccaaatagcattccttcattctttcaacagacatttactgagcatcagctgtgttcaaggcacttacaattaggcagtggaagtaaaggcaattgatctggatgtggaaggaaaacatgtgcacttctatttttatttatatatttatcttaaaataataaaaattaagcattaataacattgtactgccactgtcacctccaggatagccagataccatattcagtactcaagatatttttaaaaacagtgagaattccactgccctgaatggtaccctcattcatttgatcagattgtgctgcattgcagtttgctgtaatatactggctggttaagtagactttagacttgcagagtttaattatccaagcactcccaaaatagacatgtggttttagaagtttttttctttttcataaaaaaggaccagactaaagataattcaattaagtaaataagaaaactaaaactgacacctatacttttattatgagcttttcattagtcatattactgtattataattttagctaatagaaagacaaccaaaataatattaaattaccaagaagactacctgatatgtggattcacttttactattaactatgaacttcaccctatgtatgtaccatgttttgtaataccagttcataatagaataataacactacagtaggaaatatgttttaaaaaaacatatattttatatttcattagtatagtaatgcttgtataatttatatataaatgtatttataatatttatacatatatacaagcacactcataaaatttatggataaatatacttctatcacagttacttgcttgatttttttttaattgataggaaggcctctgatttagtccactggaatgattagactggaggaactaagtaaaaatgacttggatcagaaaatactggagacagagaaaccagttaaagcctattgatgtgctggtgatttgagatatagagcatctctgtgaaataaaacgtactgaaaaacttcagccctcagtgcttctccccatgttacaagatactggcatcagaaaagaccacaaaatgaataccagtctttactacttccttgctttccaaatccctactgggaagtaagatttagcagtgtgagagtaattaagcagaatacctccttcctccagataccaacacagatgcataagaagacatagctgaatttttgagcaacagatgttaacttacaaaggacaagataagctgtactgtgttctttgcaacagaagtcaaatatcccaacatgagaagagcctctgtgcatataggcaaagataaccaactgtagctaaaggctcccgtgtactttcagtactcaaaatagtcatgcatatggggattctgtcagtcaacaccatatctgctgttgatgttggtaacagtgaccatcagaaacttcaggaagtgaaagaagatctcccatagaaaaggaaaccatggtcagtataatttttgtgatgaatttgtgtttcttttaaattttctaaatttctaaaaatatacacatcatatatattttatatggtaactttcagttaactagaattttttacattgacatgttcctttttaaattattattgaggaataatgtacagacagtaaaatgtattcattttaagtatacaattctgtgagtttgaaaaatgtatgcatccaagcaattgccaccacaatcaagatacagcacatttccaccacaaaggtcatcccttgtgaccctttgtagcaaattcctcctatccaccccaagatccaggcaaccactaatctgctatatatcactctaagttagttttgacttctctataattccatataaaagaaatatacaatatgtactttcttcagtctggcttcttttccttagatgatatattttgagattcatcctatattgttgtatgtatcagtagttttttttctttttattgctaaatcatattccaacagtattccatcatttgcatacatcacaattaatttaaccattcatttgtttttgagcatttgggtggtttccattgctgacaattctgaacaaaactgttcattgctgaatattttttctggaaacatttctctttcattattattgcataactccaaggagtagaattgctagggtaaatggtatttgttttaccttttaagaaattgacaaatttctcaaaaagattgtctcattttatatttcctcaagcaatatatcagagttccagttactccacatggtaccaatgcttggtaatgtcagtctttttagtattagtcatttgagtggttgtacactggtatctcatagtggttttaattttctaatatctgacaaataaagatgttaagaatctttctgagagacaggcagagcaagagcaagagggtggaatagaaggctccaccaatcgtcctccgtgcaaggacaccaagtagttaataactatctacacagaaaaaaaaacaaaaacaccttcataaggaacaaaaatcagatgaccactcatagcactgggttttaacttcatattgctgagagaggctctgaagagatagaaaaagcagtgctgaatggctgacgccactcttccctaccctggcggcagtggcctggtacagagaataactctgggtactgggggaggaagaacacagcaattgtgaggcattgaactccatgttgtcctgttacagcagaaatgaaaattggacaaaaatcagctgatgctcgcttcctaagggagcatttaaaatagccctagccagagggagaattgcagatcccagtggtccaaacttgactgcctgcaaacctcacaactgagggctacagcactctgagcctccaagtaaacttaaaaggcagtctagaccataaggactgcaattcaggcaagtcctatagctgaattcagcccagggacagtggactgaggtggaacatgatacacagaaacatcatccaaggaagcaaaaagagtactgttatcacccctcccctaacctcaggctgcacagcttgaggctccaaaagagaccccttcctttgtcttgaggaaagggaagagttgagaggagtttgtctttcatcttggataccaactcagccacagcaggataggacaccagtcagagtcatgaggtccccatttcagctctagctcccagatgacatttctagacacacctgggccagaagggaacctgctgccttgaagaaagagatgtagttctgccggcattcatcacctgctaaatgaagagtccttgggccccaagtaaacagcagtgatatccgggtactacatcaagggctttgggtgagcctctaagacttgctggcttcaggtgagtctcagcacattaccacctgtggtggctactgggcaaaattccttactcttgagaaaagcaaaggggattttgtcttgcaccttaggtgccagcagagccacagtggggtagagcaccaagtgggttcttggggtcctcgatttcaggacttgactcttgaacagcatttatggacatgccctggatcaaacgggagaccatttccctgaagggtgagtcccaggccaggcagcatctaccacaagctgacttaagggaacataggccttaagggaacaccagcaatagtgtggcagtactcctcgtggcctggggtggtggtggtggctatggatgaggttcctctgcctttggaaagagagggaagagtggcaaggactgcattttgtagtttgagtgccggctcagctgcaacacagtaaaacagaaggtagacctataaggtttttgattctagtctctgactcttggacagcacttctggacctacccaaggcctggggtacctgtctgctctgaagggaaggacacaagcctggctagctttgccacctgctgattgtacagccccagggcattgagtgaacatagccaaggagtggttacagccagtgcttttctgacttcaggtctgacctagcacagtcataattgtggttgccacaggggtgattctgtcacttcacccccagctttaggtggctcagaacagagagagagggagagagagagagaaagagagagagagactctgtatatttgggataaagtaagagaagagaacaagagtctctgcctggtaatccagagaattatcctggatctgaaccaagacaataaaggtgatgcctctacaagtctgcaggaatcacagtgttactaggcttggggtgctccctaaagcagataccacttagatcacaatacccaagtcctttcgagtatctggaaaaccttcccaaaaaagatagctacaaataagcccagatagtgaagactacaataaatacctaactgcttaatgcttagactctaaaaaatatctgctagcatcaacatcatccaggaaaacttgacctcaccaaattaactaaatgaggcaccagggactaatcctggagaaacagagatatgtggcctttcagatagaaaattcaaaatagctgtgttgaggaaactcaaataaatttgagataacacagagacgaaattcagaattctatcagataaattcaacaaagacattgaaataattaaaaagaatccagctgaaattctgaagctgaaaaatgcaactggtatactaaagaatgcatcgggatcctttaataaaagaattaatcaagcagaataaataactagtgagtttgaagacaagctacttgaaagtgtacagccagaggagaaaaataagaataaaaacaatgaagcacttagacagaatctagaaaatagcaccaaaagggcaaatctaagatttgttgaccttgaagagaaagtggaaaaagtcataggggtagaaagttgattcaaagggaaaataacagagaactttccaaacttagagaaagatatcaacatccaaatacaagacggttataaaaaactaagcagacttaacccaaagaggactacctcaaggcatttagtcatcagtttccaaagctcatggatgaagaagggatcctaaaagtaccaagaaaaaaaataaataacatgaaatgcagctccaatatgtctggcagcagactttttagtggaaacttcatgggccaggagaaagtggcataacatatttaaagtgctgaagagaaaagcttttaccctagaatagtatatctggcaaaatatatccttcaaacatgaagcagaaatggagactttcccaaacaaacaaaaggtgaaatttaattcacgccagacccaccctagaagaaatattaaaaagtccttcaaacagaaagaaaaggacattaatgagcaataaatcatcacctgaaggtacaaaactcactggtggctgggcacggtggctcatgcctgtaatcccagcactttgggaggctgaggtgggtggatcacaaggtcaggagatcgagaccatcctggctaacatggtgaaaccccgtctctactaaaaatacaaaaaaagaaaaaaaaattagccgggcatggtggtggacacctgtagtcccagctacttaggatgctgaggcagaaggatggtgtgaacccaggaggcagagcttgcagtgagccgagatcgcaccactacactccagtctgggtgacagagtgagaatccatcaaaaaaagaaaaaaaacaaaaacacctcactcgtaatagtaaacatggcagaaaaacacagaatattataaaactgtcactgtggtgtgtaaactactcttatcctaagtaaaaaaactaaatgatgaaccaatgaaaaataataactacaacaatgtttcaagacatagacagtataataaaatataaatagaaacaacaaaaagttaaaaagcagggagacaaagttaaaatagagtttttattagttttctttctgcttgtttgtttatgtaaattgtattaagttgttatcaggttaaaataatgtttataagatagcattggtaagcctcatggtaacctgaaaccagaaaaatgaatacataaaaaataaatacaatgaatacataaaaagtaaaaagcaagataaactaaaacatatcatcagaaaaaaatcaccttcactacaggaagacagaaagaaaaaggaaagtaaagaagaccataaaacaatcagaaagcaaataataaaatggcagtagtaagttcttactaatcaataataacattgaatgtaaatagagtaaattctgcagtcaacagacagattggttaaatgaatggaaaaacaagatctgttgatctgttgcctacaagaaacacactttacccataaagtccacacagactgaaaatacagggatggagaaagatattccatgccaatggaaacaaaaaaaagaacaggaatagctatacttatattagacaaaatggacttcaagacaaaaactaaaagaagagacaaagaaggtcactatataatgataaaagtattaatttcacaagagtatataaagtatataacaattttaactatatatgcacccaacagtggataacctagatataagcaggtaatattatcagagctaaagaaagatataggccccaatacagtaatagctgaagactttaacaccacactttcagcattggacagatcttccagacagaaaatcaacaaggaaacttgttggacttcatctgcatcatagaccaaatggatctaatatttacagaaaattttatccatgagctgcagaatacatgttcttttcctcagcacatggatatattatcaagaatatatcatatattaggtcatgaaacaaatcttaaaatgttcaaaacaatttaaataatatcaagcatcttctctgaccacattggaataaaactcaattttaacaacaagatgaatttgggaaactatacaaatacacagaaatttaagaatatgcttctgaatgataagtgtatcaatgaacaggttagaaaggaaattgaaaaatttgttgaaacaaatgataatggaaacacaatataccaaaacctatgggatacagcaaaattagtactaagatggaaatttatagctataagtgcctacatcaaaacaaggaaaaacttcaaatgaataatctaataatcttaaagaactagaaaagtatgaaaaaacaaaacccataattagtagaagaaataataaatatcggagcagaaataaatgaaattgaaatgaaaaaacaatacaaaatatcaatgaaacaaaaagttgatttttgaaaagttaaacaaaattgaaaaacctttagccaacaatgaaaaaaggagagactatctaaataaaattagaaataacaaaggaaacattataattgatactgcagaaattcaaaggctcattagcagctactatgagcaactatatgccaataaattggaaaatatagatgaagtggacaaattcctagatacattcaacctagcaagactgaaccaaaagaaatccaaaacctgaacagaccagtaacaagtaatgagattgaagctgtaataaaatgtctcccactaaagaaaagcttgggacctgatggtttcactgctgaattctaccaaatatttaaagaataacaaataccaatctgattcaaactattctaaaaatagagaaggagggaaaatttccaaactcattctatgaggccagcataccctgatactaaaatcagacaaaggcccatcaaagaaaaaaaaaaaaccacaaaacaaaacaaaaaacacaagtacaggccaatatctctgatgaatattgatgcaaaaatcctcagcaaaatactaggagactgaattcaacaatagattagaaagatcattcaccgtgactgaaatggtttggctgtgtccccacccaaatcttatgacaaattttaattcccaatgttaggggaggaacttggtgggaggtgattagattatggtggtagatttcccccttgctgttctcatggtagtgtgcaagttctcaacggatctggttgtttaaaagtgtgtagcacttcccccttctctctctctctctctttctcctgctccaccatggtaagacatgcttgattccccttcaccctccacaatgattgtaagtttcctgaggcctctcagccatgcttcatttacagcatgtggaactgtgagtcaattaaacctcttttcttcataaattacccagtctcaggtagttttttatagcaatgtgagaatggactaatacagaaaattagtaccagagaagtagggcattgctataaagatacctgaaaatgtggaagccaccttagaactgggtaatgggctgagtttagaacagtttggaggcatcagaagaagacaggaaaatgagagaaagtttggaactttctagagatgtgttgaatggttgtgatcaaaatgctgatagtgatatggacagtgaagtcaaagctgaggtggtctcagatggagatgaggaacttattgaaaactggagcaaagctcgcacttgctatgcttcagcaaagagacgactggaagcatttgtgctcctgctctagagatctgtggaactttgaacttgagaaagacgatttaaaatatctggctgaagaaatttctaagcagcaaagcactccagatgtggccttgctgcttctaaaagcctacaatcatttgcatagacaaagaagtgacctgaaactagaacttacatttaaaaggaatgcagatcataaaagtttggaaaatttgcagccctaccatgcagtagaaaaggaaaacccattttttggggaagaattcaaggctgcagaaatttgcataagaagagccaaatgctaatagccaaggcaatggggaaaatattgctagggcatttcagagacctttgtggcagcccctcctatcacaggcctggaggcctgtgagggaagcatggtttcctgggccaggcacagggccttgctgctctgtgtagtattgggacctggagcactgcattccagctgccccagctctagccatggttacaaggggcctaggtacagcttgggacatttcttcagagggtgcaagccccaagccttggtggcttccacatggtttagggccttcaggtgcacaggaggcgagagttgaggtttggaagcctctgcctagatttcagaggatgtatgaaaacacttggatgtacaggcagaagtcttctgcaggggtagagctctcctagtacaggataatctgtatgagggcagtgcagagaggaaatgtggggttggagccacgacacagagtccccactggggcactgcctagtggagctgtgagaagagagacacaatcctccagcccccagaatggtagatccactgatagcttgcaatgtgtgcctggaaaagccacagtcactcaataccagcttgtgaaagcagccatgggggctgtactctgcagagtcacagatgtggaactaccaatgccttgggagcccatcctttgcatcagtgcggcctgaatgtgacacatagagtcaacggggattatttcagagctttaagatataatgtctaccctgctgggtttttgacttgcatgggtcctgtaacccctttgttttggtcaatttctcccttttggaatgggaggatttatccaatgcctattgcatcttggaagtaactgacttgtttttcatattacaggatcattgatggaagggatttaccttgtctcagatgtgactttggacttggacttttgagttaatgctggaatgagttaaaacattggaggactgttaggaaggcacgtctgtgttttgaaatgtgagaagaacatgagatttgagagggatcagaagcagtataatatggtttggttttgtgtccccatccaaatcttatgttgaaatgtaacccccagtgatggggaagagacctggtgggagatattaaatcatggggatggatttccccctggctgtttttgtgatagtgagtgagtcctcatgagatctggttgtttgaaggtgtgtagaactttcctgtttcctctcccatgctctgccatggtaaaatctgcttgctttcccttcaccttctgcaatgattgtaagtttcctgaggcctccaagccatgcttcctgtacagcctgtggaactgtgagtcaattaaatttcttttctttataagttacccagtctcaagtagttctctatagcaatgtgagaaaagactaacataatgaccaagagggatttatccctgagatgaagtatagttcaacatatgcaaatcaaccaacatggtacgtcatatcaacagaatgaagaataaaaactatatgatcatttcaattgatgctgaaaaaaacataatatccaacatctctttatgataaaaatccccaaaaactggggatagaaggaatctacctcaacataatagccatatatgacagacccacagctagtattatactgaacggagaaaaactctaaaatctagaacacaacaaggatgcctgctctcacctctgttattcaacatactactggaagccctagctagagcaatcagacaagagaaagacttaaagagcatccaaattgaaaaggaagccaaattatccttgtccacagatgatataaactaatatttcaaaaatctaggcttcagagaacaactattagaacttataaacaaatttagtaaagttgcaggatataaaatcaacatacaaaaaaaaagtagcatttctacatgccaacagtgaacaatgggaaaagaaataaagtaatcccatttacaatagccacacataaaattaaatacctaggaattagcttaaccaaagaagtgaaagatctctataaggaaaactataaactgatgaaagaaattgaagaggacactaaaaaatggaaatatattccatgctcattgattggaagaatcactattgtgaaaatacccatattaccaaaagcaatctacagattaaatgtgatccctatcaaaatactaatgacattcttcacagaaatagaaaaaacaatcctaaaatgtatatggaaccacaaaagacctagaatagccaaagcaatctcaagcaaaaattacaaaactgaaggaatcacaatacctgactttaaattatactacaaagctacagtaaccaaaacagcatggtactgacataaaaacagacacatagaccaatagaacaaaatagagaacccagaaacaactccacactcccacattaaactcagtttagataaaggtgccatgagcatacactggggaaaagatagtatcttccataaatagttctgggaaaactggctatccatatgcagaaaaatgaaactagaccctgtctattaccatatacaaaaaaaaatcaaaattgtattaaagacttaaatctaagacctaaaactatgagactactacaagaaaacgttggagaaactttccaggaccatggtgtgggcaaacatttcttgatcaatacccaagaagcacaagcaaccaaagcaaacatggacatatgggatcgcatcaaattaaaaagattctgcacagcaaaaacagcaatcaacaaactgaagagatacagaatgggaacaaatatttgcaagctactcccctgataagagattgataaccagaatatataaggagctcaaacagctgtataggaataaagctaataatccaattaaaaatggacaaaagagctgaatagacacttctcaaaagaaggcatacaaagacaaacaggcatgtgaacagatgcacaatatcattgattatcagagaaatgcaaatcaaaactacaatgaaatatcatctcactccagttaaaatggcttatatacaaagagagccaataatatatgctggagagaatgtggagaaaaggaaacgcttacacactgttggtgggaatgtaaattagtgcaaccactatggagaacagtttggaggttcctcaaaaacctagaaatagagctaccatatgatctagccatcccactgctgggtatatacccaaaaaaagaaaatcagtatactgaagagttagctgaattcctatgtttgttgcagcactgtttacaatacctaagatttggaagcaacctatgtgtccatcaacagatgaatggataaagaaaatatggtacatatacagaatggagtactattcagccacatagaagaataagatccagtcatttgcaactacatagattaaattggagattattatgttgcatgaaataagctgggcacagaaagacaaacactgcatgttcttacttgtatatgagatctaaaaatcaacacaattgaactcacagagatagagagtagaagatggttaccagaagctgggaagaataatgaggggcttcagaggaggtggagatggttaatgggtacaaaaaaactagttaaagaatgagtaagacccactatttgatagcacaataggttgactatagtcaaataataacttaatggtccattttaaaataacttaaagaatataattggattgtttgtaactcaaaggataactgttcgaggggaaggatacctcattctctatgttgtgcttatttcacattgcatgtgtgtatcaaaacatctcatgtaccccataaatctacatacctattatgtacacatgaaaattttaaaaagctaaaaaaaaaataaaaaagaatatagtgtgcttatttgacacttttttttgaagtgttcattccagtctttaactcattttaaaacttggttagcttctaattatttagttctgagagctcttctggaaacaagtattttgtttctttcagtgtgtgactttcttccatgtacttaatgttgtcttttaaacagcaaaagttttattttttatgaaattcaatgcatttgttttttattctttggtttcctcttttggtgctctaaaaagtatttgcctatcccaaagttgcaaaagtttaaaaatgttttcttctggaagttttatagttttggcatttatatctgggtccacaaaccattttgagttagttactatggatgacacgatataagagtcaaaagttaaaagaacatccagttgttcaaacactacttgttgaaaaaactgtcttttcttccactaaattaccttggcatatttgctgaaattaattgaccatatgtgtatgggcctagctctggaatatctaattagtttcccgatttctctatatgccagcaccacactgtcttaactattatgataggcagcctttcagatggctcccagtgatcttgctttctggttttctcattctattataacgagactcttgattttctaaaagagtttgtgtaagacatgcattattttcctcttaaattttgaattaaataaactgttgaagccatctagtcttggagttcttttgtgagaatcttttaaaccataaattcaatttctaaattaaaatgaggctatttacttaactaacttttggtaatagttgcctttcaaaaaaatctgtacatttactttctgagctgtagagtttattggtacaaagttgttcataatattcttattacacttttaatgcctgtaggatctggtgatgcccctccttcattcctgatgttggttaatatttttctttctttcattttcttgatgaatgcaagtagagatgctaaattttattgacatttcctaagaaccagtttttgtgtcattgttttttctgctatgtattttccttattgatgtctacttttcatatataattttcttatttcaaattgcttttggtttaatttgttccttttttttagctttttaaggctgaaatttagatcactaatttttataccttattcttttctaaaataaacatttaatgatagctttttctctaagtactgctttagctacatctcagaaattctacagtgttatattttcattttcattcaattaaaattattttataattttccctctgatttattctttaacctctaagtaatttataaatgtgttattttccaaatatttatagatttcttaggcagctttttgttattcttttaaatttacttcatttttgtcagagaacatgctctcaataattttaattcttacaaatttattgatatttattttattttatttggtaaatttttcatgtgtgctttaaaataattttattctactgttattgcacaaagtactatgtaaatgttaattaggttaacctggttgataatgtgcaagtcttccatatctctattaattttctatctgttttattaattattgagaaaggaattttaaaatgtctaacaaaattgtgaatttattctttattctctgttccatcactttttgctttatatattttgaagctctcttattgtttataagtactataattgttgtgtcttttaatatgttaatctctttaatatgaaaagtttctttttatcattagtagtagcccttgtcctggatattaatatttaatatcatatcatttttgtatttttacttttaacttatttgtgtttagatataaaatgagtttcttgtagaaaacaacttgttggcacttagttttatatccagtctgacaatgtctgcttttgaattcaattgtaatccattaacatctaagtattcactgctatggttaggtaaatacaccatttatatttactttgtcgcatctgtcctgcattcctgtttttctctttttcttccttctttgggttagttgaatcattctcagaattctatcttatgccaaccttcggcctagtagctagactctctacctttggctttactaaaaaggtttactttgtggatatgatataaaatgcatttctataagaattttcaatatcactttaggggttcttttaaaactaaaaacaagattagaaaagaggaactctttttttttttttctatttaaaggcttttaattatttggaaataattgtaagcatacagaaaagtacaaaataacactaagaatacccatatgccatttacccagattgacttatttgttgtttttttttttttttattatactctaagttttagggtacatgtgcacattgtgcaggttagttacatatgtatacatgtgccatgctggtgcgctgcacccactaatgtgtcatctagcattaggtatatctcccaatgctatccctccccactcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtataaatagctattctataagcctaaataaaacatcttgataatttaacttttctttttaaaaatcaaagacaatatatggttgctcaataaagaaaagtggtgcatagagtcaggtatcaaaatgcattaacttccaagttggctcttccaagcaaatgactcatataaattggcctttagattaaaatacattaagcaatggagtgcactgaaagcatcattgaaagaatttttggaaaaataggctcaaatttacagtcagtcagtaactcactgtttaatactcgaggatcatcaaaccttctagctccagttttctaatttggttaattaaaatacctttcacacctactttgcaggactcttataaggaacaagtggaaccatgtggaaccatgttaatgaaagtcctataaaagtactataatacttacaattccttattttattttcttatggtataactcggcacaaacatctattcacctgagaattaaaaaaaaaatcacctacacaaatgcacattaggatagctatgcaagcacataaggaagaagggcaaggaaggaaatgatttaagttgcagaatttaggtttgtaaatattagtaaaaaataagaatatttactaccatctgtctaagattttataaatatggaacaataaaaactgcttcatcctttattgctttgagcagtgtctaaagatttatattctgctatattaataaaacttgtatatgatatatagtaagtatgaatctttctccatttaatatctttccagtattatttatagaagtttttggaatgaacttccggttggtctctcagtttagccataatcccatttcaaattctacaaaattataggtttaataaacatcaaagaaaatgtatcaagtcaatttcatctgtgacccttcagaccaagaaggccccagtgtgctgaggtttgacatgctgtgaatgttcaattccagtatccatatcctgaccttggaattcaggctttgactcagttaagataagaactgcttctctccttgttttggcagagcactgagcttgcttttgacaacactatgtgttagtacatcatgttttcttgtccttgcctgttctatttctgttctttggctcaatgctttctggcaataggctttctacatatataatacctccataccttttatgataataggaccaacactatggttgttgggaagcaaacataccttccacctatgaaccaaaaagaggctgctggatgaagatatataagggtagctttgttgtttgaggtctttttctaggatagaagaaaggcaagtggcaatatttctacttcccatgggaagagatggaattctggagtgaagcttacccttttgtcttgccatatgaaagtttttatcttagtctcttctgtaaccaacatgtatttcctcctttgtaccaaagccttttacccatagttgtctttctcctgaattcacattcatatcgtctacccctcctcctatcaagtaataattattgttggatgttattacgaacacttgttatgttcactaaattgtttttctgtctttatatcttgctgtatacctgcagtctctcatgtacacacacttgattttaagctagattataagcttccctaaaagagaaaaaagaacctatgccttataattccctgttcccactgctgcatctagctgtattaatataaaaatatttgattcaagtcaatgggtccattgttcacatgagatatgcttcaaaagtgagagaactacatccactaataacattttttaccaattaggcaatcattggtccaattttttatttgtttgttttgttttgttttgttttgtttaccatttccattcaaattctcagattagtctacttaatctgcctctctcttccccaactttggttccatctttaacccactgtaataaggttatcactgttgcaactcatataaaaccccagcaaaatgccattgatgactactaaataaaattgaccggtcactgtcttgacttcattcttaagtctcagcacaaagcttggtagacataagtttattctattaaataagcaaatacgtgaatcctgcacagcctttctggaacatttgatacagctatgcttccttctcgaaatattttcctcctttggtttttgagacatggatctttcctagattttcttctctttctgtgattgtcctttactgcctcctgtccttccaactcccaaatgaaggttaacaccttcatttcccttcacccaaagctgtattgcagacctcaacttgcttcatactttttccttgggtgatatcatccatttctttagtctcttttgcctttatatagatgcatcaaatattgataccatctaatttgacctgcattttagagcccctgtgtgcctatctgacaactaaattttattgttccatggttactataagcttacatgtcccaaacagactttagtatcttcccctttaaatctgctccttcttgtttgtccactgttacatttccttatctcatcatccttctatctcatccttgggttaatcttcaactcttgcttgcccttcaaaccttacactcaatcagtcttgaagttgtactgtgtcatggtaaatactgtgtagaggcataaatcctctctctccaaatcctctctcagatctgttttgttctcttccattccattgacagtggtctggcttcctgtgggggccactgaaatagctttcaggtactgctttgattcaatcctctgtagctttcccttcatctcagctgcgatcattcaaccctcctctatggtcattaccctgcctcagcctctagaatggatttaatcttaggtaaaagatatataattattttccagcccaatacattggcatttgttaaaaagttccttttgctttttgtctcattttcattaacaagacttttgacttggtaatgtatttagcattcaactcgcctaaaggaactatttgcttttatagccctctaccaccctgtcactaaatgctagactggtagctggagcctggtcatctgctgagtctgcctgcctgccagtatttttttcataccactgtcttaagagttctaagctagcaccattccctgttgccttatatcaaatccctaagcatggccctttgtgtggactctggccttgagaggtttcaaatctggctgatgttatgtgggactattgacttcagtacatggtcctctatgtaactggataggcagtggttcattcctgatagtacttagaaaaaatgaaatctactcttggtatgtaactgaggagataaaatacacagattatgaaaataatattaaatctcaaaatacttctacttgatttggaagatagttcaaattgtgaatacatgatgatcaacatgacaagaaaaaaaaatttcaaaatttactcatttgattcttacctgacagctaacaattaatcttaatttttgcttactgtgttgattaaacttatcagttatttggacttttggagacaaagaccagccattgagcagaaaggatcacttctttttcctggcacataattttgcctcaatcttccagctcgtgattgagtctttatgaacaatccaagagattttatgtcattaaagacaacacacaatatgtatcacaatctacaagacttctagaattgaacagatcattgaaaaccacagacctgtaacttaatatgtgtatttcacttgacataataaatgaataggaaatacattttttaatattaaacccaaaatagctcacggaacactaagtttaatccttttctaaagaaagcatcaagatagtcatgctgtgatttctctttgggcaaatctgtatctttcatattgtgtaaagcctcctcctcagtacatcttacagtgagctcatgtaaagaaagttggtttccttatttaagtcttttgatccaatattcaagatgctaaatttgagaagtcctattttactgatgactctgaggagtagagaagttcagtattcatcacaattttaatcaacttgctgggtcatttctttaaaccagtagatgagctgacaacgaatcatttaacagcatcaatattcagattattcagatcaagaggcagaaaaaaagagcttgctcccattgccatccatggtgaaactattaagtctctttctcatatgaatttatttttaaagattatcagcagggcttccagaaaaagaattataagagacccaggtattaccaatgctgctctttcaaggcccacactttgaatgtgaggtattaaggtaatacagacatcttcttgctcatcaactactcattacattgccttctttcctgagccctgagtttcctgtgcttccactctcagtctcttttctgacacatacacacatatgcatatacacaaacacacatacatgttgacacacatacttctgcttatctgatctgagttgtgattatatgaggacattctaagttttgggagatgtcacaacacctgtgttgttggttgaatactttcctgtcacatataaaaaaatctgaactaaacttttttttaaaacaaaaaggttgacagaacatttattaataagttttgtgattaattttattttaataaactgtctgaggttatttagttattaatactcataagaagaactctggaagtcaatccgcacatctttattaagaagtcaaacacaagtctgtggccataagaatacggtgtcgcataagtaagcctaattcctcttacccttgaggccaccaagctgcattttcaaatgtatatatttctacatttgtaacgatcacccttccaaatgtagtgagtcagggagaaggatgaatcaaggatgactaaataataagaaagatgggggaggaaagtgtccataacagagatgtggcaaagatgaggaagaaaaagagcagattttattaacactattgccttggctattttagcagaacacagagaagaatccaaaaaggacatgtctgttggcaaacaacttgggagagaaccagaagtgaacccagttgcttgtgtcattattttgccttagcctccaagagcctgaacagcccaaggaggacaagacagtcttgacctaagggaaagatatgctttatttacaagaaaacattaaaaaatctgttttgtacaggaaactgtctagttcttttcctattcactgcccccaaagatgacctatgaagctggagaaactggattatcgggagccttgagcagccttaagcccagggtgctaaggtcacaaaatggatcactctccctttgctggctgggctccagccacagcaggcttttttgagcttatcaaatatactaagctcatttcagcttagcccctgcacttggtaatcccactgcctgcgatactctgcccctcattgtgtgcatggctagcaccttttcattcaagtctcagtttaaatgtcatcttcttaaataaacctcgtatctaaagtatctaactcatccaaccctcccctgctgcctgttagtctgtatcacatgatctagtgatattttcttcatagagtttatcactagcttcaagtttcattttatttagttgcatatttgcttgttgtctatctctccccactagcatttaaattccatgagaattagtatagaatctgtcttgttcgctattgtgccctcaacaaaaggcactgccactagtacatgaaagatgttccctaaatatttgttgcatgaaataatatattttcatttcactaaacctcaacatcctcatctataaataggactgatatcactacttataaagattataaaataagtgataagcagtaaacacaaattatgcagacaatattcaagaagtattaacttttattatcaccatgaattacaatttctacattattaacactgagaactaagtgcctggcacagagtaggttttcaccaaatgaatgaatgaatgaaagaattaataagaattatactgagagattacaaacaacatggttgtcataagctctcagaactaactcaaagaaaatactgccacagcctctggggtactttagatagattaatgtcttctaaagcccccctccttttatttatcttttttttttttttttgagacggagtctcactctgttgcccaggctggagtacagtggcgtgatctcggctcactgcagcctccgcctcctgggttcaagcaattctcctgcctcagcctcctgagtagctgggactacaggcgtgcgcccccacgcctggctaattttttttttgtatttttagtagagatggggtttcaccatgttggccggtatggtcttgatctcctgacctcgtgatctgcccacttcaacctcccaaagtgctgggattacaggtgtgagccgctgtgcccgtcccccgccccccagctccttttatgattccctggaccgtgaatttcctgtaccggatgtcgcaatgccaagccctgccaattctggaaggctctgctccttacacatgtgccgtttcagattcttactattactgtatgttctgatatccaggctcagcactgacagctgtccttctacccaggccatctgaaggaggctcaagtgtagggcacctcactttatggccaccttttttcccagcagttttatccttgtgacaaggacctaaaactgagcatcaacagcagcggttgaaagagaagcaaacaaaagtcagtgccatatagaggtaacgtgcagcataagaaaagaaagttgggaaaggaaatgtggttgccacacagtcagccacatcttccctattcctctgtagcagctaattgtataagacgttgatatcttttttatgccaccttctcccccgatttctccactggagcctcctggtggtggcagaccctgcagtttggggcagtcttgagtatatgtaaccacaggagcagctcttatgtgggaagacagaacacatagcctgggcaaatgggggagggcagattagataaaaacaagtccatatcactaaaaccaactattctgaaagacaatgactcgattgtgttttccctctaagaagaaaacaaatacaaaacctggcaaataaacagtctaattattaaattctcttagatttgagaaccaagaaggcctctgaagcctatttacctttgttcttgtatgtctggcactatttcttttccttttatgaataaagaaaatctgaaataacacaacattacccttaatcatgtttgtgctacagaaataacatctccttgaaataccagcctttgattctatgatgccctcaccaaacaccacttcttgccaatagctggatcttttctttatcaagggagtgtttgagggttggggattatttctttgctcttccttccagtctccctttctcttcctctagccttgggatttgagatctggatatgtagagaatatatttccttttgctctccaatctcacagcagagctgggataataagaaatgtttataaaactggcacaaacaaacaaactggtttctaaaaactagaatgtaggtaccaagttgagcccatcataagatgattctgaatagtatcaccttcatgctacatgatatttggtcttataaatcttacatggcatgcaaacattcccaaactccttactccaaataatatttttataattttatattttataattttataatttataatttataatatttttataatagttttggtcatatagagtattgatcatggatatatatatgtccatattgatatccatatatatatctccatatatatgtatccatatatatatctccatatatatgtatccatatatatatctccatatatatgtatccatatatatatctccatatatatgtatccatatatatgtatccatatatatatatgtatccatatatatccatatctatctatctgtatgtatgtatagctgcaccatttagagcacacacagacacaatcacatttctaacaattgttttacttcttaaggaatttttttaggcctttttaatacactgaactgtttatattgtcttctgataggaactgtttagactggattcaaatcgtggtcaaatttatactctatattcttactcatgtttggtctctttaggaaaaaaatatataccaaatgcattgggttacaacatcaatgtttttccgtagtattacatagtcttcaaacattgtttaaatgattgcattgtgccgtatatgctaataaatactttaacaattcctttataagtatgtgtttcgagttatctcttttattaattataccgaaatgaaactcttcctatatcttttataataaattctcagaaattcagtagtctcatttattaggaggtgacttacaccctttctttacctttacttcattatttcttcctgtcttttctcagagttgtgtacctaacttaaaagaagtcaaggacatgagagctgttagtgggaaattacagtggcaatgtgctcctttgccactcgcccttgataatgaccttctaatcacatactgttttcagtctgcacccctccgcctcagaaaacaggcatttcttgtttcagccttaatgtctcacatctttattacattatcttttattgtgtcagcctctacttcttatctgtagtcactcaagatcttacctcaaagaaccccctaatgctaaaaggacttgatattgtctggacttggtgacatacaatttagagtatacacagacacaaacacatctctaacagtgctttacttcttaaggaaaactgtaaagcctttctttaattcaactatttgtactgtcttctggtaggaattgtttagactggatttaaattgtggtcaaatttgcattctatattcctactcatgtttggtctcttaaggaaaaaagaagtaacgacatgacaaccagtaattttctaatgatcctaagttgagatcaaaacaaaacaaagaataataataaactctgccatttattgtattacacttactagaattatatgtttaacttgagagttaccaccagttcacagaagattgcaaataatttttttttaaattgcctacttacaagttacttatttttctacaaaccaaacaaatactttgcaagtgaatgatgccaagattagatcatgaaagtcataaattttgtacaacacaaagaaaggatggctgcgagctggctcaattgcagtgtcagaccaggcaaatcaagaagaaatattagaaccattttgtttctgcactgaacttggaagagtcatttcaaatcaaatgagcaaacatgcattgaacacctgcaatgcaacaggaaatttgctaaacactatgatagatgtaaaaataaatatgactacttctggccccaataaactcaaacccaataaatttgtgaatgttttcaaaaaaatggtccttgcctttaggaactttaaatgaaaacttctggccaatcctgccaaagagactgttattccacttttccattatttgtttctaacagtcaatgtgcttgaattacaggagatatgggttaactggattagcttcttggtcataaaagtgtttctattattattactagtttaggcaatggtcatcacacttatgaggtgaaagaagggcttttaatctcccagtgtgagtaggctttgattctcagtacaataaaaatcacctatattctgcaccttaaaatatgacaaactagagtttaaaaaaaaattctcccataagatacaaatatgtttttcaaatatttattttttaaaatgcaccgctgagctggtaagaacataagggcaattttcaagggtcaaaaccaaaccaaggagcagacagaatccaggtgggtaagccagacctgaagccttggaggttctgatgatatttactgatacaaaaatctaggacttttgagtttttttagatacacagtagaaaggtctgggcctaaccaagcagtattcacataaagctaagacccacatgctgtactatactatagcccagtgaaactgaggcttccataccccaaaagaagttttcaaagcaacttgtctgtcttggccttagctcttgattgggatgggggaagagagggagtaggcattttttttttttaattatttattattatttttttgagatggagtttcgctcttgttgcccaggctggagtgcaatggcgcgatctcggctcaccgcaacctccgcctcaccagtagctgggattataggtatgcaccaccatgctcggctaattttgcatttttagtagagacagggtttctccatgttggtcaggctggtggagtaggcattatttttgatggaaaaagagaagtaactaattaagaaagacacttctactgtggtctttaattgtactgcgaatattttatttctttacctgtatgatgaataggagggtgattattatatttgtgtgtctctaatatctctgaatcaaataaaaaagcataagtagcctgttacaaatacagtacttaacccttatttgcagttttgccttccgcaatttcagttacccatgctcaatcacagcccaaaaatgttaaatggaaaattccagaaataaacaacttataagttttaaattgtgcaccattctgagtagcatgatgaaatctcctgctgtcctgccagggacatgagtcatccctttgtccagtgtattcacacagtctacactacccactccttagtcatttagaaaccatctcagttatcagatcaactgtcaaggtgtcactgggcttgtgtttaaataactcttattttatgcgataatggcctgaaagctcatgaataatgatgctggtatattgttataattgttccattttattattagttgttaatttcttattgtgtctcatttataaattaaactttatcacagggatgtaggtataggaaaaaacatactatatgtagggtttggtactattcataatttcaagcatccactggggatcttggaatgtatcccctatggaaaaggggatgctattgtaaaaccaaagacatagattatttttagattaaaaaattcaaggtatagctaattaaatgacaggtgagattagaattccagcctctcaacaccgaatcccctgctctttctgtactttttaaaaagagtgtttcaagacctcccagaagttttgtattttactgtgggatgtggctgagctcagtctcaagggtaagtcattttcaggaaaccttgtcccagactggcaaatactctgtgtgctctttggaatagctccaaaacaggccatccactttggtacatctttgaatacaatagtcatcctggatctagattagaaaatccactaagaaatgactctcttgtgttggggtgaaatttattgacagatccatatgtttcctctgactatttagttcacaatgacgttgcccatttctgaattcttagagcacttattatgcatcctaatcacttagatacttagttccattctgcatttagtaggtaaataggttatatcttcaatgtgactcaaagttcccccaaaaaagagatttattttgcagtccctacattgccaagaaaatttagaataggaagggatattattatctgcttgaaacttcttatactacatttgaggtaatttgcccctataaagtgatttgccccaaatcacacagtgtatctgtcaaagtgttaaaacatgacacaacccaattaggataattcaaggagagtttataatggaactgtgtggataggatgtagggaaactacatattataatgtagtgcctcaaggctagtaacaggtaactgtggccactcttaactgataagaatcaggagtgttaccagaaactggaaggagagggctataatgaagatgccttgagaggaaaaaggatcttcagtaaggaaactcagccatccccaaacaagctcaaagagggagattaggaggaataaataacctgacatcacttttccatatccactctgggtacttccattggtcaaacccaactgtaaccttgagaacaaagaagcccattgataaatcctataatagttacccttctggagccaagggcaagatgaaggagggtgaggagatctagaaggaaaaagcgacagtatctaggacatttagctttggctggaatagaggtttcctaactccaactttactttcaaccaggacataactcacattgctcaaaaaatgcttaatgaattgagctaagtttaactgactgaaagctgccaaaccagaaggaaggtctgtgtacctaatgttgagtcagggcccagtgagggtgggtctcagaccatctcctactttcagaattggaatcagatcccggaactgtactcagaagcagatgggaaaccagtgtagtgcccagggccaagtgagtaaatgttccaagcaaccagacccactcagcatcctcttttgctaaacagtgacacagcccagcatatggcaggctggacactgtgtgatgtgtaggaccagagccaaagatagagctgggctggttaaaagagacatgttagttttcagaatttgagagttacagatgtggcaggttgagaacattcaagaaccatcatatccttttgcctatgccccagttagatgtgaaactgaacttcagaaggcaagagtgggattgaaggcagcttttctacacctccactgtagcagagccccagagtacaaaagatgaggaattcaccttttgggacggtgaaaagtttgcaaccaggaatgagataccaattaatccaatatgaacaaaagattcttccccagaccaatcatcagactgaaaacactggcattcatggaccaagacaagaacaatggtggggacatttaaggttgatctagtagatgtttctcttttcttctcaaatctgtggccaacactaacatgtctattattcctcttacatatcccttgctgagctattacgataatcaagtgaaacactgaaatagcactttgtaaatcatagggctccctacatgacacttattactattacccattgagggctgcctaagggtcccaggaagggagacctatttccacccctcactttggctactatcctggaggaaggttccattgctgaagtctacattacaaagagagttttgccattgccattgggtggataaggtgatggtgagtgtcttctcaggagccccagctgatttttgggtcagcctcctccttttcattccaggaactaggagccagaagcagatgaaacttgactaatgaccaagagaggttagagaaggctgggaaaaagtattttcttgctgcttcttctacccagcaaggcaagaagatagaccctgttactgaagaatcagtagaagcaggacaatcaggactctgggaaatccttggagaaatctcaagggaggaaagaaaatcctggaacagaataacacattgatattaactactctctgattaacagctaattattgcaaatgagtttactgaccttttccctgatgattaggagagtgctgccatcacaaagctgttaagccatggtatagggctgcgctgagcaaacctggagggtaggactttcccaaggaaccagggatacctgggcaaaatgaccaaggatatcccaggagggcagccagagaaacgtgcccactgtgggcctgagggggtgtctatgttggactggccaagctgactgagcaggttgttggagatttggatacatgggccaaagaaaatagaatatcctcatgtgttatcttatttcactacctactaacagtatggaattatctatatgttagttttaagaattcaaatgtcatattaagttttctgaaatcaaattctatcaaataatccaacaaaacatgtaattgcctctttgttaggggaaaaaaattgtccaggatggcttaggatatggttttcaaactgcaatatataggtatgtggcagtgcagtgatctagaagccaatgcagtgtgtgtggcatatatttttagaatataaattttatctaatatttgaaagaggaagaaattattttcatttaaaacacacacacacaagtgcattaataagaggaggtcaaaattctcttttgtttttaagataaaacatgaggcttcaaagacttttttcttccttgtagcaagctactttaaataacacacagacccacacaccctggggtctgctctccatatgcagctactgtgagtacttgggtaagaaattctggtgacacacagccttatgtgaaagcagagggataagaagtagaaacagctgtaaggtcttttacaaatctagaaactgaagactaaaaaacacatgtcatattaatttttttggtacactttatttaatatttaacatttgtatggcaatatcctagatactaaggcaaagttaaaactgaatggtatgtaattcagttgcaagtcttccagtttatgaatcaaaccacattaagcggagtagtataggttcttgcttccctctcttcttcctgccacactgcctccccacactgccttccatcccagataccaactgaaaaaactttcactcataaactatcctaattgtttgttattccagcaatgacactgaatcagtcatcattttggagaagagtgtgactcccaaatattttgtcatttcctatgatttacaatgaaattatgatctgttccacctcagaaggttacattgttcatcacaaaaggcaccttgtaaatggaaagcagtaggagtcagagagaggccaaggctgagcagcaggcagctgggtgctctgcattccactatcttggaggagtgactgaggccacagccctcgattgtagacagtaggttttactttatgttattattagttccctcttctcacttggtatatgttagaaacatgaaagttgaaaatttggcagaggcagggggtgggggaagaaaggtaataatgttaaggaaaaatgccttctaacagaatttccagagagaaaataggaagatgtagccagcagcaagagaatccttcccttcccagttcggctcaagattttgtagccacaaatcttcctcaaatcaaagcttcctatcatcaggaattccaaggcttcgtgataataaaaaggacctcacaaaaaaatactatacaagacgttctttctttggaataatttcctggagtattcaaatcaaagtgctaggggaacatttcagagatttcctaggatatgatagtgtttttccaatagaaaacaacatatcatatagcaagtcagtcacatcttcatgatgccaagacatggttgaagtttttgggaaaacagtagatagtatttctgctccatgttaaccatgaagcaattaaaaaaaatactgaggtttttcccccagagatagccaagcaaaatcttatttcttagaatgatataattctattgttcactgaatcatttcacaccaatggccatactggagaaaatgacatgtattctagaattagattgccccagtcccactacttcttagttatgtgacaacagattaaattttttaatctatttgtgcctgagtttgtttagctgtaaaatagggaaaagaccatagaccaacctcactcaataggttgttgtgatgattaaatgaggtaatacatggaaaacacttagcactgtgcttaagtgccaaataattaattattatgattatgattattgttagaaaattatttctctgagatttcacagtaagcacctttagtagctaaataattccatgttagaggtacatagtctttcctttttcccatttcccataattactcatctatttttatttttaaattttaattattctctgtcaaatgtgttgttgctataatatgcttccaaccttttcaaaaagtttacagggtataaattataaataaagacaatgattgcacctatatcaagtatctcatctatgagcttttaaatggactacttttacgtctatatcccacccacagaacaagaaagaactcctaaatatatattaactagagagtaaaacaaaagggaatagaagaaaactgatacatgtcattaaattggtcttatttgagatgaatatattgtgctcgtttaacttttcctcagcccagaaatgcacattttttagagtcacagttattatagaaatcctagtccaagctaggcaaaaacccatgatctctagtggcataaattcagtgttcctcatccctccaaaacaaccaactttagatgctgcataaaacaagattataataatcacgttttcttttaggaatgtaacagtgacatgaaagatgcaaaggaatcaaactgtcagggtctacctccaaaccccttcccctcttagctagaaaacatgttacatctctcagactgggcttctgccaaatctgccatgcttagcagtcttaatttcttctgcttctcagtgacaagtgactggcacctccaatgcttgcagagagaatttatctttgcatggcaggataattgtatacaataagccaggacatgaaacacagatacaaaatggcgttgtgtcagcatttttagtctttcctccaaccctaactttgtcacatcacctttgcattgtctgcaagttcttggttgccgtcactacgctaattctgggcagcttctctctgcaatcatgtgaccatataactccattatgtgaggctacagataataaaatgctactatttattaatactcagggatacttttcccctgcatttcctgcattctttcagtggaatcttacccacaagtagatccctgatatccttttactctcctaaggtaaagggaacatcattccagtgataatatctgatctctcaagccctaaagaagttattttctggtaacataaaaatggaaagatatgcctaatataaaatgttaggcatattttaggataatattaggcataatatccaaacatcaaaacagagtgtattaaattctcactgagtcatatttctgtttgtgcaacagttttataaaatttattgtcaactatacattattcaatccctaattcttttttaattgtcttctggaccatattgctctaatatataagtaatttgagggtaggtagggtccatgaattatatttcttataatagcctatagagtattattccgttagatgtttagcagatccttaaaaaatactctttggagctgggcgcggtggctcacgcctgtaatcccagcactttgggaggccgaggcgggctgatcacaaggtcaggatattgagaccatcctggctaacacggtgaaaccccgtctctactaaaaatacaaaaaattaaccgggcgcggtggcgggggcctgtagtcccagctactcgggaggctgaggcaggagaatggcgtgaacccgagaggcgaagcttgcagtgagccgagattgcgctactgcagtcaggcctgggcgaaagagcgagactccttctcaaaaaaacaaaacaaaacaaacaaacaaacaaaaaagctctttggtagaatttagatgaatggaaagcttaaatatacgcacattttaatttcagctgatttgaaagaatattcaaacataagtcaactcaggtgtgctaaaaaactttttttaggtgacaaagcagtgagattccaagtcctggttacccgttaataaaacaagcattatgtaacaacatgcttttcttcatatatttactataattctcgatatcactcagaaatataaacaacctaggtatttccatatatatatatatattgctaatgcataggaagatatcaacctacctttaagagttacttacatatgtattaatttaaacacacttactgtatttttatctttattcttagtctttatagacaatagaaagtatatattattgtaaagggctattggaactccatatttctgaattattactcacctacagccaaattaatcagcttgctctttcctataaataacttccttatccctgactgttttttcacatacgccttctccgttttatcagtcctggaaatggcttcaaaacatgactgaaatctccttgaggagcataatgtggaggtaagaatgtggacttggcagcaatatgaaccagggtttaatcttacctttgacttttacaaggctctgtagccttgggaaatttatcaaccaccatcttttcatatctgggtaggatgggtctcatccttcctttttactaccttagtccaaattgccttggccaatcttggagtttcattctttcatttgaattttagactatattaatcagatatattaaaaaattgaaaaatttgttaggattgcattaattgatagaaaaattgcgagacaattgtcatctttatgatattgactcctcccaccttccaacattatatttctcttcatttcctcagatcttcttttaaagagtcttcaataaagttttacacatttatctaaaaagttcctatgctccttttgtcagatttatttccaggtatcttttacttcgtttgctataaaagtggcatttttttccagtatgtgtgtttttcttttgctttttttgatactgtactagctggtcctccaacccagtgctaaatagcagtaataaaaacaggcatctttgccttctttgtgaatttagagagtccttttcattgtgaaatagaatactaggttaggtagttgatagatatactttatcagcttaaggaatctctcttctattcttaattttctaaaaagtattaattttttaaaaaaaattatgaatgggtgttgaatattatcaaatgccttttctatatttgtgaggtgatcaaattattttttctttttttatctgttaatatggtaacattaatagatattctaattttaaactattcttgcattcttcgcagaagccctatctgactttgatttattattttatttttatcttctcccagaacagtttatatgaaaaatgggttatatgttctttgatggtttggtagattatgctggaaatatactttggtctaaatgctgtgttttgtggttagaataaagtttttttatgcttaattattataaggcttttgaattttctgcttctagttgagtcattttcagttaagttctattttttaaaaatattaagtttttcaagtatattggcacaaagtagttcatggaattctcataaaattctgctgcatcaatagttatggccttcatttctagaatgattatttttatattctccttttttcatcaatttttccacagattagtctattttattagaagaaatagattttaattttgttgactccatattttctgatttgatttgtatcagatgattatattattactttatatatttttcttttctaatatatacataaaaggttgtgaatttctggccgggcgtggtggatcacgcctgtaatcccagcactttgggaggccgaggcggacggatcacctgaggtcaggagttcgagaccagcctggatccatttttgctctcatcattttttttctcctttattgagttttgatctttccctacctttgttgagatatatttgaaaaataaaaactgtatatatttaaggtgtacaacttgatgttttgatacattgtgaaataatcacaaactaattaaaatacccatcacctcacatagttaccattatctttcttttgtatgtgttttgtgagaatacttaagaccaactcttcaagcacttttcaaatatacaatatagtatgttaactatagtcacactgctatacattagatctccagaaattatttgtcttgcaaaattcaaactttctaccctttgaccaacatctctccattccccttcccccagcccccagcaactattcacaatagccaatatatgggtttaatttcctttttatttttctaacttttgggttagatgattatattattactttatatatttttcttttctaatatatacataaaaggttgtgaatttctggctgggcgcggtggctcacgcctgtaatcccagcactttgagaggccgaggcgggcagatcacctgaggtcaggagttcgagaccagcctcaacatggataaaccccgtctctactaaaaatacaaaattagccgggtgtggtggtgcatgcctgtaatcccagctactcgggaggctggggcaggagaattgcttgaacctgggaggcggaggttgtggtgagccaagatcgtgccactgcactccagcctgggcaacaagagcaaaactccatttcaaaaaaaaaataggttgtgaatttcactctaagaaccagtttagtttcatcacacatgttttgatatctacttttgctgtccattactttttctttgatgcaagaaatattgcaatttttgacttccttcatttttatttttctgtattttatttattctattttttcacattataaataaggaatttgttgtgtataatatgtgttacttagtatttgttgagatttgctatgtgacataacatgcaatcaatatttaaatatgcttcaagtgttttgagaaaaatgagtgtcttgatttggggaagcaggattttgtattctatattatcatcaagcttgtttattgtcttgtcaaatcatacatacccttactaattttctaactttatgatctagcacacaatatgagaattaaggtagaaatagttctcaactaaaattgtggatttagttattaaaatgcaataagcttttactttatatattttggggctattttggtggttgtatgcagctttggagttcttagagctattaaatacttggtaaatctttcttttaatcattgtatagtaatcatctttctcttgttataatgctttttgcatcacagtttgtgtgatattaatataaccacaccaaatttctgttagtatttacttagtatatctttccctccctttactttcaacctttttgtgttttcatgactccagtgtgtctcatataatataaaagtgaatctgtctcttgtcttttttttttctttctggaatagactttcagaacagttttaagtttccaggaaaattaagcataaggtgcacagatttcccatatacctgcttccccagtacatgcacactctttcccattatcaatatccccaccagagtggcacatttgttacaagtgatgaacctgtattgacaccttattatcacccaaagtccatagttcacattagcattttctctttgtattatacattctatgggtttggacaaatgtataatgacatttatctaccactatagtatcatacagagtagttttactgccctaaaaatcctctgtgctctgtctattcatccgtttctcctttctaacccctggccaacactgatctttttactgttttcataattttgtcgtttttagaatgtcacatagttggaattaaaaagtatggaggctttttgtactggcttctttcccttagtaatatgcatctaagtttcttcgatgtgttttcatagcttgatagctcatttcattttagcactgaataatattttattgtctggatgtaccacagtttactttgttgcttccaagtttggacaactatgaataaagctgctataaacatccatgtgcaggttttcatgtagacataagttttcaatatctttgggtaaatgccgaggaatgtgattgctggattgtatgataagagtatgcttagttttgggagaaactgcccagctgtctttcaaagtggctgttccattttacattcccacgagcaatgaatgagagctcctgttgctccacatcttcaatatttggtattgtcagtgttctggatttgggtcattctaataggtatgtagtggtatctcattgttgttttagtttacatttttctgacttatgatgtggagcatcttttcatatgcttatttttcatctgtatagtttctttggtgaggggtgggttaaggcctttggctcatttattttaatagagttgtttcttaattgtattttaatttgtttatattaattatatcaatgaatttgaatttattcttaccatctcatttatgctttccaattgccatatgtttttctttcttattttattcttttctgcctacttctgtattaatcatgcctgctttatttctcttttttacttctagtggcttgggaaggtatacattctagttctatttttagtctttatccttcatatgttaacaaagctacttagtttgacagtctaaatataatgtttttacccttttcttgaaaaacataatgatatgattaaaataattatccctttccactgccatgttattactgtctagaattttatttctactttgcttttaattctctgcccaaatgaattatcaagctttacagttcatattcatttagatttacatacatatttattaattcatttgcttaccattacttcttgcatcccattccttcttagttttcttctttttaaggtagtttatttgaggaggattgctgagtgatcagttctctcagtttttattttttctgaaaatgtctatattttgtgctcatttaataataatctatctaaatagagaattctagaatgactattattggtatcagtatttcacaggtatattttactcttttctgatcactaatgattttgagaattctgctaattgattttattctttataaattatcaatctctcctttcttgttgctattaagacttttccctttgctgatttgcaattacactacaatgtttccatgtggataaattttttgttttccttctcagtgtccatgggagttattcaatatgacaattcatgtttctaattaaatctggaaaattttcagacatgatttctttcaatatttcccactccctatcttctgtttctttcttgcaaatcctattagctctactcatgactcttatcctctagtttgtattccatccctttccctcagagttagagtctggttagttttctcagctctgttttctagttcattaaattccttcaactgtgtctaatctgctatttacccagtccactgtattttaaattcagtgaagacttgcatatatagaagtttcaaaaaatatttttagtattttctttatcctttcaagtgacactttactctttcctttggcttctaaacattattttactctccttaataattttatgtacacttatgtgaatgtctgtattagatgttttatctattaattcaagttttgtggttgctaatgttccagcagacttatcagtctgctgcctaatattcacagaacatagtttccacatatgttctggaactttttgctgggaggtcattttaagtaagcattgcttttaaggaaatcttgacttccttttctgccagactctgggtggttgaactgtcgcttccaaacagtgtgacatttccttcttccattcactccacaagtatcattcacatgggaacaactcttatggtgatttctcagcctacaattgaagcaccactagcaagaataaatttgagccccaacaccatcaaaggcacatgggaaacatattttttaatgtaatcaaaatcagaacagaaacaaacaccttgcatttctaccaaaacaggtgaatacatttagtccctcttaggggagccaccctgtaaatttcccatctctagtgagggatctcagttcccatttcccactttctttgggacttctttgagtccctcaacttgtgctgtcgccctgggaaggcattaaaacctaaactttgtctctctccccacaccttgtaccccaactatcatggcataaatgaaagccagttcctctggcattcagatccctttctgcctctagcacacaggaatttctttatctttcttataagctcagacatgtattaaaaatattatttcaaccagtatcccttggtatttattatgtactgaattgtattccccctcaaattcatatgttgaagccctaacccccagtacctcagaatagggtctttaaagaggtgattaagttaaaatgagtttttttgtttttgtttttgttttttttagggtgggccctaatccaatctgtcattataagaagaggaaatttggacacaaaaagagacaccaggggcgtatgtacacagagaaaagatcacgtgaggacacagagaggtctgcaaaccaagaagagaagcctcagaagaaacaaaaccagccaaccccttgatcttggacttgtagcttccagaattgtgaggaaataaatttctgttttaaagccactccatttttgttattttgttatggcagccctagcacactaatagtgttttaccacaggagtctccaacttaaaatttttcaaaacctttttcaacttttaaaatcagtcccttcatcttccctatttccacctcattaacatttagtgcatttttccacacagagaaaatgttttagagacgcttcatgcactgttaaaaaacaaatagatgctgaggaaaggtggtttaacaaaatagtttcacagtaaaataaatgggatgaggtaaaataactgccagttttaaccatagactatttcaaagactccctgagtccagattatttccagatactggaatagtcagactacggactgacttggaggaactggaagacacggcatctattttgaagacgtgttgcttcctggaagttttcgcaatatttatactgcccaggatgtatccaagaagccaaactttgggagtactaaactctcaaaggagaaatcacccatcctctcaggttaagcatattgtcaatcactaaaacaaaaatgagatgttacttagtgaaaatttataccaccaagagaagtcaatggctccatgatcagtttcattccaatgtttgcttacaaaggacaaagtgatcttccaataaagtcagaaatggatgagactgaaaactcaacagaataggacaaagacaacactgctactggggatgggggaagggcacattcagtatcaggagattctctgctatgaggggaatcaggggagggagggagagaaggcggaggagagagagagagagacattaataatgttatgttgtattaccttagcaatgtacttgatccaattgagttgcaaagattgattaaacaggactataggccaaattaaggaaaaccttatggatttgtgtcttataggactgggatttctacgtcactgaattcatgttcaaaatcatcttgaatgtggatatgtattaatatgatttcaaataaaaaggcacagttggtttattggaaatggatgctatgctttaggaagtaaatgctcttgaaagagaaaaagaaagaaatatagaaatatgataaggagggaggatggaaaaagagaaaaaggaatgacgaaggtaggaattcagatctgagacagttttataagggataacatctattcacacccaaactaatttaaaatctataggtcatttgaagagtcagataaggtatagttttaacttatgtttagtgttcttatttagcaccaattaaaatattatatttttagaaaaatattcagcttctaaccaaccttgatgcccctggaaacacctatttatatagcagagcaaagcaaatgccaaagatgaagcctaatgccaagttaccaaggcatctcccaatgatctaaaacaaaagggcaaattgagtttgaaccctactttgctgcttgctagatgtgcaagcttgaacaagttgcttaacctctctgtgctttagttgcgtcaactccatcatagtaacaataatagcacctatcccacagggtagttattaattgaatgagttttatttgtaaagcacttctaacagttcctagtatatagaaaatgctatataactgtatgtaaatatagtaaatacatacattttattaatttgctttccatgagagaggaatgagttcaagaaaaggggaattgaatagttgcttggaaccctgatagggttagattataaagccaaaatagtaaaatcataaagaattgacctgtctgtagttttccagggttaaatatgaaacagcactaattcaatttattgaaaataggtgtagcttgaaggaacaaaaatttccacatcttcttctgagatcagggcttaatgaggccgagaatatttaggaaagatacaaaatgcttcacaagcatggttggagtttcgcttgcctctctacttgggccttcatctgtccagaatcaacttaaaaaacctggaagggaattctgtgacccagtgtaagcactcatgcccagggaacttattatttagtgtcattccctagtttctcttctgaatcccttccaggggtcagagtagtaattagcgctggcataatttgaggatataaattattcgaaagcttttgggggaaataaaacttttacattataaatattattctttaaaagttattgccaattataaagaaaatagaaaagtcacaaggaaaaacaggagaatttgattcctgaaacttctgtagccacagcccatcaaaatgtttccatctgctgcttaaccaaactaatttggaaaagtattctttcccagctttgagctgaccaattggtcatcctctaatggggtatttgacaaaattgtcttggaaacatgtgagaaaggaattctttactgagaaacttattatacaatgagcacaaatcacctagcagatgcacagaacgtcagagttagagaggatccatgccaattttctgggctgacctcatcagtctccttccatagagggattttatctctaactgtcgatgtttctaaattccaagcactagattttggattatcgcttaaaattttgtttaattaaaaagtggttatagatagaaccactggcctattctctgttttgaataggaatgagactttgcttttaatttacactcctctgaatatacattagaggttatgctaagggtttgcaaagttaaaagacacactaagtatacaaaatttttgatattttgacttacacattcttatgtattacttactgatgacttttgtgttaggttacagatttattcatacaacacaatcactttcatgatgaatttatcctacattttcatgccaaagtggatcacttcacggacaggttctagaaattatcagcatgaattgggagggaaaatactcactagatattacattatatagctgtttgcttatgtatatatatcacctttttgttcttcattcaaaaataaaagtagcataacaagtccaattatctgttttatttgattgttttcagattaaatgtggagtattttacattaaatcccacagagggaggtctcattgacctggctgtcttgctgagccattactcataaatctctaatcaagacaagtttttaaagtgagacacagttaatttcagaattcaaatcacactttatttttagaaatgtaggaggggaaatggtggtgtgattacctccaatttcaagccattctcctgcaacttgtccatgataggtgctaggcccatgaggtttgctggacctacaagagccccaggcagccatgtgggaccttgagcaagaggaccacgcaggagaagctagttagggaatgagaagaatggaggagacagaagaccaagcagaggtgagaggccttccatcttggagacaagagagcctttttccaactctctaatgtccacgacaagggacccagctttttctggtttcttgccctcagatactgggaaattgtttaaatagactttacaatccaggataaattacgacttaaagaagcctcccatcttgaataatattactgtcctccctctccctactacgtaattcaaaataagcttaatgcacaaattgcaattatcatacttgtgctaatcgagcttctttctaaatgcactatttgtgaaattcaggtaagtttatcgaagctttaaaaaccctgtatttctttggctatcactgtttttctgctgtccagcatgggtttattcagcagataaaggaaagtaagaaggggatgaaagtggatggggggatggagaagatgtactgcattgaggttgttcattccttatttgatagggtcttaaaacgtttagtgataaactgcatgttattcttttaatgtcttccctaaaagttatgttaaaactgtcttttccaaagtacaacctgccagagaaaagcacataagagagccagcttccaagaggaagggcaccatgttgtaatgcctgagcacccagaggaacatgccaatcaatgtgtaagagatatttgctgagtaaataaataggagcaagaacattctgtttatttaataatgcaactaacagataaaagaaaaaagtgaggtcaaccaatcttttgcctcaaataaatagccattcttgacaggttttctggatatgttcgttgaactgacctatttacaggttgaatagactgatggaccttttcttttcctgggaaaggacaaaaagggcctatacactctgtccacatctcagtctgtcttgtctgctgttttcttttggcccagaaccagtttcttatgtcacgaagaacttgaccttaatttcaaggtcctggaacagcgagcaggtgaggtcagaatgctgcacacctggagctctgttcaattagccggtgcagaggccagctttctccaccacatggcagaggagctcagaagtagcattcagggcacaagctgcctttcttgcctttgtggctactcatctgctggagtcagaccaggatgagaatttggactgctacttaccaactgggtagccttgggcaagtcttagactctctgagcctcaaagcctacactctaagtgaaaataatgacactaacctcatctcctgtttgaggattttatgataataagttcctagtgctcataatgtgaaatgcaatcagtgttcattaaatgatatttatgactttccctcttgccccttttttttctattcaccaggtacctaaggagtgctgaagaataaaagccatgaacagatggatattggctcccctaaacctccctattgtaaagtattcccctcaatcattgcctaaacacccctttccaccatcccaagatggaagcagccagattaatttctcagtaacctctgagagcaattgtatagatttttccatgtttgctcaggcacaggagaaatgagacctgagcccttggtgccaaagtgtttcttctattactgactcacaaaaatgacagtagaaatcaggaaataaaatgctcattctaagaatgattaaagtgcatggatgcagccttgctcatctcagctgatctaaacagcgccctcacaggagggagagaaaactgctgccgtatcaagtaatccattaaaaccttgtgaattgattctttaaacgcacagaaacaaaaacataaaatgactcctctcccttgaagtgatatgatttttccccctcctctaatcttgttccatcaaaagcctacaggtgggaagggaaaaagcacaggttacttgtatagctgtgacgtaatatcacctgatgggagccaatgggatggagactttcagcagggatggcccaggcattgcaaacacattcagcagcaggagccattcacttctaacccactgttcaggggaaaagcaggaaatgcccacacagctgctgacaaagatcctgggggctatttgccaataactgtggatccttgtggcttttctatatatctttgtttatcctagtttgccctgttggctgctacgcaagttgctgtatcacaaagcaccctgggtttgacttctgcgtgtgattttggccaagtcacttgacctctcattcatttattaattcattcaatgaatactgagtgctagatactgtactaggtgctggggatgtgatgtgaacaaaagcaaacctgttctctcactgcattggaaagcgaggagatgagcattaaaaatgtacaattgcaactgggagaatggctaataccagaaagatctgacctagctagggaggttcatggagctccacttggtgactagattgaggcctggatttcagtctgtactcacacccccaggtacttgccttttttgtagggcacaattggtataggagccctgaatccaaccctgtaatatgaaatcttgtataagcagaataagagcacaatcagtggaattatttcaatagcattaggggtataaattataaagggggaagcttggaatgggttcttgaaagatggaaggaattttgatggatggagataatatgttggaaaggaagggacaggcattgtgtagaaaagtgggaaacacatgaataagacttgggtgcaagtgagcctggtgagagtaggggtgggagggattgttttcacagggctgctatgcttgtgcctggagctggcattactgtggaggcacaaattgtggaggaccaggagaaaggagatagggttggaattgacagaaaggaaagggatataatttttgttctccttaattttaatgctagcacacgctcataaaaattttcagtagtataaaagcaacatgaagaaaattttaaaattacatatagtgtcaccattcaaagcaagtatcagtatttcagcatatagaattttagctatttttctttgcatacacatgtgcatctatgtgtacaaaggcacaaaggattttaaatggtatcgtagtgagaatactattttgtaacctgcttttaccacttgttcaatatgccctgggcatttctccaattcaaaaaatgtacaactctgtcatcatttttatgaagatggtggaggccactgtatggttctaccacaatttgtataactactaatcccatgtggaggaaatttgttttccccttttggctctgtaagtaatcttctgataaacatacttagataactcagagtatgcaaaaaaaagtcaacctgcccttgaaacctaagattagtgtctggctgcattgtgtgatagctgaggttcacggagcaccacccacatggacactggcagctgtggggtgtgggcagaggcatgtggtgcacagtgcactgggctagatgggaaaggttttgagtttgagtcccagctcttgccctgagcaatcttggaaaagtctgctggcctctctgactctgaatttcctcataggtaagaatgggggtagtggaaaacaggtggagaagccatggtggatttgatagaacttcccaaaacactaattctgaggaaacctaataggcattccttggtaaaaataatggttctgttgcaaagtaagttttgaaacactagataatgtttagaaaataagatttgtggagactaaagatgttaagcttcttcttcagagtttagcaaagaatggagtttctccttctcccgtaaagaaacagggcccaccattcagcatcatttgagatagaaacctctgtggcctcatagcccttgaagtcactctataccacctactgaatagtgcctctgcacctgccagcctggcctgccctgaggataccactcaaccctaacacattggttgggggtaagaggttattagtgtatcctctgagaagggacaaatattgaaagagaagttggaattgggctgatatttaagaagcacacaccaggtgagatatactggccacccacatttggatgggttaggcatccattctgactaaatgtctgatgcagagttgaatattacatgtggttcaactcataaatgtcaacccttaaaagtatcttagcaattatctagtatagcagttttaaagctatgtatcactgaatgccatccctataaatatgtattgatacaaagcaagttagcattgcttaagagaatgaaatctaacacatagttaggtttacatcctggattcacctcttactagctgtgtgattatttgcaagttacttaatgtctctaagccttggttgcctgatctccaggcagatactgttgaaaatagttatattatacccacaagactagttcagagtttgctacttaatatgttcagtaaatgttagctgttgctattgctgagtcacttgaaaagttcttattaggcacctctttgtaatggcattagcaggcattctactaagaaattccaactattgcagccctccgatacttcccaccatggtaagtggccctgaagtctttcaatgcaacaaaaccaccacctactaagcacttagcaggtgcacaacaacagtgtgtaaagggccaaatccagagcttgaagaaatcaaaaactacttcatacatctatgggctactggacaaaagatataaacctacttcagaataggtttttccaaagaaaatttaaaagtattgaaagccaaaataatttatctatagaattcaactaaagttcagttatttaatttcatgtattctatacttttagatacttaatatagtcaaggaaaacatatatacttaaatgaaagtacccccttcattctttctaaaagctcttttacttaagcttcacctgaacaagactgtcacagaatctcatggggttagagaggagaccaatgtaaaatctgaacttgtgattgaaatgttagctcccatgcccattctcacattaaagactctgtacttatttcctcttatcttttatttaataaaattatcctagttggaatgtaaagatatgagtaaatcagaagacatcacacctgtctttggggagcttacaatctaaacacagtgacaagacatcatacatgaaacaacagagagatggaatactgagacttcaggcccactggaaagggctatggatttgagaaaaatgatgaagctctggccacaatgatctttcattcaaatacgtggtgatagacatttagcaagtaaacactgaaagtgaatgcataaaatacagcaatttcaggaactattaagtatttacaaagactataataatgcagccctgtgatagtgacttgtgattgtgggaagaggtgagggaagaccttcttgcagaggtgatgtttgaggagcaaatagaatgatgaaaaggaaggagcaatggatctcagttttctttcttctagacccattacacagcaaattcacaaactttaaagtaggaaggagcttggcaagttcaagaaatacaaataagccagtgtggcagaaccccattggtgcaagaataaagacaggagtttgaagaagagtcgtaggtcagatagataccatgtctggtacgtactggcaaaaagtttggacttgatattcaagcattggggcagccactggagaggttggattgaaagagtggtatcacctaattaagtttttctacagatctctttggtatgggaagaaattggattataaggtgcagaggctggaaaaagggaggctaactactgtccatcaacatgtgataaatactgctagctattgaccaaaatccaggtttccttcttcctggacatggactatagtacattccccagcccctcttggagccatgtgtaatgcttatcattggaatatgacaaaagtaatgcctgcaatttcttcctcacttacttgggaaaaaattcctatccctgggctttggtttgttctgccttaagttgtttggaaaggtgaccactagcgaaattgttactgaatccctgaatgcctaagtagagaaaaactgccaccaacttagaacagccccgacagacttatgtgagaagaaaattaaattgctcacttttaagtgaaaaagtattgtgcttcttattttagcactttaatcaattttccttagttaatgatgaaaaggcaataagaataacatgctaatgatagagacaggagacagacaagggtcccctgcgaaaccccactttcaagcctaaaatagcctgaagtctgaaaaaccggactgctggccctggatgaagcctgccctttccccgactagttctctctgaataatgcccacctgcacgctgggagaatggggtggaaccaggggaagtttgccccatttgcagagaggagaagcctggcttcttcagttcctgtgtggtgtcctgggcttcaatctgtaagacgggagcctgttagcaagactctctctccctttgctgagagttcctctttcctttttcccttttcacccaataaaccctgccctaatcaccctacaatatgtctgtgtgcctaaattttccttgtcatgtgacaagaacccacttttttctacaacactaacatgtgaaagtctctcttctagaaatatccaagaatagctagtcctttggagcttattatttagtccttaccctgtcattaggaaaaaaaaaaaaaaaactttacaaactatctatattgactaaagtcagagcataaaaaagctaagcgaacagccaaacgtttctctctgtggaaaagagttaaagaaagcagagctttacatgtattttttcctatgactataaaaatacatttatcaaggtgaatttcaagacctgttgtttgttttaatgtaggagagccccggtctttagcaatctaagcaagtgaaaacaaacaaacactgtcgtagtttacggtggagctcacggacacttcctgatattcctgatatttccattgaagggagaccaagctgtcctccaggtatcctgcgcctcctctgaaccatccaaagcacattttaatttcctgcatgggtcatgaatggaaaatttgtccataaaaaaatagaaggtttctaagaagaaactgagagagattattttcattactctctgtggcaaagcctactacttgcctatccaacatttatttttctccttccaacttagtactagaaccttgacttttaggagggcatattaatgtgctaaatgaaagactgcatttcccaatgcatccagaagtagccattttaaaagttccatccaatgagatgtaagccaaagtattatgtattatttgggattttcaggaagtctttttaaatgttttttttttctccattgaggagtaccctttctcctccctgttgtctggaatgcgggtgtcatattgaaccaagaggtggccttgagaatagtctccaagttctaagagttgcaaagcccaaagataggagcctgggttcctgaagacatcatataccatttcagctctggactaacctcttccaaatgtctttcaggtgagagaaaaaattcatcttgtttaagttactactatttggatattttcctgttatatgcaatgaaactgactccaaaactgatagtcccccatatattaaaacctaatatctaaaacattcaatatctcaagattctgttgacttgattattggtcacttatcaagtactagattctccagggacacaaatgaactatattcaactgtctcttttcatgtattttctcaggctaattgggcaggtggaatctgcagaataaaaagggaaaaataatagtaatgtgttaaattagatgtcagtgactgtgagttttagaaatggaaagaagtcagttgggacaatgatagaagaggaaggattcgcacacaggtggaacatgggcctgacttgtatgatggccatttatagagtagttgagtatagtgaataagtccctagattcaggagccagaccacatgggttcagatcttagctccgtcagatcttagctccgttacttattagctatacagttctgagcaaattacataatctctcaattttttttttttttttttttttttttttttttttttagtcagagtctcactgtgtcacccaggctggagtgcagtggcacgatcttggctcactgcaacctctgcctcccgggttcaaatgattctcctgcctcagcctcccgagtagttgggattacaggtgcctgcctccatgcctggctaatttttgtatttttagtagagacggggtttcaccatgttggccaggctggtcttgaactcctgacctcagatgatccacctgccttggcctcccaaagtgctgggattacaggtgtgagccgccaggcccagcaaaatacataatctctaatggctcagtttttgaatccataaaatagagaaaataatatctatcttatagagttgtcttactgattctataagtctatgtatatatgtacatagaggagtgtgtggcatataataagtactctatgggtgttagctattatgattctgatttggacccttttctgataacatcactcttttcattttagaaacctgttatacctcacgataaccgtgttatttctttctccaaccaacccacaggtgaatgaaaagacccaagctggaccaaagaataccttaccttgtggccattttgtttatttcaacaagtgcagttgtgactttaacctaaggcagaaaggatgttctcttgaacttttagaaccatgagatcaggctatcagaatgagctacctaggagtctcggaaagttagtgtataatgcagacaaaaacagacagagtggacttcaggcccacagaatcagttttctggttcttgcagtccttcctctaaccttataaactactctccaacatcttgccaccaaatcctgttcatttgcctattcattcattcatttcatttttctttaagatagttcaactgggctttcggtacctgaaaagacagcaacctgaaaagacagcaaacctgaaaatacagtcttaagaagacttgtaatgaaaaggaagtggatacctggcaaaaaggatacaccagccaagagatgcagaaaagaatttctttagaagacgcactcatgcaatgtcaatactaactgagatgcgactctaacagagacaagacatcctctccaccacagttttcaagatcattttgcatggaaaagaagaaatgcattgggaatacgttcgttctgctcagatttttactcctctcctcattctaatggaaagctaatttctcattttatggccaaaattagtttctcacctgggaaagcttctctaaacagtctcctgaagaaacctccctccaggagggagtacaaggtgcatccaagagactgctccagaacatctgcatttgcccacacgagccaccacttcattatgtagatttctatatgttggacctcactatgcacttttaaggtagctttttgattcttttgtcactgcatgtcttacatgtgacctgtaggaaaagtagacaacgtcttggggataaactcaattctgccaagtgaacataaagggattatcccaactctgtgtatttcatgtcccctgcctatagaatgaaaataacaatatgatctatgataaatgtggagacccaggttgtctccacacatgggatacaaatgcttgttttgatcatctctaaacatcagaaaaaattttaactctttatgaagtttaagttttgtagaggtctcaattgttgggattaaattcttctctttaaaaactctgtttgtaaaagcaaaatttagattttcagtatcagaccattttagattctccactatgtcaacctaattgttgacgtccattgaagaacatggagatcagcaaaagattctagactcttattgagatgattatgttgcaatttaaatcatcccatatatgggaagaaggtaatttttattaaaaagagtaagccctctctatgccatgataatagtgaattctccttctaaatctgtatgtaacaatgaataaacaactcagaaggtgttgatctgacaaggaggcaaaaacacaaagtatgcacatgtgacttagttaacaatattccacaatcttccaaattcactggacagttttcagtgccaaagaagttcactaacattttctgaaatgttaatgtatcccaacagtttatgtatcatacacattaaagtaataataaacatatgttaagaccagagtactgctaacctgccccaaacaccacatttctaagccacagttttgttacctgtaaagtgggagaaaaataaaagacaacctcagaggagtattacaaggattaaatgaaataatgaatgtgtaaatcacaagacattattgaggtgttttatgatttactttagcagacttacattgagaagtaacttttccaacatccaaaagtaagcaaactaagcaaggttaaaaattgtgttgtgatggtagaacaatgtctaaggaaagtttcatttaccacacaggggaaagtccgtaaagttttctttttctgtctcattagctagcccttaatcccttccctcacccaaacacttcaaatcaaatctgattgcattactcttgtcttccttgttcttcttcctctatccatattttccagtgtgactcaaccaacttgttatggtttatttctgtccttcccttgactttactccaacttacccaggtgacaaaaataaagacaggaaagacagagttctccttataatatatgaagagaaggagaaggaggagatgcagggattttcacaaattaacatttgtccatatatatgtattattgtatacatatataataataatatataattatacatatccagaggctgtataattataatatatataattatatatgtatataattcatatatacccaatagtcatgcactacacaacaacgattccatcaacaacagactgcacataccacaatggtcacatgagattataataccatatttttactgtacctttactatgtttagatacccaaagacttaccattgtgttacaactgcctacagcattcaatacttgaagcactcagtacaggtttgtagggtcggtgcaatgtatgccataccatatagcctaggtgcgtagtgggcataccatctaggttagtacactccatgatgtttacaccataatgaaattgcctaacaatgtatttctcagaacatctcctcatcgttaagcaacacatgactgtatatatattagttgatataaatgaaataacatgttattattgtctatatacatataacatgtaatcagtcattacaaaacctgagacctggtaagcatccattatattgttattactatgattattattaggagagacagagcatggagggtgaaaagaaggagagactgtgctgaccttttgcaggaacgcagaggtggttagcagtctgagggagagaatctgaactgagtctttcctttaaggaaacttgggatgtgttgataaaataaaatgattatcctttttgacaagcatttcagggcaggctgggtgaagtacagacagaccatacctaagtataagcaccaggacagcctgtaattttacttaaaatagcaaattggtctgagattctgtatatactgttttgtaccttttagtttttcttttaatcctgctctatgtagatactttccctgagctattttgatggtaaatgttggactctgcttttctcatagttaaaatagtattcttttaaatgggaaaattagtgaagtacaaatcaatctgtggatatactttcttctcaggtgttttttttctcacctctaggccagtatctttaattaaatttcaccctataattggtggcctttattaggggtgagcagtggtgacaatcatatttctcacagaatagtcattctattgtttgtctagtattttaaatatgatgttacctagtcttaccctgggtgtctcccacagattagggtttgttgacacttgtccccaagattcctcaagctttcttaggagggttaatattatcatcaattctgtctgaggatggcaaagttagaatcaaagggagtaaattataatgatagcacttcaagtaccagaataaacacatagagtcacatttttgggttgggctagaggggctcattcagtgctcctcagctagcatcagccaacatcttctacctgggcagtaacatcaactttgtctgccaagaacaacctacttatctgtaattgatttaaattcctcctgctgaaatataatcccaattcttattttgtccccaccacttaaacaaatgattcaggtcctgtaatgccagttaagctgcaatacatgctggaaagctaataatacatgaattaataaaagatgacacattttaagcagcagtttcataattacagataatgatgttaatagaaatgcattgtcaaatggccaatcccactttaaatgggtaccataggctgaatcccactaattgtgcaagcagagacacaagaaaattactcatagcaaagccgtgcctaagttattttgttagcacctggtaggcctttcgattatggtagcatatagtaagttctgtataatagttttctattagtatgagtgttcatgttgacaataaattattagaatattttgggggtattctactttaaaacgtaaggaagggaaatagttggtttatattcttgaagtaaaagtaagagcttattagatgctcttttgtcaacatatacagctattcacaaagtgtaaatatgacatgctttctctgaacacagctccagaaaaaataattctctattgatgagaatcagagtccatggccctgaagagaaacttgttttttaatattatagtgctgagcacagtcaacaagggagaaagtcaattttgatttgtgactttaaggatcctgccaactgaattcataacaagtctggtttattggattgtggagaatcattcctggtgacagagtattttcaagtaccaatttgttatgtccagtgctcaggttctctcattaaggaagggcacataagtcagatcttcctggcttcaaaatcagaaattatgctgattaggatgtacttattgtaccaccttttactcagtgagtcaaataaaacgagtatcattctcaaaagcatgacagtatttcaaaaagtggggcattcagaaggtaaagaatttgtctcatctatgagtctcctatggaaatatggcaactatgccaccaattctcctcactaggaagagaggcttgaaaatcagtgatataagacttccacaactccctctctgaaatggattatcagaattttctttgaggaagagaacaatgaaataaggtctccaaaaagtaagatgcaagagaaagtatatttgagaaagagggaacaaggtaaaattacaattcagaacaatcaggaatttcgaagtagttacatttgcctatttttgcttctgttgcctgtgcttttgaggtcttatttaaaaaaatatttgcccagcccaaggtcacaaaacatcgtccctatgttttcttaaataatcatgataagtaattaattaaaaagtaacaaaaagttaacagtaagtatttaaattaaaaaaagaacaacgaggccgggcgcggtggctcacgcctgtaatcccagcactttgggaggccgaggcggacgaatcacgaggtcaggggatcgagactatcctggctaacatggtgaaaccccgtgtctactaaaaatacaaaaaaattagctgggcgtagtggcgggcgcctgtagtcccagcttcttgggaggctgaggcaggagaatgacgtgaacccgggaggcggagcttgcagtgcgccacagcactccagtctgggcgacggagccagactccttctcaaaaaaaaaaaaaaaaaaaaaaaaagaacaacgagagaatagtgagggttggggtttggtggggcaggggcagataaggagtattgttgcttggctccttcctaccagggaattttcatccagaggctgttttaaactacccttggctttggagaatggattggccaatcacattcataccaaagccattaaccagtaatggaaagcatggcttcaatccagctggctgttcattctaaaactgattgggctgtgatctgactcaactagtcaattccaaaaaagagcttcacatgggtgtttcatactggcaaatgtagcctatgtaaaaatccccatggaatgaataagtgctagtttctttttttttttttcattttcatgtctatatttcacattgtcttcaaaacaactctaagaaataaatcatgcccatctttggagacaaggaactgatactcaaggagaagggaagatgcaaacagagccattcagtcatgtggtgagcctggaacccaggctcagctgtcatagaacagttttttctgctgggtgtttgaagcccaggggtgtatggcagtgcacccggataacaatttttatttctatgaacgttgggatagagttgatgctttggggagacatatcacatctgcactgtggccataagtgctagtttcaactgaacaagctttttaatttagatacccgtcttctagacaaatgctaaattaactatataattgctttatactgaacctagctggggctacctattgggatgctgtaataattgttcaatagctgcaaaggctattaatgttcagaaataacatccacctacattccacccatgccaaaagctcttctctaatagctgtatttctgggggtggaggtcagaaagcgtcatgaaggttggcttggaaaataggttggagaatggttctattaacctttagtgcttgtaaaactcttatccagttcctgattcatgtctgattatgatcaatttggtcatgttaatagagttgttgcccttttttactcattgctaagcattaataagttaacagaaaggcagataggaaagaggtggttgttagccagggtaaaagactcagtggtaattgaaatgaaatgaaaaaaataatttgagagaaaaaaagacaaggccaagatatttaaggagctgagaccaagcatcttgtcaatttctctttggaaaatgttaggttttcatgttattttcaatatcaaatcatgtgggattaaaagagagaaggaaggagggaaaagaggcagaagggtgagagagagagatttgttcagagagacagaaccagtacactcacaggccctgtttgataacagcatattggaattcagatgtgactccatggagtacaggcaccttgaatagcctcttcatctaaatcacatgtgtgagccccagaggatattgcatttaattgccaagattgggacggaggccttaaaatggcccaaagaacagagcaggaggaggaagccattacagctatccctctctgcaaatagaatggataatatgttggcataaagttacaatttcttcctgtatctgcttaggtaaggctgacaaataaaactagcgtaaaccttcaaacctgggaggcaaacagttatctcattaaggcaaaggccattaacttgccatcatcatctggttacatgctgtgctgtgaataaattaaattcagatttagaagcattctggctattgttggctgacatgcaatataacagtacaaatgccaccaatcattcatagaccaaaattatgggggacaaagaaggaggaaagagagaagcctattctcaggctctggtgcagctgtaactgaaagcctcataacagctcttaaacaccataaagagttaagacataggctataatttttccctgatctctaggaccaaaacagacatagaaggtgttgtgaaatcaatgcatctgacaagatgctcttgactgggacctgaaccccacctctcccatcattcctggatcctgcagagttgatacaaaccagaaacccagttgacttcagcatgctgagaaggatgaaaaagccacctgctcttgaataggagatgtctgaggccaagctcaaggcagatttacttgggctgaagccatctttcttcccacatcccaaactggcatctagccaatatggcaatcatctgaaaaatgcctcggaaattggtgccaattaggttttccaaaagtaactaagaaaattgatagaattagagagcaaaataaatcttacaaaatacctcttgtattgtaaaatcatatagaactagcatactggttgcatgtagcctgccttaactctttttggaaaagttagcaaataaataaatacataatttatctaaaacggaacaactcaattctcctttctaactttcctaacttctcaatcatacaagttttgagtcatccttttcttctttccctacctcttttttcaccaagtaacaaaatctaatgtatgcctttaaatagaggagaagctcagtatagttaatgaatggatgagtgaaataaatgaatgctattactgtgtttaaaacccaacaacaaagaaagataatactcacttcccaaacttcttagtatgacatttataatcttcttaaccttggtccaatacatgtacatacacatttttaacttctcttctcccctaaaagaatcttccatttcagtcagacccaaatgctaaacatgcacacctttccctttctgcacctgcaaaactttctgtacccacactatggttccttgcccatgatttttccagaaaactttctatatccatgacttcactggactcctacgatatatatagtctctattttcacattacatttcaccatttactccttggcatttctgtatattattttatctattatcatttaactttgtaatgaatgttctcattctcctcaaaagtacaatctaatattctttcaaatagaaaaagatattacactcactgatatcctcatagcaatttgcattaatgcattttataccaaagctcagaaaaaaattttaatgaatgactaaacaagattgattttgctgagaatgtaaagctgaaattgtaaagtatagcttagagcatagtcagtggtcaaatttcataataactttctaattttctaaactatacagacttttctaccattttcggtgacaccatagattttcacattcaaaaattgaaatgcattctctctgtgtgtagcttaatttttattgcccaaaagcagactatgagactaagattttagtgcaagtagtttatttgaaaggtgatcataaaaggaccatagaggaggtgggcagtgagatagggaagggaaaaagccagtgtaaagtacactgataagcagaataacattgtgagaagtggggttccatcctactgggaatacctaggacatactataggagtgcctcagagttatctcacctggagattgaggagactgggatattcatctaccaatttcctgttactggttaaggcccttttctgcccttactctccaaccacaggaccttgcattaaaaagccattggtgggcataggaatggggggcgaggaagggcatataagcagtacactaatagtgtctgctatatcttaaagcataaatattgaagacaccacctattacctcccctaacaggtagatggggaggtatactgaataccattataattttaatgctaaagaagacatcaatggctttctctggagtagtacacaagagaacagcaatacagtaaatacatctacacactggaaacaaactgaaagaaaaagtgattctgtcctatgaagctctattccttgttctatcttcaaagctgcccttggttttggcttgatttcaccagaaacaagatcatgaggagcctggtgaaagtaagaaggaagaacagaactgggagggtgctgtataaagactgatacaagaagagtggaaaacctgctgattttcttgcaagtctgaattgataggaaactaacattcacagcatcttagacacaaaagcttccagccaggtgatagttattttatctctaaacaagcttctctgctctgtttttcaaaggtctccaagataaaggacatggattttaattagcaagtttcaattgacagagaattaaaatttaatgttctattcatcaatagtttaaggatgaagtttcccagtagtgcctgggaaatgtggctgtcagagctgcttacagtttacaaatactttacaaaacttacaatgctgatagaagcagcttgaaagtttcctccaagtacacctgaatttaggtctctctagtagtaaagaaagaggcaagcttactcttttccaatttcactctcatcttcccaagaacactttacttgttaagactgtctgtggaagtttcttatcagtgacacattttctaaatgcaggtctcctaagtccccgggctgcctcagataccacctgcaggtccttctccatgatgtatatagtgaggggtcacacaaccccattctctcctctacattcaagggattctatacgcagagatggacaaaagagaagtaggaaaggggaaaagaaggagatggattgcagcacagataatgggaataatggaagcagaaaaaaaggaggaagaggaataggaggctgattatcaaagttggaggttgagcttcctgctatctctatgcctaactgagaagacactggagtgtcatgctgtatcttcatctctggtttggaggagttctccaagccaggagcagtttcccctggtgtatgtgtcagaggaaataaatggattctgggaaaacaatgttcttttggtacatattgaacaatttttactctagagtggactcttcaaaaaataccaaaggttcaagggcttcatacacctcaacgtaacctgagacatcttagtcaaaagcagaaatggacaagtaaatttgtcttttcttttttgactcctgaagtacaaaagtagaatgttttataagccagtgaatttcctgctaccaggaatgtttggaatatttgtcataagatggtatttgaggaatattttaaaagatctctgcttgaggagggagatgggattctatttacaattcaactcgatagacatttaagtgcctctgattgcaaaagtgaacacaaagctgttgctgatgtcaacaaggcaacactctagcagaaaagatgggtatagatgactgtggtaacaaaagtgttatgcctaaatgtatatgcagagaggaaaagcattgacttttcaagaatatttaaaagcagccccaaagagaaatagagtgattattttgtctggtagatctgagatctttcctctctcttttttttttttatgttggatgtccacccctaatccttggtctcagcaaagaacatgatgaactcacctactgaaagacattgaagggaaactggaccctaagaactagctctccatgaggttcttcctttcttcacatttgtcacttttttgctagccttcagagagcaattttctttaaacaatataatcagctgattcactgagcagtaagagaaaatatcatcttcttgttggattggaggcttcccaaggcctacttgacccttggagtgtaatatttacccaattctcaaatgaggggaattttgtgtgcatgttgagaaacaggtatcttgattgccatactttcagctaagtcttgttttctgctcaagggattgctttccttactgaaataaaatcaaggaccccaaggtattggtgccagaaggaggagcttcatggtgaaagcagactgaacagccctgattctgtctcccaaatttgctccttctttgctatcctcacctttcaaatttagctgatgttgtctgctcttaaattgcttgtataagtttggatcagaccatcttcttttcattctccttagtcctataccatcaggatttcaaatgtgcagaaccttactgaatactaaggaatggcaaaggggaactgattcaagaaaaatctgtatacataaaggaatactagttagattttcacaaattttgaaggaatgtttcaaaaggaatgtttgaagtgatctaaactttataagcagagactataaggctttcatccagggaagcccctaaaatgaacagtcaatgatccctcagagcaggtgcaacttggtaccagagacctatgtgcgtgctgttaagtaggcataccttagactccaaacaaaacaaaacaaacaacaaaagtgtaaaaattctgtcaaatatgacctccaaatgaaaaatcacaaaagcagatgcaaaggcagggctacaatacactcaagttgcccctctgcacccatgagcatttctgtataatctacttcaaggtcagtgtgggcagagacatatttacttgaacaatggttaatgatttttttgtgcaatgctggcaagctcagctagtatcagaaatttgaaagcatttccatttaaaagaacacacttctgaggctcccatagctaactctagtctcaaaaacggtaccacattccattatctttctttcttgtttttcttcgttttatttttaatttacaaataaaaattgtgtatatttgtgaggtacaatgtgatgttttaaaatatgtatacattgtggaatagataaataacctaattaacatattcatatttcacatatttgtcattcatttgtaatgagaatatttaaaatctaccctcagcacttttcaagtatacaacacactgtaattaactatagtcaccatgttgtacaatagatctcttgagattattcctcgtttaaccaaaattttgtatcctttgtccaacaatccccaatcccacccaatctcccaggccctggtaatcaccattctattcttctccttccatgactttgacatttttagatgccacatatatgccattccattttctgccagaaagcctatcatattcttatgccaaagagatgattccaatgtcacaaactattggctgtatgttttgctactatgctctgtacccattctctgtctttttttttttttaatgaccgcatggcaattggtttcctcaatatctttattctttcataggccttcattcagccactcacctgaagtttctccactttgttttgcttctgttttatgatacaagaataggcagatgtgagttcaaatcctggctcaatgactcactatataaacatttatcgtggtcaagttattcacctttcttaatatctttacctcatcggtaaaattggactaaaataagtgttttacaaagttgttttgagaaataaaatagttacttatgttttatagagaggccagcacggcatctagcatgtggtaagtacaaaatatatttcctcaatggaatttataagctttctctgcctagggttgtgcaaacttagactccaatgcttggtcaggataataaattcatgcactggaaagttttgtccctgtcacttttccccagaatggtatagccagtgatttgcccagagtcactcagtccctggtgttcttgagggccatggttcaactatgtgtcctttttagactctccaaaataatggccatgacttttaggcttctatatttcaattttccaaacatccaactctgcagaatttatattcatcaacaagagaaaaatacctttttttggcatggatttagacctcccaggaatctattaagtcacacaagaacacctcaaaacaccagaactcctttgaaagttagaaatagatcacaatgtatactgagttaaataaagtcctcccaaatattaatgtccattcacaacctcagaatgttatccttatttggaaatagggtctttgcagatataattagcttagatacagtcacactgtagtggaatgggccctagatccaatgactggtgtcctgtcttagttcattcaggctactataacaaaataccataaaccaggtagcttttaaacaacaggaatttatttttcatagttcttgaggctgggttgcctaagatctaagtgctggcagatttggtatttggtgagggcctactttctggttcacagatggcacctccagctgtgtcctcacaagatggcaggtgctagctaactccctggagtctcttttataagagtgctaatcccattcttgtggacagagccctaatgacctaattaccttccaaaggccccaccttctaatactttcaccctggtgatgagttttaacgtgaacttttggggggatgcaaacattcggaccatgcctatccttctaaggaagccatgagaagacagagaaacacacacagattgaagcaggtcatgtagtgatggaagcagagactagagttatgtatccacaagccaaggaacaccaaaaattgctgacaaccaccggaacttaagagacaaatgagacatattctctctccaagtttacaaaagaaaccaattgtattagtctgttttcatactgctatgaagacctgccttcatagactgggtaattaataagaaaagaagtttaattgactcacatttcagcatggctggagtggccttaggaaacttacaatcatagtggaaggcgaaggggaaacaaggcaccttcttcacaaggcagcaggaaggagaaaagctgagcaaagggaaaagccccttataaaaccatgagaccacatgagaactcactcactatcaccagaacagcatgggggaaaccactcccatgattcaaccacctccacctggtctctcccttggtacatgaggatcatggtgattacaatttaagatgagatttaggtggggacacaaagcctaaccatatcaccaatcctgccagcaacttgattttagacttcaggcttccggaaatatgaaagcatacatttctgttgttttgaggcatgtagctcatggtaatttgttacagcagttctaggaaactcataactgaggataattgaggactttcatttatttattcttccgttaacctgactctccctatttccagtttcagcagctgaaaccatcattttctcagtttaaatatgattgacaagtttaaatgacacaaaagaatgctcatgctgtctcagagggatgatggggtcagatagcaggctaggaggcagccagagcaaaggggtaagccttaagctcacaggcaatggctgaacagcactaaagaacccagaaactgaagagaaagggagtacataaactctgatggaatgagaaaatgggaagtataaagttaggtgtaagccatataaagtgaagtgcagaaacatgccttcagaaaataaaactaaacatgaaagggcaatcctaccatgtgagagccaatgcatgcattctgaaaaggtacactgcctgtccttaaagaactgcatatagttcaaggatatttgttttagtgtattctgaaaaggctttaggatcattatcaatcctgtaataagcccaagaggaaatttcaggaagctgcagttctcctaccacattttcaagtatgataatgcaggtcttgagagaacaagaaacacagttattgtcccatatcaccattgtgttaaaaacaatgcatgtaagattgtcgcaaagaatagaatcatttaaaatacaaggtgttactactgctggtagtatggtacagtgatagatggagtctggagtaaaaaaaaataggggtcaaaattctactatgcactcactaagctatgtagggtgtgataaagggaactggtaatgaggagggagagcggttcaattttaaatgagatagtcagagtaagcatcataatgaaagtgacctttaaacagagatctgaagtgtgtgatttattcatgtagatagataacggaagttgtttattaccctcaagaattctggaactctcctggcatcttggattctgactagttctgtggaaattatctgaatcctgtttgtaatctttgtacaatcacttagcaaataaaaacataaatatccatcatacttctttaaaacctattgttacaaaacattctgtgttctgctaagtataaaatatgtatgtacaatggctaacttttttctaaaagagataaattcaggatagaaaaatatttataaggataaatgaaaaataaaatatacatttatgttgaaaaaaaaagaaaaacaagttcttaatctctagacttacccattttattaatgctggaaagtagatgtttgtgtcccccctgacactccaaattcatatgttgaaatctgttccctaatgtgagggtatttggaggttgggcctttggaagatgattaggtcctgaaggtggagctcttatgaataaggtaagtgcccttagaaaggaaatcctagagagatcccttgtcccttccaccatatgaggacatagcaaaaagacagccatctatcaaacaggaagcagcctctcaccctctcaccaaacaccaaatctgccagcaccttgatctaagatttctcagccccccaaactgtgagaaataaatttctgttgtttaaaagccactcagtttattgtagtttgttacagcagcccaaatggaccaagaccattaagaaagatcatttccctactgtcttcttactctttttaaaaagggttggggttttatgagaatacattagcactaacaggaaaacatacatacccaacccatatgagtcaatggggcataagagctttctgcaaaaataaatcttgaaaatgtttttgctactttataagtctgaaaaataattcaagccactctaaacccttgaaattctgttggataatgaacttaaggagctgttgacatccatgtcgcctggtgtccacacttggcctcatatcagacagccactggaaagcgatttgcatgaacatgtatctgagaaccctctgttttatttttaaatgataacaaaagtaagtacaaccatgatagtagcctactaataataaagggagctatttatacatttttaagtgactgtggtagatatagttagctatcaacatgaagttcttgtaccttagagatggcatgtcactgaaagaaacagactccaggtcatgggagttccaaatctcctctcagatgattggaacccaggagtacacccttccccagcataacctgcatgtagatgcatagcccactgctgagggacatgtacctgtgaccagcgcctcagatacaatactgggaggacatctgtacttaagctgtctatattcaagtgacctttgctctcagagaagtgggactatattcagaatggtgccccttaacatatttcacataaacccctttcacctgctttgttttgaaactttcccatgggactagggttcttaaagctgatgaggtacatgaaaactcataccataacaggtcacccgttagaacaggtcaatggagaaagatgagcactgagaaaatgcggaaagactgggccttccctatcctctgtacaccattgtgtttcagctcactctccacaaaaatgatgtcctggagttctaagaaagaaaacagtcatagagcacagaaatacagggctgcgtgttactggatgtgagggaaaactgtagacatggggacaaagaaaaaaatagaagcaccaagtttaacttaggggagaatcaaccatcattatggttgcttgagacagaacaatgatttaaaagggagaaactaaataggagttgttactggaacagtgtttaacctgcatgtgttttccctactccctcatcccacgcctgctaatgtcaatagtgataaaaatgagctagatggaagagggttgaaggtggtcagtgtaatactttagaaaacagattcatgtatgactcaaatacctgaagctttagggattccataattaaagaacagaatatagaaggaataaaaaacatactgaacagcccaagaatctctagtaaaagtgaaagattagacagagaaacagaaaactggaaaataaaaccagaattagtgaaaatgtaattctgagagatagaagggatggagaaatgtgaccaggctgaataggagatataaaaagccattcgtttaccttgataagcaaaagtgtgtcaatgacaaggaaagttggggccaaaattaaaaagttaaattattttcattcaataaatgttcattgaattgtcaccctgtgccaggaactgtgttaagtgttgggaccaagtggtgaacaaaacagcggatttaaagtgagtggccagggcaaagggtcaggtcatttgacactaatgctaaaatcccatggaaatctgaatgcttttcttagcaccttgaggtcacagaaaactaaagcagaagaaatgagctgaaatgaaaaataagagttcagaagaaaaacactaaaaggcatctgtttaagtaaattacatttatttcaggtgctacatacacatttgaaagggaaaagtccttgtgagaccctgtaaaataatttacacagaaatattgagtgatattctgtaaacatatgcaatctacgctacattttagctgtacatttttaaattaagagatacatttatttttcttagagtatctattcctataacttatttccttatgaaaagcatgttttatttagacattcctatagaatattgcttgattttctttttctctcttgtctgtttttctaagaaaaatattttccttcaatgccaagtactctttcaagggtctaaatagaaaaatagtagagttatcgatcaaagaatcccttctctttctgagtgtcttcatctacatttaaggtttgagaagacaaatgacaaacatatttttagacattttcatgtttgaacaggttaggtggggttcatattttgattcttcctaatataaatgtcattcaggctagacaaaaggaaaaaaatagtctccaggatttcagaaatgttattttaaaaaatcatccaaatcaatgtggcagagtggcctgcttaaaagcccttcaattagatttcattgctataaatggaggtgaaaaatcaatcaagacaacctgggaccaaatataatgccacaatgaataaatacttcattatgggtccagcctaatcttgctaatttttaaagatttgtacattcatgtgacatgtcaaactagcatcacactgctcaagtccctttaggatatcaataccaaattaatattcctaaaataacacacacagaatattaataaaatttcatagctctggcctcagaactgccaactagatagccagcattgtctcttacttcttcctaacacattccactcagttccatcagagacacatccctgcaacaacttctcaatcaaccattaagttatttctctgccaacatcttcagtcaacactgtcaatctacttgtcagatttatatcacttcttgcaaactttcttttgtacccaacttaaggattgctgccattaagtgtacaatcaagcaagcgataaggatttactgagcatctattctgtgcttgtcattgggctaaggagagggaaaggagaaattattagataaagataaatcctgcaaggagctaatactagcgttcaagataaagcaccaagaaacaaccacagattaagatcatgtgtaacaaagggcacagctatgccttgcagagagaaaaggaactacaatttaggagaccttttaaacctatgttttccacacaaagatatgcgtatatagaatataacataatggttcccagtctcctctgggatatgattttatggatgctagtgttcccatttgtgttgcaaacctttcagaggcaggaaatgttcattcctagcactccagtgtctatcatattggtgactatgctgttaattctcaatggtgttggctgaattttaatatcctttacctttgatcctgttgaactgtacataattcacagcatgtataaacagaggtgcttagatgtacggtctaatttggatgtgtgcagttaatacaaatgtgttcctcatcttctgtaagtatatgggcattatcatatctatattttttaaagtcagagaaactttagagtgagggctgtcaaataccagtgtgaaaattccagagtttatcacagctcatcaacatttatagcagagtacctggcatactgaaagacaccaagcagtttatgtatgacatctacttttgtgctattgtacccttggtgagcaggaaattaagtgtgtttgcacacaaataactttatctagtgagcactcattattctacaagaattgcaagattcattgccctttttacaacgtcattatgaatttataaaatgcaattttacttgaaatctttgatacttagatttcacatattttcaccaagtggcttacagtttacattctgtaagtattttaaaattcttgcttacgaatgtgcaaaattattggaactattctttcattgtttgggaattgtgaattttttttcttattactattgttgcctaagtgtttcatgtctctgaagctataacttgttataaattataacaaatttggtataagattacatttttatattttagaaatcaacaatacattcagaatattctcagtagtgttgaatctttgtcttgcaacaatttattattttctgataggacccaaaagttatctggactacatgtggaaaatagaataaataatcaaaacatataatacattttggtattacattggtttattggtaaataaactaaaaaattatttctaagaattggaacaggtttttctatgtaatctataaactgacacagcagagaaaatcaacaggggtacatcagtgtaatatgcactggaaataaaaggaagagaatcctaagtttaaaaaaatttctacaggaacaatgtaaagcatgactgaaacattttttctttctttctttttttggtatcctactaaagatcagaaaattatccctcctaccttaaaaacctataaaaggggagaaagtgtaatatgattttttgaagcaacaattctccactgagtcactgcaatctgtttcatgtacacttggaattttatttttctctcctccataaagtgtgctacaaaaccatggtggtttccttctttctaaaatgctgggttacaggagcatttgtcatcactgcctcacttgttaacctgcactgatatttctacatttagccttgtttttacagtatttcagaggtgtctgatcatctttcaaatgattaggtgagaagaaaatcaagagagagaaaggggtggtaacaccatataaggagtcaccacagctacttgaatgtgagcaaatgaagcagcttattctgctcccaaatcgtagcagcagaccaaagcagtatcacggtcagaactcaatcagactctgcgttgacacctcagccccctcactcccatcccagggaaaacacattagaaattgagttgtgataatttagtcctatattcctatgtttccattaagagactcaattttaatttaggtatcaaatctactcaacaagcatgtgccctgtaattgacaccttggttctacccacagtcctgaagaaataactgtatgaaaacctctcccagtagcctgaaagagccggaagctcacacgtgcactcaggctaggttttagaaaggcgtttaatctaggcagcagatgtcatacctctgtaagaaacatacatagttacaagagttgccatattcaggaaagcctaaaactatgccacatcatatagttgcatatagggttgctcctagtccagattcagtttagaaatccagggtcattttatcacaagcaattcagcctaaaaacatagctaacattttacacttatcagattgccaagagaacagaactagtgagctaacgaaaggtcagattctgctgcagcaagggaaatgggtaccaacagaagtttaaacgtatttgcaacacctgtgagacaatccaatggagatggtatgttggcatttgggtagtcctggaactgagataattaatcttggctggaaatatacacttgggacttattttcatataagtatttttcaatactataggagtaattacctcatctaaagtgagtagagggcccaggataaagcctaactctaacattttgaaatctgatagaagaagagtggctcaagagctaggagaaacatccatgagagttccatgtagcagaagcctgtagaataaagtgtcttcttaaagaaaaataatggctataatcccagctactcggaagcctgaggcaggagaatcacttgaacctggggggcagaggttgcagtgagctgagatcgcatcatttcactccagcctgggcaaaagaatgaaactctgtctcaaaaagaaaaaaaaaagaaaaagaaaaagaatgggcccaactttgaaaaatgatgctgagatgagaattaaaactgcccattttctttgtcttggccaacctagaattatcagtgacttagaaagaacatttttagtagaatgagagggcaccagctagactgatttgagtagaagaattaatgaaaagtaagaaaatggaaatagcagatgcaggactgacagtgggagggcaccagctagactgatttgagtaggaaaatgaatgaaaagtaagaaactagaaatagcattatgtaggactctgagcaaattattctttgagtaaagtgactgtatcttttataatcaattgtatacaacagggtaatctcacctaaccattgattccacctgtattcatcagttctggctactataacaaagtaccacagacttggtaccttctagacaataaaaatttatctctcacagttctgaaggcaggaagtctgagggtgccagcatgactgggttctgctgagagccgtattctgggttacacatgaccatcttgttgtatccttacgtggctgaaagtgggcaagggagctctctggggtctctattataagaacactaatcccatttgtgagggtcccacactcatgacctaattaccttccaaaggcttcatcttttactaccatcacattgagtgttgggatttcaacatataaattttggggggacacaaacgttcaatccataacaccactttaaaaagaatataactgtttctcatgtaagagattcatatttctggtctttgattattttctttccattactaattcatgtttacaacttcttagggatcttcccagaccttgcagagttgggtcagaggctccacatcttccccagcactaaattaccataatataagggctaggagttctcactgtggcagttgtcctcatattgctgcggcactattttttttaagcttctttgtgtcatgcattggaattcactacgaatggcctttaccttccttgtttccttcttttctgccaatcatagcatcactttcagggctacctttcctctttgaaaacttatcctctcaaagggaatttggtctcctacatccttgggagctcaacaaaatcataacagcactttttaatgtaaatattatattaacaattatgctacaggcattactagacactttctgtcagttttttgctgactaccttagctaccataattgtactgtctaatttatctaattgccactcacagaccactccaacctcatacccactactgattataaaattatccttattcaatcatttagtgtgatggaatccctcagtctgccctgactgttcatttactagtctgctttaatctgaagagctctgtaatctatagcctcaggacagatgaggagccatttattgagttctcccaattttggttgatctcaattacctacttagttaagctcttcaaagattatattcctaagaaataaacatcagtgagttccaaactcttttgactgtgcaccgctatcggtagacaaaaatgtacttacatgcactattgccttgtgcactgagaacggtagaatgcatatgctgaaaatagagatcagataataagataaaattaatatgggcattaggagaaatacctaatgtagatgatgggttgatgggtgtggcaaaccaccatggcacatgtatacctatgtaacaaacctgcatattctgcacatgtatcccagaacttaaagtataataaaaaaattgaaaaaatatctatggtaaagttttcttcactttcaaaagctgtttctgtttttcctggttattgtttaccttactcagtagaggtgtttctaatctgaagacttatgtcttcttcatggtgaattctcatccattatctcattaaatactgttatataccattctctgtattttctcctttctgaattcatagcatatgcgtgctggactttctgaatctatcttccaaatctcctctttcatagttttcatttctatatctttgtgttgtgttcttccatttcatcattccttcttcagctgtttctgatcttctattcaatgtatattatgtttttatttcaataactactttattaaattctaaaaaatgtagtggtcattttcaaaatatctgcttcttgtttcatcatcccttgttcttattttgttatcaactgtacattttttgggggtgttctcattccattctttcttttaaaaattattaaaagcatttattgtaaaattgtttctgattgtttaattatccatattttggggagttggattcctaagcttgctaaacgtatgacatgtttttcattattttggccttcgcagttattctgggtttcttgcatgtaaagacatctgtgtaaatccacagtagtttcatggaggcctcagcattggctatgtagcactgtagggaaattcagcttaggaatatcactctatgtctctaatcttcagttcctactttccccactagttcttgtctttttttttttttttttttttttttttttttttgcatttctacttgtattctccagagatttctctttcttaggatttaacaataattgtgtgttaattattataagtatgtgcccagtctttttcatgaatttaaagcagatggaagataattcagcatgtgctcaatgttcaatgcattctcttgaatcagaagcctttccttggttcttgtctcagctttgctatcagtctaataatgaaccaagggaataaaagaacttgaggttgagtagtgaagtgactcagagtctctttagagatctccaactactgcatattctaagatgatgctctaagcaggcatgggggccagggagcatgtgtctgcggtctgaaaactggattggccattatgaacatctattcttagctctgctcttgacttttgaaatagtctgaagtaaaagctgctgtctcagctcccttattgatgcttcttactaacctcaaaagacctttcccctcagttcaatttcagaatataatctgctatgaaattaaatgagtttttaagccccaattttcttaactcacaaaacaagatcttagctaagaaaagaaactatctaattacgtcatttttaccttttctcactttatcctttgcaaacacaaagagaaacacatttcgtttatcattttcccctagatctcattaaccaacagtggaaaaaagtattgctttcttttatgctctcttttccaatctcctgaagtgttgtagtctccaaatagattaaaaattttatttaatctttaccttaaaatacaactgcttaataaaaacagactttaagggttaaaaattgtttttaaagatttaattaaaacaatttttcaaatatgtaagaaaattgagccctgaacagaaaaagtacattaaaatgcttataaagttaataattgaatctagttagcaatgtagggagaaaaatcatatgtactataaaaatgtgagtattacatattcataaaacaggagaaatgtttttcttttcttagtttatttaaaaaattattattttattgaaaaatcataattgtatttacttatgagatacaatgtgatgtttttatatatgtatacaatgtggcataattaagtcaagctaatcaacatatccatcatctcacttagctatcatttctacggtgagacatttgagatttattcttagtcattctgaaatatgtaatacattattgtctacagtaactctgcttgcaatagatctcaaaatctatttttcttgtctatctaaaattttgtccctttgatcaacaactcccattccctcactcctccccaccaactccctgcctccctcagcctctggtaatcatagttctaccctctaacttctatgaattcaactttattagattcctcatataagtgagaccatgtggtatttgtctttctatgtttggcttgtttcacttagcattatatcctcaagatccatccatactgtcacgagtgacagaaatcttctcttttttaaggctaaatagtattctaatgcatatatataccacattttctttatctattcatacattgatagacacttaggttgattctatatcttcgctattgtgaatggtgctgcaatgaacataggagtgcagacattcctttgacatgttggtttcagtttctttgaatacacatataaaaatagactactggattgtatgataattggaattttagctttttgagtaacctccatacaattttccataatggctacactaatttacatttccaccaacaatgtttaaaaattccctgttttccacatcctctccaacacttaactttcatcatttttgttaaagccattctaataggtgtgacgtgatatgtcaatgaggtttaagttgaatttcctgaatgattagtgatgatgagcattttctcatattcctgttggccattcatatgatttcttttgagaaatgtgtgttcaagtcctttgtccattttttaaagtggttatttgttttcttgctattgagttgtttgagtttcttatttttttggatattaacctcttaacagatttatgatttgcaagtattttctcccattctgtgggtcatcacttcactttgttatttgtttcctctgctgtgcagaagcttgttagtttgatgcaatcccatttgtatatctttgcttttgttgcctatgcttttggggtcatatttaaaaagaaaaaagcattgcttaaatcaatgtcatgaatattttctcctatgttttcttctggtagctttacagtttcaggttttatatgtaagtctttaatccattttgattgatttttgtatgtagtataagattagagtctaattgtattcttctagatgtggatattcagttttcccgacaccattaattgaagaaatagtcctgttcccattgtgtgttcttggcagctttgccaaaaatcagttgactgtaaatgcatgggttaggaccttggttttctattgtgttccatgggttgatgtctctgtttttatgcaggcaacatgatgttttgattacaatgactttataatatgttttgaaatcaggagtgtgatactaccagctttattctttttttttttttttttttttttttttttgacagagttttacttgtcacccaggctggagtgcaattgcatgatcttggttcactacaacctctgcctcctgggttgaagcaattctcctgcctcagcctcctgagtagctgggataacaggcacctgccacctggcccagctgatttttgtatttttagtagagacagggttttactatgttggctaggttagtctcaaattcctgacctcaggtgattcacccaccttggcctcccaaagtgctgagattacaggcatgagccactgtacctggcccagctttgttctttttgcttaagattggtttggctatatgggtttttttgtggttccatgcaaatttaaggacatttctccatttctatgaaaaatcacatggaaactttgatgagaatttctttgcatctgtagattgcttttggtggtatgactattttcacaaaattaattcttctagttcatgaacacaggagatctcttcatttatctttgtctttttcaattactttcatcaatgttttatagttttcagcattcaggtcatttacctccttggttaaatttacaactaagtatttaaattttttgttgctattgtaaatgggattattttatttttctttcagatagtctgttattagtatatagaaatgctatttagttttctatgttgattctatgtcctgtaactttactgatttcatttaccagttctaacagttttgtgatagagtctttaggattttttatatgtaaggttatgtaatcttacatataaaatatagagacaatttcacttcctctattgctatgagtatgacttttatttctttcttttgcctaattcttctggctaggacttccagtactaagttgaaaagaagtgttgaagagagtatcattatcttgtctctgatcttcgaggaaaagctttcaaattttcaccattgggaatgatgtcagctacaggtttgttatatatggcctaacggtgttgaggtgcattccctttatagctaatctgctgagaggttttatcatgaatagttgttaaattttatcaaatgttttttctgcatctactgagatgatcataggatagttatctctaactttgttaatgtggtatatcacatttattgatatgcatatattgaaccatttttgcttcttagaaataaacacaatatgatcatgatgaatcattcttttaatgtatttttaaatttggtttgataatattttgttgaggatttttgtttctacatttatcaaggatattggcctataattttcttttcttgtagtctagctttggtctcgggtcatgctatctaaaatgagtttggaaatatttcctccacgagttttctggaagagcttcaaaacatttaatattagttcttctttaaatgtttggtagaattcaaccatgaatccatctggttgtgagctgctttttttttttctctcaagtgtttcaatcccttatttgttattggtctgttcagattttctatttttcatgattcagtcttagtaagttgtattgtgtctaggaatatatctacttcctctagttatccaatctattgatctataattgtttgtagtagttttatgatccttagaagtaattagttttttaaaaaatgccatcaattaaataataaatgggaaaaaactaaagtgtatttatatgtgtgttatgcttatataccattgtggtaggcaggcattctttctgtattataacatgctagtggtgttttctttactttttaaatggtgtgagcaataaattcacctagcatattctttcacccaaattaaagttcttaggtaccaataaaggttatccacacatttgtcatgtatggttttaaacaccttgcctctcgtgagtgagatggagaatgagaacagtggggtcaaaagtgatattgggctgataagagctagtttagaaagaactcaacaaaagcctctgaagtgtgatccagaccagcagctctgtccagtgattttgccagctaaggcattatataaaaacacacagtgtggaataaacttagaaaacacagcagattaaatatgcatgtttatctctatctccttcccaaacaaaggggggtggcagttaaaaaaccataagaattatgatattttgaaagaagacaaagatacatcaatgaatatctgaaacataaagagtagatgaacaaatgaatggtaaatgacttagaagagcagtagaagctgttctactgctctccagaagggtctggaaaggagaatactgatgaaaagaaagacaatcatttcagacagaaatctgaaaaaaacataaggtttagaagcaccaagtatcatggaagatgcaatgaggagacaaggtggaaattagtagagcatcagtctatgattcagatcagttagatccacatggctcttcctccagcccatacaactgggcaggaatttttccccctaaaactgaaaggagaactaaggttttcctacagagaagttgatccagaaggggcaggcataccatggaaattgaaggtggacaaatgccactaaacagtaaaaatgtctgctcttctattggctgagttcctagtaaaaatgtctactcttctattggctgagttcctttaatgctagaagctaaacaggaaaaagactagaatattattttctgggtagtccaaagaactcctgagaaaaaagaaaagaaaaagaaaaaaataccttccaccaaacaactggggagatgtctaccttagtaagcagatacatttgccacctgatctgccggcagtgagtcccaagagttaataaactgcattcccaagtgcaccctatcaaagcaagccagaaatgaatagtagttaaagtgatgaaaacaaattttactcaggaactattgcaactggggaaaagagacctcagtatagaacttggctcaattctaaatttatcatagataactgatgacttatagtcaaggagcagggcaggggtcagtgtataaaaaattatgaagaggggagaggggtagaacaagatggaataatagaaggctccactgatagtaccctctgcaaggacaccaatttaacaactatctacacaaacaaagcaccttcataagaaccaaaaatcaggtgagccatcacagtaactggttttaacatcatattgttgaaagaggcactgatagtcttgaattgccaatgccacctttccttcatccccagcagcatctgggttggtgctgcagagagaaaacccatgcactagtgataaagagagtgcaacaactgtgagacattgcactgaatgcactgcagccctgtcacagcagaaagcaaaactcggtttccctcagctgatgcccacccacagaaggagtatttaaaccagtcctagccagaggagaatcgcccatcccagtggtcagaacttgatttctggcaagtcttgccaattcaggctaaagtgctcctgtcctgcaagaaatgtgaaagaggactactccaattagaaggaaaggatgttaatgagcaataagaaatcatctgaaggtacaaaactcactgtaatagtaagtacacagaaaaacacaggatattagaacactgtaactctggttggtaaactactgtcatcttacatataaaggctaaatgattaaccaaacaaaaataataactacaacatcttttcaagaccttcccttcccttcccttcccttcccctcccctcccgtcccctcccctcccctcccctcccctcccctcccctcccttcccttcccttcccttcccctcccttcccctcccctcccttcccttcccttcccttcccttcccttcccctcccttcccctcccctcccttcccttcccttcccttccctttctccctccctccctcccttcctccctccctttcttcctttttctttcttttcttctcttcttctctcctactttgacaaccaagactccaagcacctggctcaattccagaaaaatgccacataatttaaatctggatatatttcctacctaaaatgttaattgacaaatgtaatgagttcacaatttaaagctacaaatggaatgatatacttaggcctatgacaagattctttgttgaagcatgtatgtcttaatttgttagactgtgatgcttctgccatcccttaaattttagaaacaggcagttaactcttcaagtaacaatggctacatctgatctgccttgactggtttctggaccatttggagagtatggcctaagaattgggaaaaacatctattttcttcattctctaactatactgtttttctcatgactttagatttcctggctacaaaacccagcaagagattttaaggggacaaagaagaagataaactgtgttaaattgtatgtgatagcattggaaatggctattattattaaattttcatccaagtggatttcttttaaagtccttgaataattaaagtaggcacttaaaaaataattgaacaatctataccatcatctctacataataaaataacatctcatctcagaataggcttgtcatgttgttctatttcagagatgacattgaagtaccttaaggatctgctttttaagaagcaatgatggtttgaaggtgatggtatttgttagcaacgtgctggatctttaggttggcctaaattgctcaatactcaggggattcattagttgaccaacgaaagaaagacagatcattgtaggtactaatataaatcttaagttatagctccaatgtaaaaaagataactgttttacctcatataaggaacaatttttttttgctttttctagagaacacatgatttagaaaaaactcatggttgattcaaacaaccacatcaagtttgtggctaatccaaaataataaataaaattataagcctctcctatctatattcttaacattttatatattttatgaagagatttaagtgttctactttctagagcacttttattgcctaaaaaaatctgcaagtaaagaaatattcttggtggttagggagaccttgcctggtattaaaaattagcatctaaattagccaccaagtggaaaatccataggcagataattgaggattaacagtatttcaaaataataaaggagaaattctaacatcttgggcctttaatgaatcaatttgcaatcacttttgtgctaagatttctatagcacaaaacaaagtaatgactttctccctcatacaaagtgatagcacatgtatatcctttcttggtgccaattctgagaaatgcaataagtaaactggtagtattaggttagtgcaaaagtaattgcagttttgccattacttttttaattaattaattaattaataataattattattattttttgagacgagtctttctctgttgcccaggctggagcgcaggctccgcctcccaggttcacgccattctcctgcctcagcctcccgagtacctgggactagctgggactagaggcgctcaccaccacgccccgctaattttttttttgtatttttaatagatacggggtttcaccatgttggccaggatggtcttgatctcctgacctcgtgatctgctggcctcggcctcccaaagtgttgggatcacaggcgtgagccaccacacccagccgccattagtttttatggatagaaccattcattttcaagcgtcctcagtacagagaagggcacatagtgaagcagcccacagaggtaaccccattaattaccattacacaatgacttgggttcccctcccccatccccatccttccatgtaaatttatgagaggccccttcctctttttaaatttcaaactaatctacaaaccctcaggaaacccatgagaattgtggcttgggacagtcactacaacagttactacttgagaccatcattacaaccgttactactgttactacttgagaccatcgttacgagactgaacaaagggatgaaggtagaaatgaaaacttaagacaaaggaaactgttttaaaggaagggtccaggggaagaagagagctccctgcttctagtgagcaaaggcagcccctgagcttccacagccctttgtatttattgggtagaaagggcagggaggaggaggtaactggtaggcttcttaattgataacaggttcatattattactaacaggcttcagatgtacctaatcacaagaaacactgtgcttggggtgtgactgccctctgcattcctactgggtggcagacacagtttgtcagtttgccaacattctgcatttatgagaaacagtttgctgtttactcagatagcttccaatggtatactgaattgatcatgaccctcattctttcagcctctaacatttctccctttttgtttttgaattaattgagaaaggcaattgaaaaatgtgcagccttcaatttgtacggtacaggtgggtccactaaacgccatgggttgtgacagataaatctctctcctagttgtacttccaaatccctgattctctcacttctcctttcatgaagaagggtgcaatttacaaggaataagcaacagttgagcaacatattttcccagttcaaaaacccaaagatcttgtgacattaccactactacctgaatttctccttcacaatcaaaatcaacaactcctgggactacagtaattccctgtaaattgacttttacccagaattaatcccatgtatcctgttggcaaaggtccccaaataccagtggaaatcttagtgagtgtgtctcctccaactaacgcaacccgttctctgactgggagatctaatcctgtgcttccaggtgttctgcaatccgcatttgcattctcaaaagctagagccaaagtcaaagctagcatttctgcagccacagaagaagacagtacaagccaattttcatcctccctttcctgttcaccaccctccaaaggtgctgtaggtggggcaaaaaattccctcaaaccctgaaatagtaacaaaaagatggtatgtaccaaactccaaacaaaaaagagaaaagaaataacaaaattattccccatgttaccctgattcaaaaacttccccttctttgtatctctagggcactgaccagtacctttttagagcactgaacttatgttgctgccagcagacttgtaacggggtttgtcattcatctggttgattttagttttttctgttccagcaaaccttcctcgttcaagtccctataggaccctatctgtccctgtctgtccctgcaagtttctgctggcttctgctagtctctactagtctttgctagtctctgctagtctttatctatccctatctgtccgtatggtccctgttagttcctgtgaattcctgcaaatccctgtctttccctacctatctctatttgtctctatctctatttatctctacttatttctatttatccctacttatctctgtttatccctgtaggcctcttcaggtcccttcaggtctcttcaggtctctgtttgtccctgatgtccctgtttgtccctgttcaggcgccacctgtggctgtctgccacaagtactatttgagaccatcactacgacagttactacttgagactgtcattacaagagttacttctgttactacttgagaccatcattacagcagttactgctgttactacttgagaccatcattatgagactgaatgaagggatgaacatagaaatgaaaacttaagacaaaagaaactgttttaaaggaagggtccaggggaaggaaaagagagttctctgcttctagtgagcaaaggcagcccctgagctttcatagccctttgtatttattgggtagcaagagcaaggaggaggaggtaacaattggtcagctgcttaacttataacaggctcatattattactaaagggcttcagattacacatgaataatatctgtacataaccccatcataaatccaggcaagtactgaatgcatatcactttcacatcatcataaaatagagaaatcataagttgaaccatcctaagctgaaccattgtaagttgggaacagtctgtacattatctcatttgattctcaccactttgggagagtgggcagaaaaaagtttacatagcaggcctgattgctatccttagaaaggctttattacaaggtttacctttggctggcatctaaaaacttgaatttcaggcatgtcctcaccattcccagaattaataagaatgcctcaatgtgcctcaactatttagacaaataatatggtttatgatgaatatcttcttaaccatctaggtgtctagaatttgatacatgccaggtagagtatgcctccctcatcagtccctaataaaaactgggtgctgagaatctaatgagcttttctggttggcaacatcttatacatgttgtctccatttgttgctgagaggattaaacatgttctatgtgactccactgggaaaggactcttggaagcttgcacctgtcttctcccagactttgttcatgtgcttttttccccctgatttttctttgtattctttcactgtagttaaatcttagctgtgaatgtgaccatatgctgagtcctgtgagtccccctagcaaactgttgaacctgaggttggtcttgaggacaccaacacaaagagcaattactttcattatccacattttacagaaaagaaaactgaagtacagaaaggttagggaggtcctagtgtttccatcaaggcttcaaggcttttataggcgtcaagaatgattctggagagacatggtgcttaacaccttaatcttccactgcctttgagatgtttacaaaatgtagtttccatagatagtcatgtttttctgtcaatgacaatgttcttcccatttcctgctgcaactgtatatttatacataaaatatgtaaatataaattgtttttctagccctgtgatcctgaaaaaattcccttaatctcctaaaatctggagcccatgttatatgtttctggccctctgaactaggagaaaatttacttcttttctctgggcctcagttctcctatctgaaaaatgggaataatatgttaccctaacagtatagaaatggtacttactactagtagtcattgtagtttctataatacccagtatttacttttatcttctagtatagagtttattgtagattgtcaataaacatttaaaaacaaaaacaagtttattagcatggtacaaaagaaagtaatcaggattctggaatcagaagacttagatcctatccccatacctgtcgctcctggttcaaaaaatttgggccaatttcttaccttctctgtgtgccagcatccttgttgcaaataggcctgtgacatttgcctgggttccatttaaagagtacatcaaagaatcaggtgcatattttcacagctccttggtctgaactggtacccaggatcaagatgtccctcccatgattctaatctccagcccccttacaccatagtcacttccaaactctggatttcttaacattgcagtttgcttccaaaaaaaaattaaaaaaaaaacctcatctgggcattagaagtcattctgaagaggctgtcctatatctcagtgcaatttcctacttatccactcccgactataccctgctttcatcagattgcaactgacctaatttgtaaagacttcagtgaaaagagcctcattaaaagccttcatctcttttgcagcctctctttcctccctcaaatgatccaggtcagaatggcccaataaaaatagctgggaaaattacaaagtcactcaagactctgccaggagtagagattttaagaattagtgacagacatatactgtctaggagtagggtgggagtgggttgcatggcttagggacatagaaaatgcctgacaaagtatagcaatggctaactactattccaccctcatctcatgataggctggccatgtttttctgtttcagagatgacactgcagtgacttaacactttgccttttaagatgcaatgttggtttaaagatgatggtatctgttaccaaagcgctgggttgttagagagttgatctttagcttggtctcaattcctcaattctcagaggatttgttagctgagcaacaaagggcttgacatagatactaaataagcaaccataagtaataataattcatgagtttaaagctaaaaggttttactatggatatcatcaaatatttggtcccttaccagaacatataatcatacagagttaacatctagattttaaaatcttaatttaaataactgtgtcacttttctagaagccatcactcctataatattaattatctaaaacatcattaataagttgaaagtatatgaaataggaaggcctttcagtgattaaaacatgtcataaaatgtatttactaaagctgatgtactttacttaaacgtttctcaaagcctcactcagagactatttacttctgttttaagaatgattacaatcaacttagctaaatcactcttcagctaatggaaaacaaacagcaaagtgtaaagaggtgtgtattagtctattatcttactgctatgaagaactactggagactgggtaatttatgaagaaaagagatttaattgactcacagttacacaggctgtacaggaagcatggttggggagacctcaggaaacttacaatagtggcagaagggcgaaggggaagcaagcaccttcttcacatggcagagcagcagaaagggaataaagggcaaagtgctacacactttgaaacaaacagatctcgtgagaactcactatcatgagaacagcaagggggaagtctgcccccatgattcaatcacatctgacaaggcccctcccctaacacgtggggattacaatttgagataagatttgggtgaggacacagagccaaatcatatcaccaaatgttcattgacagaagaatgggtaaacaaaatgtggtatattcatataatactatattattcagtcttaaaaaataagaaaattctgatacatgatacagtataaatgaaagctccagacccatgcaaagtgaaataagccagtcacaaaaaacaaatattacatgattcaatttatatgaggtgcctagagtaatcaaatttatagagccagaaagtagagtgatggttgccagggtctaggagagggaagaatgaggaggagttagtgtttgattggtatagagttttagttgaggaagatgaaaaaattcttgagatagagagtggtgatgtttgcataataatgtgaatgtacttaatgccacagaattgtatgcctaaaatcgtttaaaatggtaaattttatgttgtgtatattttaccttgataaaaaaaactgtaacactcaaacacaaaagcttaaaaacatagatgtatagtttagtgagtatagtcataaacagctgtgcacataccaaaagcgtcttcaaaatatctctttgtgatatacagttcaatatgctaataataattttgcattataaaattgattaaattgtattggtccttagtactctgctgagagggagagagagagagagaaagagagagagagagagagagtaggcatagactttaaaaacatttatttgaaatcattgaaattaatcacggtattacctcaaagaggcaaattctatattttagaaaagaaccctataggttcattacatataagtatttgccaatacttgtcaaaacaactaatacatcacctagaatatagaaactaattattaaatgttggttacatttgttacatttttaatggagaaaagaatctagtagaatttatttctttcatttaattttctattaaagcattgtctcaaagtttgggaaaatgcatttgttatgattatcagttgatattataatgaaaccaaactgttttagagggatacgagctgaagcttttctgttctgaattttggtgaaaaccttcctttcaataggaataaaaatgatttttgcccaaatattagccaagaaaaatgccctgaaagcaatatactgagaaaggttctaaactcttgataaaaaagcaatcaaaatcaaaatgccatctcctagggtcaaggaccaatgagtcacccattgagaggctctctgagctccaggacacagcaatgtccttttgagtataacatcaggatttaaagctccacttgggtacttgtgcagctcttgtagctgtaacaaagttgttttttttttttttttcatttataacatttgctttttttctcttctaataaaaattggtatgatgacattttgcagccaggggttgggtacagagaaaaaacacaattcagggtttaaggcattaagaaaactttttttttttaatctcactcttgtggaaattcagtactgtttagtttgctcctttacttgtttaaggatttaagacaatgtctaggtccattgttaaaagtatagcatagtgggccaggagcagtggctcactcctgtaatcctagcactttgggaggccaaggcaggtggatcacctgaggtcaggatttcaagaccagcctggccaacacggtgaaaccccgtctctactaaaaatacaaaaattagccaggtgtggtggcgggcacctgtagtcccagctactcaggaggctgaggcttgaacccgggaggtggaggttgaagtgagctgagatcacaccactgcactccagcctgcatgacagagcaagactccatctcaaaataaataaataaacaaacaaacaaagttatagcatagtggaaatatcagttgaagcattaaagtatactaacactgtttctgaaaggggtcaaattagtatgcacttaatgagttagtcagaaaaatacctaccaaatttataattgtcaatggagagagtcctgaagaaataatgaagacctaatttgtaaaaaaaaaaaaaaaaaaaaaaaaagaaaggaagggaaaaaaagcttggacatggaaatccaacagctctctctctgtctgcctcacctaatacttcctgaatatttagtctctccatttgtatatctgtaaaatgggaatgatattgactatacagagttgttataagtattagagttaatacatgtaagtgactttcagacagcagcctttaacaaatggtcacaattactgtgatctcttcctatgaacataatgctataatacataagctagatctcccagaactggacttctgcctgcataagagctacccagcatacttgagatgagtcagataacacttttggaatcacacatatggagcaaaaccaacaattatcttttcatcacctctgaaacaacttcctttaggatcctaaggtgcagggggaccctaaaactcagcaagtactctccaacagcttctgaaaaaagccagtcaaaagcagagatgctgtcttctgaaattatcccagtcagggtctgaaatggaaggtgcaagtaaataacaagtatgatatgattcaagtaactgccaccacacctgaaagaaaactgtgaaaggaactgagctgtgtctggagcaaggtcaaaagaagggagagaagcttctggggcactgctttgccctctgggatgagccccttagccacagcctccttcccttctcccacctcctggcatggacagcagggcttaggccctgtgaaacgtgaattaggtcaggccttcatctgagtatttgcccctaccaaaatcaaagactgaatttttcactctttaattagatattcagagcccaagccacaagaataaggacctaagtaacagcatttacagtgtaaggacgtatgatgggctatcagttattatgcccattttctaaattttgatgtgaaaatgaaaagtgaagttcttcaagataacttttttttttaacctagaactcagatatgtcagtaaaaaaagatatgcttcttttggcttaggtgaattctttcaatgggtctttttctctgcagttgtttacagtctccttcctaacattagaatggaaatgcctaatctagcttgtttatctccatttccagctcccagcataacctggaacacactcactgtttagtgtgtaatttctggatgaatgagtcccaaatccaagttgcattatggtgctaccgaccctatccatgaagagaaattgtctttgtagggctttgtagtcacgtgtctgggccacgtgactcgtaacgtacttacaaatctaggaagagagtttcaatataaagaatttgaaagcttcccatatattattccattaacccttatcagcaggatacttaagagcacgaagtataatacattagtctgatatcacactaaagaaggagagacctaagaaagtaatgtgatttggccacctttaatcagtgaaaccatgaatgaaataacaagaggagcaaacaaacttattggccatgtagctggaagcaaagttaaagaggatgccctttcttgctgttagagcctcagaaaattaggaacactgcagaaaactacagggcaaaaggtgtttatgtcaaaaaacatttttaaaaatctgactaggctatttcttttcttgttttctttaatttaggtttaaaaaatacctcacatttaccatcttaacaatttttaagtgtaccattcagtagtgttaataatatcacattgtgtatgagcaatcaccagaactttttcatcttgtaaaactgaaactctacaaattaaacaactcccatttcccctccaccctagcactggcaacggccattctagtttctatttcttcaaatgtaactatttgagatatcttatataagtggaatcatacagtatttgttttttgtgactggtttatttcacttagcgtaatattctcaaggttcattcattggacaagttcattttaagatcagtttctacctacatcacttaaagctttaaggatgtcaattaaagtgaacctgacatgatcttaatctcatcagaacaaaatacaaatcccaaatacttaggattaaaggagaacttgcaaaggaagcacaaagtttacagtagattaacaaaatttaaaaaaatcccagttacttgagagatcaggtgaaacagagaatgagtgagttttgcattacctatgagattaagcaggaaagaatattggaccggatgcgaaatgacctaagttcaagttctggttctccaattaaccagaagggtgagatttagcaagttattgaatgtttctgagccttgagaccccatcttaaaaggttgtcgctgtaaaaataagataaaatatatgctatatcttcgtaatacataaagtgctttataagtgaaataaaaattatttttaaagtaatttttaaatattattgcttaagcttaatgagtacagaatttcagttttgcaagatgaaaaatgttctgtggatgaatgacagtgatggctgtacaacaatgtgaatgtacataatgccactgacctgcacacttaaaaatgattaaaatggtaaattttacattatgtatatttacaactattaaaaaacaaatgtttaaaaaatatgacaatatttcagtcttaaaaggaattgctgaatcagatgaaatattttagaagtagcaattcacattctttttctatttagattttgaattgccatttttggccctcccctatccaaaatactgtcaacaccactaacacacacaaaattaaatggcctaattttactgatcttggtattctcatacatatttttaaaggctccaaatgcattaatgtagaattcctctcattttgaggaggcaattattgatctcaccttctaatatgtaagaaaatggaagcaaaaaggcattaagtgacttgctccactttaggaatcaagactgccagttatgaccccaaaaatctaatacccattttaatataaacattaggggtatagggggccgcagctatatgtatgattttcaaaacttaagcagattgacttggttaagtaaattcttgtactcataaagtctgtgacttaagatcctggaacatgcacacacacacacacacacacacacactaactgtattctaaaatatttttgcacatattcattgaacaatttggaccaaaataggtaagccatgtttaagttactgtatgcattagtcacacacctttagttttgagcaactttttgcaaagtgtttatccttgcatttctaggctttgaagtccagcagctttttctttttccaaatcgtttatttgatcaacatttagtaagcaaatactgttgccaaatattactgtatgccctattacattgcttaaatggcccttagatgaattgttcattaatataaaatatctaaatggtaagattgcttttgggagaaacatattgctcataaaattttaagaactctgtcctgagggtcattttagcatcttgacttcagaaactgcccaggtaatcccaacctgtgtataggtaacggaatgatcatagcctgcagtctgcacatcttctattgcagaagtctctataattacattgacatatgagaaaaataaattccatctactgtcatgttaaaatattgttcttaatccaatagccttggaaataacattcaggtgctaaattgagatttgttcctgctgtattcaattttcagtttcatgtcccacctgctaagaaactgctaaatccttgtaggcaattaaataataaataaataaaactttataagaaatgaaagtgaagaccagaaccatgttattgacagaggatagtaaggtataaacagggataggtgagattttatttattcagttggtcaagaatttgctagattaactcataactcattcattgagaacttagtaggtgttaagcattgtcctaaatgtttcacaccaattatttcatttcattcacacataatcttatgaagacggacactattctacttccatttttaggtaataaaaaagacattcaaagaggccaagtaacacacccaaaatcacacagtatcttagagtgaaaaaatgtcttaatggtcattgggctcaaatcctgtgtcaatgcagatgtttggaagatagccataagcctctctttatacacttctaccaaagaggatgagtttactacttaaaaaatcacactgatgaaagtttctttccttactttcagtttgccaaaaccttcaaccttctaaattgtattctttggttgctttaatttagaactccagagaccccctccttcatgtatttgaagaaagaaggctatattccatttgcggtggcttccagaaccttcagagttatgacctggtagtgtcctcctgcacaatcccaatccttcagtcccagccccctctctaaaacacactgaagctttcctgagtttttgtggaaatttgaacgccagaacaaagcaccatgctgcagataggctcttcctggaatagaatcagcaggactatcacactgcttactctacaaactatatctggttatgcagcccggtatgcattacacattttcgctgccatgtcacactactgacttacagtcagttatcaccagttggttacttgccctaggtctttttctcacaaaccatagttaagtcaggtttctactgacctgctcttacatagttcattttttgatgttccaaattttttttagtatgagtcttgttgaagctcatcagaataggtccaattaatcttcaagttacaatcaagttacaagaggttacaatcagccttgtaacaacgggaagttttctccacagtgagagatagctcagttagtatgaggcatcaggagcctgggcaggaagaattccatggaacccttctcattctaggatatgagtacaatccagggctgaagaacttaagcctagagagaaaagtctggtgatacaagcttgtccaaagcttagacttgggtgagtagatatcatacaatgaagtccaatctgggtgaatcttccctgtgtttctgggaaatctgcttttggatttcctattatctctgtcaatatatattagactctgtttcctctgctggggaaaaactcttggtggtcatcgtcccccctggataaggatattctcccaatcacgtgtcactatgtctgtctggctaacatctccaccaatgggaagattctatcactctctctgggtacctcatgtctgcccctcccacaacagtccatttttctatgtccagctgcatcagagaagttcagtgctagacacaataagttaacttttaaaatagctttctttactctccatcttcacagtctatggttggactgcttctggaggctaagcagagctgagcctcaaatggaaagacagaaaatttgagagtcttcaactgaggtgagacaagaaacaaaggagcttagagaggcagagaaaaaggcagtccctaccagagaccctgttagcaaagtaaatgaggttagttagatatgatgtaatggtcgaaagagctacgtttattgactactaactctgtgatacacatactatgtatattatcctcttgaattctgacaacaaagaatatgaggttaatactgtactcatctcaattttagagctgagaaaatagcacctcagagggtatttagtgattcccctggagctattgtaagtagcagagccacagtttaaaccaagactgaccatggcatgaatcccccaaccgttttacagatgtaacacctgatcctacttgaattaccaacttacagataattagaatgcgaatttaaaaaccaaagcagtgttaaaaataacatacttttttttctgaaggcacggtccaatctaaaatttcttcaaagcctttattatgattagtaatcattaagtatataaatatagaaataagaaatgtgattgcacttgtagtgccataatggctaaaaattgttccttgaaacaaaatcttattttattttattcaattatcatgtgcctcattcaaaaaatattgaaggccaggatagtctttattgaaatgtaacaagatcattccttggcttgaattaacttgtttcagtgtgggcttcttgaaagattttgaaaaaaaggagctcacttgactactctttttgggttctctttctcttagatcaacagagcagaagcctttgtgcaagggcagagtctttctatgcttattttgtcatttgataggcaacaaatattaattggacattgactataggccagggaaccagaaaagatccagacaaggtcctgaatttgaagagcttatattctactcatttgagaaataaaaacatataaacaaataaagtagttattcataagcactagataatgtataagcactatgaataagacaaagtaattgttagaaaaatgataaaaatggagtagactaaattagctagcatggtcagggaatgtctcctcaggaggtgtcacaccggagactagaggaggaaaagaaggaagcctagtgatgatctggaggaagatgccaacgaaatttttaagacaagaagcctggagggtatgagggcaagaaagaatggattggattagtgagaaaggaaaaggtgaaaggagttgaggtcagaaaaatagacaagaaccaataagtttagtaagttacaatggagggttttatttattttattttattttttaattttattattattatacttcaagttttagggtacatgtgcacaatgtgcaggttagttacatatgtatacatgtggcatgctggtgtactgcacccattaactcgtcatttagcattaggtatatctcctaaagctatccctcccccctcccccctccccccacgccacaacagtccccagagtgtgatgttccccttcctgtgtccatgtgttctcattgttcaattcccacctatgagtgagaatatgcggtgtttgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgggtcaaatggtatttctagctctagatccctgaggaatcgccacactgacttccacaagggttgaactagtttacagtcccaccaacagtgtaaaagtattcctatttctccacatcctctccagcacctgttgtttcctgactttttaatgattgccattctaactggtgtgagctggtatctcattgtggttttgatttgcatttctctgatggccagtgatggtgagcattttttcatgtggtttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagttgaattagatcccatttgtcaattttgtcttttgttgccattgcttttggtgttttagacatgaagtccttgcccatgcctatgtcctgaatggtaatgtctaggttttcttctagggtttttatggttttaggtctaacgtttaagtctttaacccaccttgaattgatttttgtataaggtgtaaggaagggatccagtttcagctttctacatatggctagccagttttcccagcaccatttattaaatagggaatcctttccccattgcttgtttttctcaggtttgtcaaagatcagatagctgtagataagcggcattatttctgagggctctgttctgttccattgatctatatctctgttttggtaccagtaccatgctgttttggttactgtagccttgtagtatagcttgaagtcaggtagtgtgatgcctccagctttgttcttttggcttaggattgacttggcgatgcgggctcttttttggttccatatgaactttaaagtagttttttccaattctgtgatgaaaggcattggtagcttgatggggatggccttgaatctgtaaattaccttgggcagtatggcaattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgtgtgaatgggagttcactcatgatttggctctctgtttgtctgttattggtgtataagaatgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaatacccttgatttccttctcctgcctaattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattatcttgagatatgtcccatcaatacctaatttattgagagtttttagcatgaagtgttgttgaattttgtcaaaggccttttctgcatctattgagataatcacgtggtttttgtctttggttctgtttatatgctggattacatttattgatttgtgtatattgaaccagccttgcatcccagggatgaagcccacttgatcatggtggataagctttttgacatgctgctggattcagtttgccagtattttattgaggatttttgcttcaatgttcatcaaggatattggtctaaaattctcttttttggttgtgtctctgccaggctttggtatcaggatgatgctggcctcataaaatgagttagggaggattccctctttttctattgtttggaatagtttcagaaggaatggtaccagttcctccttgtacctctggtagaatttggctgtgaatccatctggtcctggactatttttgttggtaagctattgattattgccacaatttcagatcctgttattggtctattcagagattcaacttcttccttgtttagtcttgggagggtgtatgtgtcgaggaatttatccatttcttctagattttctagtttatttgcatagaggtgattgtagtattctctgatggtagtttgtatttctgtgggatcggtggtgatatcccctttgtcattttttactgcatctatttgattcttctctcttttcttctttattagtcttgctagaagtctatcaattttgttgatcctttcaagaaaccagctcctggattcattaattttttgaagggttttttgtgtctctatttccttcagttctgctctgattttagttatttcttgccttctgctagcttttgaatgtgtttgctcttgcttttctagttcttttaattgtgatgttaggttgtcaattttggatctttcctgctttctcttgtgggcatttagtgctataaatttccctctacacactgctttgaatgtgtcccagagattgtggcatgttgtgtctttgttctcattggtttcaaagaatatctttctttctgccttcatttccttatgtacccagtagtcattcaggagcaggttgttcagtttccatgtagttgagtggtttgagtgagtttcttaatcctgagttatagtttgattgcactgtggtctgagagatagtttgttataatttctgatcttttacatttgctgaggagagctttacttccaactatatggtcaattttggaataggtgtggtgtggtgctgaaaagaatgtatattctgttgatttgaggtggagagttctgtagatgtctattaggtccacttggtgcagagctgagttcaattcctgggtatccttgttaactttctgtctggttgatctgtctaacgtcgacagtggggtgttaaagtctcccattattattgtgtgggagtctaagtctctttgtaggtctgtaaggacttactttatgaatctgggtgctcctgtgttgggtgcatatatatttaggatagttagctcttcttgttgaattcatccctttagcattatgtaatgtccttctttgtctcttttgatctttgttggtttaaagtctgttttatcagagactaggattgcaacccctgcctttttttgttttccatttgcttggtagatcttccttcatccttttattttgagcctatgtgtgtctctgcacatgagatgggtttcctgaatacagcacactgatgggtcttgactctttatcgcatttgccagtctgtgtcttttaattggagtatttagtccatttacatttaaagttaatattgttatgtatgaatttgatcctgtcattatgatgttagctggttattttgctcattagttgatgcactttcttcctagcctcgatggtctttacaatttggcatgattttgcagtggctggtactggttgttcctttccatgtttagtgcttccttcaggagctcttttagggcagtcctggtggtgacaaaatctctcagcatttgcttgtctgtaaagtattttatttctccttcacttatgaagcttagtttggctggatatgaaattctgggttgaaaattattttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttcttgaggagtatctttgtggcgttctctgtatttcctgaatctgaatgttggcctgccttgctagattggggaagttctcctggataatatcctgcagagtgttttccaatttgtttccattctccccgtcactttcaggtacaccaatcagacgtagatttgatcttttcacatagtcccatatttcttggaggctttgttcgtttctttttattctttttttctctaaacttcccttctcgcttcatttcattcatcttccgtcactgataccctttcttccagttgaccgcatcagctcctgagccttctgcattcttcacgtagttctcgagccttggctttcagccccatcagctcctttaagcacttctctgtattggttattctagtttacattcttctaaactttttccaaagttttcaacttctttgcctttggtttgaatttcctcctgtagctcagagtagtttgatcatctgaagccttcttctctcaactcgtcaaagtcattctccctccagctttgttccattgctggtgaggaactgcgttcctttggaggaggagaggcgctctgctttttagagtttccagtttttctactctgtttttttccccatctttgtggttttatctacttttggtctttgatgatggtgatgtacagatgggtttttggtgtggatgtcctttctgtttgttagttttccttctaacagacagaaccctcagctgcaggtctgttggagtttgctggaggtccactccagaccctgtttgcctgggtaccagcaggggtggctgcagaacagcagattttcatgaaccgcgaatgctgctgtctgatcgttcctctgggagttttgtctcagaggagtacctggccgtgtgaggtgtcagtctgcccctactggggggtgcctcccagttaggctgctcaggggtcaggggtcagggacccacttgaggaggcagtctgcccgttctcagatctccagctgcatactgggagaaccactgctctcttcaaagctgtcagacagggacatttaagtctgcagaggttactgctgtctttttgtttgtctgtgccttgcccccagaggtggagcctgcagaggcaggcaggcctccttgagctgtggtgggctccacccagttcgagctttctggctgctttgtttatctaagcaagcctgggcaatggtgggcacccctcccccagcctagctgccgccttgcagtttgatctcagactgctgtgctagcaatcagcgagactccgtgggcatttaggaccctccgagccaggtgccgggtataatctcctggtgcgccgttttttaagcccgtcggaaaagcgcagtattggggtgggagtgacccgattttccaggtgccgtctgtcacccctttctttgactaggaaagggaactccctgaccccttgcacttcctgagtcagacaatgcctcgccctgcttcggctcgcgcacagtgcgctgcacccactgtcctgcgcccactgtctggcactccctagtgagatgaacctcgtacctcagatggaaatgcagaaatcacccgtgttctgcgttgctcacgctgggagctgtagaccagagctgttcctattcagccatcttggctccctcccgggttttattttttacttatttattgttaagacagggtcttgctctaatgcccaggctgaagtgcagtggtgtgatcagagctcactggagccttgaactgggctcaagcaatcattctgcctcagcctcctaagtagctgggactgcaggtgtggagggttttatataagcaaattatgtacctaacttacacttctgaaagatactctgtattgagggtcaaaaatgagggcaggaaaactggtttgaagaacagtagaaatattcatatgggagatggcagtggccacattaggactgtaatagtggcagcagagaaaagtggaaggattgtagatacattttagagaaatattccacagaatttattccttgagtggttttaggatttaagtaaaaaataaaaatgaagaatcactcctagattttgggcttgggaaactaataggtaatgatccaaaatacttagatggggaaagcttgaggaggagcacatttggcaatggatgatgatattaatagcactatttgggtcatgttaagtttaagatttctataggaaattcaaatgcatatgatgggaaggtagtgggatatatgaggatagagtccagcaaagaggtctgggctaatgatttaaacttggcagtcattagcatactgatgttatttcaagtgattggattacatattttcacctaaggtaaaaatgtaacaatagaaaaaaggagtcaaggtctgagcccaaggtaatctaagatttccttagatggcaataaaagaggctacagctcacaaagataaccttacggaagcatgtagtgaaggaagtgaaggaagaaaaacaaggtaagtgtggttaggagtaatgtcagcaagatggcagaataggatgctccagactctcctttctgtcatggagacactgattcaacaatacatggattaatttcctctatgataaatcctgcactccagatgagcaagaaatgtgccacatcaaagccagaaggcagatttttggcatcctctcaccagagtccctccttccagcagagtcatgcaattgggaagaaactttgagctcccagattctccgtagggagagaaagaggagactagactgcacgtccaacattctgacttttggagaagcctgcctaagggactggcttttgtctcacctgtagaagagagctaatgagacccagagtattctaaatgtctggtggtcactgaaaacaaaatttttgggcaacttgctgcccctccagagggcctgaggtaagctgacagaagccgacacagttcagcagcctctccctcaggaaggaaagggaaaagtaaagtatgcatccaatttcttgctttttgatgggatacccaaggggttagtttctgaatatcctggctttggggactgataggacctggcatattctagatgcctgggaagctctgagaatataaaatagcaggtggtgtgctgcttcttcagaggactcacagtacagcagtcaggcatcagtcaggcatcattcattaaaagctcctgaaaaaatctaataaatctttctaattagaaatctatatgcacaggcctagagaagacacatcacagagaaggtttgagagtcttccagaatccctagttgggctgattgatgaatgcctttccctttacaaatccagtttataaagattatgagaggtggatttttttcaagtgcataaataccaacacaaaggtacaagaaatatgaataaatgagaaaataatcaagtcaaaggaataaaataagtttctagaaaccaacctcaaagaaacagagatatgtgaattacctgacaaataattaaaaataaccatcataaagttgtcattagttcaggacaacaatatatacaaaaaataaaaacttcatcaaacagaaaatattttaaaataacagaaattttggagctgaagaatgcaataactgaactgaaaaaatccactggagatattcaagagcagacttgatcaagcagaaaaatattgctaacttgaggatagatcattcgaaattatccagtcagaggaacaaaaagaaaaaagaataaaacagaagaaatccttaaggatttatggaaaataattaagcagaccaatatacacattatgaaattttaaagaggagaaatgagaaacaaaggggaaagaaagcttatttaaaggaataatggccaaaacttcccaaatatgaggaaagaaataggctttcagattcaagaagcccaaatctgaggaactcaaataagtcaataccaagacaaattataataaaattgccaaaatcaaagacaaagaaggaatttttaaaataacaggagaaaagtgactagtcacatacaaggaaaattccagactataagtagatttctcagcagaaaaattgtgagacagaaggaagtagaataataacaaccaaccgagagcacaatatctgacaaaactgtcttttaaacataaaggaaaggtaaagcttttcccagaccaaaaaaaaaaaaaaaagcctagaaagtttatcaccattagacctaccttacaagaaatgctaaagggattccattaagttgaaatgaaaatatgttaaataataatgtaaaagcgtaggtaactatgtaacttaatggtaaagataaatatagagataaatacagaatactataatactataatgatatgtaaatcattttcaattcaggtataagagttaaaagacaagaatgttaaaaataacttatagctagaaaaatatattaaaggatagaaaatatgaaaaatataacttatgacattggtaacataaagtatgtggagggagaagtaggggtttttgtatgtgatttaagttattttttaatttaaataatgtgttgtaagatatttcatgtaaaactaatggtagccacgaagaaaaaatctacagaagatacaagaaaagaagaaaaaaaaatcagagtattactacaaaaataaatcaataaacccaaataaagataacaatggtgaaaaaaaggtatgaaaaagtcaaaagacaataagaaaaacataactaacaagacagcaatagtaagtcttttactatacaattttttaaaaatgtaattaaatagcaagaataacaattcataagacatatgtgctgtctacaagacttgctttagacttgagaacatacataggctgaaagtgaatagaaaaatatattccaggcaaatggtaaccaaaagagaatggaatggccatatttatatcagacaaaatagattttaagtcaaatattgctgcaagagacaaagaagggcattatatgatgatataattggatgagtcaagtcaaccaggaagataaagcaattataaatatatgcacacccaatatcagaacacccaaatatataaagcagtgacagaactgaaggaagagataggcaacatacagtaataggaaaaaatttaatatcccacatttaatactggattaatcatccagacagaaaatcatgaaggaattggacttcaactacagtttagacaaaatgaacctaacaaacatatacagaacatttcatttaacaacagcagaatacacattcttctcaagcacacatggaatgttctccaaggttgatcacacgataggccccaaaacaaatcttaacaaatttaagagtattgaaattataccaagtatccttcaagtatcttcttcaagtatcttcttcaaccacaactagaaatcaatatcagaaggaaagctggaaaactcacaaatgtgtggaaattaaacaatgcatcctttaacaaccaattggtcaaacaagaaatcaaaagggaattttaaaaaattatcttgagacaaaaaagatgagatgaaaacacaacattccaaaacgtatgaaatgcagcaaaagcagtaccgagagatttacagtaataaatgcctatattaaaaaagataaaaaccttaacctaattctatacctcaaggaattagaaaaagaatggcaatctaagacaaaatttagtagaattaaggaaatcataaagattagagcagaaataaataaaatagagaatagaaacagcaatagaaaaaatcaacaaccctaggaattttttgaaaagataaacataagtgacatttagctaaagaaagaaagagagaacactcaaataaacaaaatcaaaattgaaagagaagacattacaactaattccacataaaggattataagatgctactataaacaattatataccaaaaaaatgggataaaccagaggaaatgaataaattcttagaaacatacaacctgttgagactgaatcatgaggaaatagaaaatgtgaacaaccctataatagtaaggagattgattcagttgctaaaatctctcaacaaagaaaagcccagaaccagatggtttaaaggtgaattctattagaattaatgccaattcttctcacactcttccaaaaaaactgaagagaagtgtacacttccaaattcattctgtgagatcagcattacactgataccaaaggcagacaaagacactacaaggagagaacactatagaccaatatccctaataaacataaatgaataaatcctcaataaaatactagcaaaccgagttcaacagcacattagaagaatcatacaccacgattaagtgggatttatccattggaggtaaagatgattcaacatataaaaatcaattaatgtgatataccatgtaaacagaatgaaggataaaaataacatgatcatatcaatagatgcaggagaagcatttgataaaattcaacatcttttcatgataaaaaacgctcaacaaattagatataagagaaatataccttgacacaataaaagccacatatgacaagcccatagtcatactcaatagtgaaagtttaaggctttccctctaagaccaggaagaaggcaaggatggccattcttactgcttgtatttaacataatactatacaccctagtgagagcagttaggttagaaaaaacaaaaaagaaagaaaatgtatctaaatagaaaaggaagtagcaaaattatctctgtagataacattttatatgtaaaaaactagattccaataaataaataaatttgttagaattaagcaaatctagtacattgcagaatacaaaatcaacattaaaaatcagttgtgtttttatacactaaaaatgagcagtctgaaaagaaaattaagaaaacaatcccacttacaatattatcaaaaggaacaaaatactttggaataaacttaacaaaggagacaaaagatttcactgaaaattgcaaaacgttgcagaaagaaattaaagaacacgcaaacaaatgaaaagtcatcatacgttcatggactggaagacttaatattgctcaaatgttaccactccccaaaggaatctatagattcaatgcaatctttatcaaaacctgctggcctttcacagaaagagaaaaaataatcctaaatttatacggaaccacataggactccaaaaaccctcataattttgagaaagaaaaacaaagctggaggcctcacaccttctgatatgaaaacatactacaaagcacagtaatcaaaacagtatagttctggcataaagaccaacatatagaccaataaaacagaatagagaccagaaataaaacctcacatataccattaacttatctttgacaaaatactaagaatacacaatggggaaaggatagtctctttgataaagatgttgggaaactagatatccacatgagaaataatgattttgagtccttatcttatgacatatgtatgtaaattagtacagcctctatgggaaatagtatggctatttctcaaagaactaaaaatagaacttccatttgatccagcaatcccatactggtcatctacccaaatgaaaagaattcaatacatcaaaaaaacacctgcactcatatgtttatctccgcactattcataatagcaaagatatggaatcaaacttagtgcccaacaatagatgattggataaagaaaatgtggcatgtatacacaatagaatactataatattcagccacaaaaaataataaggtcgcttcttttgcagcaacatgaatggaagtagaggtcacattatcgtaagtgaaacaagccagacacagaaagacaaatattgcatgtgctcactcataagtggatgctaaaatacatgtacatacgaatgtagcgagtggaataatagacaatggatactcagaagggtgaggggataaaaagggagagataatgagaaattaatgggtacaatgtatattatttgagtgacagataccctaaaagcctgacttgactattatgcaatctatgcacatttatcccctaaacatatatattatatgcacacacacacacacaaacacgcaacttaaacctaagacctgaaactgtaaaactcctggaagaaaatgtagggggaaagctttatgaagttgggtttggcaatgagtttttggatatgaaatcaaagccacaggcaccaaaagcaaaaataaacaagtggaactacatctaactaaaaagcctctctgcaggaaaagaaataatcaacagaatgaaataggagaaaatacttgcaaatcatatatatgataaggggttaatttccaaaaatatataaggaattcctacaactcgatagcaaaaactaaataaccttattaaaactatacaaagaacaagtatagacatttctctaaagaagacatgaaatagctaagaggtatgaaagagtgctcaaaatcactaatcaccagggaaatgaaaatcaaaaccacggtaagatatcacctaatacctgttaggatggttactatcaaaaatatataaaataatgtgttagcaaggatgtatagaaattgcaattcttgtacactgttggtggaagtgtaaaattgtgcagcctctatggagaacagaatggaattacgtcgaaattttaaagatagaactaccacatgatccaacagtcccactttggggtatttatccaaaagaaatgaaattgagatcttgaatcgagatctctattctcattgcaataagcttcagtatcgttcacaatcaaaatgtatatcaatggatgaatggattaataaatatggtatatacatacaaatgtactattattcagtcataaaaagaagaaaatcctgtcatatgctaccacatgggtaaaccttgaagacattatgcgaactgaaataaaccagtcacaaaaggacaaatactgcatgattccacttagatgaggtatctaatagtcaaactcactgaagcagagagtggaatgctggttgccagaggctgggaaagagggggaaaagggaagtttctattcaacaggtatcaagttttagtcatgcaagatgaaaaagttctagaggtctgctgtgcaatattgtacttacaggtagcaacactgtattatatacttaaaattttaagatagtaaatttcacgttatggatgtcatagtttttaccacaataaaaaaaataaggtgtgctaagaagccaaaggaagaacatgtttcacgaagagaggtgtggcgaaccacatcaatgttgctgaaatgtcaaataagatgatagagaattaaccattacctttggcaaaatacagatcattggctaccttgataagaacaattttagggaagtgatggggaaatgagattagtatggactaggaagagaaagagatataacaacctgaaggtagggaagatatttttacaagaataagagaaatagtttactgattgagaggcaggtgtggtaacaaatttttttttgcaaggagcattattacatatatttgtgtgctgactggaatgatcccatagaggtggagaaaactgatgacacaggaaagagagagtggataaattcaaaagtaagctttgaacagatttgagtggatgggatccagaacacaagtggaaaaacttagcttatgtatgagcaggtctagatcttcctcttatttaaaggaaatccaaagtataagaaatagatgcattgtgggttcaatggtgggaaactgaggaagatcttgtctgtttgcatcaagtttttaaatataaaatcagaggtgaagtaatcagtttaggtgaggtgggaaagagtaattaataggataaaattatgtgtctgtgtgtatgtgtatgtgtgcggtgtgtgtgatttaaccttttcttgatgggtcagagcacatcaattaactgttaatgtgctttaatacaatggagccctttctttaatataaaataagatgtgatgtaatcagtacagatgaagtaggaagaaggtgttgatttgagaatcaagaagaggtaaaaaattctcatcttagagaacaagaaatgaatttactaaggaagtgtagtaagtctctctgcctgtattgaacacccatttaaaatttatggtcagaaatttccagtgagtccagtcacccaaaccgcgtaatttctctccaacaatgttcatccattgaagttttctgggatctgaatagttagaaagttgagtttaactgaattggggttttccaggtacgtaggacagaaaaagtgagacgagaacattaagatcatctccaaaggtgtgaatctcatgctggaccaagaaatttggctttatcagcagagaaatgaggacatgaaagggtgatgaagactaaacaaaacttcacattctgcagccttcttctctagcagcattcatggcaggagctttacatcccctgacaacctttcttttcttgagaaagggccaggacgggtcacataggtgtgtgtttagggctaacttccctctaaggcagctatggttatcttcctcctactcttcttcctcctctaaatggcagcatgggtgtatagcctgagacatgcattgaagataagtcctatctgcccactaggactgcaagtgcagtccactttctctccactagctaacaagccataggggagttccaggaaagcatagcaggaaattaatatgaccatttatcataatccactttgcctcatgaaataaaaatttttcaagtgaatgaaggaaccaaattttcatttataatgataattatggataaatgtgactgcttcataaaaattaactcacagaaataattctatgtaaaacataacattagctcgcatttaagatagagtgttgtaagagctgtccacttccaggatctgtaatgaaatataggaacataacaagagtgcatctaacagatccatgggccatctgtttcagtacctgacctccggaggtgactaatcctggctgcttagcaagaatatttaaccatctcctcctacccctctgttactgacctatcttcctgtcttaatagagcataataaaaacatatggtgctgtaaaaagcttctggcagcaaaattccacctgaaccatgattaaatttttcactcacttttcccttccttctggaatatatgatatagacaattttttggtccccactctcctaagattgatttgaaccctatacaaaccagaagacatgagaggagtctataaacttcttgaggacattaatttcaatgactacgtctaggacttccttgagtgctcatcatggtggcatgttctctggtttccaaaaactaatatttttgggcaagaggcatcctcactggtggtaatagttaaattttccagaaaacacagctttcccctttaagcaacaggaattaaaatgtgtgtgtgtgtgtgtgcacttgtgtgtgtgtgtgtgtgtgtgtgactgatttaaccttttcttgatgggtcagagcacatcaattagctactaatgtgctttcatacaatggagcccttagggattactttagggatatgggattaattggctctgtttacattatcccagcctgctcagtgggaaaaatatagaccctagctgtgtttccactctagatttgtctaaaggaatgattacattgcacccactggaagtttacttataggaaaaatcaagaagattcctgaaaaagaagtttttttaagaggaagtcaatacaaacacataggtgcagatgcagagagtgagctaacattgagcataatgcagagtataggataaaatttgtcccacatattttcctctgcccagccacataaaatcataccttagtccccgagcaatggagcaacaacaaaataatcaatataaaccaggcaaaaagatgcctggttttggcagtgccagcactcagggcttcagcagtgatggcagagtcagcaataggagatgttggcatcagcagcttccacaatgggtgaccaagctctgggagcctttgactcttgttagacattaacatgctcaatgttgggcctctgcagacacagaataagctctggaggagctattagtaatactagtgatattttggggataaaactatggaagcacagtttctctatatgtcaaaggagcaaaggtgacaactctccaaagctttcccaaaacaggaaagaaggaaaatggcagataccatgttgtagcccagaggactagtttatcaatccagcccaaatgactggcttatagatcatacttaagaatccatccagatttttagaactatttggaagttcgttaaggaggtatttgggaggagttgaagaactgacagttgctatgactctgattttacttttggactggtaaagtgtagagaacactatgttttgtgtcagtgtatctccatttgttagtcttccctcataaatattccctattttcattactgatttatggcactcaacagttttcatcttctttataatttgctctttctgttctcattgggtggagttggaattaaatatgagtaaataaactctaagtcagggtataataaatttttacacgagtaaagcttatgggccttaacgtatgaacattgtggtatccatttaagcaattggagagctgtgtgtgagtgtgtgtgcatgtgtgtgtgtgtgtgaagtttaactattttagaacaattatagtatcaaacaactgacattcaatctagtggattataaactgttatatatgcttgtactccatgtaagctatgcttcaaataaatgagatgtgacttgcaaatacaaacaagataggtcattttctattgaaaaccaatttactgtttacctttgatgttgatgcttttgatggctttctgatgctacattttgcattatttcatgatgccacttttgctcgataacaatattgcaaagttctagcttataaataaaatgaatcaacctgcaacttataacagaaggagctggtcctgtgcaccacaaagagtgacttaaatggacaaagaaccaatatagagatgtttcctaaactggcattagagatcactagcattaccagatgagctgattttaagtgctatcgatggccaataagaagcagcaggactttaaggaaatgaggggaaaggttttacatttatcacagtgacctaatgtgaacagttaagtagcaattaagtcacatttattgctcaaggtacatgatgacctgtaatgtcagttatcagaaatgtccctaacttgggcaattagctttgagtcaaatatggtgttctggctttaagcctgattataaaattggaaacatgtatagactgcatggtgcaatagaaagggcctagtaaaaaatgtatatttaaatttgcctctgacatttacataaaagccctctttagagatacactaaagcagttttctcaaactttaaatgtgtatataaatcatctagggattgtgttaaaatgtagattgtaattaaatagatctgatgtgtgatgtgcagagtctgagatgcagcatttctaccaagcccacatgtatgctgatgatgttggtccctgaaccaactctgagtcccaaggccttagaagattattgttagaatgtgggaaaagcatatgtgtgcataggaagacactttgtgaatggtaaaatagcatatataacactttacattgaataacaatagtcgaggatttgattcatcaagaaaagtcctagtagaacaaattatgtttcagatactgttcaatttttccttgttcgcaaaaccaaaaacaaaactgagaattagagaggcagaacaagagagatattcatcctaaacaatgttgttgcttttttactgtcttgaaagattcacttctgtatcactatccactaataaatggggtaggaggtgagaactgctcttgttttgttctttagaaatttgcacaattagacccagtcccagatacatcctagacattgactccttccaagtaaaatagaaataggaaattacaaagaggaggaagatggttggctccaggaacacaggcagcaacaaaaagggatgactgttaggggaagaaattaaaaactagtaggtcagacacaagaacagagactcagagctgtttaaacacttagcttcccttagtgaacctgttgtttttcattggtgtttgcattttctaaaggaaatgaacaaaattcacaggcacaatcattgatttataaagcgtttctgtgttccttatctaaaaagtacagtcaacaattccctgttgaagaaaacatggattctttctgagtttccagtcccacaacattgtggccaatattttattatttcatggtcagtttgctacactatatgaaaaagatttttacatattagagaatgcaaagcagacccctcccatgggctaaacccttcccaatcttttagattttggacagaatgactctctgtcacacatgcagattaccagcaccttatgtgttcccatgatgcatctctttacaatagttctggagccaccatgattacagagttagaactctgtttcagagaaactgaattttcatcagtctcacttttacctaaattttatactttgtcttcctgctttcatctctgtttatcctctctcacctgcttatagtgaagggcagtatcattcataatccaaaatgccagtattcaacaaatatgcacgaattaaaacttaagtttagggccatcagagagagaaggaaataataaacaaggctgaaattggagtaactgtcaatgtgttctggctgtgtcatttctttaaaaaataaattgaaagtgaaatactaataccaattactaacttaattcctcagcccagtcaatatcatatcatgaagccatttaaatgccaaacagctattgcgagattactctgaaaccattcaaactgcagagatttgagaaatatttaaagacaccggaactgtgctctggtggggaatatcacacagttgcacattgttttttgctgtaactctgggcaatctgggtcagctgccccagttgggtagccttataattaggcagctctttattttccagccgctttacctaagacaacctgaagctttgaggatgactgagcagcagtttccctcaacagaaacacttgtgtggtgcaccaggagtggttttaaatgatggagataattacttaatttgagctgtagcaactggccaagtaaacatgtagcagccaggaagctattagcatgattttaaggcaattattccattagtgtttaatagtctccaattagtcttctctgactatcaaagtttgaatatctttttttcctccaaaaattcttagtgctgagtaatgcaaaaaggtgccaaacctgtttttaaacctggttttttatatatgtggatcttccaaacaaatttacagaaacatgcgagtattcaggagtatagatttgatgaaaaatgttggtctattttttctcacaagtattggagtgagaaggggaagctttacaggagatccatttgagtataataccaacaggagctgggaaaacaatataaattcccatggaagcccaatgtcatcatctttatgtctgtactctaagatcacccagataccaaaatctctcacctcaggtttttattttgtcccagggcaggaaaggaaaattactgtgttcccactaatgcttagttccttttttcttaaccctggttagtcacagttgctgctgaatcatccagatacaaatcacaaagcctttccctccaaaattcatagggtatcttcccaaaggtccaagtaaggggtcagatccctgaactgatagggataaatagtaagtcatttgtcttcacttagcttcagttttttcatctgtgacatggaggtaatagtgccagcactccctgcttcatggggttttagaaggattttgtgagctggtgtacataacagggctttgaaaagtgaaatattacagaaatgtaaggtagactcaaaaagatatcataccatctcagaactagataaacaaacataggcttttaatcctgtagctctagagagtcacctgccagaaggtttgcatcacagtgattgcccttcttaccttctatgcatataaaaacattcaggggaaaccatgtgaaagaagctgtctaaaatccaaataaaaatgaaggaagaaaaggaatgggaatgcctgtggaagtgagaatggagttatgccaaagttgtgctttctactgtctccttgaaaagagcaatctccaggcttgcctaggtagcagaataagtgctgcatggagaagctggggttggttcttttccttggagattcctggccggtagcaagctatctgttgaagaaggacgaaaggagacagccccttctgtggatagcacttgtagtagcctgtgcctgccattgctgccaaacatccacttgactaacaaccattgatttgagggactgatcaatggcagcactcttggttggagcatctagtgattttcaaaataacccttcttttgtttttgtttttgttgtttttttctttattatgttttcctccaacagctgagagggggcgctggatggggcagatcaagaggaggtagaccataacgttgagtttaatagcccagctcagctcagggccagaagtgaactgttcatgagtaatttgccctccagcccagctctgaaaagatcaagtgtgtgctcccccagcccaactgcatagccaaattgacaataaagtatggccgtgtcccagctgtcattgttgtaaactgtcctgaaacgaccctcactcctggatacctgatctagggggttgttaggagctgccaccctagaaacctgcccagtctctggtccaagtcgcacacatcaagctgaagcttcttgatccctcaggtctcttcctcgctttgtccacgcttctttccttctagactgtctggacacattctcagtcaccttttccgtactatttgcctattaatcccacccctccgctcaggtcacgcaggttcccctgcccagcttctgtcccgagcagtaaacatacggtccgcaagggtttgcttttttgacctgggcgaagtgtgttgccaacacgcacttggaccagactcgagacagcggccactcggccaggtcccccggggtccaaaccgatacgaaatggtgccctctgcccgtcgcccccttgggctccttttcaagggcagctatcacgccgcctctggtccctgaactttcatcactcttcgggaagcgctttgtctttttaaaggagattggggacgaatattaatgactgtagccgagaatctatcaaatccgcccaattccatgccagggatagactcaggtccttgcaccgaaggcgagcccctgacactagctcgcgttcttcacacacggtcaccccgcagacccagagatttctcccacttccccaaatctgcaggagaaaccataggagggggtcacgaggcaccatcctggagcccagcttctcctctgccccagtcctccgcatacaacctgcttcaaaagcccaggagaaaagcagtcaccttgactctagcgcctcggtccttaggggtttggaaaacgccaggaagcccaaggctacccggcacgcgctcgcctggcctgagacccaccctggaagacgagtttccctcccgcgggcatcgtggcaagttaccacttagtggcagataaagcagggcggggcaggtggagcgggcgccgagcgcctagcccgcagcccctgcgcgcctacctggaatggctaaattggtgagggggatgctgtgcatgctctccggcagagttgccatccagtcggctaatttcagctcgtttttcccctgagacgaggccatcgtgccagtcggcgtgcagcgcgctggtcccagcactcctcgggcaggctggcaggctgctgccgctaatccaatgtttgctctagccccgctagagtttacactcctctctgcgccacacccacaggatggcgcagacacatgctaattttaataattattcaaaacaccccgtgctcccttagtgcctccgccagactccgctggagcttttgttcctgacgtccgtgctcagctctctccgctctcccctccctccccaaccccctcctcccgtcttatccttcctaggcgtctctgcctttcctcgccattctgcagctttccctggtttcttatttttcttttctattcatttttttccaactgctttgcccatggcttgctcgatcctttgctgtgactttctcgtcctgtttgtatgaaagacagtcttgcacttgaacctaaaatcctagcagactttgggatgttattgcctcctgaggaacagacttctcatgctgggtttcagggctttccgtccttatcaaagagctttcctttttgtaatctacaacaggttatacctttcctcagccagagaccacaaccctgtttattaaaaaatgattatctttattcactcttttgcctactttgtgaaatagctggtaagtatgagtcagtgaagggcatggtaaattctaggtggttcctacttaatcctgggtaccttgctccagacatttcaaagtcaagaaatgctactcccccttcttttctcagatcatgagaagtctacattatttccatggagaacactgcctctgtcctgtcagtttcatggcactcagggtaagactggagccttatgctggaagaaaatcgccacatctcccagtgacatgctctaattattgccagtagcatttggtggaatgtatttggcaccattcaaagtgatctatgtgactgtctgcattttcattcctttgcagactggaaagatgtgcctctctcaagagaaatcactcactgggcctccaaagaactgtctgggtccacctgctctcagatgagtaaaaggagagagatgaagttttacaaatgtaatgagagcagcagtggcctgaataggaattataagagatgaactgaaagtgtgctgggcttttgcaacccaggaaatggaaatgcaataaacagacctctgttctttcatgccagggttgtgtaaatttttatttttctatgggaaatgctattagattgcggaaatgacaatcaacataggagacaaagagagccatgaaacatgagaataattattcaaggttagtaaatccatttaatcccaaatagcattaaaaaataagaaaaaacctagagcctaccttattttctacaatgatgctaagtcctaagaatattcacccccaaatggggagcactatgggaaagatagaggagaggcaacgccttattttggttatcaaattttccatgccccttgtaaaataaattcataccttcaagaggacatggtacagttatctttagtgatgaggaagagatatactgaaaattttccccaaataaatcttaatatacatgctagtacaatagaacccacatatccttttaattaggatgatagtttagcttactataggactcttggtcaagagatctacaaacaccacccttctgtaagaaacctacaaacaccacctaatgctggtggtctcagggcatgattgcaaggcaatgaggaaaattcaaatctagtggtcagctgctctgtctctgagtagtttgggcaagtcctctagtctctgctagccccagttttctccattataaagtggtaataagaactcagagatttgtggtgaagcttccagaagagagtgcatacatgtttaagataacaggatatgtgtatttaccactctttgtcttttctatacttatgaagtatttttttcaaaagcatgaaataattattgaatctggggtacatttttaataagacacattttagaaacatgccctgttaaagtatattgagcttatgtggccctaaaaatttacaaagcattttttacaaaatgaaaccaccttaactggtgaggaaagttcccctctataaagaatcatactatcttttggcaaaacaaactaacagtcccttctctgtttcatctgatttgcatttcaggattttaaatgtcttggtttaatataagttattatcattttctacatgcaacccatgaaaaaagataggcctgaaagttgatagttgtgaatttctttcccagccttataatcaatattttgggcaattatatgacccagtttctccatctttctatcaccaaccctgctaccacttactaaaacacattgggacaatcatgtaatttctctgggctttaattttgtcactggattaatcaaggttctccagagaaacagaaccagtagtatatatatagagagaaagagatttattttagagaaattgtctcatatgattgtgagagctggcaagttcaatatatgtagggcaaactggaagcctggaacatgagataagaattgttcttgcagtcttgagttcaaaatctgcagagcaggccagcaggccaggaactcaggaaggacttctatgctgcagttttgaggcagaattgctgctgcttcagatagctttagtctttgttcttaaggccttcaactgatttaataaggcctacccacattataacaggtaatgcactttactcaaagttaaatgattataaatgttaatcacattgacaaacatcttcacagcaacatctacactagtgtttgaccaagcaattgggcatcacagcctagccaagttgacatataaaataaaccatcacacccacttgcaaattaactagaagttactgccaaactctatggccccctttgactctattattctataattttatttttttatgattctttcttatttatatagctgctcaaaatagcaaaaggaggcatgtaatatttactttcttttttttttttccaggctggagagcagtggtgcgatcttgactcactgcaagctccgcctcctaggttcacgtcattctcctgcctcagcctcctgagtagctgggactacaggtgcccgccaacacgcccggctaatttttttgtatttttagtagagacggggtttcaccatgttagccagaatggtctcgatctcctgacctcgtgatctgccggccttggcctcccaaagtgctgggattataggcgtgagccaccgcgcccagcctactttcaatttttaattcatgcagacagctcaagatatagaccaacatttttttccccacaaaacagatgagaaaataccaatggtttttagttacggcattaatagtagcctgcctctgaaaatcaaatgcttttaggcataaatgaaaagagaaaaatgaccaattgcagtggcttcgtgctaccaccaaaagttgtttgtgtaatgctctgctgtccatcaaattcatataacacacaaagctgatgaacaaggatactcatctggagcattttctcacttcatatcctcttccacccataaaaatacataactctttgctatgtattttcttccattagttcataatctttcttaatcattggagatatatattttatttttgtcactgaattgattttgaattatgttctgaaaagcaagggtttttatagatcagaaaactttagaacacatttttgtcaaataatattttaaaagaggaactttttctaaaacaattctgccaaattatttttttaaacacagtgttctaaaacaaacacttacagagtcagacttaaaacatgtccaaaagggcaataaagaacctttgtgaaattaactattaataataaatttttttttaccattctctacaacttttatgtaggtattccacccaaagaatttttctgtgttttaaggacaaaaatacttttgtacttaaattcagagtagaaaaaaagtgatgaccctctctttccaccaccagtttagccctgcagagttgtctgtcttatccctcttgtcctcccctagtctaccttttatatgtcaaccctaaacaagctaatttacactcactgaatgtaatctattggctggaatcaccagctatggaatgcggtgattcaaatccaggtctccccagtcaattactgtgcgtttcttggtatctttttctgaaggataaagaatgattattttctcctggaggtggggaaatggaagatgctatgaagcttaataaagtaaggaatttaaagtttattgaacagactggaagattaaaaattatacttttatgcttcttgctcccaccatgactttgctcatgcacatgaaataaatgtacttcatgctttcatctatcaaaattctttccattctaaccaactcctcttttcaatttcccttactatccataagtagaagtaatctttcttatctctgtacactcattgcggtttgtttatagtattgtgtctctcattccctagctagtcttaaagcattatgtaggcagggatggtgtcatttgacactctctaatgtctttcacagagcccaagacataataagggctcattctaatcattcattttactcacttatttcataaatatttattgagtgtctataatgtggtctgtctcagagagaaaaaatagagcagcaagtccctgaactctttgagttgatgctccaggcagaaagtggcaaatgatagctttatggctcaatacataaatgacttggctgtatctcttatctcaatggcaaaacccaaattttgcatccctatttttagcacttgggtaagtagcaaagcaccaaagacttacaccttagttttgaaaatacattttaaaataaaaattggtttagaattgttttgtctctctacactctttcccttaatctttcccactctattgctatcttccctaatacaatagggaagaaatctgaaaataacatgataaactcatctagatctccaggggtcattactacaaaatgtttgatttctcagagcttggggattggtggaggtgggagtagcctgggaagggagagggaaactgttttaaattcatgtgcagagtaaaaaaaatcctggaactattctacccatcactgccaaaagcttaggaccattgtacaccaatacttctagaagcattattcacaattcccaaaaggtggaaacaatacaaatgttcattgacagatgaatggataaacaaaatgtggtatatacatacaatgggatatcattcagccttaaaaagaaatgaaattctaacacctgccacaacatggataaaacttgaagacattatgctatgtgaaataagccagacacaaaaggacaaatatcttataattccacttatatgagatacccaaaataatcaagttcataaaggcagaaagtagaatagcagttattagggtctggggcagggagaaacaaagactttttgtttaacaggtacagagtttcagtttgggatcctgaaaagtttctggagatagatagtggtggttgcacaacaatgtgaatgttcttaatgccactggactgtacccaaaatggttaagatggtcaattgtatattatgtgtacttcactaaaataaaaaaaatgaccagtgactctgttgggcaaatttaccctatttcttttatcagttataaagtagccattgtaaccacttagttttaataatagtttattctccacctgatgactaccaagagcgcatctcaagttgaacaaattgaacttatcacttgttgcgctgagtgagaatgtgcatcatgggaacctgggacaccttagaaagaggatgttagaaagaacttaaaatatttgagcttgccttaggtgatttggaagagagtttaagaaagtggagcttcattctgatttggatggtgtcaaaaagtaaggagaaggtaattctataattaggtatcatgataaaccttatctagaatgaagaaacactggactaaggctaaatctgtaatggtaaagaaataggagtcattcattagaatagaatagtgggtcatttttgtggtgtaagacagtattaatattttattttcaggcatgattacaaagacttcatattcttttcttttcttgatttaccaaggtcacagagtggacctgtatgatgctaatgatccagagcatgtttttgttcaacaggtggacaccaaggcctagctgatagtaccaggagagctcctagatgccagggactattttgcactttctcataaataaatagaaggacacagtccggtctaatttacctggggttccaagagtcctagtctagtggacctttgtcaatgatagacactactggcaactttgacatgtacttcccatcaatgacattttaacttacattttacagcaaaagcaaattgatgcaacaaagtaaattatattcctgtgtgtgcaagctgattgttgttcttccacaggtatgccctgcaagactttttgtatatttctgtcattctcaaatagtctctcagctacacagaagcaaagacaatccctgttgcagggtaactcattcaatttgcatttctttccagcctcttcttgcaaaccccaaaggcaatcatctatatctagggctgtctgacagacacaggtaatgctgtgggacactctagcaccttggggaaagagattctgagaagaaaagttagataatgagctctccatctagctctagtcctagaactgcagttcagcctctggaagagtgtgtcagaaatatggacatggtgtgagaggcaggacagatgtcttgctgttcagagaactcagagcaatctcagcacttggaaaaagaataattagagactgatttttttataattattgattttttctggctgtcagtttagcaacatttaagactacagctttgcctaataaaggtttactctaaagaacagtcacctccattcagtactgaacccttctttacagctttatgtaactgctaatccataagtatgattttttctttttgttttcatcttataaagaatttaaaaattggagctatttcttttcatacttgagctcaatggctcaaatgtaaccaagcattaaggaaatgttaccatatcccattaaattgaagaggttaattccacataatttatagcaccttgattttattaatcaacactgtaatatttgggcatatcactcctatcaaagagattttaaggataagagcagcatgggggaaaataaagcagaatgcatttaattttttcttcatcccatgaaaaaaaaagttgtatttaaaaagttatttatattttcaaaaacataagaaaaaatataaaatgcccaggtcctgcttttttttatttttattttttggaaacacagaaatttgagggattttacaagtcataagctacagaaactgagtagctgtccacaactttagtgctgaatacaaacagattcataatttgctcttggcatgtgtttgtcctggcttgtattgtaagcctttaactacatcagtatggtgataaataccaaacttttttgtggttcacaaccaaatcttccttttggccctgtctttgaaaacattttgtgatgaaaaagttcaaacaaaaaagtagaaaatatagttaataaacctccacatctccctcactggtctcagtaattatcagcttatgggcaattttaattatttcacatacttcccttccaagctggattattttgaagtaaagtccatatatgataacaacatttcatccatatttcaatatattaaattaataactattgtatttacaaacagtccattcagatttaaaaatcaccaatgattggctgaattaactgattaaatttttctgacttaacagattagtcacctggatacaatataaatgtgaagctttaagctttaagttctctcctttttttttttttctttttttgtcgcccaggagacaaaaaaaaatctgctgcccattgcaacctctgcctcctggaagacggggtttcaccatgtcggccaggctagtcccaaactcctgacctcaggtgatgcacccacctcggcctcccaaagtgctgggattacaggcgtgagccactgtgcccagccagtcctctctttttattaacttaatcgtatctagataaatgcatagataaatgcatcgtagggaaattatgaaaagtgaaattaaagcttcatgaacatagatcatcctaaattcaaagtaaccacaaactccggttgtgtaatcactatggacatacatcgttaaaaagataattagtttccctgtatccatgtatgtcatcactgcaattacagtgtagtgtaatcattgcctttattccaaataatgtaaagccttttatattaaaatgattgaagtttgtgtatttttatcacaatgttggtcccttttttttaaaaaaaagcaaaataaaatacatccatctctaataaacaaatggatctagtcctcatcttgttcactatactatatatattttacatatgggcaataatataattttacttaattactgtatttagcttgaaaatagcatttgacaaaatatttaaaaagtttgtagatttccttataaatatataaagacatttttactgttatagagaaatggcatatttctaagaaataggaatacattatctaataattatataataacaacatttcaactgagtgctaaaatgctatatttggaatcaaagtatctttgaaaggttatataaagagcttgttaataaacttgcctttacacacactgcagaaagtgttataaaattcatactacattaaataagaacaaattatgaatacaaaatggcttaggagcagcttcctcggcttcagaaaagacaattgtgggcccagataaggtgaaggccaaaatttattttaaatcatacaacagctgacagaaaggtccaaaaggagaactgcaaatagcacaatgccttatttccctggctgaatgattcgaatttataaagcatagtagaagagaataggacagatgaaaaaatataactcaagaagaaatccctgcatatacatcatggtgggatgaggaagttatagagataccttcataaaattagtaagcattcatcctccaaattaatgagtttagtagaaagcccacatagggcactgaaaaatggcatacttctcaaagtgaataatgctggtttgcagacacaaagggtcataagactaatcttgattttgcatgggaatttgaaaatacaatactcaaatttatggttaggtaatgtggccacctgcaggctgttaagcaacagaggaagaatatcccgttcttatggttaagaatgggaagtgattttctctttaaaacaatttatagtccgggtgcggtggctcatgcccgtgatcccagccctttgggaggccgaggtgggtggatcatctgaagtcaggagttcaagaccagcctgagatagtgaaactccatctctacgaaaaacccaaaagttagccaggtgtggtcgcacgcacttgtaattcctgctacttgggaggctgaggcagaaaaatcgcttgaacccgggaggcagtggctgcagtgagccgtgattgcgccactgtactccagccggggtgacagagtgagactctgcctcaaaaaaaaaaaaaattatagcaaaaaaattacaacacagcattatcatatactttgtgtaattataaaacttaaattcttcacacatgacaattgtggatataattttcaacaaagatactacttattatacctcattaactttgattactgatattgaaaaagaatagatttactattattgcttttcatcttattcttgccttctttaacaagcattgaaaaatctgagatgttgcttttggctaagagacatagggttaggtaaattc

SEQ ID NO: 341 - DNA, 38070 bp, Homo sapiens
tatcatttatcaatcacgtctctgctcatttatttattcctaccatgttcttagattaacttaccactgagaaatgattctactgtaagtaatgcattgaacaatgatcatgaatacatcttttggaaacctccgacttactggtgatatatcttcttgttaatttgctctgcaccctaattattctagcaataaataattattcatccactgatacactcgattatatcataaacataaaccatacttacaatatatcaggtaatgttctaactaagtactttatatattaactcatttggtcctcaccacaaccatatgatgtagacacaaatattatgaagattctgtggcacaaagaggttaaataacctgtctaagaccacacagcccataagcagcaaaaccaagattcagaccaaggctgcctaaatccacacatgagccaaacccccgcacatattgcctctctttgaaaaaatttgggggtacagaggtagctctgtccatctcactggggaagagtacaatctcaattaactttttctttttaagttgaatatatatttaagatatatttctgccatcctggacagcacagtgaaactttatctctacaaaaaatacaaaaattagccaggtgcagtggcaggtgcctgtggtcccaggtacctgggaggctgaggtgagaggatcacttgagtccagggaggtcaaggctacagtgagccatgatcacaccactgcattccagcctgggcaacagagcaagaccctgtctcaaaaaaaaaaaaaaaacatatatatatatatatatataaaatttctgttttaattatatatcaataattctagtgatacgcagagagaatgtgagagaccaaatggggcaaaatatcagtaatcgtaggtaaagggtatacaaaaggtcattacattgttcttgcaaatttctaaaactttgaattttttaaataaaaagttaaagggaattatttcatcttaaatgttaacattaataatatggtaaacgttacattttaaaatataaaaaaagattttagattcaaaaatatacacagatgtatgcagcttttcaaaatgctattgatagtagtaatagatccaaagtttgcaggcaaaacagtctttttttttttttttgagatggagtctcgctctatcaccccggctggagtgcagtggtgtgatctgcactcactgcaacctctgcctcccaggttcaagcgattctcctgtctcaccctccagggtaactgggattacaggtgcacaccaccacgcccagctaattttttgtattttagtagagacggggtttcactgtgttgcccaggctggttatgaactcctgagctcaggcaatccacctgcctcggcctcccaaagtgctaggattacaggcgtgagccactggccacaggcagttttaaggaacatacctgcttttatctcattggccagatcttgctacgtagtcacttgtatccactccccacaggatagttccaggaaatcaaattctaagatggggatatgaaggtaagaggttgatttggaagtctcttgaatttgacccttgtggagaaatgaagagggattaggcggtaggcgaatgatgcagcagccacaggcagctctgcagctaggatggccctgcagagttgcccccagctggaacaaggggcccagactttaatacttccacatcagccagccagtggatacaggcagccccaggaaaaggagcagaaccttgggtgaagcagttcttcagctgaagcaattgctgggagaggagacacagctgaagctgtcaacagtatccaccacattcccattttacagacaaggaagttgaggtatatagcaatcagctgtgtgtggtggctcacgcctgtaatcccagcactttgggaggccaaggtgggtggatcacttgaggtcaagagttcaaggccagcctggccaacaatgtgaaattctgtctctactaaaaatacaaaaattaaccaggcgtgggggcacgcgcctgtactcccagcagctcgggggactgcagcagaagggtcacctgagcctgggagaccgacattgcagtgaaccgagatcacgccactgcactccatcctgggaaacaaagcaagaccctgtctcaaaaaaaaaaaaaaaaaaaaaaaaaaaaaaagagtatagcaattaaataactttcccaagatcacagagctggtaaatggttgtatccattctccaacaccacattagtgctgcataacaagcacccaaaactactaacaggctaataataaaaatgtacttttgcacatgaatcaaccaggttggctaagtcattctgctgatttggtccaagttagtcagatctcagctgggctccctcgtacgtttgtggctatgggtcagctttcctctgcctggtctaggatggccttagctaggatgacttactctcctgcacgtggtctcttgtcctcctgagcttgttcctcatcatggtgggaagcttcccagacaatgaatgtggacaaagcctttggagctccaagactagaacgagtccatcatcacttctatcacattctattggccaaagcaaatcacaaggccaagcgcagagtcagtgcggaaggatcttaccaaatagcatagacactcagagatgtgaaaaatcagggacaagcaaccatagtgatggagcccgaatacaaactccagagacctcactcctagaggtcttactccacagtcatctcccaagcaaatctttaattagtatctatgtcaagttccacctagcctggcactgtgaaagagcaaggtcctgctgttaaggagtttacggcctagataaggagaggagacacccaccatgaaagtttggtaacaagaaaggtaaggcaaatgtaagaggggcatatgtagcaggaatcaggggcagaggaggtactgtggaccacgttggtccaggagggtctgggcagggattaatacaggtcttggagaatgtgcagacttgagtcagatggtaaggagggattcatacccgcacctcctcctcctcctccccctggtactgatggagggaagggaaggaaaagagacagaatgcagggcctgtgaagatagtagttttctttctttcttttcttttcttttcttttttttttaattttttgagacggagtcttgctctgagtcaccgaggctggagtgcagtggtgcaatctcagctcactgcaacctccacctcccgggttcaagtgattctcctgcctcagcctcctgagtagctgagactacaggtgcgtgccactatgcctggctgattttttgtatttttaggagtgacagggtttcaccgtgttagccaggatggtttcgatctcctgacctcgtgatctgcctgcctcagcctcccaaagtgctgggattacaggcatgagccaccgcgcccagcctgaggaaagcagttttctaaatcccctctctgttgtctcctcagccccttagggtttccttttatctgccttggccatgcattgacagcccagcatgccgaggacaaccatatttcattgttacatggatttactatcctccttttgaggacgtgggcgaaacatctttgttttactgagcagaagggcagacgagattaccaaagggaggacaagagtagatggctccataaaggaaagggaatggagccatgggagggggaagatcaggaagaggggttggaaggagacagaagagggagcaggagaggagaggactgaatagatactatgaggaagaatattttggggagagcggagtgaagatgcttattaggaaacgatgccgtgtaataagcaacagagccctgggctcgggctccagccaacagccctcagtaaagaccagccctggccagcagccttcagtaaatacttctcaaagctttaggagttagatttcttgtgtcttcaaatgctgagatgacatttagggctgaaacaaggcagtcagttttatctggtttcctttccatacactaggcttacctagagcaacttgtttatttgcctattggatagtagttaaaggtgccagcttgggaatgaggcaattgagttcaaatcctgactttttttcttgctaaatttgtcatcttgaacatgtcatggaacctctctgagcctgtttcctcccctgtgataggagtatgatagtatctacctcataggatttttgtgaggattaaataaaataaaacatataaactatgtgccttgcacatagttattgctttaataagctagctctggctgggcgcagtggctcacgcctgtaatctgagcactttgggaggccaactcaggaggatcccttgaggccaggaattcaagacaaacctgggcagagagggagacccccttctctacaaaaaattaaaaattagccaggtttggtggcacacacctgtggtctcagctacttgggaggctgaggtgggaggatcacttgagcctaggaggttgaggctgcagtgagccatgatcgcactactgtactcccagcctggatgacagagcaagatgctgtctcttaaaaaattaattaattaattaattaaagttagctattgttattattgtaatgatccaatgattccaaaatttagttactttatcctcattttacatacaaggatggagatatagacaaatcaaatccagctgcccccaaagcccgatgaagggcttccctatgaaccaagaccctggcatgagacagagatggctccaagcctctgagccctgcacagtgcatttgtattctaaaaacaacaaaccaacaagtgcaggagcagtaagggaggcagagatccgtcatttaggcaggcagaaatgattaatgcaaaattaaggtagaaaccgacacaaaatgggctgggcacagtggctcatgcctgtaatcccagcactttgggaggcggaggcaggccaatcacgaggtcaggagatcgagaccatcctggccaacatggtgaaaccccgtctctactaaaaacacaaaaattagctgggcatggtggcacgctactgtagttccagctacttgggaggctgaggcaggagaatcgcttgaacccgggaggcagaggttgcagtgagccgagattgcgccaccactacactccagcctggcgacagagcaagactccatctcaaaaacaaacaaacaaacaaaaagaaaaagaaaaaaaaaaagattccacagctcttggtccagcaccttttcctccttctctacccagccgactactactcatccctcaagtcccagcacaaagcttgcctcctctagaagccatccctagctcccctatgtagtaactggtccttccaaagtgttcctgcagctcccagtttatcccttctatgtctaacttccatatcaatattctgttcacccatctgttcatccagtgttctgttcactacagggcatgttggcatgtgcctgtggtcccagctactcgggaggctgagatgcgaggatcactggagcctcggaggtctgggctgcagagagctgtgatggcgctactgcactccagtctggttgacagagtgagaccctgtctcaaaaaaagaaaaaaaattccacagcctctctggggccgcatgtcaaaagggtgcctcggagcacagacctggacatccagacatctgactggaagatatgccaccgtaaatcccaagaaggtagatccacccgattgtcttctagtcaccttcgccatcagcttccaacagaggcaaaggccttacattctcagtgtcccagtcttggctcagtgcaagacaagtgactgataaacctcacgctaaggcagaaagagccctctttcccctggggcagacattgctaagccatcttagcattctttctgctgagccagccacagaatccttcttaagttaatgttccaggaacccaccacctatcagaattagcccgcaattcaggatctgagagaatctggaattttaaaaaaagaaaaagagaaaagaattggcctgcaaggtaaacttacatggtatgtttgccctaatggagaggaacatttaggtgcatcacagatgtcctgatgctacagtaatcaagcaggaaaggaaactgaaattatggaagaattccaggtatctaaaaagcaaatgtggttcctttgggtagggacagaacagtacaggccagtctatctgcaagtcattctgtctgggtcctctagcaagtcaatccagttcaattcccaaacaccatgccagtcttgtgttaggctggtctctgccctcaggcataggtggcacatgctaatatcaacttagtagggagaacaagagtggtgccttttaaagaaacatagcggtcaaggcagctgcaagcagggaggaaagtgatcagcctggctgcgggattattaggaaaggcttcgtgaaggaggcagtcctaggaaagacctcgaaggaggtaagtggagtcggaggacaaggcacccagctgaggggaacagcttgagcaaaggcatggagtcaggaaagtcgaggccgacccagggaatggggacacatctagggattgagtagggaagtataactgaggtcaaactgcggaggtcctggaaggccacaaagaaggttcgtcctcctaagccaccacccagagaccctcggctcggaagctgggatattcccagggagccaacagggtagaccctcaggaggcctttagggaagtctgcccttccccagtttctttttaaacatgctcttccctcctccagaaatgtcctttcctccttctcagcccagctgactgctactcatccttcgagtcccaacacaaagctcgcctcctctagaagccatccctggctcccctatgtagtaaccggtccctccaaagtgttcccacagctcctgacttagtcgttcttggtctaacttaaatatcaatgttcttttcgcccatctgcctccccactagtctgtaagcccctagaagtcagggcctcttattcttttctatattcctactgtcttacacattgccagtaaatgtggaaggaagggggaggggacgaaagaagaaacgggaagcaccagttctggcctgaggcaccagaggctttgccctgtggcctgtcctcctggtattcatctgcctcacatgacctggcgcctcctagcttgaaccctcagtttctgcctcgctctgggcagggaggacacagctcccattagctgcctcctgttgctagtgcctgccagcccctcattagcccagatggtccccacttctgccctgagagatatgggctcagcagaggtcgaggcacaaatgagtttccctgaccttcctgcctggtgagccccttatgccaaccccaggcagttatcctcaggctgctattggacagaagcatttgatcctcagagctctgaccgtggacacacactttaccatcagttatggggtcaatccaggggcctaatgaggagcatcttacctgggagaaagtgaggcatatgactcaagctagacatgtgaggaaaggctaggataaccaggaataaagagaagtatccagatggcatactctggtccaaggaccagatggcccctagcctcacttggcagaggccaagcctccagcctcccaattctttacatttcattcagctccctgagaatgctcccctcagcctgccataggagtgtgctctccgcagcacagaggagtcatggaagtggagactgtgagagtgacagaagagaagaaacagaacatggaggcctgcctcctaggccacacacctgtgcccggccacacctctggcttctagactccagcttgccctgggaacctctcctcccagggaggctgaagacaggccctggggcagtagtgggtggagactggacctcaacgcctagagggaagtgaaagggttaaccaccccgccacccaccaccacctgccactgggcccctctagccagctcaccccagagcactgtaagcccaggcttgtctttggtgctctctcaatttcatcttccctcttattcctccttcccactccttctgggagacactgggaggagaagctaggggccattggcaccagctgtctctggggtgtcatttaatactgtccgtaatcaccacctcctctcctggcttattaactctttccctcatggctactcttgtcatccctggacatctctctatctctgtctagctctcaccacacacacacacacacacacacacacacacacacacacacacacacacacacacagtgaatgggaagagggaagggctaggaactaggcacactctggtttcttgccactgcagttcctttcccacctgacttcacccccgaaaactagtcccaccaccagctgggccaggagcaggagacaggctggttcaaggagctggaggaacagaggacacttctgaaccagcagagcaatcacacaacagcaagctcagagaaagagaatcccagagggcagatttgaggatggacacagggaatacaaaattagaaactgcccaaagatatagattcctcctccaaacaaaatagagtcaccagagtccgagtgaggactagaacactctgatcatgtatgcgtttcatagcctagatgggaaaagggaatagaggccttttcccctggcaactcaaggagattctgcttctgaaagtgtttcctgaacttcaggatgctctgaagaagtaaggagccgtatcaatcactgttgagttcattggcaggaaatagaccacagtcagggtgaggggctgggagcctcagacctgccacctgccaactacagggtcttgggtttcatggttgtgagattataatgaccacacatccacaggacacttctatctcaaatatccagtgcttctgtcagacgaggtgccatgatttggagaagtgaaaaggtggggaaaccgaagcaggaggatcgcttgaacccaggagttggagtccatcctgggccacacagcaagatattgtctctattttctttttaaaaaataaattttaaaaataaagaaaataaagtatggtcctttcatgcaatgcccagcatgtgtcagtccttccacagcatctttttctttttctttctttttttttttttttttttttgagatggagtttcactctgttgcccaggctggagtgcagtagtgctgtcttggctcactgcaacctccacctcccaggttcaagcgattctcccgcctcagcctcccaagtagctgggactacaggcgcccgtcaccatgcccagctaatttttgtatttttagtagagtcggggtttcaccatattggccaggctggtctccatctcccgaccttgtgatccgcccgcctcggcctcccaaagtgttgggattacaggcgtgagccatcgcgcctggccccacagcatctattttagcagccaccgcaagggctgggtgaccctggtgtagccgggagtgggcttatttgcaggtgaactgggagggtgcccccacctgagtcttaggtcataggagaagtgcgggtcaggcctcagctgcctatccctggagcaaaggcaaagtccaggatagccttccagtatcaccttccaccaggcaggccagccggtcctctgagagataaggctcacactttggactccacacagcgacggggccccctgcccctccagctggcaggcgggctccctgcctgcttaggggtctaggccgaggcagggggaggaccggacggccggccactcgccgcgaccagcaggagagaggggtgcctgccacaggttgtcaccctcgccgcctcccccggcggcgccccgccccttactcagccctcattactgcagcgcctcgcgggggtctggcccggagtggagggcgcgcggtcccagccctcccgctcggccggcgggtgtcgagttcaggtgcgaccgaaaaggggaaaggagggcaccgccacgtgagctgtcctctccggggaaggcggtggctgcgtgagggcgggggctgctcggtccccagggccccgcccctctgcccctctgccccgagcggtgctggcggtagggaggggccagcccggtccccgccctcctcgcccggacccgcgctgcccggctcccgcgggccgctcgatcccagtcccaggctgggcatcggggctggctggcatcgccggggagccgacggcgacggggagccccgcgggcggggagggcggcgcagggcagcgggtgcggtgacacctgtgggcacaggtgagcggcgggagggctacgcggcccgggggcggggcggccgggacccggggcctggaagccggggcgaaggggaaggaaggcctggcctcccgaaggcgggaggaggggagccgggggctgggctgagacaggaccctgggtagggagcagtgcgagggagacagcgccctcagagggaggactattgggaggcggcaggagggacagcgaacgtttcctcctctgctcctgaatcggaggaaggtaagggagggctgaggcaggacctcaggcccacccggtcggggcacaaacacctgcgcagccttcttgagcccaccgccccttaggaggcctctcctcttccaggccctgcccactcgagggcgggccctccctccaggtttaggggggagggatggagccccacgcctggcccccagctccatggtggtattcccagagtctggggaggaccaaatatatagcccgaaactggagaaactctaattctatttggctggtctctaagggcagtggccggacagctggccccactcacctccctgtctgtggtcaggagggttcaggtaggagatgggcaagcctttcagtaaaggccagacagtaaagattagagacttcgcggcctacaccgtctgtcccaactagcaagaagcagtcacaggttattaggagaccagcagaagaggatggattccaacaaaactgtgtttatggacactgaatttgaatatcatgtaatatttacttgtcccaaaatattggtggcttttttgcagggggggcagcagttgtttcaactatgtaaatatgtaaaggcttacaggctgtacaaaaactggtggcagactgggctgtctccagccacccccactcccagcccaccccacccaccatggcctccctccagctttttcccaagctttatatggggaaggggatggggttatatctaggtgcaaggagaaccctcccacctgggtgtatccagaaagcccgagacctgtctgtgacccttgttcccatttgagaccagtgcaggagcttgtaccccaaatatgcacacatgtgagagaggaggtacatctccaaggggcttcctacccaatatgtacctggacctaccctactcccaccaagtcatagatgaggcagccatgttccccccaacaagtgaccaagcccttggccctctcctcccccactataccctccctcccaggccccctaccagccttggtctcccgcctggtgccattcactgattggggatggcccttccattcctcttttctctcttgcagccctaggggacctctttctcctggacattgaagatatggccctttggaggtgacccaggagagaagggatgaaggcctttggtcctccacatgagggccccctccaaggactcgtggcctcccgcattgagacttatgggggccggcatcgagcctctgctcagagcactgctggcagactctatccccgaggataccctgtgctggtgagtccaggctgtgccccaaaagtgacctggtggggcaggagggaagacacctaggctgtggagtctctgtccccttacaggttcagaggttgagctattcctgccccttaccctactcttctttcctgggttgcgggaaagaggagggcagtgacagggccaggctccagggatatcacaccccagtcccagcagctgggcaggagaggcggagccaggagaagccaggccctccgaggagtgctgttagacaggtctcagacaaagagctgcgggtaaggtcatcaaaccccagagctggcgcctcccaggctcccgcctctgcttggcaggagtttgaggccttcctgagatctgcctctccctgagtcaggatgaagatgagcaaaggttcagggtgtccctactcctccagtggtgggtagggacaggagggtgcctgccttggctccacccctggctccacctgcctggctctcctccagtcctaaccaagcagaggggtgtggaagccaggtctgtccctcagcctgcaggtttcccctccaccttgaggacagttctgcttgtggctgggacatcccctgcctcaatgcacgataattttgcctttggagatgggactttcctaggctgtgggtgagaagggagactagaaagtatgtggggtaattcaggccacaggcaaatgaaggaatgtgaccaggcctgccctgggaggagctgtgtggctgtggcttcagcctttcacacagaagggcagccactcccagctggatgggatgcaggctgcacgcccctggggagaaggctgcacatgtgagtgccctcgtccccatgtgtgagggaggctggtcatagacaaggagagttacgagagaccagaatgctgtgtgcaccacgccttgtccatgcaccccccatggtacggagagcaggaggcagtgggggcacacacaccagagcccaggcatgtgtgtgctgtgcacctgctcggcaggaggccccacttcttccccaggcccactcagggagccaggctgtcttgcctctgcccactcagcttagccttgccggcagtggccgctgtgactcagggcaggagcagtccacaccaaactggtttgcagggagaagtgagccagcccgacttaccagggtgggggaacaacatctagagccaagcctgcccccctactacctctctggggtttctggggaaagggaggcacccccagaacttcccctgctcctctcccaggatcccagtcgccgacgcctccagcagtatgtcccctttgccaggggttctggccaggcccgaggcctgtcacccatgagactgcgagatccagagcccgagaagaggcacgggggccatgtgggggctggcctgcttcactcccccaaactcaaggtaagggggtccctctcctcccatccccacacatacggccccaattgtgatggctccgcagatgaccagcaagctccgggagctgagaacacaggtccaggaggctgctgcctgccagtcagacatggctctgcctaggacctctcagggatatatctctctttggtccatgcatggcaaccagggactttgacttgagacactttgattaaatgtggataaacgattgatattgagctttcagtttttgaaaactaccaagtcaaattaccaagttgctgagagtcaggtatgctctctctatcctcagtgccacatcatccttcactgccactgtgagcctcacctctcctcccaagccacatccagatggagtgagtgagggtcaggagtgtctattgctcacattcttggtaccaaagaaacctgtaaaatgggccgggcgtggtggctcacacctgtaatcccagcactttgggaggccaagacgggcggatcacctgaggtcaggagttcgaaaccagcctggccaacatggtgaaaccccgtctctgctaaaaatgtaaaaaaaaattagctgggtgtcatggcgggcacctgtagtcccagctattaaggaggctgaagcaggagaatcgcttgaacccggtaggtggaggttgcagtgagccgagattgcgccactgcactccagcctgggtgacaagagcaaaactctgtctcaaaaggaaaaaaaaaagaaacctgtaaaatgtaagccatgctgcttcataaaaaatgccattttataggcaaatgtcaaagtggtgcctgagaccactggttctctaagtcttgttctgattcacttgaaggtccctctgaagtgtctgtttctgtccctcccccacctcattctgattcaggagacccatggaaggcctctttcctgtcagggagcctagatcagacccctctccagggacctttccacagaccagggtgcctcttcacccacattccagcaatgcctttttccctggaattccagctggggccgacccctgttctctaggcctccatgtccccactcatactcagtgctgcttgccatctcccattccagacacagacacacgcacacactttaacacacatgcacacacacacagccctcccggggccctgtggctgggtgccaaggatgtgaccagagctgatgcccttctcggctcccccaggaactcaccaaggcccatgagctggaggtgaggctgcacactttcagcatgtttgggatgccccggctgccccctgaggaccggcggcactgggagataggagagggtggcgacagtggcctgaccatcgagaagtcctggagggagctggtgcctgggcacaaggtgagcctgaaactcacaaggtgagtctgtccccacggcgtgaatgcacacacagattctgctctagaggagggaaaggccttgggaagtggggtcatgtggaaaaaacatctggaaacgcgttgatctgggttcagatcccagctctgccacttactagtcagaccttggtcaagacagtaaagttctctgggcctcagttgccacatatgtaaagtggggataataccacctacacatcagagcactggtttgaggattaaaaggtcatggtcatgcacaaagtgcctagaacctatgaagtggatccggtcgcacttaacagctggtacttgccattctaattatcattccccaactgaaccagcattctccccaccccaggagatgagccaggagctctgccaccaacaggaggccctgtgggagctcctgaccaccgagctgatctacgtgagaaagctcaagatcatgactgatgtgagcccccctcagccccagccccggccccatcttccctgcatgagcccccatcctcccagactggaaggcaggtcactgggggagggaggggcaggatttcaggccagtctgggatgcagggagataggtcagcagtactgaagttggtggggggtgggaggtgacgacactgaagggctgcgctgggtcctgagaccctcgtctccctccctgcagctgctagccgccggcctgctgaacctgcagcgagtgggactgctgatggaagtgagtgggtgctcaggaggggaccctggcacagcccgacctctgagcctggggatgagggtgggccctccagccatccctgtctgaattcccactgccccgttttttgggatgccttgccctccctacttccctgttactggggactccaagcaggccacaggccccccatttctcagactgacatccttgagatcttccaggcccagtgcccagttcatccttcttcacccccgcccctgctgtccaagcttaaggtcctcacctttcctcagccagtgccacccctggggaccttccaaaagtgtgctgctcagctctgctccctcctccaggtgtcagctgagaccctgtttggaaatgtccccagcctgattcgaacccaccggagcttttgggatgaggtgctggggcccaccctggaggagactcgggcctcgggccagcctctggaccccattggtctgcaaagtggcttcctgacggtgaggcctgtgaagggctgtgtctggatggggcaggactcggagccctcgggggtcctgtgtgtagggcatgcccacagtatgcaaatctctgtgatttgaggggccgcaggacacagcccctacccctaatatcacctcacctcctcccttcatgccacaagtctgacctctgtgccacaggctccttgttcttctggaggcctttatgaaatgaaaatgcagctgtctcagagaagggtcacaccttggctcccatcaactacaaaagctgggtgcagcaaatgaggcctaagtgaggggacccttaggaggacctgggtgggtgtaaaaggccacaggaggcacccggggcacggagaagagtgacaagagaaagcaagagggcctaggatccgactttcttctacaatgttacctagccaggaaaatgtgggccctgcaggaaaaagttgcagtggggtagagaggtaggcgtactgcccctgggagccttaggtaccccctccataggagcaaggcttctgagccaactcttaggtcgccaccccacccccagggtgaaatgggatctgcaatgtcctgacaacggtccagctgaattatcgatggtgggagagtaagtccagagcagcaggccccagtagcactgtggatagagggagctcagagagctctgggtcagtgtcgggacctcaggctccttcgtggaatccagagaaaggggcgtagcctcgagagcattcctgggaggatcctgggagggagggactgtcaggagctgggctaagggcccctgcgaggctctcttcacctgctcctgggtcctgcagctagagcctgtattcatggccttctccccatgcctgctccccacctcccgtatctgtctctccagtttggccagcggttccacccctatgtccagtactgcctccgagtgaagcagaccatggcttacgcccgagaacagcaagaaactaaccctctcttccatgccttcgtgcaggtgggagaaggggtgctggggagggggacgggtgcatcttagccggccggtctccagctgagcctgaggctgagttcaccactaggcagggcaggagggagcaaaccctgagccccacccaccttccctgcagtggtgtgagaagcacaagcgctctgggaggcagatgctctgtgacttgcttatcaagccccaccagcgcatcaccaagtacccactgctgctccatgctgtgctcaagaggagccccgaggcacgagcccaagaggccctgaatgccatggtaggtgccccagtggggctgggactctggtgaatcggggactgggaggggggtctctttcttagtgtgtctgtgacagtgtggcgctgtgctgtggctggcattggttgggaggggacggctgagccgtccctcctcccacacccccaaccccacctagattgaagccgtggagtcattcctgcgacacatcaatgggcaggtccgccagggcgaagagcaagagagcttggcggctgcagcacaacgcatcgggccctacgaggtgctggagccacccagtgatgaggtggagaaggtgagagggcaaagggaagggacccaggaaaagcaaggtcccagggatactggtgaaggggagggctgcaaggccagaacaccccgtacttgggtgctacaagggtgtccatcattcctacctggtggtgacagtccaaggggtacaggtcagaagagcaaaaaggaggccctgggaggctttctctagcccatgggggaaggatacaaacagaaaggtgttggtggcagaaccaggagccgcccttggccaggaagtccaggcagactgccgagcgccctgacccctcccctctgtgtccctcagaacctgcgcccattctccaccctggacctgacgtcccccatgctgggggttgcatctgagcacaccagacagctgctgctggaggggcctgtgcgagtgaaggagggacgagaagggaaggtgagggtgctgcggacagagtggaggggatggggcacggtgggagaaggtaagaggcagaaacgccggaagtgggagaagaggggtttggggaagaggatgtggttctggctaagccccagtcatttgtgtgaccctgagccagccactttgcctgcctgtaaagtgagagatgtgaccaaagcgacgcccctggccactcccgcatttgggctctgcgtgtgtccctgtgtgcctgcgcaccatgcctgagcctcctcccggaccagccctgcccctggctccagctgaccctgtctctttcccctacgcccccacccccagctggacgtgtacctgttcctcttctctgatgtgctccttgtgaccaagccccagcgcaaggcggacaaagccaaggtcatccgaccccctctcatgctggagaagctcgtgtgccaacccctgcgagaccccagtacgtccttccttcagggagtcttttcttctccctcttctcagcgaggggaaggaggagctgggacggagatcaaataaaggctggcctcttgaaggttgtctcctccatccagacagcttcctgctgatccacctcactgaattccagtgtgtctccagcgccctccttgtgcactgtcccagtcctacagaccgtgcccagtggctggagaagacccagcaggcccaggtatgggaaagccagcaacggggaggcatgggcaggggtccccggagctcagaaatgggagcacagtggtggatcacacctgtaatctcagcactttgggaggctgaggcaggtggatcacctgaggtcaggagtttgagaccagcctggccaacatggtgaaaccccgtctctactaaaaatacaaaaattagccgggcgtggtggtgtgtgcctgtagtccccattacttgggaggctgaggcaggagaatcacttgagcccgggaagtggaggttgcagtgacctgagatcgtgccactgcactctagcctgggtgacagagtgagaccctgaagaagaaggaaaaaaaaaagaatgtaggaaggaaggaaggaacgaatgaacatgggagcgcagaggggaggaggagagaggctggggtggattcagtttcagactggacaatctgatgtgccccagagagggaggcagagcctccaccatccatcagaagacagaaaaagcctttggccagctactgtgccagccactgggagagcccaagatacagcatcccctgaaggtttgtacagcctgaaatgattaacttctagaagtcatcttccattcgcagacatttacagggcacttgctgagtacggcaggcactagagctaggtgctagggaatcagaaaagagtaaaccaccattcctgccctcaaggcctaggtgctgcagcctggttgagtaattagtatacaaacaatagagagaagttatgtagaatgaagctgggacagagaagggagcaaggcattgtctgctgggtctgtttggaagggacacagaggagctgatgtctgagcaccatttgggaggatacctaggagtatgtcagggagtcagggtggaagggaagggcattccacatggaggagcagaacgtgcaaaggcgggaactgtgaaacagttgtgtgtgttgagagaactgcccccattggtattgctacagtatcaagtacaagagtagacgcagcagggagaggctagggggtaggtgccaccaggtcatgcccatctctgcatgtcatgataaagcatcctatagatgagctttgtcctttggatgacagagggccagtgaaggagtcgggcaggggagtgatgtgagcagataaaaagcaggaggagttcaaaagaagagagatgcaaatggagctgtattaggtcccacaaacttggtggcctaaaatgcatcagaagcttactctctcacagttctggaggccagaagtttcaaatcaaggtgttggcagagctgagtttcctctggaggctctagaggagaatccatccttgcctcttccagctcctggttgccccaggcgttccgtggcttgtggtaacaaaattccaaactctttctctgtcttcccatggccttcctctctgtatgtctctgtgtccaaatttccccctcctttctcttacaaagatgtgagtattagatttcgagcccaccctaaatccagggagaactcatcttgagctcttaggatctctgcaaatctgcgaagactctttttcgaaatcaggtcacattcacaggttccagagggtaggacttagatatatctatcttttgggggggccactattcaacccaccacaggaacggaatggccaaagagaagtgaagatttgagttagacttttaaggataggaagaccatgagcagcagaatcagaggaccagctgggctggatatatttctggaatgacggccatatctgcctaagtatggagcacagtgtttgtgtgagtgcgtggtaagaggccagattctgcagaatctcagagctgcagaaccctgtggcctggatgcgcttgagttaaatagggtcaacaagagacagccaccgtgaattctttttttttttcttttgagacagagtcttactccatcacccaggctagagtgcagtggcatgatcacagctcactgccgcctcaacttcctgggctcaagtgagtctcccagcttagcctcccaagtagctgggactgcaggtgtgtaccaccacacctggctaattttttgcatctttttgtggagacagggtctttccatgttgtccaggctggtcttgaactcctgagcttaagcaatctgcatatctcggcctcccaaagtgctgagattacaggcgtgagccaccgtgcatagccctgccatgaattcttgagcaagggtgaaatcagtgtgtttcctcttgaattaggttttcaggaaatcaggtagcagtgtgctgggtgggctggaggagggagaaattggtgacaggaggtttattgtactagtttgggtgtgaaacatggaaggtttagtgccacagccttagggagacattgcaaaaagggacaaaaaacaaaggagaagaaaggacctaaagaagagggaagaggccgggcgcggtggctcacgcctgtaatcccagcactttgggaggccgaggcgggccgatcacgaggtcaggagattgagaccacggtgaaaccccatctctactaaaaaagacaaaaaattagccgggcgcggtggcgggcacctgtagtcccagctactcgggaggctgaggcaggagaatggcgtgaacccgggaggcggagcttgcagtgagccgagatcgcgccactgcactccagcctgggcgacagagcgagactctgtcttaaaaaaaaaaaaaaaagaagagggaagagaagggggagccttagggatactttggttaaagtctatactgaattcagaaaaatccaggttcagacaccggtcctaccaggtcctagccatgtgaccttgggtaagttatatgacctccctcaacttcaatttcgtcatctgcaaaacagatatacacaatgactacctgcttcctagggagattcaaagctgtcattcggcttaggcacacagcctggggccagcactgggcacaggctcaggaactccagatacccagcggcaaagagcacagttggcctcccgaagcttcagtttggaacactgcattggcaatgggaccccagacagaaatgcagtcattagaaagggaaagggaaatgtgtttgtttagttattgcttcctcagtgaggtggctttactgtaggaatatttaaacagcagcgctttgaaattgaggcagccaagatataacctagtggagatatcttaggggctttgggaacaaaagaaacagaaacaaagacctggaattcaagtgaaagaggaggacaaaaaacacaccccaaggggaggcaggtgggttttgtgatgacagtggtctcccatctgccctgtcccctgcttccggctcggttcactgtcccctctgcatggcagggacttctctccaccacttccacctaagcctaaacacactttccactaggctggactgactggcaagtgacatcattctggtggttaatcaaattttcttggccaggcgtagtggctcacctcctctaatcccagcactttgagaggctgaggcaggcagatggcttgagaccagaagttcaagacccagcctggccaacatggcaaaaccccatctttacaaaaaatacaaaaattagctgggcctggtggcgcatgcctgtagtcccagctactcgggaggctgaggtgggaggatcacttgaacccgggagatagagcctgcggtgagctatgttcccaccactgcactacaacccagacaacagggtgagaccttgtctaaaaaaaaaaaaagttaaataaaacattttcctgaaggctagaggctcaagggggagcccagggacaaaagcgcaagctagtggcatcggtgtccctagagccccaactccccaggatagccagtggggctggcagtgaatggcaggctgccttttttccttcggaactgccacctccaccttcagaactttctcctcttttttttggtttttagtcacagaacaacagccagactctcaccttctccctttcagaatcccaagagctactgaaaattacgggtattttactatgcaaaacaactcagtcccctggtagtctcactccaggctaacaggaaagatctgtcaagatctataaccaagatatgcaccaaggctccctggccttccttagcaaaacaaagaaaactgaaactttgaaatgacttttcctgctattgtctcacaccagattattagggaatcctctctagagccatcagtctttatacactgaagagggcagtagaaactctgttggtccctttcatagagcaatccccagggggcagactattgttttctcaccctggcagaaacgttgacttgcagatttattcctagcgggtctagctgtgatgactcacacttttagagaaagtaagcttctccagggagaagagactgaatcttggggaatgcccagggactgagaagaggaaaaggaacagagacaggaacagaaagagccgtcagagatggcgaccaagaaattaaagcagggagactgaaggaggcagccgaggctaagagccagggtctgaaggagaggcccgagcagctgtcagggagttacttcacctcttggggagttgcagtgcacgcaggacagacagtccgcaagtggccaggcacaaggcccagcactgtatgggcactccataaatgtttgccgttgtcatcattagaagaaaggggtggtctttggggcctgggtagggcctgctgctgactggggaaacgcatccgcatctgttgctcaggaagtcagtgggcacgtttcagagttcggttttagtccggcactggggagttctgggaggagagtgggtgaatctaggagccaccccagagacagcagggaaaggaggcatttcctctccatgggtacaaaggaagaagaatcctgctaggggccctcccttcctcttctcagttttgtaggggggtcacattctggcttaagcgccaatttccttttcctttcccgtcccctctgcccccatgtgtctctcctcttaaccaagccgagaaaattctcccagggttgctggagaggctttgggctcgctgggaggcacctccaagagccccatcccgcccattcccccgaccccctaccccgtactcggggctccccctcgcccccctcccccccccgccgcctcctccagcctcttcctggggtcgggcaaggggcaagtttagcagagatgatggcattgaacgtcccttacagaaaccctgcttccttccagttcttctttcccgtaacatcccttccttggcacccgaaacacaaacctgaatttgggtcctgtggggcaaaagggcaccccagcaggacaagcagatcggcccagcgcctccaccctctcttttctcacttcttccctcccttcacatggagttgggagatgaggcctgggaaagagggagtcctgccccaggtcccggccctggcaggtttcctacccccaggtaccctcccctgctccggccaacagaccacatcttatgagaatgctgtcagccttgggaataagtgactggagagccagaaaaagcagaatgggaactataagcctggtgtcattttcctatccctgttcatccatttcgtctcttgtcctgacccagctgctccccgggtttcttgagaggctttgggaaagtccaggtgcccaggagttgctggctcatatacttcaagctggggagatagtggaaatatttaacaattagtatagcatgggcatcaaccaatcagaaaggagcgctgcactagaggtcctctgctgtgccagaggttatctcccttagttgctagatcatggggatgggggaagtggttgaggcccaggcagcagccattcccttaccagcatggaagacttcaatattttaacaaggatatggccataccagcaagtcctgatatcagtgctgcccacagcagccaccagtacctcccttttgccaaggcttgcctccgcctccaacctcagctctgccaccttctcttccctctccctccccctccccctccccaagccaacaaccgaccttctgtaactctttacccttcaaggctgtccttgaaagtgttgcagtgactgaactaggactcaaagagcaaggccctgtcccagctctgcttctccatacctgtggcaccttgagcaagtcacttcacctctctaggtctaggtttcttgtctgtaaaatgggctaacattcatgttctccacaccacagggcaatgatgtgtatcaaatgaccacatgtgcaaaagtgctttgaaaattttttctcaggtggcgctatttccttttgatggtacctgtatgaaatcgctgagggagggagaaggcagataatataatgcgtcctctcctcagccttctaggaactttcctccctctgaaggacagcagagtcctcagcctgggacaaagcccacctctgcccacgttctgccctcctgctcctcccagcttcagggcagaggcccaggtggtaggagagggatgctcttgaaggagcaaccagtaccaattcagaacacttattctaccatcaccaccaaccagggagggcttcctgaaggagggggaagacctgataacaggtctgccaatgggacatgagaagcaggaagacctgtacaggtaggaaaagggccattctgttcaccccactcacccccaacactagctccagagtttggtgccaccaaatcccggcaccaccccactttcttatggtaagaagtaccccctcagacagttacttaaccttagagtctccatgtctcagtagtaaggtggggtaaaaatatctggttcatggggtttttgtaaagattaaataaggtaatgtaggccgggcacggtggcttacacgtctaattccagcactttgggaggccaaggggggtggatcacaaggtcaggagtttgagaccagcctggccaagatggtgaaaccccatctctactaaaaatacaaaaattagccgggcacgttggcgggcgcctgtaatcccagctactaaggaggctgaggcaggagaatcgcttgaacccaggaggtggaggttgcagtgagccaagattgtggcactgcactctagtctgggtgacagagcaagactcagtctcaaaaaataataataataataaaataaaataaggtaatatatgtaacgcacttagcagggtgcctggcaaacagcaagtgctcaataaatgagagctcttaataacgaaagtgtcctgtcccaggccgccctacagaagctgaaggcagaggagtatgttcaacagaagagggagctcctgaccctctatcgggaccaggacagggagtcccccagcaccaggccctccacgccttccctggagggctctcagagcagcgcagaggggaggtaaggctcacacggactacaaggtctccccgagcaggaggagggagccataaggctgagaaatggcattactgcacatttttggtggaattgggaatagatagaggaacgcaggcgtagggcagggtagggaagctcggtaccagctgtgttgggtcggaaggttggtaccagccgtgttgggttggaggtgggggatagggcacagacagcctacagagttagcctgcctagagtcacacaggagcactgtgagaggagcaagctcgagagtgaaggtaggtgtggatctgcagaatattagagctgccaaatccccggggagtgtgaggttcgtctaggatagcaccactgcttggcagcagcttaaggagaaaagaagaatcgatcattgaggataatatcaggtaagttcaggaaccactcagcaaaaacctgactacccactcgatacaagatcctggaccagatgctatggataaaacagtatagaggcagcccgtactctcttaggagcttaaaatctagccagccagatgagaaaaacaatcacagtgcgatggaaagatgataccaaaataagtttggaggaggggccatttctggatgtagtgatcaagggaaactccctggacttgaacttgacccctacgcatctgactctttgccattaactgtaggactcctgagttctcgaccattatcccccacctggtggtgacagaagacacagatgaagatgctccccttgtgccagatgatacctcagactctggctacggcactttgatcccaggcacccccacggggtcccgctccccactgagccgtctacgccaaagagcccttcggcgggaccctcgcctcaccttctccaccctggaactccgggacatccctctgcgtccccaccctcccgacccccaagctcctcaacgccgaagcgcccccgaactgccggaaggaatcctaaaaggaggcagtcttccccaggaagacccaccaacctggtctgaggaagaagatggggcctccgagcgagggaatgtggtggtggaaacactccacagggcccggcttcggggccagcttccctcctccccaacccatgctgactctgccggggaaagcccctgggagtcctcaggggaggaggaagaagaggggcctctgttcctgaaagctggccacacatccctgcgcccaatgcgggctgaggacatgctcagagagatccgggaggagctggccagccaaaggattgagggggccgaggagccccgggacagcaggccacggaagctgactcgggcccagctgcagaggatgcgggggccccacatcattcagctggacacccctctgtccgcatcgtaagtgctggagggaagctggcctgggagggggcagacggggatgtctgtatggtggtggggtgtagtatagaaagagggcaaagcaggaacaggggctgaggcaggaagggctctccgcctcactcttcacctgaccctcacccgttgccactgaatgtcgcctaacaccccctcctgtcttttcagagaggtatgaggaatgcagaggacctttggcatgcatctctcccagaggagatctctccccagtagtgctggtcaccctccggcatctgtgactctacctcaaggaccacatttcccaaaggaagcctggcccaggcaccctgcctcctgctctgtttggggatcaagaactgtaaatttatgtatcataggtgcacctgagccccacagaaagttgtgcataaaaatgactgccctggctgggcatggctgcctgtaatcccagcactttgggaggctgaggtgggaggatcccttgagcccaggagttccagaccagcctgggcaatatagggaaaccctgtctttacaaaaaaaaattttaaaaattacccaggtgtggtggtgtgcctgtgtccggaggctgaggcgggaggaccccatgagcccaagggttggaggctgcagtgagcgcactccagcttgggcaacagatgacggtgttcagaacaagaacctgctactcctctgtcacttggcgtgatggtgatgggctacctggccctagtgcagggcttttcccatctcacccctcaggatctgggcctctgcccccacctcccatcccgacagaccactgtctccaagagcagagctttaacttcagaattttagtgtatgtacaaaagtccacagctccagctgaaggccccattgttccgtgctcgcccctgccttaggacagttcagcttgctatgtgcttgtccaggcagagggcacaggagtgccaagtttctattagtgtaacatgattgatttaaaaacaaaacaaaacaaaacaaaaacaaaaaaaactgcttatgcactgtgaaaaaggctcagggacgaaccaggggcccccgagcagccttgctggtgaggacacccaaaacgggcatgaggcatagcgtccctcatcctcgcaaaccacccactcaggctcttgagcccacggcgcacctctctccgcgcgcacagcgctgactgtcggcggcgcgcaggcagctgagaaaagctatgtacatcgaggggttagcaccaagtaggcggctgctagctcctgcttgcccctgcaggacccctcctttccagaaaaaagtggggttggaaggcgatctcgcaggacggtccttagagctgcccgcaggggcgcagcctcatctgagaagactgggcgcgggcgggagggcggcggggccgcaaagcgcctcctcgatgtcctccaggcagcccagcaggtccatgtcgcggagcacgcgtcccagcagctccagcgtggcctcgcgccgcggcgtgcgccgcctccaggtcgccagcatgctgtattgcgcctcgcgcaggcagcgcccgttctgcagctccagccgatcgatctcgtggtcgctcagccctaggcgccgcacgaattccttccagcgcaacgggggcacgttctccaccacggcgtacagcgtcgcggggtcatcagctgcggggacgcgggccggtgagcctcgggcggcaaccccaggccccgccccgcatcccgcgccctccgcctctcgtggtcccctctgggagcgcctcccgcgctcccccggccctcccccagcctcctcgtctccagccgcgggagaaactcactgtctaggctctgtggcttgtgggcgctgtcctcccacttctgaagggggttggggatggggtcggaggcgagggctgtcgcaaggatggggtcagccccctgatagggtggtgccacctctctgcggggagccgcaaagttgggacagtcaccgggggtataggtggagctggaggtgaaggtggaactgggcacgggactgaagcccagggtgggggtgaagcctggagtgggactgaagcttgggtttggggccaggggcttagtagtagttccttcaagctccccctgaaagagagaaggtggcgcaacattagtgcggcagcgaaaaccagccccggccctctttattctacgtgggggttgggacttagagggaatgaggcgagcccccggaaagtgaaggatgattccaggggatctgagcattaggcaattataaggaatggtcagggacatttgggagtaactctctcatttcatctcacctctttttcaggtgtcgatttcccacaaactgaggaaaaagaaagaaagcatcataaatttcacttcctctctcagccctggcaccctggactcagctggcagtggggacttgtggtgacatgcctcagggcctatgtggccccagggacgagagagctactgatgcagctcgacatctccccagccatccagggccaccttctgcccagagtccccagcggtatgaactgaggggacactcctcacctccctccacacatgtccatcgcacccacccatgtcctccctcacccccaccagctccctctccctcccaaagcccccactcaccaatggagtagagcttggacttccaccgttggtagcgatacattaaaccaatgaagaggagggataaaaggcaaagaccaaagaaaatgaccaggggcaacagcactgtggtgcctgcagacaaagcaggtgttggtcagaggagcgggcagaggggggccgcagggatagatggatgggtgggatggatggacgggtgggggcaagaagagggagagggcaggtgagcatgggcaccaggtcacttctcctcacctgagtcctcagtgcccttaacattctcaatctggggtaggcacaacttcgtgcactccaggcttttcttacagctaaaagaagagacggcactggtgaacagaggccctaccattggaggaacacagaaaaacaaccacacagattgttggacatcctttctttacaaatatttttgctgtctcttgatataatttgttttgggaactgatgcagaagaatgaaacacagttaatcatagaatcatttaattttagaattggcagggatcttgaaaaggctgtgtagaaaatgtgaaaagcagtcagggtcagggtgtaaattccagttcattccttggctagcagtgtgaatctaggcaagccattaacccccaagcctcggtttcctcatcaccacagggatcgcccacctctcaggattgaggattaagcaaaatcattatgcctcatttaataagtgcttgagaaggtagccagctagctgttatgggattgttgtttcatcactgttttgctgataagaatcctttggcaaagagaggttaaagggctttttcttaaatgacactgctagttacagtacctgacttcggggagtcggggtcaaacatgcatgtgaaaaatttaaaaacacatgttactggggcagccagagagcaccctgtagaactagcagatcttccatgttgggagttgtcactggacagtgtggagtgatgggaactctatggggtggtgctggaaggaacttgagagagtgagttcccagcaggaagctgaaagcagggagaggcactttagcccaccactcaagctcatggtgagaaccacatagaatggtataaaagtgatttcaagaagagatgaagccggctgggtgcagtggctcacggctgtaatcccagcactttgggaggcagaggcaggtggatcaccaggagtttgagaccagcctgaccaagatggtgaaaccccatctctactaaaaatacaaaaattagccaggcatggtggcacgtgcctgtaatcccagctacttgggaggctgaagcaggagaattgcttgaatctgggaggcagaggttgcagtgagccgagatcgcgccactgcattccagcctgggcgacagagcaggactctgtgtcaaaaaaaaaaaaaaaaaaaaaaaagaagattaatggaaaataaatagttttgtgtcagacgtgttgtaggttttgtttgtttctttgtttttggttctcacaaattcaccaaatgaatgtcattatgcttactttaaatataagaaatctaaggcccaggccaggcgtggtggctcatgcccgtaatcctagcactttgggaggctgaggcggaagatcgcttgagcccaggagtccgaggccagcctgggcaatatagtaggaccctgtctctacaaaaagtaaaacattagctgggtgtagtggtgtgtgcctctaatcccagctactcaggaggctaaggcaagaggatggcttgagccctggaggtggaggctgagccacggttgcaccactgcactccagcctgggtgacagagtgaaaccctgtctcaaaaaaaaaaaaaaaaaaaaaacaccaaaagaaaagtcaggctcagagatgttaagaaacttgcccaacgtcacatagccagtaagtggctatgctggggttcaaactctgagagccctcagagtttattctttgcaagtgagtgacaagaacagcctctgtggagccaggagtaaggaggcctggacagtgactaatgaggaaataccatattgcatcaaacctaagacgccatcaagaataaaaggcacttttctttacattactacccagacgcaaacagagctgccaattcaaccatgatgagtcaccagttataggaggtttgatttcagagctataagagtgtatgtcctagaaccaatgagctatcgtagatccaagaatctacatatctgagttggaagggctgccagcccttggggcatgatcttccatcctcaaagacttcttcagatttgaagagcaaggggaaggactgcctggtgtcttaacgaagtgtctcctactcagccagtaggaccctgagcactctggggcatcctggcatctgttgcccagctaatggttcccaccagtcacccgtcccaacccatgccaccatccagtgcccagcagctctcagagatactcacttactacaggagacacactcgttttctcttagaaagaaacctgcatggcaggtgcacacggtgttctgtttctcctggcctgtagggagaagtgcggcacagctaaaggagaagcgcctgcacccccaccccacaggacagaggaagtgacgagggacagggtgggggcggccagagaggagttggttgtcagacccacagaatacaggagggggaaggaaaggaagtgccaccgcatggggaaggggccaacccctggggtggggagagggcttggcctcaggagagctgcgctcacaggagaggtgcacggtcccattgaggcagaggctgcaattgaagcactggaaaaggttttcactccaataatgccggtactggttcttcctgcagccacacacggtgtcccggtccactgtgcaagaagagatctccacctgacccatttctggtgaggggagaagatggggtatgagtcctgcatcctcctgtccctgcatccccttcctgacatacccctaagtgtgtgtctctgtaatacacactcacatccatgcagtgtcccaccaaaacacacaccttcctgcccacacccaccagcctgcacatagacaggcacccacacaccactcaagacccgcctgactctcctgcctgtgcacactcaccctttcggcatttggagcagctgaggcagtgtctgaggtggttttctgaagcggtgaaggagccgctctcacactccctgcagtccgtatcctgccccgggcctggacagtcattgtacaagtaggttcctgtgaatggggccgcagagttaggctgcgggtgagaacacaaggaaggagccccatgctagggacaacagccagggccgattccctgaagtctctaggagaggagggagggagaaaatcccagcccaggagagacagcaaagttagggaagaacaactggaagaagcagagaaagaagcagcaccccagacctgagggcattcaccgtttccacttgcccctacctttgtggcacttggtacagcaaatcgaattattttgagggtggatatattttccttggggacacacactatctctcttctccctgtcccctaggtgagggaccagtccaataacccctgaggggtatattcccaccaacagctccaggagcacctggggaagaatcagatagaggagacaccatcaagagagggagggatgggaagcttaggggtagcagatctaaaacttccctggctcaagtccttcctcagtgaaacattccgcccaggccacgccactcactaagtttagagttcttccttgaaacttagacagttggggccatacaatctgatgcttaattgttctctagttgtcctgtgtgttcatttttgttccctcaactcaaagctagtaggccccagatctaagctgtatttttttttttttaggcaggatcttgctctgttgtccaggctggagtgcagtgatgcaatcactgcaccctccaccacccacgctcaagcagtcctcccaccttagcctcctgaatagctgggactacggccgtgaaccaccatgcccagctaatttttttttatttttagtagaggcagggtcttgttacgttgctcagactggtctcaaaatcctgggctcaagtgatcctcccaccttggcttcccaaagtgctaggattacaggcgtgagcccagccctgtattttatccttactgtgaaatcccccacagcagctaacagtgctggacacagggcagatgttgaaaggatgtgtttttgattgggaattggcaggttacttcagtgatggccccttcttccaacaagcagccctaaagattggggcggtgtttctccatctgggtgctgggttcaccgtgtgatcgctttgcgaacattcacagaggtaaacaatgaggatctatgcacatcccaggaatatgttacaccatgaaaagctttctgaaaaagtcagctggcggtgggggcgagtgatgttcccgtgagcaccactcctggggagtggacagaagaaggaagtttatttacatgtttgtatcaaacctcaatctgcctccgccctcacattccctggcccatcccctccacctcaaaatttacaaacacccggggttggcaaggacaaatggggaggagagtaaaagggaaaggttggggatcctgcatgggtagacgggggacaaagttgagacgggggcaggagtgggcaaaggtgtgcaggacataggcaaatagagctggccaaggctagcgacccagcttggatgactgtcaggtcagagctgagggcgtgctggggagtcctggagccccctgcacaccatggcattctggaaggtgtgctttgcagtctcaggccaaccccacagcagctaaatggcttgtcctgttccggcatcagtgccaggaaagcaaagccaggagtgaatatttagctctaacttggactttgatctctgccagcttcatttctggttttccctgggcttcattttttttttctactataagagacactttgtgtaaagataagagggtgtcctcaatgtctgttaaacactggggagcaactgactcaccagatcacagaaaccctagggcagggaaggagggtcaggcagcccacagccacccagcctcaccaactccacatttcggagcaggaggccagtcaccctgagtcagccacggggagacgctgcagctgtaagctgtgcaggcccggaagttcaagcctcagccgcaaacaggggaagccacacacagaaacacaacagcagcccccgcaggtggaggcgtgtgcccctgctcagaggacaacaaccttcccctgcccgcaccagccaacaccgtgccacctctgctgagaacaggactggggcttccagggcaacaggaagggtttggggtggtgatgggaagaacttcccagtcctgaaagtgtggttcctttccccgaagaagccactggagcacctaaggtcactggtactttgaatcccatccagggggcttgaggcagagtcatgatgaagaactgggggacgccagccccagacagccttaaagggagcttttcagggacctctggccagtgggggatgagcctccctggagggagggagggagagaggctttctcaggccacgtgttcccttctctttccagcactctgggggttaagtcagatccgggaaagggaaatcttttcccagcaactccgccccagtgactcaggccagagggagggagacctagggaggggagagggaactagcagcttccccagctcctcaagggtcatgagtcagcagaaaggcagaaggcaccagcctgcatgcaagtgggactccatctaatcccttcttcctatggccaagtccctccttcccatccccactcaacccccatccatcccctccccatgcaaagagccaggccacagacccttgtcccacttggcccacatgttccgggaaatgcctccctctccccattccatcccgaagggaagtctccctcgaccctggcttccgcccatcaggtctgtgccctcccttccctgagggccacttggctcctcctagcccctcagcggcctttagctgaggccccgccccagctcctcctcccagttcaacaagtctccaacagctaaacccattccgtgagctctcactccatcccccaacactccccagtcccagcaggaagcaagccaaggctgccctcccaccctgggttcaccgcattcccacagcctggctggttctgaccagttgtgctgggtttgggggcctccctggggtccccagacaatccttaggaaacaaggccagttctgagtctccacagaccctccccaagcccactggcaatacaggaaagcctccagagccctgaacacccacttccaggaacgagggagcaggcaagaagggatgccggatggaagaaccagccctgcttcctaggcttcccctggcccccagaatgctccaggtcagccctctctgatccctaggagccagggccctcagactccccaccactgggcaccactgctggcaccagctggccccagtaagcccagtcctcagcagttgcgtaaatgaagcaaaacaggagaaacaggaggtgagctctttaggcccagactccagcctggagcagaagggcaggaagctggggtgcctgtggagagacagttgagggggtggcccaacacccctccaactcccccacaatttccgccagaggaggctttaaagtgtgacttcctgtgctggggctgcagagtggggaggcgacgctgagatcggccttgtggtctgaccccgatccagccaccttgcagggacccaattagtcttcctttccccctcattcatgtgtctgttcatttaatgtcaaggtgttgggggaggtcgtggcagcttctcctccaagggcccagttgagatcccatctccctcccgtgaagccaccattgacgatgtctgtttcctccaccccggctccttagacccatagtccctgtgaactcgaagcacgtgaactgaccctatctacttttggctcttatcataatatggttatgttgggtgacagatatgatctccccaaagtgaccacgaaccttataagatgagagatcaaaaaatgtcttggtcagaaagtgtcttatcctcccctggtgtcctctcagctcccagaaccagacctccagactgggagcagataaatatggatcaactgatcgatctaatgatacatctgtcttccactctagtagaagccagtgattcccaaagagggaggtgaggagacagcacccctggtaggaatatatttatctccgggggagagttttcagaccatccccccacctccccacacacaagcacacacacccttacttaagagtctggtgtgctcctctccttttgagaaccactgatgagtgaacacagtgtgtctgaatgatacaaaggcagaaagaagttgcagcacctctcctccagcttggtaggcgcacccttccacatgaccatttccctgacccttaacatgccccagacggaattcatccatctcctcacctagacaaatgacacaccatcgacttcccggacgaatgctgagaacttgccacgctctctccccagggccccatccctatccctgccgccatcccatgtgtcagttcatcttgcgaggcctccccctgtgatctctcggtcctctccgcattcctgggttgcctcacacctgggttattgcaagtgtcttctagcctctctcctgctcccatccgtcctacacactttttaaatcttcattcaggctttaacttgcacgcacaagtgtgtgaaccttcctctccatc

SEQ ID NO: 342 - DNA, 99134 bp, Homo sapiens
gtaatcccagcactttgggaggctgaggtggatggatggcttgagtctaggagttcaaaaccagcctgggcaacatagtaagacccccatctcttaaaaaaaaaaagaaaaagaaaagaaaagaaaaattagccaggcatggtggcacgcacctgtggtcccagctactagggaagctgaggtgggatgatcacctgagcccaggagatggaggtttcagtgagccatgattgcaccactgcactctagtctgggtaacagagcaaggccatctcaaaacaacaacaaaaggttgtgagaagggggatgaaccaggctgaaacagcaacccagtcctgtcacagtctaatcccagattgaattgaagtgatcagatccttactctatctgcctgatagaaaaaagggaaaactctctttggtagaagatgatatgatatggctcctctatatttactcataatttctggcaaacaatacaaaattgtaaaacttgcaaagtcaaaagtaaacgtgaccaaaattaaagaaaaaaaaaagataatggaagcagacccacagatgatccagatattagagttagcattcaagaatgtaaaataactacaattaacatgtaaaggaaaatagagaaaatgatgaatatatagatgaaaatacggatcatttaaacagagaaatagaatctataaaaaaagtcaaatgaacatattaaaactgaaaaaaaatctgaaattaagaactcagtgtacaggtttaatagcagattgggtacagcagaacataagattagtgaacttgaagacaggtcagtagaaaatactcaaactgaaggacagagatttaaaaaagaataaaaaagaaaaagaaaggaggaagattaggggtaagctaaaatatctaccatacatacatctggagtctcaaaaggagagaagaaagattattgggcaaaagcaatattggaagagataaaaacagtagtgcagccatggataaactggacatgttttctttcttatcttccttttatagcccctgaggccagataattttccaaactgatgaaagatatcaactcacagagtcaagaagctcagcaaacccaagcagggcagatacaaacaaaacaattcctaagaatatactagtaatgctattaaacactggccaggcatggtggcttatgcctgtaatcccagcactttgggaggctgaggtagatggattacctgaggtcaggagttcaacaccagcctggccaacatgaaccccatctctactaaaaatacaaaaattagtcggtcatagtggtgtgtgcctgtaatcccagctacctgggcaggcagaggcaggagaatcgcttgaacccgggaggcagaggttgcattgagccaagatcatgtcattgcactccagcctgggcaacagagcaaaactccatctcaaaaaaaaaaaaaaaaaaaaaaaaaaaaaaaaaacacaaaaaacaaacaaacaaaaaaaactattaaacatcttaaagaagtcagaggaaaaaaagccacattaccttcaaagaaacaatatgactaacaggtaacttttcaacaaaaacaacagaagtttgctgggtgcagtggctcacacctgtagtcctagtactttgggaggttgaggcaggcagatcacctgaggtcaggagtttgagaccagtctggccaatattatgaaaacccttctctactaaaaattgaaaaatcagctgggcgtggtggcacatacctgtaaacccagctacttgggaggctgaggcaggagaatcgcttgaacccaggaggtagaggttgcagtaagctgagattgcaccactgcactccagcctgggcaatagagtaagactttgtctcaaaaaagaaaacaaaacaaaacaaaaaccgaaaaacaaacaaacaaaaaaccaatggaagccaggagacaatgaaataacacatttaaagctccaaaagaaaataactatcaacctgtgccaaaggataaatgctacaaaaataaaagtttaagaaagacacttttaccaaaacaatcttgaagaagaacaaagttataggtctcacatttcctgatttcaaaacttatgacaaagctacagtaatcaaaacagtgtggtactgtcataaagacagacacactggccaggcgcggtggctcacgcctataatcccagcactttgggaagccaaactgggaggatcatgaggtcaggagatcaagaccatcctggctaacatggtgaaaccctgtctctactaaaaaatacaaaaaatcagccaggcgtggtggtgggcgcctgtagtcctagctactcgggaggctgaggcaggagaatggcgtgaaccccgggaggcagagcttgcagtgagccgagatcgcaccactgcactccagcctgggcaaaagagcgagactccgtctcaaaaaaaaaaaaaaaaaaaagacagacatacagaccaatggaatagaatagagagcccagaaataaacattcacatacatgatcaaatgagttttgggcttttttttttttttttttttgagacagggtctcactctgttgctcaggctggaatgcagtggtgcaatcatagcttattgcagccttgaactcttgagctcaagcaatcctcctgtctcagcctcccaagtagctgggactacaggcacatgccaccacacccggctaatttttaatgtttttgtagatatagggtctcattagattgcccaggctggtcttgaattcttgagcccaagcaatcctcctaccttggccccccaatgtgctggaattacagatgtgaaccattacacccagcctcaaatgagttttggcaagggagccaagaccattcaatggggaaagtagagtcttttcaacaaacagtagtgggaaaactggatatccacatgcacaagaatgaagttacagcaatacaaaaattaattggaaatgaatcaaagatttaaactaacagctaaaactgaactgttagaacacgggaaaagcttcatgacattgcatttggcaacgatttctggaaatgacaccaaagtcaggacaagaaaagaaaataaataggactacatcaaaattaaaagcttttgtgcatcaaaggacactttgcaagacaaactcagttcctgcctttatggaacttttagcttagtaaggcagtctttcaagttatgacgaatgctatgagaggtgttatagaattgaattacagaggatataaaacttcaaaaatcctcaggggatcctcaagggggactcacatactagtgcagccatggatacattggatatgttttctttctcatctttctgttctagtcccttgggacagaccttgcgtaggtcaagaaagaatccttaactgtattggagttgaaggttcaaatcccattctcttaaaaagtggagtagtggcccgggcacgttggctgacgcctgtaatcccagcactttgggaggccaaggcgggcagatcacctgaagtcaggagttcgagaccagcttggccaacatggtgaaactccatctctaccaaaaatacaaaaattagccaggcatggtggtgggcacctataatcccagctactcaggaggctgaggcaggagaattgcttgaacccgggaggtggaggttgcagtgggccaagatgtcttatgtcttgttctcacggttctcacgttcttttgaatattgcatcatcagtagttagcagtttgctttctctgacatcctactctcaggagggatgactctggatcctctcatttaaaaaattattttatatatagataaaatatatagctatattaccccaccggtaacatagcttctaaaagctcagggtcacatccctgaggtgaccctctcctgccttaaagtgtctgcctgagaaaactcaaggctgccaaaataatttactttgttccagccaatacctgagaataggccaggggcagtggctcacgcctgtaatcccagcactttgggtgggcagctttctttctctctctttcgttcttcctttccttcctttcctttccctccctccctctctctcttctcttccttccttcctttccttttccttcctttcctttcccttcctttctttcttcctttctttttctttctgtctgtctctctttcctttctttctttccttccttcctttcctttccttctttcctttcttttctttcctttttttgagacagcgtttcgttagttctgtcactcaggctggagtgcagtggtgcaatcttggctcactgcaacctctgtctcctgggttcaaacaaatctcctgcctcaacctcccaagtacctgggattacaggcgtgtgccaccacacccggctaatttttgtattttttgtagagatggggtttcatcacgttggccatgctggtcttgaattcctgacctcaggtgatccgcccatctaagtctcccaaagtcctgggattacaggcatgagccaccgcgcccggcctgaggtgggcagatttcttgagctcaggagtttgaaactagcctgggcaacatggtgagatctctcctggtctctacaaaaaaatacaaaaattaggccggtcgtggtgtctcacgcctgtaattccatcactttgggaggctggggtgagaggattacctgaggtcaggagtttgagaccaacctggccagtgtgatgaaaccccatctctactaaaaatacaacaacaacaacaaaaaaaaaattagctgggcatggttgtgcacccctgtaatcccagctactgaggaggctgaggctggagaatcgcttgaaccagggaggcggaggctgctttgagttgagatcgtgccactgcactccagcctgtgcaacagagcaagactccctctcaaaataagaaaaaaagaaaaaaaacaaaaacaaaaattagccgggtgtggcatctgtagtccccagctactcgagaggttgcagctggaggatcgctggagccggggaggcaagggtcgcagtgagccgagatcatgccactgcactccagcctgggtgacagagccagaccttgtctcaaaaaacaaacaaacaaaagacacctaaggacagtgttgaggatggtatcctcaccagtctctgtgggaggatggaatcctaacttccataaatgccagctagcagacatcattgacctaagcacatttacattgactaattctgtaaatgttcacttccctgactctactgaccctctgtctcactgtcccctaacctcattttccctataaaatacccattacttgcatacaaattgcagttgagttcagttcatgctgaactgtttttccttattgtagtagttattactgattgaaatctgtcctttccactttagtgtccggctttgtttatctttgacaaaattcaccagtttgattcaagacagtttccagcccctgctatggagttacactgagaaggaaacccctggaatttagtttcacccctacacttccaatggaatttttctgtttctttagaggtgggcaagggcccttgacaataaggaaactttcagacttgtctaaggtcccacagagagtgcttgatccacctgagctatcacaccccacagggtatacacaagtgtattctttttttttttttttttttttttttttttgtgacagggtctcgctctgttgcccaggctggagtgcagtggcgccaccttggctcactgcaacctccctcgggttcaggcgattctcccacctcaccctcccaagtagctggaattacaggcctggctaattttttgttttgttttgttttgtagaggtgaggtctcaccatgttgccaaggctggtcttgaattcctgggttcaagtgatcctcccgtcttggcctcccaaagttctgggattacaggcatgagccaccgcacccggccctgattcctttttttattctagcttcaagattcagttctaccgttatcggctgtgtgactgggtaaatcactacaccgcaagcctcggtttcctatttaccaaatgggtcgaataatgcctgccacatggggctgctctgaggagtacagatgtaagagatcctgtgttcactgatattttcatgtgggctttttgataatgatacaaaaggaacatgagaactgtgacttctaggccgggcgaggcggcttactcctgtaatcccagcactttgggagtccgaggcaggcggatcacctgagatccggagttcgagaccagcctggccaacatggtgaaaccccatctctagcaaaaatacaaaaaattagccaggcgtggtggcaggcgcctgtaatcccagctactcgggaggctaaggcacgagaatcgcttgaatctgggaggcggaggttgcagtgagccgagatcgcgccactgcattccagcctgggggccagagcgagactccgtctcaaaaaaataaaaaataaaataaaaaattgtgacgtctcactcaggatcagcgtctttaagtggccacctccccaccccaccttcatgcctccctcctccttgaatcgtgtgttagaacgctgtgatctggtccaaactccacggagatgcgatgcgatgcgaagcgatgttgggcaatttcaactccctgtctcggtcgccacctaggattactgcatgttcagctacgacctcatcaacatggctgctggaagtcgtctacaggaaaaagaaagaaatgacactgaaggatcacttccgcttccgttggcgcaagcgctttcattttttctgctaccgtgactaagatggaagcgtttttggggtcgcggtccggactttgggcggggggtccggccccaggacagttttaccgcattccgtccactcccgattccttcatggatccggcgtctgcactttacagaggtccaatcacgcggacccagtaagttctcggcgctttcgtttgcgtagcgggagggaccgtggggcctggtgctgccggctggttttgagagcccgggaaggtgaggcggggaccccgggggcgcgcgaacggcaggggagctcagggcgcggagtcctggagaatgcagaataattggaaggaattatagaaaatcagaagcgcagctcagtgcgcggaaagagggcgcagtccatcccccctctcagctcccaccgttctcactctttaggaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgtaagtcatccagagaacaggagagtggttcccaagtagagaggggagtcccctgttttttattcccttcgatgggatggggggacttgttgcagcgggggactggaagagttgttggaggtgggcgatctgtgtttgcaataaagtttttggcattaggtgtaaaatgggggaaggtgtggtaacttcttttggggatgggtggagaccccgacttaattctctcccttttctcacaaccaattccttttaaggattgatgaggagcttctgggagatggacacagctatagtcctagagctattcattcatggctgaccagggccatgtacagccggcgctcgaagatgaaccctttgtggaacaccatggtcatcggaggctatgctgatggagagaggttcatatgaatacaaataacttatttcctttaccacccaacctagtacctgtgtagtatctcttctgtctcttctccccaagtgaatcccactttaactcagaccccatggtccccttcttcagctaagatgaatctaaggtgaaatgagttttgacccattgtgtcctgttagcttcctcggttatgtggacatgcttggtgtagcctatgaagccccttcgctggccactggttatggtgcatacttggctcaggtaagtagtaagtctagaggtgggggaaagggaagacaaaaggaaatggattagtggttgtctgcttttctcctgaaattctgatatgagggatgggctgggatcgctattactgggcagatggttttctttgtagtctgggggctgtaggtgttgacactgattccagtgacaagatgacatgactgggagtcagtagacatgcaaagagaggacaccctagaacttcttcctgaagtggctcttagcttattttctaagcagagttcattctggtgaggcaagaagtagaatgtcatctttcactctaatgctttttataccatagatttgagacaactagcctgttattcagcccaatatccccccatggttttcccccaatctccctagcctctgctgcgagaagttctggagaagcagccagtgctaagccagaccgaggcccgcgacttagtagaacgctgcatgcgagtgctgtactaccgagatgcccgttcttacaaccgggtgagggatgtgctgggaacctaattggcgggctctggctacttgcaatccctgggtctctatgctttgaagaacagattgccttacttgtgtgactcctattttcacattggggaagacctccacctgacctttcatttaaggacttaaggcgtgggcattattgaatgctctgctttcttccagtttcaaatcgccactgtcaccgaaaaaggtgttgaaatagagggaccattgtctacagagaccaactgggatattgcccacatgatcaggtgagtaatagggaaaaaattggtgacagacttgggaggtctttggcttacactaagctgggcttttctgggaggctcacccaggaaaattttctgggtggaaagttttggttggacagtacagctatttttaggaattgatccctttatgcttcacaattttattattctgtcttccttttttagtggctttgaatgaaatacagatgcattatccagaactgaagttgccctacttttaactttgaacttggctagttcaaagatagactcttcttttgtaaagtaaataaattcttcaaaatgcttgctgagtggtttttgtctgactgggtcacaccaagtgcaaaactgctgagtactgccatgtgccatctccctccctggtcggagaacccttgtggtcttgcagcacacacagaaattctctctgcacaacacagaaagacacactagcgtcatttggagctgtattagaagcagagcttcctgtagaagccagacttaatttttgtgtgctaactggcttttgtgttcaaattcccctcccaaatcttcctccactgcactggattatcaaatacagatttcttaatgttggctgtgattttcattaaaataccactttaaaaataatctagtagaactattctgcatcaggttgccctcaagtcagctggggcatcagccatccctggaatggttctaaacctgaatattttagagacaaaagtctcattctgttgcccaggctggcgtgcagtggcatgatcatagcctactacagccttgaatttctgagctcaagcaacctcctgcctcagcctcccaagtgctgggattactggcatgagccatcatgcccagcttgaatttttaaaatgaacactgtaggcgattctgacacaaatcctctccaaacttcttgagaaagaaaatataggcagcaaattcaaagtacagaaattcagtgagaactgaaggaaaaaataaaaccatccctccatttgcattgtccgttaacaacaaacttgtaaagccaaacaatgagctttcaatctgaaacctccacacattcagtctcaacacaggaaacagtcaataaatacatgtttattgattaaactgaattataaaaaacaaaaccaaaaaaaaatttccttctactactaagccatgcaggcagagtccacaaagacaacttcctggccaaaacccagctgatccactgttggtataatcttaaaaaaaattacccatcaagaaagtcaatcgtgtgcagaagacaggaaccccagctctgctaaggctgtggctgctgcagagactaccaaagagtaggattaggttgtagatagacgtgaccaaccatagttcttgaactttctcaaaggcaaaggctgacttcaaagtccattgtctgtcaataaaatggcatcaggcaaaaagctggggaagagaagcccagatggatccttggttgttttcagatgtcaaaggttcacaaagctggccaagctgtttctggaagggacttttccagttcactatattatagtgtgctgggggatgaaaaaacaaacaaacaaaaaagcagggtggggtgggagaaatgggtggtaacaaatgtcacacctgtaccaccaggcccatcacatcttgagcattccccagtctgtgaaagcctattaaacagggtcacctagaaaaaaaacaagtttataaatccatttcccctcattttattaaatgttccacttatgtacattttaaagacgaaccatttacaagcttgtgcagtttgcctccttggctcacaggaggggaacattgtggaaagcctcaggataaacagaagacttggttttttgctccttttctctgtacggtacagtacgttttggtttacaaccatgagtacatacaattaaaaaaatccctcatgcaaattgtagaaaaaattttctttccttgaagctggcagtgaaaaataaagattcatgtcattttctttgtgcacacccctgtgcgcttcttcctgtcagattcttccctaagtattaagagaaataggggaaagccacagagcacgctggatttcaacaagtggtcttgtctttttaaagttcaacacttcttgaacaattagctcctggctgtaggaccagtaatcccttaaacaggcatgctctccatctaacaggatgaagttcagtaaagcagggactgcccctgggggcttacaggatgaagactcaaactgggaatggcttccaccctaaaactgtttgatcgcttcagtatctcttgcttgctaataacacctgtatgatcctttgtccagagggatggatggtgttgagaatggggaaaggggccaaggatcacaagtgcaaaaaatattgtttatgtcatgttttggagggaaggtggtgaggaaaagacaaatctattcattctggataattaaaggtggtttcatgcatttttaaagccacaattttatatctagggttgctgtagaaaccaacatctctggagagggaaggaaagaaaaggagaaggaagagagagttcagtgggactttttttccattttcatttttatataaaagtgttaagaccacaatgaaaaaagttttttatccatatatataataaaccagtttgtgagctacataatttgtctttcccatcttcagaaatgttctcacattaacaatgattagatagcatcatgcccaaagacattggccacacaataaaacaaacaaaaaaacccagtactatgatacaattgaggtaaaaggggaaacaaaaaaatttaacatttgcccacaaataattttttttctttttcttaattttgtcagaaaaataccaaacacagtgatttaaatttaaaaaaaaaaaaagtcacaaaaacctgtttttagcagaagtgaatgaccaatgggccagctccttggctcagacgtgattactattggttttcctaattaatccacaaatccacagggaagtgtaagtcaacttcaggggggagtggtggtataaaattaaaaaatagaaaccaaataccccacctggtatgcccccttttccctaagcccctttaccctccctcacatgttcccaccctcactccacaccccctcatgaccccaacactcaaatctccatcagatctaggtcagcttcttcaaagccatagaaagactcggtctcactttcaccctcaaagagctggtgaagactttcaggctcaattgtctcttcaggagatgatctgggtcgtggagtggaagactcagaatgttccccactcagcttcagttgctcctctagggaggcaattagctcctcctgcatgtcagcatttcttgtaggtgagttaatgttgccatcggggccaggcagaacactagccaccaggaaggagcgctgaactagctctggacagtccccaatgacacctagcacttcacccagccagacaagcaccagctgaagcaggacatcagaatcacatgcagtatctgccatttcccgagcctgttccttccattttttatgcaggaagttcttgacagttcttttgatgcatacatctaatggctgaattttggagctacagcctgctgggaccactgcaggcaaagtgctagaggcactaagcatagccagtacctcttctgacaagtgagtgcgatgacagtccatcacaagcatgcctttgctgcgctggcaagctgtgtgcttctgccacactcgagttgaccacagctccatgatctcgtcatcactgtagccactctcctttgcctctagcaatatggagtctggcatgttagcaggctgatccatctgccctctgtagaaaaccagggtgggaaggacagtgccatctgccagaatggctaggactacatcacaccaaggttcccctgtgcccactgtctgcagggcattctcctttcgatcatcactgctcagcacctctgtatccaggaacaaagagatctcatcaatagccacaatcatagacaagggtaagtcctggttgtgaatctgccgttgtacaaaatcaatgaagagtcctgcattctctgctacatccttaggtagggtgtgggccacagctcgccgggcatggggagtcaggtggtgccgcagcatgaaacgcacagcccactcataggagatcttaaaccccccttccaaagaacgtcctattttggtggccttctggaacaaggtctcctcatttacaggtagctgttgttcgcgctgggttagcacccactcagccagtttctcttctgcctcaaagctcagatatttgccctctagattctccccctgggaggcctggaaacgtcgaagccaacggcgaatacgtcgctggggatttcggaagtgttcagctgcctgttctgtattgcagcatagagcaaacagtactactcgaagcttcttcacagacagctgctcctttttgccaactccaccactaccaccaccacctgatgctagctcaggttcttgggtgactgggctcccttcatcctgatcatcaacattcagacattcggctccctctgtagccagcggtggaagggctaaagcctgcgggtgagtgggggttggtggtggggttgcagttgaggctggtgatgggagtgctggggctaagggagttagtagctcttcaggctcagctggggtggcccccgcagatttcacagtggcagctttgttagtggggaaggaaggaggagggtacatattcttcacgttccggtcatgcactcggtcacgagtctggccatgcctaaaggggtgaggagcaaagagaagaggagaaatctcagttcaactaggaaattgaaacaataatatgataataataataataataacagagtaaacacactgcaaaccagaaattaaattgtgaggtgagtttttgttaccttgagtgagctatccaagtgagtcctatggaaaatgaaacaacaaaaatagttagctcagtgaaaaaataagccctccaaagacagtgccctgggattcaacttactacatacaaatacgctgttcgcagtgaccagctttcccagttttatataaacttcaggtcggaaggtttctaattaggtccagcacatctcaacagtgaatgagtgaggccaagtaggtatgctcctgatgcatacagtacgaacctgtatcttttttcctccccttgctcaactaatccccttctctcctacttaccccgtggcaggatgctgctggatctgtgagaggggttgaataccaaatgcttggccatagcatcgcccacagaggtaacaaaggtacatgaagtgcaggccagcttgattccactaaaaaagagaattgagactatgtaagacaaacacagcagtgacacttgagaccattaagctttgaggcttaagaaagaaaaggaatgccctcccactttctcctttttctgaaattaattcacataaccacctctccaaataatgaaaaacctgaaaattaatgtaaaaacctgaaaaattaagatgctgccaataagttttttcttacctcacagaatttttaaacaaagccaaatacttggggctcttccgtggaacatgattgctgagaaagacaaagaagtggtatgagttacggagttctgctggctaagctagagatcaccagccagtgacaatgcccccaacaaaagagacacttcttcagtgcaccctaatctcaacctaagccagttttcctgtcaccatgcttcttaaactttaatatgcatacaagtcactgaggatctattaaaattcacattctggttcagtaggcctagggcggggctgagagtcagcatttctaacaagctcccacctaatactactggtacttgaatagcaaggccctatgaaattagagcacagaccatcaaaaccgaaaaaacagagcctctcactctgctaggagagaagaacaaatagctctaagagttgaaggaggaaacatattagaagcaggggagaaaatgaaatgagtgctcaagaatctggctggggccgggcgcagtggctcatgtctgtaatcccagcactttagggaggccgaggcaggtggatcacctgagctcaggagtttgagaccagcctggccaacaaggtgaaaccccgtctctactaaaaatacaaaaaaatcagccaggcatggtggtgcacacctataatcccagctacttgggaggctgagacaggagaatcacttgaacccaggaggcagaggttgcagtgagccaagatcatgctattgcactccagcctaggggacagagtgagaccctgtcttcaaaaaaaaaaaaaaaaaaagaagaagaagaagaagaaaaaaagaatctgaactctcaagctaaaacactggttaaaaaccaacttacttgatcatgtggttggcataagctcgagaacagcaggtgctatagcgacacagagagcagtgtacgtaagtagggaaatgattagggaagtctgggatctcgaagctgcactccaggcatgtctgccggcccatgacactcctgtgggggaaaaaaaaaaagaattctcattactgcctcatgggtccccaaaatgtaggattttcagacaacaaaccctgctaaaaagctaccagattgcactgtgtatcaggaataatcctggccacccagtccccacccgcccagcacttagaagaaggcgctgacattttcctaacagctctcttctggatgctgcgctggacagggggataaaggaagacaggcagagggtccattgaggaggtcagcggtgctgcctcctgcaaggcgctgggaggtgtatcattagaggatacaggaacagttcgtggctgccctcgggaagcccggattgtcacctgagaaccaagggaagtaacaatgagacatcacccacactaaatttcagaatactgaaaatctctattcctccctccctgggcctataaaagacactggcaaactctttaccttggtgcctggtttcaagccctccagctgcttgggtttacggaaggttttatggtgttgaagcttgtgttcaattttgtccttggcaaagagaaactgcagccggcatttgttgcagtgataaacatttctcttctgaagtgggggagggaaaaaaagagacaaaatcccttaaaggttcctaataaattttcttttttgaggagaaagcagatcaatgtcaaccatatcattcttcccacctttctgttgataatttaagagagtaagaaagaaatatgcaacatgaccacaaaacctaccattgagaatcatcacctcccatgatatcaaagaaagatggattctagtccaggatgactaagttctcaaatcatcctttcctgacttgttttaacaatttgaatgagtgatgtaacctttatttgtattatatctttacactgctgacaactggacattcttctggacattcttcattcttctttttttaaaaaaggacaatgtacatagtaaactaaagtcatacttttttttctatactcttccaactttgctttcaactccaacactcagtccccttccatacaaacaacttattaccagtttcctgagtatgctttcgtgggcagtctacacatataactgtatcacaaatacattcatatccaatcattacctgcctcgccccctttttttgagacagggtctctctctgtagcccaggctggagtgcagtggcatgttcatagctcactgcacgtcccaagtagctgggactacaggcacgtgccaccacgcccggctactttttgtatttttttgtagagacggggtgtcaccatgttgcccaggctggtcttcaactcctgggttcaagtgatctacctgccttggcctcccaaagtgttgggattacaggcgtgcatcactgtgcctggcccttacttttttccctttcctttttgtagagatgttgtctcaccatgttgcccaggctggactccacctcctgggctcaagtgatcctcccacctcagccctcttctttttctccttttaacacaaatgatagcacttgtctataccttgctgttttctcacttaacacatcagtatatacagatatgtctcctggtgagaccactttgaggattcagtctgcctagtattgaagtccttcaaaaatagaacccatgtctatgattttctttagtaggataacaaagctctgtaagcttaggctaagagacaatttccatgcccctatttggaaatacagttgtggtagacaatcagcagtcactactgtgcaaaggagactatgagtgtaatagggtacatatgtttgtgtgcatatgtatgtgactattaagcacacatgcactcatcttattctccattttgaatcctctcttatatactatatacctttcactctcctctagtggctctcttcttgtagtattttaaaacgaagtcatagcttttcatcttataaggaaaataaaagcaataaaaaactcttctttgccacttcttcctctggatttacctaccctgggtcctccctttttataaataaacttctttaaatacatcgtcttcatttccttacctctcattcatttgttctgctgaaatgtgacttccaccctaccaaccaacaaaatggctctcatcaatgttgctaaattaaaggcctgtttctaagtctctatgttgcttgacaccttcctgtaacatatgacattttgatcacacccttttctttaaaacactttcttctccccagtttccttaaggttaagactcttctggttttcctcctagtactatggtggttgctttatagataagggacttcaaatatcctaagccttctcttattctcaacagggttggggggcccatggtatttaagtttaaaatctataggatttatataacgctgattcctaaatcttttctacaacccagagttctctcacaggcttgagatctattatccaacagctacacttgacatccacagatactgctaacttacaatatccaagctcatgatctcccccctcacaaatatactttctctattgtttctatttcagcaaatagttccctcattcacccaactgcccaagacagaatcttaggcactattcttaactactgcattgctaccttcacctaatccatctctacatcataaatatcacaaatcttctgaatatctctcaactctaccctctttttatttcaaaagccaatagccactatcatctctcacctaaactactgaaaaaggccttctagctagtttccctaactgtagtctcaatctcctttaatccattctctgcagtgcaggcagtataaagccttaactaaagctgaacacatcactccagggcttaaaacccctttagtggcttcccagtgaattcttttcatggcttaaaagatcctccatgatctgtccctgcctaacttccaacccctctgtctcttacaccctacactgaatctctctcaatttcttgaacctccacaattttgctttgtgccttgggcacactgttcttcgtcttatttcatctggctcattcttattcatccctcaggtattgaacaacacttctttctggaagccttactaggcacccagaatagctatgtgattttctatatcctataatttccccaacacagtactcttcatgttttattgtattgtttgccttgtttactactaaatctctagcatctagactagtacatggcacattaagtgaattcaataaatttctgcaaacatatgcatattataatctctgcccaaattatttgcctagctcagccctggccccagcatccatgtttaaaaaaaaaaaaaacaagagaatatgggaattgcttggtgcctagtacctggtgcctcatgtaatgctgttggaatgcattgccatttttgaagaccttcaggcaataagggcagagcagatgccgggtatcctcatggatcatccgaaaatggacatctacctcagagtagagtgaggagcgatattgacacacctgagtcacataggagggaaaataaggctaagaatgaagtgaacaactgagaggccttaaaaaaaaaggtagcaacaaaaatttttaaattaaaaaaaaaaagttttctcaaatgcatagaaatcaaattattttcctgactttgtaatgctgggctatgtttgtgataggtttagctattactttaaaaataggaagggacagaaagtctaagaataatccatgttctctaactaagaaaaataaagccttttctgtcaatttccaaagggcacgttcaggagacagacactcccttagaatatgcacatgttcccggctagtctacttgtggacatgttcttttatgtttttctcctgcatggaaaccctgaagataaactgtgtttactatttcttctgtacctactcagagttcctaaactgagtgtatgcagtaggtggtcaacaatattcattagtaaattctttgtattcttcctgagggcaaaactgctaaaactccctggagaaaaaggcaatacctggcaaacataaggcatctctccaggcttatgagtatccttcatatgctggagaaatagtggctcactttcaaacgcccattcacagatcttgcacttggctgtaagaagaaaagtaatcaataaatccacttgaaaataagacaaaagtcctgctgactcacaatctttattttctctgcctcctttattttgattttcaacaatcagtaaatcataggtcccttctgttctttctttaaatggctccaccttaacatatatgttgctgataatcttatgtacgtagctcagacttcttaccaaagcttcattctagattttatctataagacattttaaattggttattctatcgtcaactctaacctaattcagcatcctcctgtcttaccactgtttccctttttcctttccccatttcttcctgagctcaaaatttaggcactatctcggattccaaaccctgcattctgtcaccattatttcaaactgcatgtaggaactgtcacttctctatacttataataaggcaaaaacttggtactagcccatatgatttcccactgctaatcagctggcctccaatacctcctactctctttgaaattgtccattttgtcaagcttatgagaaaaaattttgacaaaattttatgacacaaatgaacaattttgtcaaacttctgagacaatttttggtaatttcatgttggccaggttggtctcgaactcctgacctcaggtgatctacctgtcccagcctcccaaagtgctgggattataggtgtgagccaccgtgcctgggcttttttttttttttttttttttaagagacagaatctcactgttgctcaggctggagcatgatcatagctcaccgcagcctcctgagtagctaggactatcctttgagctcaagcgagcctcctgtttcagcctcccaagtagctaggactacagtggtgcaccaccatgcccaagtaattaaaaaaaatttttttttgtagggacagggtctcgccatgttgcccaggctggtcggaaactcctggcctcaagcaatccttttgtcaatccacttcagtctcccaaagtgctagaattacaggtgtgagccagtgcaccggccaattttggtaagacttttaactgctacatatttttaattatacagtatggcaaaaagagagagattatttacatttttgtcactttaatggaattagtttcaagtttttgcaaatatgaaaactggaagcttaaagccttgggcatttactggacaatgtctaacctccccccgcccccagccccctacaccccagccaaagaaatatgaataaagttgaaataattcttttttctttttttaactaccgagaaccctggatttttgttttgagacagagtctcgttctgtctcgcacgctagagcgcagtggctcaatcatggctcactgcaaccctgacctcccaagctcaagcaatcctcccatctcagcctcccaaagtaccagaattacaggtatgagccactgtgcctagccaagtaattttttaaagtaaaacaaacaaacaaaagccaggggttcttaatctggggtctatggaacaggcctctaggaatccaggctttctctgaaattatttgcaaaagagtaaaatgtagatttttctaggaagaggattcaaacatttcatatttattctcaaagaggtctgcaactccatttagaaacactgtctacaggtacattaggtgctatgaggacatggataaataagaaattctgcataaaggaatgaggaaaagctataacaacatataaaagctgaattgtcaaagaatggggctcagccagccagagagaggaccaagagaaaagcaggaggaaaggcaagtaggtatgaaagttaaccacatgtttgggaaacagttaactagcaacataacgatattatctcttttccactcaccccccgatttgtttacctctctcatttttctcttctagaacacctttaagcaatattttgtccaggcctttcttagtctatgttttccctgggcaatctcattcactctttctcctataacctatttatcagctctattttcacagctgtcatgcaacatcaataataaaaacacttattaagcaatttctaatgtacaagcatcaggttaagatttacatgtgttggctgggcacggtggctcatgcctgtaatcccaacactttgggaggccaaggcaggcggatcacctgaggttgggagttcaagacaagcctgaccaacatggagaaaccctgtctctactaaaaatacaaaatcagccgggcacagtaatgcatgtctgtagtcccagctacttgggaggctgaggcaagagaatcgcttgaagctgggaggcagaggctgcggtgagccaagatggcgccactacactccagcctgggcaacaagagcgaaactccctcaaaaaaaagaaaaaaaagatttacattgtgttatctcaagaaaactagtgaggtaggaactcaaatataaggggatttaagagatctctggtaacctttgacacatcagttctacaggggaaggagctaatacagaaaaagattcaagagggaaaatgaattgattctccatggtggctgtcctaactgtccctctgagcaccatcaccctccttaacacctaacacaatctcctactttgaggaaataggcatgaacaactgtaacttctgctgcttgttttccaaattatggaaggatagatctcttgtaccttcctaaggctcatccaacctcatcatgccatgtattccaagattttgtcaatttgttttccctgtcttcaatcttccccaaccccgacaggctccgactcctaaacatggttaagctccttaaagcatccttctctcaatcctatttcttcctcaaactttctcctttccactaacacaagattttttgaaagattagaataacctacatctgttacctttaatgagatgctcaggaagtggaggtaacaatgccaggaagaaaaatgttataatatttgaagaaatgggccgggtgtggtggctcacgcctgtaatcccagcactttgggaggccgaggccggtggatcacgagttcaggagatcgagaccattctatcctggctaacacgatgaaaccccgtctctactaaaaatgcaaaaaaattagccgggcgtggtggtgggtgcctgtagtcccagctactcgggaggctgaggcagaagaatggcgtgaacccaggagacagagcttgcagtgagccgagatcgcaccactgcactccagcctgggcaaaagagcgagactccgtctcaaaaaaaaaaaaaaaaaaaagaatatttgaagaaatgtaccttaagatagccactatggaaaacaggaataataactaacagtcttaaccattttttagtcccaaatctcacactaacaaaagctatgcaacctctcccttgaaaaatgcacacacacaggcaaagtttatatgtaatttcaaggggctcacaggacacctcaccaccaagcaggttaagatttctgtattagacataaatattaaaagactatgaatcagggccgggtgcactggctcacgcctgtaatctcagagctttgggaggcagaggcaggcggatcatctgaagtcaggagttcaagaccagcctggccaacatggcgaaaccccgcctctaatacaaaaattagccgggtgtggtggtgcacgcctgtaatcccagctactcgggaggctgaggcagaagaattgcttgaacctgtgacgcggaggttgcagtgagctgagactgtgccactgcacacaccagcctgggtgacaagagtgaaactccatctcaaaaaaaaaaaaaaaaaaaaaaaaagaaaaagaaagaaaagaaaaaaaaaaagactatgaatcagacagagtgcggtggctcacgcctgtaatcccagcactctgggaggccaaagcgggtggctcacttgaggctaggagttagagaccagcctggccaacatgcctgtagtcccagctacttggaaggatgaggcaggagaactgcctgaacccaggaggcttaagttgcactgagctgtgattgcgtcactgcattccagcctgtgtgacagggtgagattctgtctcaaaaaagactaagaatcagcattagacaaacttatgaaaagaaccctagggccatacaagctccttcaagtcactgcactgctcttaaacaagtgtgaataaaaatgtaatactactttttgggttttttttttttttttgagatagggccttactctgtcacccaggctggagagcagtggtgtgatcatatctcactgctggctcgacttgctgggctcaaacaatcctcccacctcagcctcttgagcagctggggctacaggcacaagccaccacacctggctaattaaaaaaaaatacaaaaacagagagagataaggtctcactatattcgccaggctgttctcaaactcctgggctcaagcaatcctcacgccttggcctcccaaagtgctaggattagaggcatgagtcaccatgccttggcctgtaatgttattaagatgatactgttatcacaattaaatataatgatccactgatattctggggacaactcagaaaatttttaaataaagtaggtattgaatgttattaaggatttctgattaattctgttagatcttttttttttttttgagacggagtcttgctctgtcgccagggtggagtgcaatggtgcgatctcagctcactgcaaccttcgcctcccgggttcaagtaattctcctgcctaagcctcccgaatagctgggattagaggcgcgtgccaccacacacggctaactttttgtattttagtagagatggagtttcaccatgttgtctgggatggtctcgatatcctgacctcgtgatccacccgcctcggcctcccaaagtgctgggattacatgcatgaggctccgcgcccggccctctttttttttttttgagacagcgtttcactcttgctgcccaagctgtagtgcaatggtgtgatctcagcttactgcaacctccgcctcccgggttcaagcaattctcctgcctcagcttcccaagcagctgggattacaagtgtgcaccaccatgcccaactaattttttgtatttttagtacagacagggtttcaccacgttggccaggctggtcttgaacttctgaccttaggtgatccgtccgcctcagcctcccaaagtgctgggagtacaggcgtgagccactgcgccggcctattagatcttaacaaaggtactgtggccacacacacacacacacacacacacacacacacacacacacaaaaggccttattttttagagctacatattaaaatatttaggagaaaaatatcatgatgtctacaattaacaaacaattcagaaaataaaaggaaaaaaatcccccaaaatattagcatgtaaaaataagctactttttgaaaaggtatctgcactcccatgtttattgctgcacagttcacaataggcaaaatatagaatcaacctaagtgcccaccaacagatgaatgaataaagaagatgtggtggctgggcacagtggctcatgaggtcaggagtttgagaccagcctgaccaacatggtaaaaccccgtctccactaaaaaatacaaaaaaattagccgggcgtggtggcgtgtgcctgtaatcccagctactcaggaggctaaggcaggagaatcactttaacccaggaggtggaggttgtggtgagccaagattgcactaccgcacctcagcctgagcgacatagcaagactccttctcaaaaaaaaaaaagatgtggtatatatacccagtggaatattatagccacaaaaaagaatgaaattctgtcatgcagcacatggttagaactggaagtccctaagtgaagtaagccaagcacaaaaagacaaatatcacatgttcccactcatatgtgggagctaaaaaaaaaagtagatctcatggagagagagtagaatggtggttaccagaggctgggaagagtaggggagtagagagttgaagagaagctgatcaacaggtacaaatatatggtttgaaagaagaaataagacctagtagatcagtagggtgactatagtttacaataacctgttgtaaattttaaaatagctagaagagaataatttgaatgtttctagcataaacacatagagtgatgaatattccaagtacactgatttaatatttacagattatataaatgtatattagattatcacatgcatccctaaaccatgtacacctattatgcatcaattcttttttttgaaaaagctacttttgggctgggcacggtggctcatgcctgtaatcctagcactttgggaagctaaggtgggtggatcacgaggtcaggagtttgagaccagcctggctaacatgctgaaaccccgtctctactaaaaatacaaaaaattagccgggcatggtggtgggcgcctgtaatcccagctacttgggaagctgaggcaggagaatcgcttgaaaccagaaggtggaggttgtagtgagctgagattgtgccaccgtactccagcatgggtgaaagaatgaagctctgtctcaaaaaaaaaaaaaaaaaaaaaagaaaaaaagaaaaaaagttactttcgaccgggcatgctggctcatgcctataatcccagcactttgggaggccgatgcaggtatatcatttaaggccaggagtttgagaccagcctgaacgacacggcgaaaccccatctctactaaaaataaacaaacaaaaaaattaactgggcatggtggcacatgcatgtaatcccaggaacttgggagactgaggcacaataattgcttgaacctaggaggtagaggttgcagagagccaagactgcgccactgcactccagcctaggtgacagagcgattgtctcccaaaaaaaaagctgagcacggtggctcacaccagtaatcacagcactttgaggctgaggtgggtggattgctcgagctcaataatttgagaccagcctgggcagcatggcaaaaccctatctctacaaaaaacaccccccaaaacaaaaaaccccccaaaattagctgggcatagtggcatgtgtctgtagtaccagctattcaggaggctgagttgggaggatcatcttagcctgggaagtggagattgcagtaagccaagattgtgccactgcactccagcttggctaacagagtgagaccctgtctcaaaaaaaaaaaaaaaaaaaaaaaaaaactactttcatgccagatctgtcaagggtgcaaaaaaggaaattacgaaagactgcaagaataaaattgatatatgctaaggaaaggtgattttggtaagcataaaatcttgtcataagagactcaaaaattaagtcagggaaaccaagagaaaaaagatcaatgagggtctacattgtttcttttccataaggaaaaacttatcttccctctgtgtaattttattatttgtggaacttcggaataacaaaacccaccccccatattacgcgtaaaaatgagttaggtgcccagactgggcaacacagcaagaccctgtctctacccccaagaaaaggaataaattagctgggtgtggtggcatatgcctacagtcccagctactcaggaggctgaggtgggaggactgcttgagcccaggggttcgaggctgcagtgagctaagattgcgtcactgcaccccagcctgggtggcagagcaagaccctgttgtctcaaaaaactggtgttttcactaagaggtatggatgagttactctggcttcacattactgacagtgaagaatcgtgagtcctattctagaccaagctggctaccctggcactacactgcagtgttaccattgattctttgttttttgagacagagtcttgctctgttatccaagctggagtgcagtggcgtgatcatggttcactctagccttgacctactgggctcaagcaatcctcccacctctacctcctgagtagctacgactataggcgtgcgccaccacacccaatttttgtattttttttgtagagacggggtttctccatgctgcccaggctggtcttgaactcctaagctcaatctgcctgcctcggcctctcaaagtgctgagattacaggtgtgaaccactgcacctggcccggttgattctaatatacattctactcccaaatgattagtccaaagtttcactgtctaatatggtggcaccagcaacatgtatctagtgaacacttaaaatgtggtaagctcaaacccaatttagatttgtatttcaaaagatctgttttttaatggaggaaaaaagaatgacgaatatctcattaattttaaattttgagttcatgttgaaatatttttaatatactgaataaaatatgctgttaaaattaattttgcctgtttttttaaactttacagtagacgccctttgccaatgggaaatatacgttccaagacccccagtgcatacatgaaacctcagatagtattgaaccctatacataccgtgttttttcatatatatatatatatatacctatgataaagtttaatttataaattaggcaaagagattaacaattaaaaatatataatatataaaaggataattataacaatatactgtaataaaagttatgtgaatgtggtgtctctctcaataatcttattgtactgcactcacctagttttggactgtgattgagactaaaattgaggataagggagcgctactgtatttaaagtgaaaaaaattaaaattactcatgaagcttgcatatttctactgcctagtgttactgtaagccattaatgtcaatcccacttcccttgccaataaatggtcagagatataaaaggaaagcaattctcactcataagaaaacagattcaagaaagaaaaattgaggataagggagcgctactgtatttaaagtgaaaaaaattaaaattactcatgaagcttgcgtatttctactgcctagtgttactgtaagccattaatgtcaatcccacttcccttgccaataaatggtcaaagagatataaaaggaaagcaattctcactcataagaaaacagattcaagaaagaaagatgggaagataagatctcttctttgtctaacaattttttatctggacatagtgcctgacacttatacagccaccctgctatgagccagagacaagagaattgttgaaaaccagcagggcagtcaaattctaggctgaagcatccatttctgtatctctcagttaaatgatataacagatattcttattgttttcttttgttttgagacagagactcgctctgtcatccaggctggagtgcagtggtgcgatctcagctcactgcaacctctacctcctgggatcaagtgattctcatgccttggcttcctgagtagttgggattacctgcgcacaccaccacagccagcgaatttttgtatttttagtagagatgtggttttgccatgttggccagactggtctcccctggcctcaactgatccacccacctaagcctcccaaagtgctgggattacaggtgtgagccaccacacccagtccttattgtttaattcatttttagttaaggatttttacttgtagcaaatgcatccagataatatgcatatgtcttctatgcttttgatcatgctgttttcaatcacctaaaagcttttcttactactctccatccatctaaacctttcttaaatttaagcacgactttcttggaaacctagccacaaggattttttcccttctctgaagtatttcacctatcaatgatatcttaaaatgtctatgtttataatatactatcttgttctcacattttcctatatttacataatttttgtctttacaacaaaactggaaatcccgtaaaggacatgagaagtattctcaatactgggcttaaatcctcactatgtatccccagtagaggtgtatttagaggtgtacgctcataagcaaatgactcaatttctttgagcttatgttcagcctacatctatctataaaatgtacagtgtagaaaaacattccagcttaccttatatttcactgaaagcactgtcttaatgataaagtacttcataatattatctttttttttttggagatggagttttgctcttgttgcccagactggagtgcaatggcatgatctcagctcactgcaacctccgcctcccgggttcaagcgattctcctgtctcagcctcccgagtagctgggattacaggtgcccgccaccacacccagctaatttttgcatttttagtagagatggggcttcgccatgttggccgggctggtctcgaattcctgacttcaggtgatctgcctgcttcggcctcccaaagtgttgggattacaggcgtgagccaccgtgcccggccatattatcttttatcctacttaatttctttgagcttatgtccagcctacatgtataaaatatacagtgtagaaaacactccagctcatcttatatttcattgaaagcaatgtcttaatgataaagtacttcacaatattatcttttagcctacataaaacctatcagggtttaactaaagtggaagagcaaatagatgactgttccttctataaagagacctaagaaataaattaattacatttgtttttctacagtggttctgaatcaacgcccctaacaattcaggatctaacactgaactcaatccatgcttgaacaaaataaaagtcaggcttgtaaaaaaaaacaaggtgaatgaagtaaagaactggctacaaatatgaaaagtacttcctctacactgttacccacatgtaaataaatataatgggctccccccagcgccattcaatgagtgaacagcaaggtatattccccttgagtttaagagtttccaaacttactagtagattcatagggactatgaacattttccaagtggcactgaagctggaagggagtggaaaactggcggtaacagtgctggcagatagtgtgaccatctacctcaccgttctgctgatcgagttctacgtggtgtttcatatggttcatgaatctgtaataaagcacaaagagaaagtacagaaaacataaaaaattggtagccttttagaaatataatggtaaaatcacagaacaaacattatctgctcccctccattccccagacttcctgtttgggatatccttttctgagcccagaaagataatgagttcttgaaactaagagagttctgggaaaggagacatactgctttcccttactcgatccagttaccttttgtttattaccacaatatctccttctatagtcctagttattgatttaatgataaccccagcaagactgcatagtagttaggtccattctccaaagagaaagacttaaaatatataagaaaatgtaagtcttctcttgttcaaggtaacttccaaggctcttaaacacttaccgaatattgttttttagccttttggtacaatgtgggcatcggaaagatgtggcgaccttagggaaatttgtgagctgggctactttgccaccatcccgtccatagtagaagtcatctacaagcataatgagtttggtctggacggcatcgcccacgttctcatttggttctggtactttggtaggcggtgacagagcaggaataggtgtagaagagggtgtggaagcaacaggagctgttttctcaggggatgggggctttgctgctgatgggacactgggttctgaatccagggactttcctttcttctggtattcaaccatttctgggcaacagtactataaagaaagacatctgatcattctggttatcctgggggctagaatgtgctaactccttaacttcactaccattccttgttaacggtttggtttcaggtattctcattcagctttcacccttcagttttttttagcgtttccaagttttactccttttctagagtatatccacatatgccacccaagcgctatactttgtatttctccctcctgcctgtcttaggtcccttaatcattagtataacttggctctgagctccctggcaaagaagaagttccaacctttttatctggactaataccaaaaaatgaaaagctaaaaaatggaagtaagagctcccgattcatccaatgacacaattaacaaaaatgaactgaggccaatatggtttgagtccttattatctataaacctgttctcctgtgtggtttcaaaatctaccacactaagaaagtaagatcacatatgttctgatctatttgagggtctttaaatgtatcccatcacattccaaagtacacagctcttctaaaaacagaccaagagaaacagtaaccctttaaaaagcttcagtcattttagagcccctgcttacaagcttccaatattaatgaaggtaaatggcagaagccacttaagctggatcacaggtgatatcacttacacacatgtgacctctcaaagcttcagtaacacgaaattgagcattacatcgtggacatattttccgtccaccatcctggaggtcaaatactgggatggaagaggtcactgaaagaagtgagaagaattgataagattaatacaatgacactggaaaaagattactgaccttttgggaaaaagtcaaacactccctgagaagtatataaaagggtaagcaagcatgagagatcactatggtttttgtttgtttttgttttttttgagacacggtctctcagtctgttgcccaggctggagtgcagtggcacgaccacagctcactgcagccttgacctccctgggctcaagatcactatgtttgaggcttccttttactgttctaactctaggccaggggtcagcaaaccacagcacacagatcaaatccagcccagctaccagtttctgtttggcccataagctaagaataatttgtatgtgatttttttgttaaggtttttgttttttttaatcttgcagaactgaagctatatccaataaaaacctcctcaccattctcccctcgcctccaccccggcaaccacaattcaactttgtctctatgaatttgactactctaggtacctcaagtaagtggaatcatatggtacttgtccttttgtgactagcctatttcactttaacataatgtcctcaaggttcaaccatgttgcagcacatgttgtagcagaatttcctttcttaagcctgaacaatataccattgtatgtgaataccacattttatttatccctttatcagttgatggacctctgtgttgctttcacctttcagctattgtgaataatgttgcaatgaacataggtgtacaaatacctgttctagtccctgctttcaattcttttgggtatagaatggaattcctggagcatacaacaattctatcatttttaactttttgaggaaccaccatactgtttccaaagtggctgcataattttacatttccaccaacagtgcgtaagggttctgctttctccacatcctcaacaatatttgttattttatggttctttgatagtagccatcctaatgggagtgagacggtacctcattgtggttttgatttgcatttccataatgattaataacactgagcaccttttcatgagcttattggcaataactttctttggagaaaggtctattcagtcctttgcctactttcctacttttttttttttttttgagatggggtctttctctgttgcccagactggagtgcagtggcacaatctcgactcaccacaacctctgccttccaggttcaagcaattcttgtgtctcagcctcccgagcagctgggaatacaggcacacaccaccacgcctggctaatttttgtatttttagtatagacggggtttcaccattattggtcaggctggtcttggactcctgacctcgtgatccacctgccttggcctctcaaagtgctgggattacaggcatgaaccaccacgaccagcgagtcctttgtctattttttaaaaaggttgtttgggagtttttttgttgttgaactgcacaaattctttatatattctggatattaaccccttattagatacataatttgcaaatattttctcccattctgtggcttcccttttcactgtgttgacaacgtcctgcacaaaagttttaaattttgatataatttaatttactcattttttcttttcttgcgtatgcttttggtgtcatatccaagaaatagtaatcactgtcaaatccagtatcatgaagctttttgtcctataatttttctaagagtcttatagttttagttcatttaggtctttgatccattttgagttaatttttgtatttattgtaaggtaagatccaacttcttttggacatggatatctagttttcccaacaccatgttttaaaggtttttactttttttgagacagggtgtcgttctgttgcagtggcatgctcatggctcactgcaggctcaaccttctgggttcaagcccaagccatcctctcacctcagacttctgagtagcgaggactgcagacatacaccaccacgcctggctaatcttttttttttttttttttgtagagatgggatctcaccatgttgcccaggctggtctcaaactcctaggctcaagtgatcctcccgtcttggcctcccataatgctgggatgaggtgtgagccactataccttgcggtttttatttttaaatggttgaaataaaagaataaaacttttcgacacatgaaaattttatgaaacttaaatttcagagtccataaatagtttttagtggagcacagccatgctcattcgtttatgtatctgtggctgcttccccaccacaacagcacagttaatagctgcaacagaggctatatattgtgcacaaagcctacaactttactactaggccctttacagaaaacatttgccgacccctgctctagaccactgaaaaccctcatgctcatcattctcaacctgaagatctctctaccaaatcctaactttaaaaccttgctcagaaatccatctcttccatgaagttatctttcattatctcacccatctttaatcaatcaatttcactaatctccaaagcacaattacacacataatttcttggagctgattcagttacactttttgtaagtggctttctccttactaaagtttctgtaagaacaaactacagcagctgtattttattttatttttctatttctgagtataaagctctgatacaacaaacactttattaatgtttttgaatgactggctgctcagagtctttcaggttattgtacctttcattgaagactcaggtccgctggttctttgagagccatgagcagagctgttgttggacaccaccactggcccaggactctggcccagggaagggatggtgttaagggtattcaccaatttggccacttcattgctattttcgcctgtaacaccaggtcgcttcacagtgacaaagctggcaatgctcactgcaggtggagaggggaaggagggagctacggtgaccaagtgataatcatctgttctccacccaccatcccaacctggctctgccatctcctcttccgaagccttacctagcttgggattcgtggtctggtttgactggcctggagactgaacagctagttgccccagtgaggttggctgtgtggcagtgggagtggtagaagtgctgggagtggacttggtctgctgggactgggactgtgggacggtgcttcgaatggtaagagtggccgggatgacggtggtgaaggtgttggtggtgggcctcacaggcattgtggagcctggcctcacaggggtcatctgggagaacacttgtggaactccaactgtcggcttaacaaactgggtacctggggctttaaaagagagacaaagtaccagatcttggtcagtgagctcacctataacacattctccctgcctttactggaaagattatttccccaaactgatggatgatcatcagaggtttccaagaggagtatagattctaaagactaagaaagcacaaggtgtccatgttgacaaaataacctgggcagcctaaaaacattaagttaaataagactcccatcaactcctcctaaaacaccttatcacactgcctttttaattctaagaatacaatcagtggcttgacctcggtactggaagaaaagagtgggaagcaatatgggtgtatataggccaaatggcaaacctggtcctgaaaaaagaaatcagtctttctcagagtactaaaggagtcttccatcctcttctatcaactcagaagacagactatgccattctactaggatgtcccaaagaggaatgtctcctggctcaactgtagacaattccactgagaaaaataaagaaatgccagggtaagctggtcagacttaaacccctatgggctacgagaacaaaaaacaaaaccttaggaagacaagctacagaggtacccttacaaatagctaaattaagatactcttttttggtctgaattgtagtaaacttatacatgctaaatagagcaatggaaaattctaagattttaaaaaaattatccttctcagaatcttaaaaaaaaaaaaaactatctagcagaatcttaaaaaaaaaaactatctagtcattgacagtatttatccataaaaggaatgtcatttgtttatatctaaaatctatgctataaaattaaaacaaagtttataatcccaccgtgcaaatgaggagatgtgtaaggagtgtagaatttatgagtttgcattaataacatagtcttaatagctgactaaataccagttacagaaaaatgactgtaaactctgttttactacttgatgaagggtggtgaaaagctaaacagaaataaataaaaccaccaccctggccaaaggttagaagcagattttttaaaattgggcttaaatcattaatatttttatatttttagattttctttaaatgtacttactaaatgacttaggatatttagaacaataaaaacaaatcttctggatgccagtttattccaaatggatagacatttttccttacctggaactagtgtaattggtctaaccgtttggccttgctgtacgttcagcacaatcccaacctgattcattgcattttgtacaggccggacattccttacaggaaatccctgtattaaaaagcaaaatgatctttaacatggagaccaattaacactgacaaagattgcagtatgacctacatccaaaaaaaaattcccatactcttacttaatggttctttctctagaattagaggtttcaaatgactgagagggaaaaatttaggaaattctggcaaacttttgagagacaaaatatcaaaattagagaacaagctttggtacacatgagcaaaaatgaaaacctatttcctgacttaagagagcatcggcttaaaaaaacctcatcaacagactggctccctaaagtgctaaatgaacagaagtgggggtggggggcagggggaagagcaatgttcactggagtgattcaacatacaaacaatcctaaaaaattgttcccaaagtctacttcaaaggccataaacctttggcaaattcataagaatttacaactcaggaagccacaggcaaagagaagcatttgcctttagaatccatattcagaattaggctttcaacttcaattcaacacattatatatcaaataagtcatcttccttgtctcccaaaggtctccatgaactccaccaattacatacatacatctccaaaagttaactaattcatcccatgtgaagaggagcagtccacgcaaagggtgaaaagcctcaagagccaagcgttaaggcttcctaattcaagttttcccactatttctgcctagactttaatcaaatcacttaataaacttctaaggggtttaaagaagatattacccagccatactatgctgggctttccacagttggcatcaaattacagaacagtaaaagagaaagccaggtcaaaagacaagacttagaaccacttctaatgacgccaaagaccctaagtcagagttttcagaggtttatagtctttctctcctctagcaaccttggaattcagagtcctactcacctgcgtagtgataaatattggttgtgaggccacaggggaactagtcacatgattggcattctgcatgacctgaacaggcctcaatactggttgagtaaccattgtgcccagacctggggctggattctgggtcaggatgagtggctgtccaccttgctggaccaaaggattgccagctaaagggtaaaggaagaaaaaaaaaaaggaatgttagaaacaatgttaaacccacattttactttattttattttattttattttattttattttattttattttatttgatacagggtctcacactctgtcacccaggctggagcacagtggcacagtcacggctcactgcagcctcaagttcctgggctcaggtgattcttccacctcagcctcccaagtacaaatccacattttattagaaacagaaatggtgtcctatatgccaaaatatccaagactgccactcatctcaggtttaatgtgaccaaactcaccaaaaatttaagtttcacccaaatctacaactaacagaaaaacagatgggtaggggaggttcactaacacttcacccatatgtcttcactggggatgaaagacacattagaattctatgtggctagcaccctgactctcatgatttaagtgaccacacataatctcccccaccaaatcagcagaacaaaatatgttaagtctttttccatattttaactaggtaaaacctattttattagaagataatttgttagctaatcccccttaattttttaaaaagaatattcatcaacaaacattaattcagcaagcacacagaatctaaggaatggtttctcttcctagtgagttaaatctgagaaatgcaagattctttaagcaaccactgggaacccagagactgacaggctacctaccgtagccctctctttatgtcatcaggggtgataatcagaagacctggacaaaaactaacccacaccaagtaaaaatgacatgatttcagaagataatgattcattcatgaataaatattaataaactgggctattattgaaatatcttaaattcttttcatttgtgaaaaattttataaatatttttaagtcccctatttcatgacatttggtgaaaaaaccaatactaagtttcctgatttacaaagtatactcaaaaccagatagaaaatttcagagagccaatatacctaagccaaagagtcaagcaggccaggcatggtggctcacacctctaatcccagtactttgggaggccaaggcaggcacatcacttgaggccaggagctcaagaccagcctggccaacacagcaaaacgctgtctccactaaaaatacaacaattagccaggcatggtggcgcatccctgtaattccagctacttgggaagctgaggcaggagaattgcttgaaccagggaggcggaggttgcagtgagccaacattgtgccactgcactccagcctgggcgacagagcaaggctctgtctcaaaacaacaacaacagcaacaacaacaagaaacaaaaaaccaaagagtcaagcaaaatatggcctcaactttttacccaaaatcaccagaatgggatgggcccctctgaaatgtatgttccacttggcaggttatatcaccacagttaactacaaagctagaccaccaaaggaataggtatgtaggtggctactaatgggccagcagtggcttatcttatactctctcagaaactgagagctcatcagtagactagaccctcagttactgagccagaagaccagtgattgtagaggcagatagataaataaaacagaaaattccagcaagttctatccatgttaaactatactggcaatttatctatggtgggttttttaaatttttaaatgttttattatggagaagttaaaacatacataaaaagggaacgctatagtgaacccctatgcaaccaccaccctgcttcaataattatcaatgtatggcaagtcttatttcatctataccttctacatacttactagttcccatatcactttaaagcaagttctagatcatatcatctataagtatttcaaaatataccttctacataagaacttcaaaaaaagataaaagaatcataccaacataactcctgaacattataataattattcaatatcaaatacccagtcaaaattcaaatttacttgtattttttaagtaatttgtctgaatccagttacaaaatgtttgcaaagtgcaactgatgaactaactcttttaatctataggttccccaaccatctctttctatccttttgaaatttatggttgaaaaatattgactaagcaaaagtctatattttttagtcattattttaactgctaggacaaaagaaaataaattatctcttatttatcctaattctaaaaattcttaagataattactagctcaacatcccaattaaatacaagaagggaaagatggaggctttttgcatttatgggaaatcagtcagcattagcaagtctcttaaagacagaccaggtttccatgaaacccgtaaataccattataaagaattttaacagcattttctgcaaatattttctcttatatcagggtcaagtttaaattttggtggattgttagaatttttccaaaaaggctgggcaaggtggctcatgcctgtaatcccagcattttgggaggctgaggtgggtggatcacctgaagtcaggagtttgagaccagcctgaccaacacggagaaatcccgtctctactaaaaataacaaaactagccaggcgtagtggcgcatgcctgtaatcccagctactcgggaggctgaggcaagagtattgcttgaacccaggaggcagaggttgcattgagccgagatcgcgccactgcactccagtctgagcaataagcgaaattccgtctcaaaaaaaaaaaaaaaaaaaaaagaattttcccaaaaatatggtacaatcaaaaagtggttttctaagaccagattagattcacaatgcaatggaaagcaaaagccagactatggaaagtcatactaggtaaattatacttacttatttagaagcattttaatgatttctgcaatctttgctcaaaggaattctgacaattcaagtgtcttacaaggttctatttccagaggatgaaacaggcaatcacaattctggtgctttaaaaaaaaagcctttaaaaggattatccaaactagggcagtggtatgcacccgtagtcccagctatttgagaggctgaagcaggtggatcacttgagcctaggagttcgagtccagcctggacaacacagtgagacccccatctcaaaaacaaaacaaggccaggcgtggtggcttacgcctataatgtcagcactttgggaggccgaggcaggcagatcacttgaggtcaagagtttgagaccagcctggccatcatggtgaaacccccatctctactaaaaatacaaaagttagctgggcatggtggcatatacctgtaatcccagctacctgagtgactgaggcatgacaattgcttgaacccaggtggggtcttcagtgagccaagattgtgccactgcactccagtctgggcaacagtgtgagtctcagtctcaaaaataaaaaatgaaaaatagctaggcatggtggtgtgtgcctgtagtcccagctacttggggggccgaggtgggaggatcgtttgagcctgggaggtggagggtgcagtgagccagctgtgttcgtgccactactgcactccagcctgggtgacaaagtgagaccccatcttgaacaaaacaaagaaaacctaagaaacaaatgaaataaaacaatccacctcagtgacaattaattccatgagttttcttctatacttcagacatcacatggtatcaagcacattattttttgagacagagtcttgctctgtcaccagggtggagtgcaatggtgcaatcttggctcactgcaacctctgcctcctgggttcaagtgattcccctgcctcagcctcccaagtagctgggactacaggcacatgccaccatgcccagctcatttttttgtattttagtagagacggggttttaccatgttggccaggatggtcttgatctcctgaccttgtgatctgcccaccttgcacataaatcaaagaattatgcaactaactttctccctctaagtttgctctctcttgatttttttccttcattctttctttttttttttcacaaggagttttgctctgtcacccaggctggaatggcatgacctcagctcactgcaacctctgcctcctaggttcaagtggttcttctgctcagcctcccaagtagctaggaatacagatgcccaccaccatgcccagctaatttttgtagtttttaacagagacagggtttcactatttggccatgctagtctcaaacttctgacctcaggcgatctgcccgcctcaagcctcccaaagtgctaggattataggcgtgagccactgcgcccagccttccttcattcttttaagtttacttccatacccttaaagcccagaaatagagggctaaatacaataggaactgaaaaccataattagttatactgtaagaaatttataacattaaattcacatcattcacagctcagaattaagcaatagtttatttcacctcataatgtttctttcctgtgcaaacataagatgagtcagaactacaggaataattttaaaatactgagtagtaaattctaaagaacatcaaacagaatagtaaaaatattccaaaattttattcctgatactttccttttttttttttgagatggagtcttgctctgtagcccaagttggagtgcagtaacgtgatctcagctcactgcaacctccacctctcaggttcaagcgattctcctgcctcagcctcccaagtagctgggactacaggtaaatgccaccacactcgcctaatttttttgtatttttagtagagatggggtttcaccatgttggtcaggctggtcttgaactcctgacctcaaatgttctgctcacctcggcctcccaaagtgctgggattacaggtgtaagccacacacctggccttgatactttcttaaaaacaaaacacacacaaaaaaccaaacccagctttgagatataatccacatactgcccatttaaaatacacaattcagtgatttttttttatattcccaaggctgtgcaaccatcatcatcattatttagttccagaacattttcttttctttttttttttttttgagatggagtttcgctcttgttgcccaggctggagtgcagtggcgtgatctcggctcactgtaacctccgcctcccaggttcaagcaattctcctgcttcagcctcccgagtagctgggattacaggcacatgccaccatgcccggctagttttttatatttttagtagaaacagggtttcactatgttagccaggctggtctcgaactcctgacctcaggtgatccgcctgccttggcttcccaaagtgctaggattacgggcgtgagccaccgcgcctggcctagatccagaacatattcatcgccctcaaaagaaacctcatttcccctagcaattattccccattcttttctcttcccagcccctggcaaccacgaatctaatttctctctctgtggacttgcctattcaagacatttcatatagatggaatcatataatatgtgaccttttgtgtctggcttcttttttctttcttttttttgagacagagttttcctcttgttgcccaggctggagtgcagtggtgcgatctcagctcacagcaacctccgcctcccgagtgcaaacgattctcctgcctcagcctccctaatagctgggattgcaggcatgcaccaccacacctggctaattttgtatgtctggcttctttctcagcattatgttttcaaggttcatctatgttatagaatgtatcagtatttcattcctttttatgggcaaataatattccattgtgtacatatattacattttgtttatccatcaatttatggacacaggttgtttttacttttagctataacaaatgatactgctatgaacattagtgcacaagtttttatgtgaacatacgttttccattctcttgggtatacagctaggagtagaactgctgggttatatggtaactctatgtttaacttttcgagggccaggtgaggcggctcatgtctgtaatctcagcactttggtaggccaagacaggcagattacttgaggtcaggagtttgagaccagcctagccaacatggtgacacactgtctctgctaaaaatacaaaagttagccgggtgtggtggcaggcacctgcagtcccagctacttgggagactgaggtacgagaatcatttgaacttgggaggcagaggctgcagtgagccgagattgcgccactgtactccagcctgggcaacaaagcaggctggagtgcagactccgtctcaaaaaaaaaaaaaagtaatacatgccacaaacaccttccagtttgtggtttgtcttctccgtgtgtgtttttttttaatcacatctttaatgtagttctatttatcaattttaccctttatggttagctctgtttttgtatttggtttaagaaatctttccctcttctgagaccacaaatttttttttaattttaaatttctaaactttttaaagtacactaagtgaaacaatactgaattgtttaaaaattattctcatttgctggtggggagcagtggctcatgcctgtaatcccagaacgttgagaagccgtggtgggtggatcacttgaggtcaggaaattgagaccagcctggccaacatggtgaaaccccatctctactaaaaatacagaaattagccgagcatggcagcgcatgcctgtaatcccagctactggggtgggtgaggcatgagaatcgcttgaaccagggagacagaggttgcagtgagccgagactgcgccactgcactccagcctgggtgatggagtaagactctgtctcaaaaaaacaaacgttattctcatttgctatgttactaatgtagtaagcagataatatatcaatacaattaaactgaaggcttaaagggaaactgggttgtatgaggcagtatttctcattcactttattctgaagccatatccttaaagttggactagcatttcaagagttcctaggctgggcgcagtagctcacgcctgtaatcccagcactttgggaggccgaggtgggcaaatcacctgaggtcaggagttcgagaccagcctggtcaacactgtgaaactccatctctactaaaatcacaaaaaacacagccaggcatggtggtgcatgcctgtaatcccagctactcaggaggctgaggcaagagaattacttgaacccgggaagtggaggttgcagtgggccaagatcacatcactgcactccagcctgagtgacagagggagactccatctcaaaaaaaaacaaaaaagaaaaaacaagagtatctgatgaaaaaagttacagaactgtatgtattttttatatagatatataaagtaaaataaattagacaactgcaattaatttatgcttatctatggatgaatttttttttggaatacacaagactgtggttacttaccagtctatacccactgtcttcttttttttcatgaacatgggttatgggttaacattttaatttaaatattagaggcttttgaagtaaataaagtcaatttatattttttagaaaaaattagtacactggccataggcaggctcaagaatcaagggtacattcaaggagtcaaggagactaggtcatctcagcatgtcacaagatgctcagctggcctggcatggtggctcactcacgcctgtaatcccagcactttgggaggccaaggagggaggatcgcttgagcttgggagtttgagaccagcctgggcaacatggtgaaaccctgtctctacaaacattataaaagttagccaggcatggtggcatgtgcctgtagtcctagctacttgcggggctgagatggcaggattgctgagccacagaggttgaggctgcagtgagctgtgttcacgccactgcactccagcgtgggtgacaaagtgagatcccgtctcagggagaaaaaaaaaaaagaagatgcacagccatctcagtatgggccttggaaccctgggatcaaagaaaaggttaggtaagctggttgctaacagaactttaacagtttgagagacacataggactagtcctgtggtagtgggttatcagaacttataaacattagtgtcactaaagttggtatacaactcccccactgctaaatttgactggcttaaaaaaaaaagaaatacacaggaaagcaatataatacagtggaaatcccgaaagctttgaagtccagaaaatgcaaatacagtttagtcacttagcaactattattacttataacaaaagcaaattatttagactctctaggcctcagtttccacatctgtaaaataatagaaatctttacataaatggttccccatctttatacatacaagggatcccatttataagttttttagaagtctaaagattccccataaaatcatcatattttcagtacccaaatactgaaaacctttggaaatcatggaggttttaaagtttgataatacctaaagttggcaacaatgcggggaaagagctactggcgggcacttatttagagcaacctattaggacaacttgacaacgtctatcaaattataaacacctgatccagcaaatctcacctctaagactttatattgcaaatacgttttacacagtaggcaaggacacatgcctgaaaacattcaccacagcatcatttgtaatcacaaaggatggggaccctaataaatgttcaacaatggggaatgcacatataaatggttatattcccaaactaaaaaccatactctcttctatcagcaatataaactgacacaacatttctagatggccaatccaggaacaatactgatcacaattcttaaaaactgtgatgacctttgagccaacaatttgtttcagaaatatatttgcagaactaattaacaatgcgagaaaagatacagagataggaatgttcactgaagctcttaaaaatagcaatataccctcttacaacccattgttaataagttaatcaaataatgggaaatacagtcagtcatcaaaaatgttatagatgactattaaaataagatattcactattaaggggaaaaggcaggcagagtaatgtacaacttgtataatctttttttgtcaaatgaaaatcaccacatataacatatagatgtatataaaaataaaaaataaatatatgtacagaataaaagtaaccatcagttatcttcaggtggtgggattatggttaaacatttttttgttccttttttttttcactttatagtttttctacaatgcatatattatttttgtagtactaaagctgttttagttttaaaggaaataaaataattaaaaaataaagtccctcgcagcgatgcaatgactctatgaaagtgcctacttcagttatgaatcttgagacataactggtcaacaactcatcttaggagtgtagaaatagacattagaaattaaatagaaaccaatactatatagcctttctattaaaaaaaataaaataaaatacactaaaaacactagtctttcaccatttctttcatgtagacaacaaccctatcctatcttccatactcaggaaccaataaacaaatgaatctgccagagaaaatacagaactgccctgggaaaattcttaccaaactaatggaatttttctcattaaagaaacaaaaacaaccaaccaaccaaacaaaaaaatcttaacaggaattttgggttgacattttctctccaagaaattatcaatagcaagaatctactgctctctcacttgaaacaccagtaccgagtcagcactaacttagaaggaatagcaccatctacagaaatcacttccgtatcagagaatcattactaaattcattttccaactagtagaaccacatctgtacctaactaaacaggtagggctgtccctgagaccttttttattctttcacccctctagcccaggattattatttcccaataatcccacttaccattgttgttggcaattagtgtgacaagagtcttctttgtactgtcgctgttctgtgccccgctgctactaacggtggtggatgtagagaggtgcccagcaacagaagcatgggcagcgatgggcactggagccgagactggctgctggctcacagaaactgtggggaaggggaggcatagtcacttggagacagggacagatgacactaaaggatactgctctaatcttccctttccatcttattgtgggtctctatagccaaaaagtttcctgtttcataaatccaactgttcatgtgatttctcctcctacttaacccttagtccaccatttaaacacaatcccttcttcgtctcacatctcctggttaattaagttacatcacggagcccactgaactgggattttaatctttgcttacatagcactagcaaacctctaggactcaaaggtttattattaccactagtggtattcataatcatgcatattaagccatccaaaagaccctgaactgtgccctatttcagcccaaaccaatgccatcttcaggtctcaagacaggaaagataaaaatatagagcaactggtacaatttaggggagcaaaagaactaccacccattttctgaattcagggcaatctagaatttgacccagcagtatcacctttatgaaagaaaagctaacaagcctaaatttgtaaactgtccatgaaggcagacacaaggcaatttctactccactcacaaaggaaaccaagttcaagtaaaacaaaataaaacaaaaaaaacaagactatgggaacctatttttgactgggtacataaatgagcactgacacacacacaccaccactttgaattcttgttcatacatcttttagtaagaagactgctagatatttgataaacactggttaatccaaccttccaatgttttcgatgaattaaatatatagtttctagctatatggatgaggaaactgaggttttcacagactagagcatgggaaaaaaggcagcaccagtgagtgccacaacgaggtctccctggattcttcaagtccttttccatctcacactttgttaaccaaaataccattcaatttaattaatttaaaccatctaagatcagaagagcttttgttacctgtggtagttttatccactgaattataatcttcaactacagagtcctcaatgacatcactgattttctgccatggctccaactcctcctcctcacattccatgaacaggtcggtgtccgccatgctataagaaaaacattcaaataagatatgggcctaagaataggagatattgctttataccaaatatgaaatcagaactttgactccattggtaacctacctccttggactcctttatcatatcctctagccttcctccatttccaagggttcagaattacaacttctattattgaatattagaatccattccacagcaaattatttaataattagggttacaggccgggcatggtggctcccacctgtaatcccaacattttgggaagccgagggaggtggatcacctgaggttgggagttagagaaccagactggccaacatggcaaaaccctgtctttactcaaaatacaaaaattagccaggcgtggcggtgcacccctgtaattccagctacttgggaggctgaggcacgagaatcgtttgaatccaggaggcagaggttgcagggggtcaagatcacaacactgcactccagcctgggggacagagtgagactctgtctcaaaaaaaaaaaaaaaaaaattaggattataaaagtttaggccaggcacagtggcttatgcttgtaatcccggcattttggtaggctgaagtgggtggatcacgaggtcacgagttcaagaccagcctggccaacatggtgaaaccccatctctactaaaaacacaacaattagccgggcacgctggcaggcgcctgtaatcccagctacttgggaggctgaggcaggagaattgcttgaaccccgggcagcagaggttgcagtgagccaagatcgcaccactgcactccagcctgggcaatagagactccgtctcaaaaacaacaacaacaacaaaaagtttaatgtgtaatacccagggccagggttaggatgaggacagtgaggtgagtcaagcaagtgcaggatcggattcagtctttatttaaaatagatattctgttcattatggattgttctgcattaatattgatcttttaaaatgatgcattaaaatgcatttattatgattactgaacctctctgtactcctttaaattttgcatctaagatgagaaccttacttgtcatactctagtcccagtcctactactaccttgtacgtctagtctaggaaatcctggaggccattccactgtgatttcggagtcaacccttaatttgaaaacactgcctaaattacatgtccctttaaaaaattaaagtctgagccgggtgcagtggctcacgcctgtaatcccagcactttgggaggccgaggtgggcggatcacctgaggtcggatcacctgagatcgggagtttgagatcagcctgaccaacatggagaaaacccatctctactaaaaacataaaattagccgggcgtggtggtgcatgcctgtaatcccggctactcgggaggctgaggctggagaatcgcttgaacatgggagtggaggttgcaatgagccacaattcacgccactgcactccagcctgggcaacaacagcgaaagtccatctcaaaaaaaataaaaataaataaaaacaaataaataaagtctgtatctctgcattgcaaacaaagagttaatgctattctgccctccaataacagtttactaagggtcagtttctctgtgttggaacgggagtactattactgctcaatgttcaaacaaagcctttactgtaaggctctaagtgtccttagtgtcttagtaattctgctgctacatccataagcgaaaaccaaaaccaaacaaccaacctaaccattctgtttattgagtatttagttagggctatacatcctgacagtagcagtttgcaagaagcccaacagatggcattgtttcgcttgaaaattgaaaacaatcttgcagtgccccagtgagtcagctatagccaggggcactctgggttttaatgggtaaagtgcttaactggattctaactggtctttaatcttctattttaattatttctgtctttctaaaccaaagccacaaagggggtgaggaaagaaaaagatctaagggatcaacttacttaaattctcttattttcaggcttaattatatgaagacaatactagccagaaactgaattaaaaagaaatcaaatccatatcacaggtattctttgagacaaagacaacacatgcctttgttttccagtctaattccactacaaaatatattttcaaaaactttttccttaaatacttaattttattccattgttctttgctgtataactttctgagagcttagtcaacagataattaatgcgcaaatatccaacacccagcagaatgaatataaactgtggacaataacctctgccgatggttttcaaggacctacttttgtcctgaccacttacaagcaaactctccacacatatgaaaactttgatttggaatatgaagagctatcagaatacaaattgtggttttcaatgtcatgcctgtggttattttaatagcatacccaaaagggtgttcttttatcttaagtatttacaataccttaagagtttcagttctttattttataaagcaatgaattttaataagaatattgaaatttcttccatttgaccttctgagagaaatggaaagaactccagcttgggtagcacagcaagactccatctctacaaatttttttttaaaaattagccaggcgtgcagcacacaccagtggtcccagctaccagggaggatgaggtaggaggattgaggatcgcctgagcccaggagttcgaggttacagtgagctcgaggttacagtaactgcagtggtgccactgcactccagcctgagctggagagctggagagcaatactccatccctacaaaataaaataaaaaacaaatggaaataaccaaaaagggtagatctgaaaagatggcaaagaaagatgtttatgtcctaactactttttaatcaagtgagaaaaatatctcttctccttaggtatgagtactgccaagatatccaatgtaaattaaaagactcaaaatgaaaagaaaatccaacttggctggacacagtggctcacatctgtaatctcaacactttgggatgctgagaagggtggatcatttgaggtcaggagttccagaccagcctggccaacatggtgaaaccccacctctactaaaaatacaaaaattagccggacatggtggcacacgcctgtaatcccagttactcaggaagctgaggcaggagaatcgcttgaacccaggaggcagaggttgcagtgagccaagatcacgccactgcactccagcctgggcaacagaagccagactctgtctcaaaaaaaaaaaaaaaagaaaaaaagaaagagacaaaaaagaaagaaaaaaaagaaaatccaacttatggggaaatatttttcatttttttttaaacaacatagaagatggagttagctaataaggtttgtcaactcagaaaatattaggtctgctgactgaacatatttcacagacttatacacaaagcatctctgaaagacactgaagccaaatttttcaaaactgtccttgattttgacctacactctgctatctcaggatgtgatcaattcctttcactttcagcatctataactcagggtctaaaagatacaacagagatatatcaacctaatataaatattcagcaaaccaaaaatagaaaattcatatttagatccttcttgtagttttctagttatcaaaaggaaatcttatactaacataataaaatgcagtatttaatatttctaccaagattctcaagaaacaccaccattctctgtggtctttcaagtgatccatggcataccgtctttcaacttttttttttttttttttttagccccgatcatgggcaagggcagcctttcaactgtttttgaacaaagaagacagtaattactaaatatgcagtgttaacatgtatatccagattctgaaaatgtgccctcaaaaaaaaaaaaaagatcttcccaaactatcattccacacatttaacctccttccataccaaatctttctcataaggaaaaaaaaaaaaaaaaaaaacgaattttattccctcttccctaatttcttgctatgaaggattggatacttatcacactaaaaaaattatgctgaaatgtaatccttaaggggcattttaatttctcattttttatttcaaaactgccaaacagaaatgcgaatttcagatatttaaagccagcccatagtgaatacagtgctacatcaagaggaaaacggccgggcgcggttgctcacgcctgtaatcccaacactttgggaggccgaggcggggggatcacctgaggttgagagttcgagactagcctggctaacatagtgaaaccccatctctactaaaaatacaaaaattagccaggtgtggtggcacacgcctgtaatcccagctactcaggaagctgaggcaggagaatcgcttgaacctgagaggtggaggtcgcagtgagctgagatcgtgccactgcactctagcctgggcgatagagcaagactccatctcaaaaaaaaaaaaaaaaaaaaaaaaggaaaacttggatgggcagtaaatttgggaatcatactgcaacaagtgaacaggcaaattttcatacgagtctctgaatcaaaattgtagtggttccttttctgctaattttaatgatacaaattttaattgaataaaaaagttagacatgtattcgtcactcagtttcaaaaattatcaactcaaaatggattccttcatttatgcccccacttccctgtattatattgaaacaaatctctaaaacatcatattcataaatattttggtatgtaggtctaaaagataaggactttaaaagactatagtttaaaaaaattgtatggctgggcgcggtggctcaagcctgtaatcctagcacttcgggaggctaaggcgggcggatcacatgaggtgaggagtttgagaccagcctggccaacacggtgaaaccctgtctctactaaaaatacaaaaattagccaggtgtgtaattccagctactcaggaggctgaaacaggagaattgcttgaacccaggaggcggaggttgcagtgaaccgagattgtgccactgcactccagcttggacaacagagcaagactccatcttaaaaacaaaaaaattgtattaccattacatgcctaaaaaactgataatcccttaatatcaaatatctagtcattatcccaatttcttttttctcttctttttttgtgagatgtggtctcatccaggctggagtacagtggcacaatctcagctcactgcaacctccacctcccaggctcaagaaatcctcccacctcaacctcttgagtaactcttgggacaaagagctaactaactcttgggataaccaagagccaccatgtctggctaatttttttttttttttttttttttttttggtagagagggggtcttaccatgtttcccaggctggtctcaaactcctggactcaagcaacacacctgcctcagattcccaaagtgctgggattataggtatgagccactgtgcccagcttttgatgtgttttgatccatgcagttatctttacagatactcaatgtgccctattttggccagtgggaacgtcttcagttggctgctgagtccttctgacacaaccctagcatcgtttgataaaatctttgctgatagtcaagatgtttcagcttatctcatatatttcctgccccagacctagaaccaaccatttcttcaaggaatgatactggtggggaatgagtttccaagaccacaataaaaggctagggtccttcttgctcattttaaataaaaaattacctccatatgaatccccaagtattagctatcttcaactttgctcttacgtcatctgacagaaaaattccacatccacaaatatatttcttagaaacctaaaaaaaaattttctcctgaaatttttacttgaaatgtttgtcttatatatttagtaaaccactcattacttcccctcttatcctatcctgactgtatgtattcccctaacaaaatacctagatcattaagataatttatatgtagttaagaaattttggctgggtgtggtggctcacatctgcaatcctagcacttcgggaggctgaggtgagaggattacctgagttcaggagttcgagaccagcttgtgcaacagagagagacctcatatctattaaaatttttaaaaaattattttaaaaagataaattttaagaaaaatataatcaaacaatcaaaggttaacaaagaggacacatttagtttaatcaagccttttagcaagtaacttttccagactatcttttctttgcctgtaatcccaccacttcaggaggctgaggtgggagaactgcttgagccctaattctttgagcccagaggttcgagaccagcctgggcaacttggtgaaatctcatctctataaaaagtagaaaaattagcagagtgttggtggcatgcacatctgtagtcccagctactcaacaggctgaggtgggagaatctcttaagtccaggaggtggaggctgaagtgagctgtgatcgagccactgcactccaacctgggcaacagagcaagaccctgttctcaaaaacaaacaaacaaacaaacacgcaaacaaacaaaactatctttccttgaacacaagatatagacagatcatgtcaaacatttcaaacgaaattctcaactattcctaagctagtaaggatctttttcaagcaaatgcatgagggggtggtggcagaggtggaaaacagagatttagatacagcagaaagcctacacctttactttcaaaacaagagctcatttcgaaccttcaattaaattcccaatagtgctaaaatatttcatcatattccagtgttctccaacatatatcaggcaccgcccaagctatacactacatctgcagaagggattcattcaacacctgtacctagcttacatcaagggaaccctagttcataaaaggcataaataaataattaaggaatcttcataagtgacagtgaattttatcagaggtcacgtttgccccccagagggcatttggcaatgtctagagacatttttggtagtcacaatcagggtgggggtgaggagaggtgttactgacctatctagtgggtagtggccaggagtgctacagaacatcctacaatgcataggatagcctggagattatccgaccctaaatgtcaatagtgccaagactgaaaatcactgatcaaactgaatacatgttctgaaaacgagggcaattaaaaaaaaatcatcccacattctatacataaagaactatcatttctttttaaaaatatttgtcctctcaggccaggcacagtggctcacgcctgtaatcccagcactttgggaggccgaggtgggcggatcacgaggtcaggagatcaagaccatcctggctaacacggtgaaaccccgtctctattaaaaatacaaaaaattagccaggcgtggtggcggccgcctgtaatcccagctactcgggaggctggggcaggagaatggcatgaacctgggagatgcagcttgcagactgcaccactgcactccagcctgggagacagtgcgagactccgtctcaaaaactctgcaagagagcagaacaaggttcttatgaattattcaaatggttatatcttgtatgttaaaaatttttttataaaatccatatatatctagtctgtttcatcctataatcacctacctgtgaaacttgattttttttttttttttttttttttttgagacggagtcttgctctgtcacccaggctgcagcgcagaggcacgatctcggctcactgcaacctccgcctaccgggtacaagtaattctcctgtttcagtctcccaagtagctgggactacaggtgcccaccaccacggctggctagtttttgtatttttagtagagatgggttttcaccatattggccaggctggtcttgaactcctgacctcaggtgatccacctgccttggcctccccaaagtgctgggattacaagtatgagccacagcacccagccaggaacttgattttatcttcatattcatctgacaacttttaggtcacagggtctttgtcgcctgggctgtagtgcagtggcgcgatctcaactcactgcagcctcgacctcttgggctcaagcaatcctcccgtctcagcctcccaagtagctgggactacaggcatgtgctaccacgcctggttaatttttgtattttctataaagctagagttttgccatattgcccaggctggtcttgaacttcaggactcaagtgatctgcttgccttggtctcccaaagtgctgggttttacaggcatgagcagtcgtgcccagcctccccagttctaaattttttcttgttgtggcccctttacaattcctctacaggttacttttgctacatataaactcttctagcttcttcaactttcaaatcatttttgcagagggcaatgcctcaaagtgacaaaatggaaacctatttctatgttcttcctcaaaaatcttatttatggttgaacttaaaagttacagtagctctgtatctcaaaagccaaaggttatgattgtaatatgtttaaatagaaaaaccttagccaggaccggtgcagtggctcacgcctgtaatcccagcactttgggaggccgaggtgggtggatcacttgaggtcaggagttcaaaaccagcctggccatgaccatgaccagagatgtggtgaaaccccgtctctactaaaaaaaaaaaatacaaaaattagccaggtgtggtggcacacgcctgtaatcccagctattcaggaggctgagacaggagactgcctcaaagggaaagaaaaaagaaaaacattaaccaataaactactgactaataattcacattagttatcagctgttttgtctatggcatttttttgcaaacaaatacacaagaaaagccaaaaacaatgtatgaagtattactgacaataatatttaacctgaatcaaatcaattatttatttattttatttttttttaaattttttgagatggagtttcactcttgttgcccaggctggagcccaatggcgcgatctcagctcactgcaaccttcacctcctgggtgcaagcgattctcttgcttcagcctctcaaggagctgtaattacaggcatgcgttaccatgcctggctcattttgtacttttagtagagatggggtttcatcatgttggtcaggctggtcttcaactcctgacctcaggtgatccacccgcctcagtctcccaaagtgctgggattacaggtgtgaggcaccgcgcctggcccaaatccattatttaaatgtaactttgcgtttacaagaaatacagcaataaaagaacaaattaagtatcaccacaaagaaataatgagataaatccagaaggtgggacattctagaaggaaataatcaaatgcagaatatggaacattctataaaactaatagaagtctctttaaaaatgtcaatgttcggctggacgcggtggctcacgcctgtaatcccagcactttgggaggccaaggcaggtggatcacctcagatcaggagttcgagaccagcctgaccaatatgatgaaacccagtctctactaaaaatacaaaaattagccgggcgtggtggtgggcacctgtaatcccagctactcaggaggctgagacaggagaattgcttgaacccgggaggtggaggttgcagtgagccgagatggtgcaattgcactccagcctgggcaacaagagcaagactccgtctcaaaaaaaaaaaaaaaaaaaaaaaaagtcaatgttggccgggcatggtggcaggccaaggtggtaggattgcttaaggtcaggagttcaagaccaatctgggaaacagaaccgatccctctaaaaaatttttaaacagaaaggataatcatattatattcatgtaggagaatgtatttattcctaggaaatgcacaaaatatttaatagaaatatcttgaaagtgactttcaaggggttaagcaaatacatagatatttggcttttttttttgagacagggtgtcattctatcccccaggctggagtgcagtggcacaatcacggcttattgcagcctcaacctcctgggctcaggtgatcctcctgcctcagcctcccaagtagttgtcactacaggtgggctattttgatattttcttatagatactagtatgccaactttcaaaaaatatttggcatgggccaaaacattaaaaatcatcctgtcaccaggcgcagtggctcacgcctgtaatcccagcactttgggaggccaatgcaggcggatcacaaggacaggagttcgagaccagcctggccaacacagtgaaaccccgtctctactaaaaatacaaaaattagccatgcgtggtggctggtgcctgcagtcccagctactcggaaggctgaggcaggataatcgcttgaattcgggaggcagaggttgcagtgagccaagattgtgccactgcactctagtctaggcaacagagcgagactctgtcttaaaaaaaaaaagtcactctgtctaggtggtggatagtttaagtgttccttgtagaattctttcacccttttcttttttcttctttttgtgatggagtctcgctcagttgcccaggctggagtgatcttggctcactgcaacctccacctcccaggttcaagtgattttcctgcctcagcctcctgagtagctgggattacatgcatgcgccacaacgcccagctaatttttgtatttttagtagagacaggtttcaccatgttggtcaggctggtcttgaactcctgaccttgtgatccgcccatcttggcctcccaaagtgcttcggttacaggtgtgagccactgcgcccagcctctttctcccttttcgcatgcgtgaaattttcttaataaaaactgaggtggggtaggagggagtggaactacctactcatatcttagctgtgatattctgtactgctacattccacctatctctttggtatttactaaataactggtagccttgttggttgaatttcttgatttattcccaggaccaattttcatgtagcttgtatatatacatttctctttttttatttttatgcatccattttcacttaatatacatttcttaagacatagcaaaatagttaaataagaaataacaaattaaggtggattatgtaggctaccaaggaggtacattactttcttccattaatccattatttgacatcttggtaacctaggtggtttctctattttgtagtaattgtaacatgatttttttgtgcactcaataggttttacttaacactgcaggctcacacagaactattagcaatactcagtctcttgtctcatccttcaatccataatatgggagtaccagataaatactctcctggagggaaggggactatttcttaaatgctggcgaatatggtagtctatactaaggccctatatgatcagctagtcaataaaagtctatataattgtaaaggcaagataaaaacagaccttttaaaacaatatactatttaaaagcagcaaaaagaatcctgcagatacacctgtatacttttaaggtatttaatgggcagcaaatgttgcctatcttcatctcaaagaaaatgagaaaaagatctgttttccacaactatcctgacatacttggttcttgaaagctctgaattcctttgtcttgttctttcatagctgtaaagtccagaaatgaagaatgaagaattcagaaatgaagaatttggtatctaacgttttcaacttactgccagtacatacctgcccaaaaatcaacataaaaagaacatttggaacaggaaaaatattttacagaaaacaaacattttaagaataccactttcttgttccagggtgaaaaataaacaatgataatcctcaacataactggtaattatgttttcaagttacctcaatttttggctctaaaaaggactaataccagaaaacctatagggctgaatacttaatctgtgtataaaactatagttaaacatgtaataagcttttatttatccagtcttttgcacagcccattttgtccctcacaacatctgttatagtacctcatatgtaagaatcataagggttttaagtagtcttaataacctaaaatttccaaactcaaaatactttcctcttgtctggtagccaatcctgtatcaagaaacacccaaatatttagttctgtgctctttactaaaacaagtaagcaacaagttctcttctttaaaggggttcaatattcaggagtccctttcccaagaaaaatatctatactatgatggaaaacttttcttcaatgacagctgtgtgttgcctaaattccatttctatgctttcaatttcttttaactctgctaacacctagcaataggttagtgtctcttttctgctctcctccccttggttacatataaaaatacgtttttcagttgggcgtggtggctcacgcctgtaatcccagcactttgggaggccaaggcgggtcgatcaagaggtcaggagtttgagaccagcctgatcaatatggtgaaaccccatctctagaaaaatacaaaaattacccaggtgtggtggcgcgtgcctgtaatcccagctactgaggaagctgaaggaggagaatcgcttgaacccaggaggcggagggtgcagtgagccgagattgcgccattacgctccagcctgggcaatagagcgagactccatctcaaaaaaaaaaaaaagacaagtttttgtgaatatggcttaatatcacaaacaagaataccaaagaatctatcaaaatgttaccatattgatattatggcaaaggcattaaccagctctaggatttgtaatcaaccagctctaaagtttttattttacagataaggtcaaaacagtggtttagagagacgaagtaacttcctcaaggttacagttagtaaatatcccagttaggattcaaagcaagctttttttgctttagaattcttccccaggtcactgcctcttccatcaacttcaactatttataaattctcccaagttccccaagggagttagatttgaatgatgtaaagagcagaaacataggactgactgaatgattctcatttttttgactcttaaaattattgaagacgccaaagatcttttgtttatgtgaattttatctttccacatttaccacaaatttttaaaatgtagtatttatcaatgtattttaagacaagcccattataagttaacataaataacatttcaacaaaaaatactttccctccaaaaagtgagaaaagtaacgttgttttgcattttgcaaatctcttttatgtctaacttgataaaagatggttggattctcacagttacttctgcattcagtctgttgctatatgtagctttggttaagtatataatgaaaatctagtcggaaaagggagaagtattttaataaccttttcagataactgtgtttggtaaatactaaaactcaacaaacggtagtttctttcttttttttttttttttttttttttaataaatagagacagggtctcactatgctgaccaggctcaactccaactcctgggctcacacaatccttccaccttggcctcccaaagtgctgggattacaggagtgagccaccacgctaggccaaatagtagtttcttaaaggacagttaacattttggaatctgaaaccacatcaatccacttttttactgttaaaatccattgctatgtctggaattttcaaaggatcttttgcctttgcttgattttgcaacatcatgcattggtcatttgcaaagcctagatttactgagttatgcccatcttccaaataacatatttcattaaacaacattttaaaatattgcagtccttaaccactgatatcataaggaaagtcttttaagtactaggaagctgtcaaactccagctgtcaactttttaaaaattctaattttcacccaaattttatcactggtaataaatactgtcagttgttttcctaaaagtgacaagctcacttcattttcaagaaatatctgccaaatactaagtgtgaaaaaccatagtctgctagtcgttctttcaagtaaaaatgctactccatgaaataagccattcattcacaacccaatctcacaaatgcttttccttcatgacaacaatcacacctccctaggcagcataaatgctttatccatgtttatttaatcacaaattcttaaaaattaaaaagacatgtagtcaaaagctaagacttaataataataggccgggcacggtggctcatgcctgtaatcccagcactttgggacgccgaggcaggtggatcgcctgaggtccggagttcgagaccagcctggccaacatggcgaaacactgtctctactaaaaatacaaccagggaggaagagattgcagtgagccgagatagtgccactgcactccaccctgggcgacagagcaaaactccgcctcaaaaaaataaaaatagaataataaattttactgcttcaagggcattctcaagtagtttggtgcccctgacttgctttgtgctaaggtaccgccagtagttttacccagccttgcttttgaaccatcagtgtatcagtgaaaacaataaatagcatcttactattattttgaaaatagttatgaccttgaggctaccctgaaagggtaagaggagatccccatgggtcatctgtccacactttgagaactgctttcctacattataccactagttcaagatgggagtggaaactctaactaaatcaggttcgtcccaagagtccattctgttacctcctttagtttgagatacaccaccaacacagctctggaaaagggaaggaaatcaacggcacaaggtgtcacttgtttcaacatcttgaacacttttatgttagaccagtaattctcaatgtagtggttacattaatcagtctcagccccaggactgctcatttgaaaatgtaaagatgacaacccccctctgctccattcaaataaatttgggggatgaggccccccaaattgtacgtttaaccaccttcaagttactttttatgcaccccgaagttgagaacgattgtgctaacagttcgaattcagagttcaagctctcagaccctgagcaatagtgtctcaaaattaatcgtttgccaacgagcagccctccctgccccctccgtttccctttcctctagttgggtaaatgcctacagaagtaaaacccggccgggcgcggtggctgacgcctgtaatcccagcactttgggaggccaaggcgggcggatcacctgaggtcaggcgttcaagaccagcctggccaacatggtgaaacctcgtccctactaaaaatacaaaaattagccgggcgtggtagcacatgcctgtaatcccagctactaggaaggctgaggcaggagaatcactggaacccggcaggcggaggttgcagtgagcagagatcgtgccactgcacaccagcctgggcgacaagagtgaaacttcgtctcaaaaaaaaaaaaaaaagtaaaaccccatttctgtggagttttgagcggcggtaagaggtgtctacgggcttggaaggacgggctacaccgcttgcatcaagacggcggctgctgtgagatagtccaactgcatcttagtttccatttcgaaaatgagactggccactaaatgactctaaggactcatcagcactacctttttctgaactaagaatgtctaagacaagtgctactagcagtttgagagaatcccacatctggagaggaaggaaataagaacaacacgcagaaagacggaaaacaaatagatcaatgacagtactcctttgcaaaaggtgccaagaatctaaataaaatagtccccgggataaacatggcgcccaccgcggcaggacataatcaccagaaaataaagattccccgcctcattccattttataaatcacggcgccatcccaaaagaaatttggggaccgagggaggagacttcgtaaactagctgcagtgcactaaggcttaggatgtactattagaccaagcagagattacataacacaagggatcggctcagcaatcactcattttcctcctcccgctcaaaacgagcgccccactccttctcggagcgggaatggggcggggagggccgcgcacccccacccccaggggccgctccgccgccgcccgcccctccgccgcacggcctcgccccctcgccggcccctcccgccgcgccccgccgtctcgccaccgcccgcgcccccgcccccgccccttccccagcgggccaccgcccgcgcccgcgccgcccactcctccgagacgcctcgcgccgagcgtgcgtgtggacgtcgggctgtgtgcggggccgtggggcgcgagtgcgcgcgcgcgcgccgcggcgggcgccggggggcgggggcggccggccagccggcaggcagggacctccgccgccggcccttcgcgcggctcccgcggcccggggcgcacgcacacacactcgcgctcgcgcgccgcaccccgcggccgcccctgccgcgggccgcgccgccactcgcggtgggcgggggcgcgcaccgccggccccccgcccccacccccgcgcgtaccggccccatccccctctcattgtctcgcctctgaacgcctcgccgagcgaaaagataacggaacccccgggagcagggggtggggagagagaaggctcgctcgctcactcacctcctgtggtcgtcgccgccggtagtctgacccgaggaaggcgccgtcgccttaaagggaccttacacccggcgccagaagggggtgggagcagggggaggggacgggggcttggggggagacgaagaagaggtaaccgttgaaagctcgtctccccaagggtgaaaggaagcctccctcgggttcgagtgattcggggtggatttttttcccgaggggggcgggggggccccgagggaggggggtgggggggccaaggaatgcggctccgtgtacgggagctggcgcgggggagagagacgccgactccccccaccgaccctctcgccccgcggagggatacggctcgtcacttccgccctcccctttttcacggcctcccaattggtcggagcgcgctgcacgtcatgggctcatccaaacccctgcccgggcttcttttctagtcaagtttggctgggcctgcaaataaataaataaaggaaaacattttttgtaatgaaaaaagaataattagcttcagaagctatatctaaattttggtgagaaaaatgagacttccaaagaaaatattccccaatttacttgccaagagtttccaaggaagtgttgggaggctcccccactttccactcaaggcttagacccagtcaagagggagacttcatgacacaggccaggtggtgaggcccagtggcaccaacaactgtcattggaacaaagaacaaaatggcactcactctttctcaagagacactcggccaagtaaccttgtggctgcggccttgtttaagtgaagaacttttaaaagccattttgatcctcaagcccttctggatcctggaaagaagtggcacacgattgttaaagcgattattgtgatggaaactgctttgctcccattgtgagtagattcagcagagatccccagttccaagaaaccacacacactccacatccttatgctttttgctccaatcaaggctgagatgggttggctcaaagaaattggttagtccactcaaacgaccatccacctgtttattcttccccagacaaaaactacctcttttcaggtagctaagaaattttgtcctttattgccttctgagattataaaaatgtaatattttccttgaatatttgaaaatgtttgctatttaagcaatacacaaatatttgcttcaaaccaaatgtgaaatcaaggtacttggtgcagaaaggggaaatccagaactatgtttatttgtgctctttatatacacactccattcaaaccaccagactgaaaataggcagtggaagtaggcattccaaattgtatgcacctgcccgtgtgagtgtgcacatgtgcatacacatacacacactgccaccacccagtttcattccatttcataccaaaaccatgtgagtgatttccactagtgtaggatgcttaggaaggacttcattatttgaatgagaagaatcactaaatccttctgaaaatacttctgaagactttccagacctgatctggagaagcccatattaggattatgggatcaatcaccaaaagactacatgaaactcaaatcctattttatactgtcgtgtaattagtataattcattatatatgttatatttacattatgtatattacgttattaacctttgaaaaattccaacatatttccccatgccctgtcaatttattctcccagccaatgagatctagcgcagactatgccatataccgttgaccagtaactgttagcatgctttattgaaaatggatcatgcatccattcattcattcaatgaatatttattgggggctgggcatggtggctaacacctgtaatcccaacactttggaaggccaagggaggaggatcacagcagtctgagggcagcctgggcaacttagcaacatcccatctctacaaaaaaaaattttttttttttaaacagagtctcgctctctcccccaggctggagtgaagtggcgcgatctcggctcactgcaacctccgcctgctgggtgcaattctcctgcctcagcctcctgagtagctgggactacaggcgtgcgccacgatgcctggctaattttttctgtttttagtagagacggggtttcaccaagcaggctggtctcgaactcctgacctcgtgatctgcccgcctccgcctcccaaagcgctgggattacaggcgtgagccaccgtgcctggccccaaaaaatttttttcattagctggttgtggtattcctagatacttggaagacttgggaggatcacttgaggccaggagtttgagactgcagtgagctatgatgacactacttgcactctagcctgggagggacagagcaagatcctgtctcaaaaaaaaaaaaaaaattattgagcacatgtactaggcactgttttaggtgctgggaatacagcagcaacaacaacaacaaatacctgaatctgtgggatttatactctagaaggaaagagacataaaatatacacataaacaaattgttctattgtctattgttaaataacaaatgaccccgaacttagtggcttaaaacaacaatttcattacctctcatggttctgggaggtaattaggctcagctaaacagttctcacttgggagtctcgtatgcagtggctagggctgaagtaatctcaaaagcttccttacatgtctggaagttgaggttgactgttggcttggaccgcagctggggttgttggcagaccatttacaagtggcttctccatgtagcctgggcttcctcatatcatagtggctgagttccaagactgagtgccccaaaaggaccagacagagatcgtgacctagtctcagaggtcatatagtgttacttccattacagttacaggatggagagcatagatccccatctctcaacgggaatagtggaaatgtcacattgtaagaaagtgtgcggaaagggaaatcttgtggccatcttggaaaatgcaatctgatatacattatgtaaataaatatggattatatgaaatggtgataggtgctatgaagggtaaagggcaggataggggaattaggagtgtggtgcagacatgggggtggagaatttgctattttatgtggggtgattggagaagtccttgttaaggtgacatttgggcaaagacctgaagaaagtgaagcaaagtttaggttttacctgtagtgaaaatgaagctgctggaggatcataaagcaagtagtgacacggcctgactcacgtttttaaaggatcactgtggctgcttgtgaagaataactaatagaggcaagggcagatgcagggagaccagatagaaggctattgcaataatccaggtgagagttgatggtagcttggaccaggatgggagttgtgaagctgctgcttcaggtgattgagttctgtggtgtgttacttactcctctctatttttctgtcatttagtttgtgccctgggagacagttttgacccataatgcccaataaaatgagtgatggtgctatgcctgccaccaagaatacagaaagtctatcatgctaaatgtaaaagtgggagttttgcaggatctggaggcacctttgaggaaatgggtgaggaaacagagggtaaagatcaacaggcaattagggaatggagtgtcttttgacgttgtaaaaggtatcctggccaggtgtggtggctcatgcctgtaatcccagcactttgggaggccgaggtgggtggattacaagatcaggagtttgagaccagcctggccaacatggtgaaaccccatctctactaaaaatacaaaaattagccaggcgtggtggcacatgcctgtagtcctagctactcaggaggctgaggcaggagaatcgcttgaacccgggaggtggaggttgcagtgagccgagatcacaccacatcactccagcctgggtgacagagtgagactccatctcaaagaaaaaaaaaaaaaaaggaaatgatgagcaaagacattttataccttcagaagatttcaaggaaactctgccaccttacattacaacactggtgcagcacttcaaaagagactatacagttaacactgctatttccagaaacgtattccttgtgctaaagagagaatgctcatattaatttggacagtgttggaacattttgcttcttcagctaaaacacaggtttccagagtgaagtaacagaactgatagctttggtctctcttttggaccatctggataatggtttgaaccatcttgatgatgatgggaaacccaagtagtagaacaaataacctgaatcagatccttagaaatcaactcgtatgtgcctctgtaacatactggggaggaatctgaaagccaatccagtctgatatgttgaagaaatttgatcctaatagtggtactcctaaaaattattccagtcttcagtagccaacttagaaactttttctaagaaagaaagtcaaaggttaatggatgtcccaagctgagcttttcagttacatagctggagagtgtttcttttctacagtttatggaaatacttacttgcttccttgacttacggtttctgccacaagttgaaaattggggctgggcacggtggctcatgcctgtaatcccagcactttgggaggccaaggcaggcagatcacctgaggtctggagttcaagaccagcctggccaaaggtctttagtagagatggtgaaaccccatctctactaaaaatacaaaaaattagccaggcgtggtggaacgcgcctgtaatctcagctatttgggaggctgaagcaggagaatcacttgaacccaggaggtggaggctgcagtgagccaggattgcaccgagccaggattgcaccattgcactccagcctgggcaagaagagtgaaactccatcaaaaaacaaacaaacaaacaacaacaacaaaacatacaaaagaaaattggaaccacctgtagcttggagaatgttaaagaagagagacaaatgatttcagcatgtcttcaaaagcattgagtcatggatgccctcggtggcatcattttgctaaaatgcagacctaatcacttattgttcaggttcagcgtgaggttgactggtatgtgtttgggcggggagtagggaggctcagatggtgaggttagtccaggcagaaataagcttcgtgggagataatgccagatttctttaagaaatgggtaacagccgaacacgatggctcacgcctgtaatcccaacactttgggaggcggaggtgggcagatcacaaggtcaggagtttcagaccagcctgaccaaaatagtgaaaccccgtctctactaaaaatacaaaaaattagccgggtgtggtagtgcatgcctgtaatcccagctacctgggaggctgagacaggagaattgcttgaacctgggaagcgaaggctgcagcaagccgagatcacgccactgcatagcatcccgggccacagtgtgagacttcgtctcaaaaaaaaaaaaaaaaaagaaagaaagaaatgggtatcccactctctgtaatgcacactcaggattgtcaaagctggaacctcaaagagagctactcatttcagaaaacgtaagagaaaaacagtagagacatttttaccatctgagcagctcccaggtggaaaagatggatagctgattgcactgagcctgggattcagcatgtgtataagtcagcatgtgtggtggaaggaaaacattgaggtgcttaacttgacaggcaaattgccatgaaataaagggcaagtggagatctacatttgaccaatgtcaaattaaaaaatggggaagttaacagctgtggccggattttatttaggaatattatttgctaccttcttatgtttagaagagttggggactttcctagagacacaggaggtgagaaaaagcctgaggaagttctcagcctgggtttctaaaggaagaattcccattagctttcagtaagaagcaattaagatctctgtcttcaaaatatatttcataagaaatgcatgagcagcagtgttatcatcatcaagagctcactgtgagttgctgcatggtttcctaggaggtaatgatgtagtttaacttcgaattaaattaatattttaaagagatacccagaagcaaagctatacttgtctaatctaggttgttgctatggagttgaccaggtatgattatcaagtaattaaattgactccataaagcttcatgacaaaataaattggactattttataggtatgcttgatatatgacttgttcctgataatggattgcagagtaaaatgtagtaaaaattccttttcctctagcatacattctttttaaatttagcagtgtttatattttattatagtcatgcataattttcagaatgcaactgtggacagtaaatagcttttccaattcatatttttgaaggacatgatgattaatatcattgttttacagatgagaagactgaggtatcattcagaattaatttttttttttcaggcagagtcttgctttgttgcccaggctggagtgcagtggtgcaatctcgggtcactgcagcctccgtctccccagttcaagtgattctgctgcctcggcctcccgagtagctgggattacaggtgcccgccaccatgcctggctaatttttgtatttttagtagagctagggtttcaccatgttggccaggattaaattttttaaaggtttctggtgtagataagtggtcaggtccgtttgggtcttctcttattactgaatatgtacaataggagttagaggtggcaaaggggccatctcccatgacagcaaaagatcatccatttttaatgacttttctgttacctgaaacatagaggtaataaaatctgacaacgtgagagtgccacgattcaccagtttaaaatcattttataggaggaaaatgatttaactttcattcattcaggaaataattcttatttctcagctttcacataaatgtagctgtgtgtataagtgctgtgcatcaggtgtgaataagagttttctctttcctacgaaccttgcttcctggcaggctctgatctctgtttctcctattcagagatcttattcctagcctagaaaagtgagtcttaaacttttctgcatcatgaccccctcaaaaatctctataaaagctatgaattatctcccccagaaaaatgcacatttgtacatatacacaacattttgcaagcactttcagacttgaatcctgtttctgggcttgttcatgaaccccagtggacaagatgcttctggccagtcatggtggatcacacctgtaatcccagcactttgggaggccaaggtgggtggatcacttgaggtcaggagttcaagactagcgtggccaatatggcgaaatcccatctctactaaaaatacaaaaattagccgggcatgggggtgcaggtctgtaattccagctactcctgaggctgaagcatgggaggcgaaggttgcagtgagctgagattgtgccactgcgctcctccctgggtgacagagcaagactctgtctcgagaaaaaaaaaaaaaaaaaaagttatgcttcattccctatcttcctagagaaatgatacatttctcaataatcctatatgaacatatgtgcccaaagaactagagtttcttctcactctaacatgtggcttactattattatattactattactatattactgttattattattatttttgagatggagtctcactgtgttacccaggttggagtgcagtggtacgatctcagctcactgcaacctccgcctcctgggttcaggcaatttttctgcctcagcctcctgagtagctgggactacacccgcgtgccaccacacctggctaatttttgtatttttagtagagacggggtttcaccatagtggccaggctggtctcgaagccctgacctcatgatccgcccgccttggcctcctaaagtgctgggattacaggcgtgagccactgtacccggccattattattattattttacttcttcctttatctttgcccaagatgttcttcgacatgtaggaaagtccaggaacctctagaaccccatagatgatcagatagtctagttacttcagccagttgagttgatataattggcattaaggaggttattttgattctccaaccttgcaagaatagtggctctcctgggatgcctgcctttactatattgactgtggctcactgaatattcatgtactctcatttcccagcctctcttgtagctgtatcagggcctcaagattgagtccttgtaaatgggaatgtaagtgcaattgatggattacttctggcccagaatgttattcctagcctagaaagtgaatcttaacctttttttttttttttttttttatgagacaaagtctctctctgtcacccaggctggagtgcagtggtgtgatttcagcccgccaccacatccggctaattttttgtatttttagtagagacgggttttcaccatgttagccaggatggtctcgatctcctgacctcgtgatctcttaaccttttttttgcattttttagtagaaatggggtttcaccatattggccaggctggtctcgaactcctgacctcaagaatgttctgggccagaagtaatccatcaattgcccttcaatttaaaggttgacatgcctcctcttttcccatcaaatgggatggtagaaccagagtatggaagcatcctagattcctgagtcaccccatgaagtagagttgaactagtgagttgcccagaatacatcagactttaccagaataacaacaaaaaaaatttattgtgctaaatcactgagattccaggattaatttgttaatgtaggatagcctaattatactgactaataaacgggtataaaggttggactgaaaaaataagaagttcccaggacacttttatggttaagaatgtgagacaaggccaggtgcagtagctcacgcctgtaatcccagaactttgggaggccaaggagggaggattgtttgagtccaaaagttcaagagcagcctgggcaacgtaatgaaaccctatctctacaaaaagtaaaaagttagttgggtgtggtagtgcgtgcctgtagtcccagccactggagaggctgaggcgggaaggctgctggagcccaggattttgaggctgcagtgagctacgattgtgccattgcactccagcctgggtggcagtgtgagacctgtctctaaacaaaacaaaacacaacaaaaaagaatgagagacaacatggtgaactggatagagcctgatattagttacattgcagggttgttatattagagatataatatataaaatgtctaggccaatactttacagtagttactccataaatgatagtttttaccaataattcttaagatataaatattttatgggacatgataacatttgactatactcatggatgacaggctccctattctgattcttcccgagatttcttaccttaaggtatctcttctaaatactttgggtcttgggctcaagcatcttttataaaattgcttgaagtaataacttccaagaaatacgtagttattgttcttaatcagtcaagcatttagtaaaaccctactatttcttccacatgttaattaacaaaataggtaacgtaatattgccaagtgttaatttgtgtggcccaggcaattaaagaatatgacatataaaatgatgttaaatgtatgagacagacagtaccttctggcaagagataggaaagatctgtgcaggctcaagtcttcggtgaaaaattcttgaaaggagtgggctcagaccttgtcttaaagaaggggcaggatgtagataaatgagggaaaagaagaaaggcattccacgtgggcagcagattaataaagttactgataaaaccaacaaagaggccggatgtggtggctcacgcctgtaatcccagcactttgggaggccaaggtgggcggatcacgaggtcgggagttcaagaccagcctggctaacatggtgaaaccctgtttctactaaaaatacaaaaattagcgaggcatagtggtgtgcgcctgtaatctcagctactcgggaggctgagggaggagaatcacttgaatccgggaggcagaggttgcagtgagctgagattgtgccactgcaccctagcctgggcaacagaaagagactctgtttcagaaaaaaacaaaaaaataaaaaaaaaacacctaaaatattagattgaatcaagaaaaattactggttttttttgtgggtcaaaaacaatctaatatcagcagtttcatatcatttgacctaataaaagcagcatttgcggagtgatactctggaagtttcaaccgtattggtaatgttttattttttatactgagtggtaggtttatagattccttatattcttaattttcttgtggttttaaatatttcataatcatctttttaaaataatttaaacattagcaaaaaaagagttaagtctcatcaaataatttaaacaatctctttacgtaatgcttattctcatcaggaaaataacacctggttttctcaacatcctcagacattcatccttttctctagcttttctccagtgtggtgtccaattgtattggcgacaagcatggcttgtgcaacattatgataaagaagaatccagagggccgagtgtggtggctcacgtctgtaatcccagcactttgggaggctgaggcgggtggatcatatgaggttaggagttcgagaccagcctgtccaacatggtgaaaccccatctctactaaaaatacaaaattagctgggcatggtggagcgcacctgtagtcccagctacttgggaggctgaggcaggagaatcgcttgaacctgggaggtggaggttgcaatgagcccagatcctgctattgcactccagcctgggcaacaagagtgaaactccatcttaaaacataataataaaaataaaaaaataaagaagaagaatccagagaccccaagtggaatgttctttaactcttctggcctctgggacaatgccccttctccatctgcccactgcttgccctactggtgttcgcggttgaaatttgtggttcaagaccgtgtgggtacaacttgtgagctggtcccacccaggttgcccaggcctcgtggctctccctcaacctcctttcaactctctggctctacgggtccctctaagtttgtctgaggggcccctttggccctgaacttggggtggttcactctgcagtcctcactgcagtgtcaccttgccctactaaggctgcctcctccagcaagcttctcagccactgtggctctccctcatagcaccccaggaaagcggggcctcagggtccccttctgccagactgtagttcactcacacttttatctgatgtgctgcgccacaggagggtacaaggcatgcctagtgtggtggcgcatgccaccaggagtggtggcgcatgcctgtaatcccagctactcggaagactgaggcaggagaattgcttgaacccaggaggcagaggttgtggtgagcgaagatcgcaccattgcgctccagcctgggcaacaagagcaaaactccatctcaaaaaaaaagaaaaagaactgtcaataattattattttagttatattattattgttttatcatttttgttattattaatatccttagtgggtaagtgggccgctattgacaatggggagtgtttcccaaccatcaacactctcacccacacatacacttgggctacttttttttttttttttaagatggagtttcgctcattacccaggctggagtgcaatggcaccatctcggctcactgcaacctctgcctcccaggttcaagtgattctcctgcctcagcctcccgagtacccagtagctaggattacaagtgcccaccaccacgcctagctaacttttttacttttaatagagaccccatctgtattaaaccccttttgccatgttggccaggctggtcttgaactcctgacctcaagtgatccacctgcctcggcctcccaaagtgctgggattactggcatgagccaccgcaccgggcccaatttgggcgttttaatccaaacgttaagctactgaaagtggccagattggagtgtgtgtaatggggggaagaaatgggtgtaaagatagaaagtttcagtcacaaacttgttagcatgacagagagctcccctacttgagaagggacaaagtcaattcaagacctttgggctttctggctggatgcggtggctcatgcctataatctcaacactttgggaggccaaggcaggtggatcacctgagatcaggagttcgagaacagcttgaccaaaatggtgaaaccccgtctctactgaaaatacaaaaattagccgggcgtggtggtgtgcgcctgtaaatccagctactaaggagtctgagacaggaggattgcttgaacccaggacgcagaggttgcagtgagctgagattgcgccactgcactccagcctgggcaacagagcaagactccatctcaaaacaaacaaacaaacaaacaaagaccttcaggctttcatataacctatatgggtggatgaaattttagaaataaataataaggggaaaaaagataaataaaaattcaaattttaaaataaagtaaaatagatccatgggggtatctgatgacatgatattccagcaactcagatttctctgggactccactggagacagatctttcaggcacatttgtaatatgtccactgcccaggggacaggatagaagagccatagaaaaaaagggaacttggcagaattgcctttgtataactttctttcagtaaagaaagttatagctttctttactgaaataatagctttaaagagacaaattattcacaaatcattagtaggaaatgttgagatgagatgataagcaagaaaggtaattaaagtctgtactattcttaaaatgaaatactgtctaagtatagaggaataaattagatgacttttcaacctttccaatctaagcatccttaaaaagttccactgtctagcacagtggtttttaaacattttttgacagccacccacagtaaaaagcatattctacatcttgactggctacacacaaacacacagtacttttcatgattcagattgtatgaaagactactgatattcactatgtgatagctttctattctcttttattacacctcttttttttttttttttttttttgagacagtgtcttgctccgttgcccaagctggagtgcagtggcttataaaacatggctcactgcagccttgaactcctgggctcatgcaatcctcctgcctcagcctctggagtagctgggaccacagaagtgcaccaccacacccggctagttttatttttatttgtagagatgggatctccctatgttgcccagtctggtctccaacctggggcctcaagtgttccccctgcctcggcctcccaaagtgcagggattacagcttgggccactgtgcccagccctttcttccatcattccgtcctctccttccttcttaatactgcttgtcaaactgattttgccacccagtttgaaaaagaaggtctagaggattatcccaatcattaactatttctgcaggttagcttacctttccagaatacagaatagaattcagcaaactgcctcaaagagcagtttctagatttgacttcttcctctagggtttatgaagtcatcatactgaagtgacctggatttccctatacgtgaacctcatgacgtgggagcccggggtagggagggacagataacatgagaatcaatagaaagaactgcaaggtctgaagacaagaaccatttgtctagtggagtctattttatatccattttttaaaaatctccatttaagatatttagcttcaacgtgcaccttgaccaattaatccaacaaacaaaactctggcttgggggcccagttactcactttcatggaaagagacctctgtttttagaaccagggatcttgtgagtccctcccacgtccccagcccttctctggcctcgggtaacttttccctccagtttggtggaaggttacattagaagaaaatagtccctaccgtctagaaagttttcggggggggaaaaaagggcgttggacgtgcgggtgggtgggtataccgggaggggacagctggagccgcgaaggcgcgggggcccgcggcgcgtgggtgtggaggccgcggggcggcaggaggcactgggaagcggggtgaagagcaccgaagtccagaaaagggcagtgtccgccctgcgctcctctgctggcgcccgcaacccgggagggagcggcgaggctccgaagggtgggattcgaggtctgaaccctcgagtgggcttgggttttcaggagccgccttttcttattgatcatttctcttttgtcatcataatctcttggcctcagactgagttaagggagccatagtaggagtgcagaaaatgaagtggaggaaaaaaaaatgtgatatttaaaatatagtttttcctactttctttttctctctcaaattaatttagatgtaaataacattttaacagggcccaacatcaggctcctaggctctggctgctggtctcacttgacaccagaataagattttggtgtgctagtaattttgccaaatggaggcctactccccaaaacatcaccgtggtgcatgatgaacatttctgtaggtgatgacgtggagtttttgttttacttcattctaatacatgtccctgcttcaagtgggtaaaattatacctagctcagcccaggtttaattcagattatttaaaaaatttcagtggcaagtaatttacgagcttctctttattaagatttaggaaattttgctttattgcgcatgcattttaagtatttttttgctgtgttcctagtgtagatagaaaacaacctgtcactgtctcctagttggccctgtcaacaaacatttgagaagtgcttagatcagaatgctgttgagtactacaaattaaacaatctgatgtacttgttaatttcattacaaacagcagttaggatttcatatacatatagtctgtaccatgctatatatcagaaatctttgtaaatataaactccttaaatatagggacccagttttattcttcagcgaaagggagttaatcttttggtgttgtgcatttagaaggatctcggatgtaagaggctcattaaatgatagctgttagtattatttatcttggtatcttccaaagggctttgcacatggctaacactaagaaatattggttgaatgaatgaaggtgccatgcccatactgtgatatacacagagaaaagaccaggatggggacactagcacagtgatttcatttcatcagtgaagctttgtgtggaagtgtccctcctgcagcccttttaccagatgcaggctcccttgaccttggattgtggaccacttaaaattttcaggggaaaaagtgtgcctaattagctagtagggcctaacctcttgtcaagatggaacttgagaagtttgtctaagtatggaaaagctaagctcacttgacacagatcacgggaagaaagatttctgcatgttattcaagttattcacgtcaaaagcgattagggggccccagcttccattacatcattcattaggaaaatgtgtgctgggagctctgcaaatcacatgatttgatggaggcattgagactgggtttcttgtgtgtctgcccttggccatattcagtttttagtatgtttggaaaaggctgaagcagaacatgaagatctagtttattttaatgctgtcagacagctaaatggtggaaacttgttgaagagatttactgagctgtttccttagattgaagactttagagaattaattaacagggttctgagagatacaacatgccagacccctactgactctaagagtgtactttcttactgatatgatgtgatagctgagcacagtatatgtgaaactgctggggagtaatacaagagcagtgctgatgtgttctaagacatgcaggtgttcagatgagaactggccatgacaactgagtcagccaggcactggactcatttccttttgcttaagcaccatgagctcagtagaagcacagactttcacaaggtgctgaactacttggtgaaaatgaagtcacaattttggaagagcttcactgattttgatgtgtaggtattgtttcacgttttagctgttgcttttagaatgcatgccttaagatggttctcagttatcatgctatatctatgccacgccatttctagagcaagtaacttagctgaaagtgactatacctataagaaaacaaatatccctgtagagacatttgtagatgaattgtggaagtactctaaaatttttggccagattttggggaatgtttgagtctagctggtacagaaagtacattctgttttatgaaaatagcaacattgaagtgaaaagatatcattaatgtatacatgtagtcagaaattgaatgtgccctggctgattgcaatttatttattcacttaatgcgtatttattgagtacaaggccttagagtttcctcagttcttatagtctgtaacagtgccattccataggaatgtaatgagagccacatatataatttacaattttctagtagccacattaaaaaattaaaaagaaactgataaaattaatgttaatattaatatattttatttcaccaaatatatctaaaaatatatctaaaatattatcctaatatgtaattaatatacttttattggttttttttttttgttttttttttttttttggggacagggtctcactctgtcacccaggctggagtgcagtgacacaatcatggttcattgcagcctcaaccttctgggctcagatgctcctcccacctcagcctcgtgagtagctgagaccacaggcatttgccaccagctaattttttgtatttttttgtagagacaggatttcccatgttgcccaggctggtctccaactcctgggctcacgcgatccacccgccttggtctcctgaagtgcagggattacaggcatgagccactagaaattattaacaaattattttacattcttcgttttgaattaagtttctcgaatttacttacagcaaatctcacattgcactagccacatttcaggtactaaaaaactacatgtgattaatggttaccatactgggcagtccatgtctagagagaaatacagatgtgtaatttgtaaacaggtaaacagataatttcttttctttttctatttttcttttttttttgagacaaattctcactctcccaggccggagtgcagaggctcagtgcagcctccaccccctgggctcaagcgatcctcccagctaacctccccaactccccaccccagcagctgggactacaggtgggtaccaccatgtccaactaatttttatagagataggttttcatcatgttacccagactagataattttaattaaatgtaataaaggctatgatgagaaaagtacactcatcatacaatgaaagcatagaaaaggggcttagttcctccagtttttcctcctaaaatctcataattctctctgcttctctgcatcctgcctgccacgactctaatctaagccagattatctctctcctagacttgcacaacagcttccgaaattgtctacctgcatctatccctgcccctgtttgcagataaagtgagcttttaaaaacgcccatcagatcatgtcattcctctgtttaaaaccttaaatatatgatgaacacattggacaagtgtgagatgatgtacataaagcgcccagcccaaaggttctgctcactgagtttagttctcctcgtttcttcctttcactctcttttttcttcctcttactttcctccccagctccttcctcttatcacctatcagtctcttatcatctgaatttcttttttctttcttccttctcacttgctttccatttttttcttccatctttactttctctcctttctgctttagtttattttaatatagaatttaaatagatttagaaattcattctttaattatttacttctgagttccaagctcttcatttaaaaatcaaaagagtactgggcactgtggctcacgcctgtaatcccagcactttgggaggccgaggtgggcggatcacctgaggtcaggagttcgagaccagcttggccaacatggtgaaaacctgtctctacttaaaatacaaaaattagccaggcgtggtggcaggggcctgtaatcccagctactcaggaggctgaggcaggagaatcgcttgaacccaggaggtggcggttgcagtgagccgagattgcaccattgcactccagcctgggggacaagagcgagactccgtttcaaaataaataaatacataaataaaaataaaaataataaaaagagcttggccaggtgtggtgggtcacacctataattccagcattttgggaggccaaggtgggtggatcacttgaggtcaggagttcaagaccagactggcctggctaacgtggtgaaaacccgtttccactaaaaatacaaaaattagccaggtgtggtggtgcacacctgtagtcccagctactgaggaggctgaggcaggagaatcacttgaacctgggaggcagaggttgcagtgagccaagatcacaccactgcactccagcctgagtgacagagtgagactctgtcaaaaacaaacaaacaaacaaacaaacaaacaaacaaacaaaaaacttgaccttttatcaggattaaattaagatgctttttacttcagcatggtcttcagttaattttttttgtaggttggagagcttctttagaaaaatgcatatagtttcccagaaggaggaaagcaatccccttcacattttatagggagaaaatggtgcagtcacttagaaagggtcatgtggtggtgatttgaaacaagtcagaagaacccaggctctcgccacagcccttcctctcttaggcaaatttctgcctcctggcagtagagcagtgaggcaagttaattattcagtgtttgtggaggtcaataaataaatgaaatacctaattaaataaatttttggagtgctgagagcaggcagtttccttaacttaacacatttcctttggaggaccagttctcttccttgaaagaacagccaatctagccatatgggctgtttccttctagttctgagaaggtggatttatgaccctctgtgtactcatctttctgtttctgtctctgacatagacaactctgccaggtgccagcactcctacctccactgaaagcaaggagacatcctgaaattacagaaggaagaaaggaagttacaattcaagaaggacttcttgctgccaaggcacagtagcaccaatacaaaacaaatgagggaggattttagcctagaaaatatgtctctgtggaaaaaagaccccccccgcccccccatcccaggtctggcccaaaggagggcctccctccggtaaggcttgggcgttcacattcagaatccactaacatttgttgagcagatactgcatacaagacagctccatatacatcttcttctataccattttaatctaagagaagccttccaatgttttcccaaatgaagtcttatcttgaaatgagactctgtagacttaaaccaactacagaaacactttagtattaaggtgccacccacgctgaaacatttttcctagctttgaccattgctctgtgaacatccagagcctgtttaccacattccattccaacagcttgttcttaatctctcacttcagagatttactgagctctttctgaatagaattactcttgtgaaagaaacagtagcagcatgttatattagttaggatagactaattgctataacacatagacccaaataagaataatggcttgcccaggtgtggtggctcacgcctgtaatcccagcactttgggaagccaaggtgggaggatcacttgaggtcaggagtttgagaacagcctggccagtatggtgaaacccccatctctactaaaaatccaaaaaaaatagctggcatggtggctggcacctgtaatcccagctactcgggaaactgaggcaggagaatcacttgaacccaggaggttgaggttacagtgagctgagatcgcgccactgcactccagtctaggtgacagagcaagactctgtttctaaaaaaagaaaaaagaataatgactcagatacaatagacatttatttcttgccctttgggtggcagggcacttctcctccatacagctatttcaggaattcaggatatgaaggcctgccatgcaaaaggcatggaagagcatatgtgggaaaattttatgggcctagaagtagggtatatccgtcgaaatgggctccacagattggtgttggtttgcaaatagtttgttactggtacttgacaatataagaatagaaatggaaagtaaacctttagaaagctttatagcaatctggggccaggcgcggtggctcatgcctgtaatcccagcactttgggaggccgaggcaggcggatcacttgaggtcaggagttcaagaccagcctggccaacatggtgaaaccccgtctctactaaaaatacaaaattagccgggcatggtggtgtgcgcctatagtaccaggtactcaggaggctgaggcaggagaatcgctttgaacccaggagacgcaggttgcagtgagccaagatcactccactgtactccagcctgggcaacaatatcaaaacttcgcctcaaaaaaaaaaaaagttttatagcaattttgatacagtaattatctgttgaatctaaaatttaaaaattggggctgggtgcggtggctcatgcctgtaatcccagcactttaggaggccgaggaaggcagatcacttgaggccaggagttcgagaccagcttggccaacatggtgaaacctcgtctctactaaaattacaaaaattagctgggcatggtggtagccacctgtaatcccagctactcaagaggctgagacagtgaacccaggaggtggaggttgcagtgagctgagatcatgccactgcactccagcctgggtgacagagtgagactttatatatatggcttaattttcttttttttttataattaacattttatattttaaaaaaatataaaaaaactgaactcactgcctttggactgtaagaatataaggaaaaaaaattgaactcaccattggtaaagggtcataaagtttttatgacaaaggaaatagatgccctgatattaagaagacaacaagaatttaaaagacctttagttctcaggaaccagcactaaaaaactctgattcagaacccccagaaatgaggcaaagatgatagatgaaatgtttcaaactgtgttaacaaacagtgcaatcagaggaaaagacaggagcagcacagagaacagcattgacaattttaagagatgagggcaaccaccctacccaaaattcatcacctttttcttggaaggggcctggaaattaagtacaacttggaaagcagggactaagagaacattatattaaataactcttcccgccgggcatggtggctcatgcctataatcccagcactttgggaggctgaggtgggtaaatcacaaggtcaggagtttgagaccagcctggccaagagaccagcctggccaatatggtgaaagcctgtctctcctaaaaatacaaaaactagccaggcgtggtggtgggtgcctgtaatcccagctactcgggaggctgaggcaggagaattgcttgaacctcggaggtggaggttgcagtgagccgagattgcatcattgcactccagcctgggcgacagagtgtgactccaactcaaataaataaataaataaataactcactcttcccttaaatatgatctggccacaggaccaactctgtaaacagggtaatttttttccctatggtaatgtaaaaagtcaattaaatttccttttttctttttctctgtttatgattcttcatcattcagcttaaaaagtcaggtaatcttgactaggtgtggtggctcatgcttgtaatcccagcactttgggaggctgaggtgggcagatcacctaaggtcaggagtttgagaccaacctggccaacatggtgaaaaccgcgtctctattaaaaatacaaaaattagctgggcatggtgacaagcacctgtaatcccagctactcgggagactaaagcaggagaatcttttgaatccaggatgcggaggttgcagtgagccaagattgcaccactgcactccagcctgggtaacagaatgagactctttctcaaaaaaaaaaaaaagtcagataatcaaaagacactttttactgttctaaattataggattttcaacattgtttctatctaattcagcatcattttacaattttatttaaaagtagttaattggatgggcatggtgggtcacacctgtaatcccaacactttgggaggccgaggcaagaggattgcttaagtccaggaattcaaggccagcctgagaaacatggtgagaccctgactttaaaaagaaaaaaaaggggagtgggcaaaaaaaaaaaaaaaaaaaaaagaaattgattcaggcctgccttagtctgaaaaaattttttactttcctatggacagtacctcagcttggtccaaaatatttcccccattactgtttctgaaaaaggatgtcagagatgctatttcaaatcactgaagactaagttgagcctgctaacattggagagaacaaacttgaaggcaaggaaggtttaaccccaacactgctaagtatcctgctactactcgataggagatgactatcaggagtttagatcttcttggtcaccaaagccatctggctagtgggacagggccctgctaccttgatttctcttctaccaaagtctcaatttcagaaattcttcactaaaaattcttggttgggtgcagtggctcatgcttgtaatcctagcacgttgggaggccaaggagggcagatcacctgagctcaggagttcaagaccagcctggacaacatggcaaaaccccatctctacaaaaaatataaacattttggctgggcgcggtggctctgaccgggcgcggtggctctgtccaggcgcggtggttcatgcctgtaatcccagcactttgggaggctgaggcgggtgcattgcttgagttcaggaagttagagaccagcctgaccaacatggtgaaacccagtctctactaaaaatacaaaaattagccgggcatggtggcaagcacctgtaatcccagctacttgggagggtgaggcaggagaatggcttgaacacgggaagcagaggttacgatgagtcaagatcggccaggcgcagtggctcacgcctgtaatcccagcactttgggaggccgaggcgggcggatcacgaggtcagaagttcaagaccagcctggccaagatggtgaaacccccatctctactaaaaaaaaatacaaaaaattagctgggcgcagtggcaggcgtctgtagtcccagccactcaggaggctgaggaaggagaatcatttgaacccggagggtggaggttgcagtgagccgagatcgtgccactgcactccaggctgggtgacagagtgaaactccgtctcaaaaaaaaaaaaaaaaacaaaacaatgagccaagatcacaccattgcactccaacctgagtgacaaagcgagactctgtctcaaaaaaaaaaaaaaaaaaaaaatcagccaggcatggtggcacatgcctatagtcccagctactccagaggcttaagcctgggaggcagaggttgcagtaagctgagatcacaccactacactccagcctgggtgacagagcaagaccctgtctaaaaaaaaaaaaaaaaaaaaaaaattgaaaaagcaatttgggctttgttttttaatgtctttattttattttattttattttgtagttctagtaactaatttttgcgtattttacaaaaatgttggcccataatgcattacaaggaaaaaaatcttgttcctcaccacatacggtttgagaagcactagtatatgttacattccttcatatttgttctgctagaactcaatctcatggtcacatctaactgtagcagaaactggaaatgtgatctagctatatgcaatgggaaaagagaagaacacagaacttggtgaacgctagaagtctctggcatgcttaggttgcacactcacaagcacagcataatgtgtgaaatggaagagagaggactaagtgcccaaggggaggttgagctgcaggaggtatatccatgctactttcatccagcctggagaagattgccagctgctggtattagttaccgtccagaaggctttggctgcaaaagccaggaggacaaatgttgtctgtatttactgtgctcatttctctcacattctggcttttctttctatcctccccaccatgccttagtttaccatttcctacttaagcatcaaagtagcctcataacaggggaccctaccgttaacttcacatcatccacctccatgtagcctgtgactctcaccatgttactcttcaatagttccatatcacttacaggattgagttaaacttttgtcatagaaagcctgtaagaccattcacaatctagtcccttgccacctcctaggcctcgcctccccactgtgccattggcatcccatgccctagtcttgcagacctcctcaccacccccttagcactccatgcactgccatgcttccttgctttggacttgtgagtcctcactggatttattcccactagtcttttagctctccatttaatgtttcttcatttgtgaaagctttcttgattctcctttgtttggtgaagcaccccttcctccacaagcatcataattgttgggtaaagaatagctatctctaggctgggcacagtggatcatgcctgtaatcccagcactttgggaggctaaggcgggaggatcacttgggcccaggagtttgggcccatcttggcctcccaaagtgctgagattacaggcatgagccactgcgccagcctttctcaaaccttttattgtcaggggatagacaagaaagaaagtctctactctcctgatagtctaaaagttgaaaacaattcatttattacctgacaactattcactgagtatcaattattggccagaaaccacatgacacacttgagatacaccaataaaaaaacatgtcttcaggctgggcacggtggctcactcctgtaatcctagcactttgggaggccaaggcaggcggattgtctgagctcaggagttcaaggctagcctgggcaacatggcgaaatcccttctctactaaaaatacaaaaaattagctgagcatggtggtgtgggcctgtaatcccagctattcgggaggctgaggcacgagaattgcttgaacctgggaggtggaggttgcagtgagctgagatcacaccattgcactccagcctgggcggcagggtgagactctgtctcaaaaaaaaaaaaaaaaaaagaaaaaagaaaatgttctcaggcctcatttgctcatagtctaacggcgagaaatataagctggagtagagtggtgtgaacagttttgacctcctgggctcaagggatcctcctgcctcagcctcccctgtggctgggacaacaggtgtataccaccatgcccggctatttttttgtgtgtgtgtgaagatggggtttcaccatgttggtcaggctggtcttgaactcctgacctcaagtgatccacctgcctcagcctcccaaagtgctgggattacaagcatgagcccccgtgcccagccaaattttctgttttatgaagccaaaccaaatcctaattaatacaaggggaatattaacagagtaactccatattttaggtattttatacatatactgctttttatcttcatgacagtgctacaaaaattggccagattacaccttgctagctatgtgtcattaggtaagttacttcacctttctgtgcctctatttccccatctgtaaaatgaagacaatatagcatctcctctagaactgtgaagattggacaagttcatgtaggtaaagtattcagaattgtgtttgccacatggtaagtgctcagtgttagccattattgtatttgcaataacgcaatgatattcagaggcctattatagctcagaaagctttagtaatttgtttaagtggtgacatactaagtggtagggccaagattcaaacccagagccgtctgacttttaaaactgtgcatttccccattgtacctgtgaaggactcaatgtgggtcaactgcagggtggagggactagagctgggatgggtaaatgaaatactgccttttgctcctgtgtaactcggtgagtcttcccaatggaggcgctgaggtccatctcgccctctcatggccataggactcactgtgagctcctggcaatcagtgagggaagccagaggggagcaaagggcttggcatggcccatctatggaagaaagatggggaattcaaatagaaaggagacagctagcaaattcaagggaaccatgcttggcttaatgcccagcatcctaatcgcaagtccattcccagagctagaagtatcagcctcccatgaaaatgaaacctagaaaactccaggcagttgataagacttttaagtacatgatatgaggctctcaagagaagaaatgggaatcccctcccaaggacctcatcatataattaatccatttaagcaatcaaaaggcagaactgtatattcttattacatgcatgactataagcatgattctagagtcagactgtcagggtgtgaatcctgctacttactgtatgaccttgggcaagttacttaacatctctgcactttgatttcctcacttaaaatggaaatgataatacttcataaggtcattatgaaaatcaaatgaggtaatatttgtaaagtaattaaaatagtaatagtaagtgctaaagtgcttttaaataaatatatacaaaacaattataaatttacagttataatttataaataacatataagtgaaacattcatcttgtggtttagcctcataagaatttataattggaaaaaattatagaaaaaaagaaatcaagaagggtttcactgaagtagtgaaactgagcaattggtaggatttgagtagccacagaggtgtggcctagatctggggatcaacaggcaaaagtatggaggcagcaactggcatggctggggccagataaggtggagagtgagaaggaatgctagccaataggactggaattggagagtagggagacataggtggagacctgattatgtaagactttgaaagttagatttgctgtaataggcaatggagaattgttgagattttccagagggaaatgacatgatgaaagggaagttttgggtggtcacagtggctcacacttgtaatcccagtactttggaaggccgaagcgaatggattgcttgagtccaggagttcaaggccagcctgggctacatggcaaaatcccatctctacaaaaaatacaaaaattagccaggtgttttggcacgtgcctgtagtcccagcaaaatttcttttgctgctctctgcatgtctgtggatgaccatgaaagcaccttgagtattcttttatttttttccttccttccttccttcctttctctctctccttccttccttcctttctctttccctccctccctccctccttcctcccttacctccctccctccctccttccctccctcttttcttttcttttcttttctttcttccttccctccttcctttctttctttctttttttttttttttttgggcagggtctcactttgtcatccaggatggagtatagtggcgtgatctttgcttactgcagcctcaaccttccaggctcaagtgatcctcctacctcagcctcctgaatagctgggactacaaatgcatgccaccacacttggctaatttttatattttttgtagagacaggatttcaccacattgcccaggctgatctccaactcctgagctcaagcaatccacctgctttggcctcccaaagtcctaggattacaggcgtgagccactgagcctagccaggatatctgtttttttgttttgttttgtttgtttgtttgtttttgagatggagtctcactctgttgtccaggcgggagtgcagtggagtgatctcagttcacggcaagctccacctcctgggttcaagcgattctcctgcctcagcctcctgagtacctgggattacaggtgcccgccaccacgcccggctaatttttgtatttttagtagagacagggtttcaccaagttggctatgatgatctcgatctcttgacctcgtgatctgcccacctcagcctcccaaagtgctgggattacaggtgtgagccaccgtgcctggctgataattgtatttcaaataatagttactgcatagttgctctccaaaaagtttgtactgatttttgctcctataaagaatatttgagagtgcctattttctcacaggtgtcaactccaggaatttccaaaccttaaaaaatttgccagtctgataggcaaaaaatgatatcttgtagtcattttaattttttgctttgttttgagacagagtctttgtctgtctcccaggctggagtgcagtggcacaatcatggttcactgcagccttgacctcccaggctcaagggagcctctcacctcagcctcccaagtagctggaactacaggtatgcaccaccatatctggctaattttaaaactttttgtagagtcttgctatgttgcccaggctggtcttgaactcctgggttcaagtgatcctcctgcctcagcctcccaaagtgctggggttacaggcttgagccactgcccccggcctataatttacatctatttaatttgcatctatttagtatgtgtgaacattttccctatgtatttggtcattttcttgttttctttttgtgaactgcctgtttctatcctttgttcatttccttattaggttgtttgtctttactatttcttttttcatttttatttttggagacggtcttgctctgttgcccgggctggagtgcagtgatgtagttatagctcactgtaacctcaagttctgggttcaagtgatccttccagttcagccttccaagtagctagaactacaggtgctcaccactatgccagcttattaaaagcattttattttgtagagacggggtctcactatgttgcccaggctggtcttgagctccttgacctcctggagcatagggattatagatgtgagccactacgcctggtcctaatatttctttacataaattaatgcaattagccctatgcttatcatatgagttataaataatacccacaatttatgaatcttttgattttatttgcagcattttttcctatacagaaataaagcttttaggccaggcgtgttggctcacgcctgtaatcccagcactttgggaggctgaggcaagcagatcacttgaggtcaggagttcaagaccagccttgccaacatagggaaaccctgtctctactaaaaatacaaaaaattagctgggtgcagtggcacgcgcctgtaatctcagctattccggaggctgaggcaggataatcacttgaacctgggaggcagatgttacagtgagccgagatcgcaccactgcactccagcctgggcgacagagcgagaatccatctcaaaaaaaaaaaaaaaaaaaaaagaaaacaagcttttaggtttataaactgaaaactctagatgaacgatattttaaatttcaatcaacagcccttaatgacagcttagatatagaggacctgggagaggaagtcatcaaaaggaaccccaaggtttctagggaataatagtagtgtccttacaaggcttctccagcagggatcctcccagtgataggtccttcctggtgagtttagggagccaaagtttcagaatcaataattcattactgtttattgcttatttatttatgtatttatttttagagacagggtctcactatgttgcccagcgtggagtgcagtggctattcacagtcatgctaatagctcactacagcctggaacactggtgttcgagggatggtcctgcctcagcttcccaagtagctgggactacaggagtgggccatcatgcctgcaggttttaatgaatgatttaagaatagtttcagggctgggcgtggtggctcacacctgtaatcccagcactctgggaggccgaggcaggaggatcacctgaggtcaggagttcaagaccagcctggccatggtgaaaccccgtctctactaaaaatacaaaaaattagctggctttggtggtgcgtgcctgtaatcccagctactcgggaggctgaggcaggagaatcgcttgaacctgggaggtggaggttgcaatgagccaagatcgtgccattgcacaacaagagtgaaactccatctcaaaaaaaaaaaaaataatagtttcaggcagctcacgcctgtaatcccagcactttgggaggccgaggcgggtggatcacctgaggtcgagagtctgagaccagcctggtcaacatggtgaaatcccatctctactaaaaatgcaaaaattagccaggtgtggtgatgcacgtctgtaaactcagctacttgggaggctgaggcaggagaattgcttgaacctgggaggcggaggttgcagtgagccaagatcacgccactgcactccagcctgggcgacagagactttgtctcaaaaaaaaaaaaaaatagtttcagatttacagaaaagttgcacagatagtccagagggttctcatatacccagaacccagtttcgcctattactttgttttcgtttttagatggggttttgctcttgtttctcaggctggagtggaatggtgtgatctcagctaaatgcaacctccgccttccaggttcaagcaattctcctgcctcagcttcccaagtagctaggattacaggcacccgccaccacgcctggctaatttttgtatttttagtagagacagggtttcaccatgttgagcaggctggtcttgaactcctgacctcaggtgatccacctgtctcagcctcccaaagtgctgggattacaggtgtaagccaccgtgtccgaccagtttctcctattattaacatcttacattagtgtggtacatttgtcacagttaatgaaccagtaacgacacattattattaactgaagaccatactttatcagatttccttagttttaaatttcgtatcctttttctattccaggatcccatccaggatacaccacattatatttattcatagtgtcttcttaggctcttcttgactgtagcagttgtttccgctttttatcatcgtcatcccacgtcaattcactgactaatgggagcaaaactctatctgagctaaccatgcacagtatacagaatcagcaaatattaatagttaagtgtagatatgtgaagtctatgtggccacagctcctggctcatatctctcaatgcccctgttacagtctttttttttttctttttctttttctttttttttttttttttgagatggagtttcacttttgttgcccaggctggagtgcaatgacgcaatcttggctcactgcaacctccgcctcctgggttcaagtgattctcctgcctcagcctcccaagtagctgggattacagacatacgtcaccacgcccggctaattttgtatttttagtagagacggggtttctccatgttggtcaggctggtcttgaactcccgacctcaggtgatccacctgccttggcctcccaaagtgctgggattacaggcgtgagccaccgtgcccggcctacagtcttttgttataatgttaggacactttaggattcagaggccggcctcagaaagcagactttcttgctatctgactttctcccgctcttatttatttattcatttatttatgttttgagataatgtctcactctgttgcccaggttgaagtgcattggtgtaatcactgctcactgcagctttgatctcctgtactcaatcaatcctcccacctcaggctcctgagtagctgggactacaagtgtgcaccaccatgtccggctaattttttattttttgtagagacactctccctatgttgcccaggctggtcttaaactcatgagctcaagcaatccacctgcttcggccttccaaagtgtgggaattacaggcatgagccaccacaccgggccttcctgttctcattgcacctgccagatgcaggactctaatct

SEQ ID NO: 343 - DNA, 159933 bp, Homo sapiens
gaatgtagggttgggagcagtttgttgatggatttggttgttgaaaattcattattcattcagaaaatatggaactactatgtgccagatgctattctaggaacaaggcatacagtagtgaatgaaacagataagacaaagcttataccctcatggagtttatattttattgaggggaattaagcaataatatgctaataacaaatgtatgtcagacaaaagataataagcactatggagaaaaatgatctagggtaaaggagtccctggagagctggagaagagggttgccttttttatagggtgacgggaaaaggtctaaatgaccaaggaccatttgagaacaggcataaaggcagcaagggaggaagtcatgtagatatttgtttccaagcagagggaacgaaaagtgccaagtccccaaggcaggagtgtgtttggtacaatctgagaaatagcagaagtcagtgtgatagaacaaaacgaacaaggtggagaagttgtaggggacaaggagagggagaacaaagagagaagcagtaggagaacagcttatatgtggctttggaggtaaaggcctgagctttatccatttcactctgagtgaaatgagaagccaatggagggtttcaagcagacacaggacatgatgtgacttacattttaaaagcacgcctttggctgctgtgggaattggactatgggaggcaagtatggaggcatgaacaccatgtaggagactgctacagtagtccaggcaggagatgatgtagttctcctaggattgcttctactttctcacggagtaagtgggaagatctccatgcgagggtatgacagaggcttgcagggagatgagaaagtgtgatagtcatatggaaagcatgataggactgctgcccacacagctggcatatagcaaacagtttgctaacatgcttgcttacctccgaacctctggaacccatctcactatgcatctctcttcctcctgtccagtcttctttccttcatcctgtttcttgtcctctgactccagttgaccttcagtgggctttaagaacccaagcactgattaggaaaatgacaacctgctgctgacacatccagcattttttttttttttttagacagggtctggctctctcactcaggctggaaagcagtggcacaatctgagctcactgcaatctccacctcctgagtgcatgtgaccctcctacctcagcctcctgagtagctgggactacaggtacacgcccccacacctagctaattattgtattttttttttttttagagatggggtctcactctgttgcccaggctggtcttgaactcctgagatcaagtgatttgtctgccttggccttccacagtgctgggcttacaggtgtgagccacggtgcctggtccacatccagcttcttataccaaaccctttcaaaggatttgaaggagctcctcagagtgctcagttgtcctttaaagactctatctaactatcattccactacctcacacccagaagtcaatgagggaggcccagcattcctatgctcttattaagactactctttcctacccataatagaaacctcagcaggatttgaggtagacctgcaagtttcctcatgctcctagcaagaccaccactccctgcttccatgacactactcatctcacaacggatggcctgacaaggcagtcccaacaagaagtccacaactggattggagtggtgtctcatgcctataatcctagcactttgggaggccaaggcagtaggaccacttgagtcctagagtttgagactagcctgggcaacatagtagacctcatcattgcaaaaaataaacaaaattagctggacctggtggtatgcatctttagtaccagctactcaggaggagaaggtggggggattgcttgagctcgggaagttgaggctacagtgagccacgatcatgccactgcactctagcctgtctaatagagtaaaaacctgtctcacctgtcttaaaaaaaatgtccaaaattagaactgatgaccgacttatcttgaaatgaccagtagagctgatcttatcctgattcatatcaatcttcaaggaggaagaactgaccatgctccagaaagatcaagtaaaatatggacacaaaaggtctatttgagttttcagttataaggttcctggtaacattataaagaataatttctatggagttatggtgaagtaaaagaatgggaggtgaagatgtagatacagagtatagcctactctgtaggagaagctggctataaaatgatggaaagagaaatgaagcaactagaaaaaggtgcctagttgaaggtgaattgttgttgttgttttaatataggctagatgcttataagctaagaatctagtaacaaaggagaaattaaagataacagaaaagggataattcatcaaggaagtctagaagaagccaggaaaggatgagatcacagtacaagtgaatatattagtcttggacaggagaaatgacacagtttcttctaagatgtgtgtgagggtagcgacaggggaacaactaaagaaaagtttataagtgaggagaggaagtgaaaagagttcatgtctaatggtatttgttttttcaaaggagttaatctgctgttggtgaagggactggccagggcggggtgtgtggggcagtgtggggaagatataagatagctattgtgtgaagatggtgggctaaccatgaagaccagtatggtatttagggctcagctgacatcggagaccccttatgtgtagtggcaccaacatacaccactgtgagattttctcctccatcaacactcaactccgggacaaggcagatgtttgaactcatcctaggccagggacttgtgttgggtggatatggtggcataactaggggttgatgggtgagaatgctggtgagagagctattacagtggtttaggctgcataggaaagaaagcaagatgaagagagggctgatgacctgggagaaagtagaggccaagggactggaaggcatgagcaaaggagtgagcaatggaagaataactgtggtgagtgggatattggagttttcgatttcagatacggaatagttgtggggaatgggagattcagagtataacccctggaggaggatactaatatggtttaaaagtaagtttccatggaattgaagaggtgggcatgctccatgcatatagggtagtgtcctggagaattgccaatgatttagactgggaggagttgacagcacgagacacaaagcatgaatactaaaaaggaagagtttttgctgtaggtgggaagaatagtagcctgaagtggcactaaggagctagaaaactgtaactccttcgttttacttcatttttctcctttcttccagtttagatcctttatcatcccatttggattaaagaaatattctactaattgatttccctgattttggtctcactctaagtgtccatcatacacaggacttctagcttgaccttgtagaacagtcttgacagcctttacttcactcctgctcgcaaacttcagtatctctctgtggaataaaatccaaatttcttagcctggcccttaaggttccaggcatagagatggcttcaatctactacaattgacccttggataatacagttgctaaggttgctgacccttgtgcgttgaaaatttatgtgtaactttttttttttttttgagatggagtctcgttctgttgccaggctggagtgcagtggcatgatcttggctcactgcaatgtccgcctcctgggttcaagtgattctcctgcctcagcttgccgggtagctgggactaccggcatgtgctaccacacccagctaatttttgtatttttagcagagacagggtttcaccatgttggctaggatggtctcgatctcctgaccttgtgatacacctgccttggccacccaaagtgctgggattacaggtgtgagccaccacgcccagcctatgtgtaacttttaactcctccaaaacttaattactgatagtctgctgttgaccagaagactgactgataacttaaacatcaattaacacatattgtgaatgttatctggtcctttcttatttacaaatccagacaaagagaaagctgcctctgaagtaatgcattacagctggaagaaagagccctgtggctttgttcttaaaataaagtaagctaggaaaagaaaatgtcattaagaaaatcataaggaaaagaaaatagatatacggttcattaagtggaagtggatcatcataaaggtcttcatccgcatcatcctcttcacaatgagtaggctgagaaggaggaaaagaaggggttggccttgctatctcaggggtggcagaggcagaagagaatccacattttaataagaccggcacagttaaagctcatgttcaaaggtcaactgtactttgctttatatatctagtttgaagcaatatcaaacattagcttgtattggtctaaactctacacttctttacctaatcttagagtactttcctgaaagtggttttgtttgctgtctggaatgcttctccactcctctgaatattcaactccatttatccttcaaggaccaaatcaaatacagattcttccctgcatcaaaggacatttcctttccctattcttcttaaaattccactttactccctatattctagttagtcctgtacctaataagaaagaaccatgcccaatttatgctcataaccccagctcataatacttcgctcattatcttgctccttgtaggtatccagtgtctgctaactaaatgcattcatacattcatgaataaataaatagagctcttataacgttgcagtcgtgttaagggtcagaatccttcactagaagataatctcgaggtttagggttgatattatattttttatcctcaatacttagcaccattctggaaacattgtaacctaagtacacagtacaataaaatcttggtaaatggaattgaattagtgtcttcacacctaagtcattctcactgtgtcaatcccaagtgctctagagagtgaacacggtctctgaaacagcaaatagctgttaatatcctgaagtgagtaaaatgctgcctcttagaactggatagcaagtctcttaacagagactatttatttattctttcattcgttgagtcataccatgaattgcaattgatctatatccaataactattatagacactaaggagaaaacaatctgtgaaaataaggaggtgaaagaatgggcttggcttcttgctgggatttaaatgccctttttcttaaggaaacaaaatgcatgcctatgttgcattttcgctctaggattttccaagggaaacccttcttctaaggacggtcatgtcacagtagaactgaaaatattccccatcagtattagacctgaaaggaaacaagatttaccaagcatggggagccttccagaaagcagacagctcatgtttataaagtaatctctcctttttctcctgtttggccaggctgtgacaacatgctgatgggcataaagtctttgaaaatagtgaagaagatgatggacacacatggctcttggatgaaagatgctgtctataactctccaaaggtgtacttattaattggatccagaaacaacactgtttgggaatttgcaaacatacgggcattcatggaggataacaccaagccagctccccggaagcaaatcctaacactttcctggcagggaacaggccaagtgatctacaaaggttttctattttttcataaccaagcaacttctaatgagataatcaaatataacctgcagaagaggactgtggaagatcgaatgctgctcccaggaggggtaggccgagcattggtttaccagcactccccctcaacttacattgacctggctgtggatgagcatgggctctgggccatccactctgggccaggcacccatagccatttggttctcacaaagattgagccgggcacactgggagtggagcattcatgggataccccatgcagaagccaggatgctgaagcctcattcctcttgtgtggggttctctatgtggtctacagtactgggggccagggccctcatcgcatcacctgcatctatgatccactgggcactatcagtgaggaggacttgcccaacttgttcttccccaagagaccaagaagtcactccatgatccattacaaccccagagataagcagctctatgcctggaatgaaggaaaccagatcatttacaaactccagacaaagagaaagctgcctctgaagtaatgcattacagctgtgagaaagagcactgtggctttggcagctgttctacaggacagtgaggctatagccccttcacaatatagtatccctctaatcacacacaggaagagtgtgtagaagtggaaatacgtatgcctcctttcccaaatgtcactgccttaggtatcttccaagagcttagatgagagcatatcatcaggaaagtttcaacaatgtccattactcccccaaacctcctggctctcaaggatgaccacattctgatacagcctacttcaagccttttgttttactgctccccagcatttactgtaactctgccatcttccctcccacaattagagttgtatgccagcccctaatattcaccactggcttttctctcccctggcctttgctgaagctcttccctctttttcaaatgtctattgatattctcccattttcactgcccaactaaaatactattaatatttctttcttttcttttcttttttttgagacaaggtctcactatgttgcccaggctggtctcaaactccagagctcaagagatcctcctgcctcagcctcctaagtacctgggattacaggcatgtgccaccacacctggcttaaaatactatttcttattgaggtttaacctctatttcccctagccctgtccttccactaagcttggtagatgtaataataaagtgaaaatattaacatttgaatatcgctttccaggtgtggagtgtttgcacatcatttaattctcgtttcacctttgtgaaacatgcacaagtctttacagctgtcattctagagtttaggtgagtaacacaattacaaagtgaaagatacagctagaaaatactacaaatcccatagtttttccattgcccaaggaagcatcaaatacgtatgtttgttcacctactcttatagtcaatgcgttcatcgtttcagcctaaaaataatagtctgtccctttagccagttttcatgtctgcacaagacctttcaataggcctttcaaatgataattcctccagaaaaccagtctaagggtgaggaccccaactctagcctcctcttgtcttgctgtcctctgtttctctctttctgctttaaattcaataaaagtgacactgagcaaataacctcatcaggttatatttgcccacataccctaagcacaaaagctttctgggagtgctgcttgtgttaggtttactgtgaatgattcccaacacactgaggccctggtaaatattctggaatctggacagaagccatacagcaggcaagcgactctgccacagcaggcatgccctgtggcaccgagggcagcatgcctcttgacaggggcttcctcagtgtttcccacgtgtttgtccaattcagctaagttcgagtcacaagtgcaggctgtggtgccagtctgtgtcacgtgctgaagcctctgtctttccaggttggtcacatgagaaggtttgctttgtgtgcttgcagctgttttcctgtctttgccaagcccaggctgggaccataggcagtgaagagaaaatgtttttttccatagcatttgagtagatatttggcagaagggaattactcaacccatggatacagtgtaattacccacagttctaacagaatggtacagagaggccaaatcctttgtggaatgagacaggtatgaataaataaatgtgatattacctgccctattacctacctatttcacagatagaaggaatgtgggctgcctcacagaggatagtggggtagatttatcaataggagtgagtcctgcaaccatagttcctttggaggcacagaggggaggttgcctgaaatgtgctgtctagattccacctgggatatgatttgattgacagctctgcagggcacatctgccccaaacaactcaccttggtacctaccttaaatccctgcagctcgaatcactcttttaggtcaagacattttctccaggaagcccctgttaagggaccactttgcttcttgtgagccagcgcaggtcagtatgcaggcctgggaatggggtttctttcaggtgaacgttttagctctggggtcttgttggatttaagtgaagactgacatcgacatggcctacatcagtggttcttaaactttgttgcacataagaatcacctgcggagttttaacagtcctcatgccgtggccatatccccaagaccattaaatcagaacctctggggatggatcgagatatcagtatttttaaagttccttcccgcaagttggttccaaagtgcaaagaagctccagagccggtgacttagaacatttaaaaaggtaactgtatcaatttaagaacaggctagcagtttctgggggcggaggtaaggggagtggctccgctagggcaataaagggtgggattcggaaacagccatgaccttgtgtgaactgtggcagcctgcgtctacaaaagtcgctctgctgctattttaaggaagtgaaagagaactgaagggtgtcctgttgtaacacaactcttgcgggccccagccttcccctgctggctgtgctttggtctgctgctggccaggttcccgcagtgaccacacgtctcatatttgccagggtgggttaggttctgttcacatgtaaaattctcctgggcctactggtcatttcagaccgcgagggtaaatttggtttgaaaaagttgtgtcctgtggagtttgtcgacactccagcctgtagagaactaaaggctagggctgtggtgactcctgccagagctggggactatgccgagtccctggtgtcgctgccatctgaggcctacagggattttaaacagcttaacagcagccagtccttggaggcctgggcagggccacaacatagcagtacaaccaaaacgggttcaggccacacgctggaggtaggggctggaccagatctccagcttcagtcctccccagttcgagaacccattcctgtggtcagacattgccaacgcttttcttggacctaaggtcccagaccttggcgctgggcacagggaaatgcttcctgacctcggctcttcataagacagaacttttgtttggtgccaaccactagagggacctccaccccaggttgcgagtgcagcgcggcgggacctgggatgattcgggggctttccgacctgcttagggagggcggctcagagacaacctcaattttgcctggattgcacgcgggccgaggaagtcgggatgctccgaagggtttctgctctgggagtgcctctaatgtgggttttctatgctttctctcttcgcaattctcgacaccgtttccttcttcctcgctttcattccctgtgaccggagaacggcgctgaaggactggagaagcccaggagactgggagccggagcgccgggtacccacccgggcctccccgcaaccggagctgtgcggaggaggaggcgcggcgaacggggcggggctcccggaagggggcgcggtccgccgagagaggcggggctggggcccggacgcgcggcccagggggtggggacgaggcaggttcgaaggggcggggctgaccaggccggtcccccgggaacaggaaccctggtggacgggtcccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccaggtcagtgggctctccccacaccccgggcttgccgcgcggtcggggttgggatccccgtcgggagcattacctagggagtggagcgcccccagagctacgaaccacggggacgtgtgggtcagtgtctctgtgagccccggagcgtgtcccaggctcgaggacggggacccttctccaactccactggccagaagcctgggaggagggcagaactcctgtgggttggctgcgaatctccacccaaccctgcctgggatccgcggacagtccgcactcctgcaggtgccagcgtggccctggagatgcgcagggaggtggggtccctgagttctgtgcggcgcgtcccagccctgctcagcccggggagcagcggcgtggactagggagcctaaggaggttgcggaagctttaggtctgtcagcccaggcaattctctggtggacacagcgtgtgtctagatgcagggcctcggctaaagccagttctgtagtgtaagtgcaaaaatacagcacactttttaaaatctaaagccgccgcgtcccagtagactgcaggatggggacggtcctatttaaaagtgggctccctcctcacctcatcacatcagattccagacccgcagtttttcctcggatgaaaataagattatgtaacaagagaacagaacttccagcgtttggataggattaagacaggcattcttgccagtgtttaatcttcttaaaaaacgaatctaattatatttttacttttagagcagccagatatttggtatagatccgtgtcccttttctatattttggtctacttcctgtctttctcttcgtctctctcctttctcaacccctccttaattgattgtaatacaaatctgaagtgttttcaaatttgtagtgtattatgtgaagttaaatggtcaactacagaaaagtagttggttttcgacataattcatcttcagcatattcagtctttcattattataggtgtatggaaagctgtaagtgttatctaatttagaaattatttctctttggcttaagagaggcaacccatttgtactttgcttaaattcatagctaaataaatttgaagtgggagatggggatgattgatgaggttttcactgattgcatttatccatgttttatttaacatatttcaattattagtaatactattttaagatttggtgatgtgacagttgttagcttattgctactggagagataagctgcttaccatgatgccttctttactgggtagctaagggagatgcgctttgactttaaaagagtaagtggaatgagatcaatgacatgaaggcggtaggaacaaagttatgggaattcctgtctttcatctgagcagggaaatctgggataattttaagaaagggtgatgtgatggacctcaaaggatccctcctggggtttttgaggcagagaagggtagagtgtggcctgggctgtgacaactgtgtgggcaggcaggcatggactcaccatgagaagtggccagtggtccagcttggctcttatgtcaagtgctagtcaggaaagctggtgacaaggctggaaaatagtcccagctgtccagtacagaagtctggacttggtctgaaggcacagcaggggactgactgatggttctgtgaacttctcaaagtcaaagaccttggtccttgaccctcccaattcctagcctgatacagagaaaatccagtaaatatttgtggagtgcatggtctgacaacactgtagagcagagcttctcaaagttgagaatcctgtggggatcttgttcaaatgcaaattatgattccataggtcaggggtgggacttgacattctgtgtttctaacagattcccaggagcttgctgatcatttccctatgtgtagcaaggatttagagtagcagtttgcaaacctggctatgcctcataatcgcctggggagttttgtaaaacgttcagattaagtagtctgggatgtttttaccaagttcccccaggtgattctgttgacaaacccgaaggcaactgctgcaatggcaaagttctgggagtgtggtgggaagcaaactccaagggaaaaagacagtgggggcggcgaggccggataggaaaccgggaggctgatccagggtcaaagggatgaggccttattttgggcctgagagagtgatgaggtggggacaggtagggagacttcggagagatagaatctgtaggacagaggactagggaatgggacagtctctagactgattagatgcaatgagaagtgaggagggagaaacaatgctgggaagattcagctttgggcctgaggaatggtatggcctttagactgtaatgtttaaggtaaagtttatgaaaggttcttgtattggttcgaaccccgagagcctgccaacagacaacatgaggcggtgtggggcaacgtgctgttttaacgagcgcctgggtgcaggtgggctgaggcctaaaatggcgtcagcaccaagtgaggacgaggcaggggttttatagtttcctgtaaacaagaagtgtctcagtctgatgtaacttctgcacagtacccagacggcccctctctctgtcttcaaggggtacgtgtcttccagccagggtaggtgtcttctggccggctgtcttcctgcttctgctgtcttgctgatgcacactgctggcgcaactggccttgcaccttgggactgggcctgagaagggaggagttactcatctcttcaagctttcagaccccggggagaatctttcattcctgtctatttggttatagtaaaaagggaaaaggggtgactttctcaataactacttcaggcgtgacttaggggtggtgtgggctccttggaaaaagaaaaacttaatttttagggtattcttgagagatgtgttggtatccatcgtgtcgttgtagcaggagcatagtctgaattgtctggtggctaactgtagtttcaataagagttttagtggcttttattattagtgggataacacaggggagaaaaagtgatgaagattactgtccctaccagggttttaaatcctcctaaattagagaactgttgtccggctgctagagtgagagctcgagtgagggtgatgagttcagctttttgggaggtggtgcctgggaggagcagattggcttcaatagtgtggggtctttaagggtaatgtggacaggggtgtggtgttttgcaactgagggtgtggaaatatccctaacagcggggttaactacagataggggtaaggaaaggttgcatgttttagggtgggaggttggaggagcagaagaaagctagaagcctcggaggggtctgggttgatgcgttgggtactacggggaatgtggaagtggagagtagtgtggagttttgaaaggatgtccctgcctaggagcagagttgggaatgagaccaggtttggggtgaaaaagtgagtgaaggaaaaggtgtgcaggaagcagaaaagtggaggggtggctcggggttaggagacttgtccatcaattcccacaacagagacttaggaggactgggtgggtcctgaaaaattaggtaaagcagagtaggtcacccatgttgattaaaaccatcagggttacccttggctcggatgaagtgatggtagttgccggggcatccattccagggcaccatcagtcttcagcggcaaggcaaatgagatccgagtaggaggttttggcctgctcatgaagggatggggggcggtccctgcaggggccgctcatagtccgacttccagtggggtcctccgcagagggggcacggcctggtgggcttacctgggtatgggcattgtctggaccagtggctttcattgccgtacttgaaacaggcgccaggtggaggtggattgctaggaggcttctgtgtggagctgtggccccgtgggcctgcagggcccctgatggcggaggcaggcatttgaaactctgcctgtttttgccttttactttcctcatcatgattgttaaagactttgaaggctaaattaagaaggtcttgttgtggggtttgagggccgtcgtcaagcttctgaagcttgcaccgaatatcgggaatggattgggagatgaaccgaaggtttaagatagtggttccttctgggttggctgggtctaggttggtatattttctcatggcttcagttacatgagagagaaaaagggctgggtttttgtcaggactttgggtgatttctggaagtttttcatagtttaccactttatgggcaccctttttgagttctgcaaggaaacacataatcgtgtggtctcgatggcagcatctagaggccctgtcttgataatctcagtgggagtcctggttggggactgcctctgcaccagtaggcttggcaggagcttgttgatgaattgtgtcagcatgcacctgagctagggtccagacacagtcctggtcttctggggtgagggtggaagaggggataacgtagaggtcatgccaagttagttcataagactgggtaaggtactgaaactccctgatataagaggtagggtcgtctggaaatgaaccgagtcttttgttaatttgagagagatcagtgagggagaagggaacatgaactcttaacaataccttcagctcttgctacttcccaaaggggacactctagcactggcgctgaagtgagggtggggcatgagccaaagatggcgctcgagcgagtatgggcgggagagaaggaagaagtcagaagtcgttcctgctgagggtttgaaggggaaagggggtttgagttgataagcagtggaggacagataggggcgtaaggtggcgggatgggtttacaggcttcaggagagggcagtgaggaaggagaatgagtacaggcagtgctagagttgtcctcaggagaggacagtgtaggaaaagaagtgggtactgctgactgggaagatggtggctgggaagatggcagctgagaagatggcgactgggaagatggcagctgagaagattgcggctgagaagataaagaggaggcttgcggggttaaagaagatggttgagagggagaggtagagtctgggaggaatggacagcagtctgctggatctaacggggaaaaagaggtatggtcgggaggagaaaggcgatcagggctgcgagaatggaggagaaggatttgaacaggtgagcaagaattgcagaggtcgggttgtgatctgagtgccaaaaggcctggaaataaggaatttcttcctatttcttcggtcgttggcaatacttgcttaaatcagttaaaactgtaaagtcgaatgtttcatttgccggccatttggaccgttatctaatttgtactgtggccagactgaattgcaaaaaaagaaaaggcgcttagggcggatatcttgcctgaggcctaaggtttgcaggttttttatgaggcagcctagagggctgttttttagaatggagggccgggagtttcccataatgaagggtaggcacaggagaacagggaaaaaggagacagtcctggacagccggacggagacgataaaaggagcgatcgtcaccactgcctttttcattcctggaacgggatcaaatggcttagaggtgtccccctaagaccagatgatcagcgagtgcctggcacacgctggagcctttttggaccaacgttggattttcggaccagagaaaccaaaagaggccgagcacgtttttccctgttaaccaggttcccggggaagcttaccagtaggtgagatcagtgactgatctgcatgcacagagaggcgactggaggctaaggagcttcctttgtccagctgctgtggcctgctttccagcatagaggggtaggtccacgggggacacagacccgagcctctcccaggtttcggcaccagatgaaaagttcttgtattggttcaaaccctgagagcgctccaacagacaacacgaggcggtatggcgcaacatgctgttttaatgagcgcctgggtgcaggcaggctgaggcctaaaatggcatcagcaccaaatgaggacagggcaggggttttacagtctcctgtaaacaagaagtgtctcagtttgaggtagctgctacgtggtacccagacggcctcccttttggttttcagggggtacgtgtcttccggttggggtgggtattttccggctggctcttttcctgcttttgctgttttgccgacgcacgctgctagcacaactggccttgcaccttgggactgggcctgagaagagaggagttactcatctcttcaacctttcagaccccagggagaatttttcagtttagaagtggttttttacttggccataagattttttttttttttttcctgaaatgcaaatctgttcatgatgctgtcgtgtttgaaatcctctggtggatatcctaatgcaaaatataagaaggaagcactaatataaacacaactgataacacttgttccattctacagcctgttcatccccattcaagatgtgacattcagtccccatttggtgtgggcacaactaggctgaaacttttggcagctttgtttattcctgagtcactattttccctgcgtccttcttcttcagaggagctccacctcccttggactttatgtttcttagtatcattttttggttccaatgcttgatggcacctatgtgtctctgtcttcatggaatctatgtagttctaggaaaggtgggctttatcctttatacacccttaaagccaagtcttgtttgactgtggatcttcacaagcttcattcttatctctcactcatctggtaaataagcctctaaaagaggctgtcctagaataatctgtttagctttaggcccagatctccttagtgcctcaagttccaggggactgctgactccgagctttgtcttcagcaaatgtatgatttctgtttgccttaaggtcgttggcttggttctccctggttattcttactttcacttcctctctctgtcatgttcatatgtacacatttatgcacactgaaagctgagcattcattgtgcttgatgcttttaatcaccctgttctatgttgcatagtaatcatgatccctaacatacctgtagatgggaggcctagacacagaaggaataggactgtctctctgataggataaaatacaccatccttgtatggcattcaaatctctacagtggtgggccctactttagctctccagctgcctctccactgttccccaaactgagaagctgagtaatttctattcttttgtgcctatctgcatttgcatacactattttatcttcctggaaagcccttttgtctctattctgcaagattattaatccttcaggatatagatcaaattcttaaagctcccttgcccctaagtcgtttttactcttctgttacatacatatcacatcaaacaaagatctgctatgctatttcatcactttatgtctatgtctctgtccatattcctccaaactctgagctgctttagggctgtatcagctcttgtgcgtggccccacacttagcagatgtccaggaggagtctgtggtagatatgggccttaagctggctggctttgcaatgtttacctcagtaaagagggaaaggggctggttatttcgtatggtagacgagagaaggaagaggagcagaagctgaaagactgggaggaaggacaggcccagtgaagagtgggcccatatggctagagtcagggggttgggtggacactgggagaggtgaagatggagtcccaggctgggaagagatcatggaaggccttgaaagttggagctatataatttaaattttattctgatgacattaaagtttccatactcaagtatggaaaagacgtggtaaaactgttcaggatgattgtggctgggaagggcaggttggagggacagggaggaacttcttatgagcacaggctgttagaataacccactgaggtagctcaggacctaaatcaaggcaatggcagtaggaatagagagaagggagcagaggcaagtgaccatgccaagaaatccggcaggatttggtgactgattgtatttgagggaaagagaaaagcgtcaaactggatactgacgtgtgttagtttgctgggagaagaatgaggcaactgttagtagcatgaaagcatggaggaacttagtggaagggggaagggaaatgaaagtggttgattcttttggaatcagaagggagcctcgggtagtttcttgcttgccctttatatgtttacccataagaggatggtgaagcccagagaaacctacccaagatcacttagctcttgattgtagaacccaggtctactggcattatggcctgggcttctatcttctgtagcacatgagtttagccagaggagagctgccagaaggtcgagatggagattccattaggcaatgaaaaatgggaatgagaccaggtttggggtgaattcagcctgcagaacagctaaggctggagtcttataggtcaagcacccagatgggaaatgtctgctagttgccaatgccatgggggcccgaaggctcatgaggcctcctttttgccctgtggcctagctgtatgtggggctgatgggagatatgaagtacttttagggtatcagcgctcttatacttattatgctcaatgtgggcacgtgtattaattttcttctgggaatgtaaccaccaatcaatttatcaattccatgggaagttgtattccaaggcccaaacacctcctctacccagacttcagggcacatccagccagttcatgagaagttgcctcttatagtgttggagtggggatgggggtacagggaacagctagctagggaaggcaaccagccatgaggacctcatccaagcagggtccggtgtagagtcaggatcggggactcagatggctggatgagggctacagctgtccgatgaggagtgaggatcttatctggaatctgcactgctgtcgggagactcagtggccctgaggctggagttcttcaatcctcctcacccctcccttccacacacctttgcccagccaggctcctcagcctccagcctcccaggatggagtcttgtctttgtcatggacgctgacacagtggtcacttctgtttcttgaggaagagccaggtttatgaatgtgaaacatttgaattattgtctgagttgtggtagttgccaaataaaaacatatacacaaagaatactgggagccaacgttgaaggaaaacttgtcaaacttccctttctcttttgagctttgtagtggggtcttgccagtttatacctcatcttgttctgaaggttttttgtttctgtttttcatattaaggccaaaatatgtgcacgagcctgctcacccatggtaaagtgtcagggacagccacaaattgcacagattacagacgtagatttgcacttcccatttcttaggaagtaggtgggtggaggaaccactaatgcatctccaggaagggatttgttagctcaagggaggctatggggactagatcctacattgcctcttcccaggcttatggtcgctgtggtgttcccaggtggctctgcttcaggtatgtctctttcctcctgggaatagggaaggaggtgatccagatctcaggatttctctgcctgcttagggatgccagtgaggtgtgtttagtggggatactcttgtccctgccctccagggtaaagttacacttccacagtaacttgtgtgcatggttgaaatgcagccatcacatgcagctgggcctctcactctgacctggagggccactcctgtgactgcactgattatcccaagaggccttcttagcaaacttctccaagttgcttctggcgaaaggttcagagaactctgccaaaaggaactacttggttgacaactctgtgtgtgtgtctgtgtgtgtctgtgcgtgtgtgtgtgtgagagagagagagagagttgtgtaggaatcaagaggtttgtaatagggacaagggggacagagagggggtagagccacagctcaagcttaggaagatcaaaaatgggttacctctttcttgcctgcttaggcaagaaagcctctatcttcaggggcaacagtttccttctcccaacacacaagtccatgttccctccaaatcaaagaggtttttacacaaataactagctcaatgctggactgcttcatggaggcagtggaggtgtagactggccccacagaaagtttcttccacaggaaaggatagagcagaacttccaactttggtggatttgacaaatggcttgtttcatgaggtcagggtagtgttattcccattttatgggaaacaggtgccagagaagtaaagacacttttgaaggttccagagtattagatttaatgtaatttattgtccgaactgaacacttttgaaagtgaaagtaggcacataaatgctaaactgggtggggactggggaagatcaggatcaggcacattgggatgtgtggtttcaaattcagtgttcaaaactccaaattctatgagcaatgggggcagaaaagggaaggggtggggtgggagagtggattggcctgagggggtggagatcgatttgggataggaatagcagattcttctaattcaacatttcaccaaggcagaggaatagttcttgactctgacacctgaccttgactggatgtcatgaaaaagtttcattacataagctcttcctgcgaccaaccagccaagacatctggttcttggatgcatgtgctcacctggtaacaacaacagccttgtgtgtctgtctgggttttcactgtgcctgctcactggtgcggcacaatgccccgggcagggattattgttctgcttgtggaaatgaggaagctgactcctcttgcctgtcctgccccctcattctatcatggcaggcaggaggttttctccagcatgaggacttggcctccctaactcctgtgggccctggtagctctagagtggagggtttgaatcagacagtcctcgattaaaatagctctacaccaattcgctattgctccgtacctctttgagctttacattcctcatctgtttaatgggaacaataataggccaattcatttggtggttgtgaaaattaaatgagatgaaatgttgactccagtgcttggcacatcataggtagtcagtaaatccttttattcccgtctcaggaagcttgagagaaatcatttatcaagagatatttagatcatccagagggcttatcctgaaatttcaggtgggaagttgcatgctctgggcttccaggtatgacacagaaagggcaaccatggtggcggtgagcagaaattccaggaggcagaagtccatgacaaggtagagaacagcccggaatcaggtggctggtcacccacgtacaggacaaaagcagcaaacagcgcagagtccaaaccagctggatgagatgtggcagggttaagtgcaaagtcctgcccttaggccctgaaaatcaattgtgtgagtgtcctacccatctatgtggaaaagcccaatacattggcttagcctggctacattaattgaagtcctgggtttagaccttggtagaggatcttttccctgcattggctgagactggccacacctggagtgtgcaaagccggtatccctgtcttacaagctttggaggggcccaaggacagtcaggaagatataggggaatgactgctattttcaggtgggcaaggtgggcagcatgttctttgttgctcagagggcagagatgaaggcctatggtagtgatgtcaaagaaaactaaagacggagcagattctactttgacataatgtaagaaattttaaagaactcaggcttgtctctagggccaaaccgctgttttagagcagatattggagtctacctgcaaagggtattgttcaagcagtattgactagagaggagtttatgaaataacagggaggaaggtatactgaaaggttatagatctaactaaagtgctgtaagattttggcaaagggaaggctttgtggatcaaccaactggggtgggatcctggggagctgggaagaaaaggctctctggggatccctggtcagtcaagtgagtaaaaggcatagaagcccaagtgagtgaagtgggatcgagaaataataaggaaaccagcttagctagactcttcccattattaaaagtcaaagaaagaagttgggactctaagggaaaaggaacttgaatgccaaactaagaagctggactttaccctgtcggtagtggggaataattggtggcttctgagcagaaatgacttgcagcagatgtaggctggagtgagggtgggaggctggggaaagagcagccttaaagctgtgcagaagcggccgggtgcggtggctcacgcctgtaatcccagcactttgggaggccgagggtgggcagatcacgaggtcaggagattgagaccatcctggctaacacggtgaaaccccatctctactaaaatacaaaaaattagcccggcgtgactatgcggaagcttctctatcccaagtcgcaggctgaacatcccacttagtgacaagggctgggagaggggaaaggctctgagcaaatgtctttgtgggctgaaaatgagactatgatcccaagaagtgactggactgtgtatattctttgctgatgcctaccttggcccaaccatctgaaagctgttttagactcacttgccaccccttgaagattttgagaacacaccatcctgagacctggagaaccagggtatgtggtgtgagacagctgggttcacagcatcctagagggcatagcaggtatagaagggagtgatccaggaggacactggtcacaagaatgtcctcctggatcactcccttctatacctaccataccctaggaagtctgactgtctgcaccttgggccatagagtgagcaaggttccatccctgggaggggaggcaaggaagggatgtgggtaccagggcctcattcaagtaggctgaggttttgggtggggtgtggtgtatgggaggagagagttgctgtggttaggcaacgtggatgtctgagcagtgtgatatcttggtctgggtggcagggaaggagtctggcaagaatggtaggaagagtggccatggaaccccaaggtcagaactggcccattggatctggggaaacctaccctttagcagcagaggtagagcatacttctcaggtactgtggaatcagtaggattgtgacagtatttattatttcagcctctaaataatttttgaaccattgtctatgctgagaatggtgatgatgggaccacaagatgaacagacatgtcccctgactgaatggaacttaagaaatgtacccccttactcaaacagatagtagtaactgctgagaaaatacagttaatattcagagaaagatgttgggggggcctggcttgctgaggaggtggcatttgaggtgtgtcctgaaggaaagacagggaccagagttgcccgtttctatggggctgaagggaattgctggcagagggaacagcagtgcacaaaggaaggcatgagtaatgccaattaaggggcacctgtggaaaacaactggcggcatgatttggctggaactgaagagtaaacgaagttaaatagggcaccagggattggaaattaccgtctatgaagtacccatcatgcatcaggcattgagcacagagtctgtgctcacttaaatttcaaagcagcctttcagggctttaactgaggaggaaatgggcttcaagaagatacctgatcatctcaagtttccctaggtggtgagtggccaaaataaaattgatgtccaggctgcctgaccccaaactctgttctttccacttaatcttgccactatgtttagagtccagattatgcagtcttaaatttacagtgaagacctgttcttaccgtatttaggcaggaagatggtcagatggcacatggcaaaccacattaacctttgagaggcacttagtggacatggccagatagtcacaaagcatatctgagttctaatacatatatatgcatgcatacacatatatatttaggaagttaatctctaacttcctaaatgcagttttcacattacaatagaaactgttactcccagaccactataggcaatttctgaattgctggctgaattccagtattttctcatcccttcaataaagtatattagaatggggcaagataagcctgaatcttctctaatttatacaaaaagcttctatcattagtaacaagttacctacaaccaaccttacctgtttaggataccaaggtgtcagccctaagagatgtttagcaagagtggtactccaagaggtttggaagcgtgggatgagggtaagagtcagagaaatgtgggcagtaacccaggtggggctgtaggggttgagaggagggaccgatacagttcagtaagcatttgctgagagcctgcccatgcaggggtgtagagtgggtgctgggatacctgcatgaaaggacaacattgttttcacagatcacatgttcaagctctgagcaggtgggtgttggtgaggactgcctgctcaagttggggttcttatgcgtatatctagtacagtcagccagtctttgttgctgagcaggtctgcccagggcccagttctccatccagtttggccttcctcctggagctcagaactcagatctagccctggtggccacgccttgcttctgtcctcagggtggacccagggtccttcagacttcctaatgggaggcttttcctcagcctggagagaaaagttgagaccacctgcgaggcaatagtaaccactgagaagacagaggaaatattcagaggaagaagttgggggagcatctgggctgcagtgacgcaggatttcatgttaacaggagacaatgtgggaggaagctctacctccttgtcctaccacttaataaggtacactgtgagaacccgttaaaggctcttccagggtcacaaatccagtcctcaaatgttatgatttatatttaaaagagaattttagataagccaagtgacagctgaatgggaaatggagttaatgagacagatcttatcggctccatgaaaaatgcatctcattacatcactgttacacatcgtatatggaaaccttccctcagtaattcctggagtgattgcctgtctggctatcggtgtccccaaagagtgtggtgtccactgagaataaccgggaggcctttctcagataccagtacggctcagccatcttctctcaaggccatctctagagttattatgggctctcttgatgccagtgcatggagccagggactgctgcaccgaggacaaagccagccagccatgaacgtggtcaagacttggcccttcccctccctaaccctacagagcccagttcagctttagcctccatgtttgaggcctcccaaaatccatttccccagcggtgtcttctctgtcaggtacctgcccctgggatggcccctgagcctcataactcggcctgttcactgttcctaagcaggtcaccttgtgaccctcgtggaatggctgaggaaggaaccgaggggctgtaagagtggccgtgtgatccctaggaaaccttcagctctggaaggccctgtggccctaaccttgccctgttttgtcaggtactgctagagagacgcagaaaacctggagcatgtgtgctgtttgagctgctgtatcccagggtctgccactttgggggctacctgcaagagatttggcaacttctcaaaggaactcaacatcatggttgttgtttttttaaccctgatcccaacatttaggccctgatgaagggtcttggccaaatccatcttctggaatagtacagttgggaacatgttctctgatgtggagaggcagagtgttacatacttactgggccaggcactgaggtgggtagtttattctgtcctctttcttaaccctctgactaaccctgtgtaaggcagatattatatccattacatagtaacctgagaggttaatgtccatattacccaaggcaaaaaacgaatccagctcataagtagtggagcaaggatttaagcccaaatctgtctgactttgctatggtctgaatgtttatgtctcctaaaaattcatatgttgcaatataatccccaaagtgatggtattaggaggtggggccttgggaggtgattaggtcatgagagtggagccctcatgcttgagattggttcctttataaagaggccccagagaactagctggtttcttccaccatgtgaggacatagctggaaggcaccatctgtgaaccaagaagcaatcctgctccagacactgactctgctggtgccttgatcctgggcttcccagcctccatagctgtgagaaatacatttccattgtttgtgagctaccttcccaatttatggtaattttgttaaaacagcctggacagactaagacaaagcttgggctctttctgctgcatgctgctcctctctttcttcaggggaagaagcacctcacttgggaagaaaggagcctcagaaggcttgaggctgggggtatggggacccagcgtctatactaccccttctgtggccatttggagtcacatagacctctgtaattttcactttttcctttgattctgaggaactgtttgggtatcttctataggggaataaagactctgctttatggaaaggaagagctgagaaagatgggagagaggtcccaggagatcattagaccttcccactcccctggagtccagctaacaaacttccaggagcaaaaccacttgggcctgcagggaaggggctacctagtacagtgtcattctccagcaggcctgtctttggcctgcaggaacacttgtgcaagtgggggattcctagatcacttttcttgggaaagtccctaaaccactttctggcctctgaactcttaggggagggaagtgatccaagtggcaaatatcttgtgactggcaagccaaggttagggaccaacccttcccctgcctccccacatgctggagcttttgaactgagttgaagatagctgggcccagggctcttggcccttgaatgcagcttgacatctggtcaggctgcaggatcttagggtttcctctttgtagcatcctaaaatctggcctcactaaatggtctcggtccagaggtgggattcgacttagagctgacttacaaagaatacagataaaggaatattgggaactgtgcttaccttgatgtggtttaaggtctgaggatgtgaagaaagtctctcctggattaagagggaaggggaacaccagtgggtcaggatagaggccgacagccctggagaggaggctgccttcttcccataactttcccagctgcgtgtgtaggatcaaatgggggtgtgtgttagtttgcttgggctgccataacaaagtactggggggcttacacaacagaaatttattttctcacaattatggaggccagaactctaagatcagggtgttggcagggttggtttcttttggggcctctccttgacttttatttattttttattaattttttttttctttttggagatggagtctcactgtgttgcccatgctggagcgcagtggcacgatcttggctcacagcatcctccacctcctgggttcaagtgaatctcctgcttcaacctcctgaggagctgggattataggcatgtactaccacacttggctagtttttgtgtgtgtgtttttagtagagatggggtttcaccatgttgtccaggctggtcttgaactcttggcctcaagtgatccactcacctcggcctcccaaagtgctgggattataggcattagccaccatgcccagcctctccttgacttttagatggctgtcttctccctttgtcttcacatggtctttcctctgtacccatgtgtcctaatctgctctgcttttaagtacaccacctattggattagggcccaccctaattatctcattggaatgtaattacctctttcaagaccttatttccaaatatagtcacattctgaggtactgggggttaggacttcaacataagaattttgagggtgtgggtacaattcagctcataacagggtgtttccaaaatcctcattgaacaaggctcagtgtcatggtgaagcatggagaggcacttactactgatcctgccaaccttgggaccaggagaggatggtggacccagctagctagtggaggaagcctgactggcctcgtccaaaggctcagctccaggccgagctgtttacttgtagtcaggctctctggcagcagtagtttctgtgcagtgtcttcatctggctcccgtgtggccctcggaactccagtgaacacagagctgctaataccctccagcccaggccttcgggggaagcctccttctcctctgatggaggcagaggccaggctgttgttgacagtgcacacaggcctgtctttaaagaaattctttggtcttctactgacttaactttttttattgcaaggggaaaagcattgcattgaatcaaaattaaactgttcaacaaatgttgaaatgaaggctcaaattacagaatacattttgattaattcaattagtgtttacctccagcctgccaaattctggggcctattcctcagcaggcagccagggaggctcgtaggagggagttggctataggcaaaagttacgcacgctccagctaatagagaaaacttaccaattcatatctgtttttttttgttgttgttgcttagcattctaaaataatggaatagggagaagtgcctggttttattatctattaggggaagtgacatccttttttctcattggtccttcaggaatacaattgcatccatcagttatgtctctcactcatgccaggcccaagcgtaagttccccttatggtagagacgctttcacctctgaatatctggctgtaagagagaagggaccccaggtgtggagaaagttcgatgagagaggctgtcatggatagcccccaatccttctttcagagtgctggccaaggttacatgcccagcctcccttcactttccactcaggtacacaaacacttaacattttgtgtcaacaaacatttactgaaggtcctgtgccaggttctttgctgggctctgaggatagaaaggtgaatggagcatactccttgctctctagcagttaatctagacagggaggcagacacattgagaaataatacaaattattatcatcttcataaataatatagacagctctgacgataaaggtgtgtaccagatatgacaggagcagagctgaggcatccagcaccttcagggatgaggggtaatggtgttaggaaaggttttctggcagtggtcatttggataaggccttagcatgggtgggatttgaaagtagagatggagaaaagcacccacgtagaggaagtacagaaaatggggtatttctgtatgcgagggtaggacgtggtccagtgaagctggaactcagagtggtgaggactatagcggggaaggttaactgtattagaggactttggcagagctgcaaaatgcagcttctctcctgaaagcactgtgaagccgaggaatgtttgagagcagaggagcatgtcatgagctccatggaacatgtcttgcctgcacagggaaagaaagacagattgcagggaagttggctagaggtagaaagcccagaggaagcagcttttgcaatctggctgagagatgatgaggttctaaactgtggtgaggtgagaggtaaggagagtttggtggaatgttaggacctattcagggagtttgaatggcactgtagaaagagcaccaaatgagtcatcaggaacttaggttcaaatctcagttctgctggaagggaaagtagaattctctgccccctgccctgaaaagtccacatccccaggtggtggtttggttttttgtgttagcctgttactataaaaagaattcaaatgtacacagaaatagaaatagtaaaatgcatcctcttacccatcatttagcttaacctcttgcttgtattattttttaggggggcaatttttgagatgaagctttttggaaatattcactttgaggttgcatttgaagcatttctctgaatctgtttatgatctggttgaggcaatgaaataatttcacgtccatttgttcctccctggaggtaaattgtgtgtatgcatgtgtgttctttgctgtaagaaggaaaatgagggtagcttcccttgaagggtaagttctggggctgaggaggcacattgccaaccgggtcctgtcaggggcatgaggctctctgtctgctgtgggggcaggtgtggtgtggacaggggagagaatggaggtaaggactaccacaggtcagacacccttatccattcactgggaggggcttgttgcccagagcttaattcacactgaccaacctgacaaggctggtccataagccagacaccaatttaatttactctggcaggcattgtgcagtggccacaacgcaaatgcctgctttcccagaccgccttcctggccttaccccacctggcaaaatgaattacagcatcatccgcaggttgctggggagccatgctctcaaatagaaggcaccatgtgcattgcaggtgcatcactacaggccctgatgggacctcataggctctttctggtgcaggccacttcctttgccaaggtggctctagggagaggggaggatgggctgagctgcacatgctcagttccttctttcatttccaccatcagatactgagctgtttcccaggggaggaaatcctggaaagagaggaagttagtatcctcccattgggtcttgcccatgacaacatgaagcagaaactaaatggaggtgggagcccatgtctcagccaagattcatttcaacaggcaggggtggggatgctgtcatagagaaaacttgcctgagcattgaaaaattagttttgatggacagagattggggaaggggcctttagttgaggaaacagcatgacaaaggcacagtggcataaggatgctctcttgcggctggggtatcaggaacccaggagcaggtcaggctcagtgaggaagtgcgtccagcgtagtggttaggaacataaccttggagttggactgcctgaattcaaatcttatctttactgcttcctggatgtgtgatttgaccaagtcacttaacctctccaagcttcagtttccttatctgtagaatcgggataataatagttataaatattgagatatgagataaacataagaacttagctcagtgtagaagtgagtgtttaataaatggcagccattataactaccatcatgagaacaggacattttcgggccggctccaatttggatgccagctcatgcgttcagactgctgtgggagaggccaggtgttactcaggtgagaggaggttctccagtgccctggttctgaatacctgaacacagtctgggcagtaggagtggaaaggatgagatggagaagagcatccctgcaaggggagaccacagagacctggtggctcacacgggaggggagtagggtggggaagcatgacaggtgaatgcaggctgcatagttcaatgagggacccggagagcgcttctcccaaatgccagaggaggagagtgtcaccactgatgagatgccaaagaaggcactagagcaaacgctgactgatggcgagtctaagcgctttactctgttaacatttaaccttcacaaccaccctttcaggtaggcagttttattattatcctcatcttaaagatgagaaacccgaggcacagaggttaagtgtcttgccctgggacatatagtttctgaatcagggctgtcaccgaggcagtccaaccccagcctgggcttttaaccccaccctagaccgcctcttaaggaaatgggaacacaagcggctggctggatgagagcatggcacgggtgcacacggatgagtgacgtcccaccactgggggtgtcagagagcacgggaggtaggcagtggggctctgaggcaaaggggaaacatggaataataacagtagggtgcagggtcaaaggacatgttctagaatagcagaggaaggagcagaagagggagagagtgcagattcagtttggagggggaataattgagaggttggatctcagtgatgatcgaagattaggggtcacagggaggaggggcaactcttagacagcatgtgaagagagggtaagagatgagagaaggggaatcaagtggttttgtttctcattaaagaaagatgcatggtagtttgcagagggagtctgacacgaagaaacatgagattagagatcccaggcgcatgaatgtctgatggagccgtatgtgttgtgtagcatcccgggagcagaaggaagaagagacatgtgaacctggttccccaggcagagggagagtgagcgtaagttgtgaccagagaggtagaatgagctgaggagcacgttcaagctggagagaggtgaggactctacactctgatgaacagagccagggagagagcctccacgttgtccagaatagggctatggtgaaagaggaaatggagtcaaggaagtgtgggaagggagggaataggtggggacctgaagtgggcaggtagaagggacaggctggcagaccatggttatacttggggaggggaatccagagagatccttgagctccttgagaaggatccttccttcaggtccccgcctcctcctcctacgttattgctgggaagagtgggtggcttctaggtggctccctcagtggttgtcattgcctaatggctacaggccatgttctaggggtgacaggtgagagacccttctcaagctggggcagcttcattcgctgtcactattcccctgctctctggccactgagctacatctttgtaaaacagggctgataattgtactatatccctcacaggacccccttgaagattaaatgagaaaacaaaaatgaggacactttttttcccccccacagaggcagcagcttctcaaaggagacaggaaacctgtgaactcccagagcaggtggtttttacacacaggtggatattgcacaggctcgaaataattcaccatcatcttgatctattgtgaatggctgtgtggccagggcaggcagccaaatcttagaacgtgtgagttatctgttgcctagtcctggctcttcacatcttagccttgaaagatagactctcatttacgtttacttcttagacccactctttctgagcggttcagaaggaagggaaagagcctcctctccgaaagttctctaagtggctacggtgggccctatccccatgagggcactgatatacttgtcttacagtattgaagggcacactgatggggtttggtgatgctctgctccctggatgctgtctggctccccatctcaattcttcccaaaggcacagatccctgcctcgcttccctgccctccccgctccccactccccaatccctctccttgttggagtacctgcactgtttgacctttggcatctccccaaaccattctctgacagacctggcattaaggcatggccttggttgtggctggtttaccctaatcagtgcttgagttgggaaaaggatcagcttggagagagaggggaacaaaggcagaatatcgagagcagaaataggtgagaagagtcagaggagggtgaagcgagcattcaacaacatcaagcaaatacggtgaaggaaacttgacatcagcttcttagtgttcctgaagcccagaaggtcagatgtgcttttgggtgtgagccatcagaacctcagactcacacccgtttcctggccagaccctgcgctcctccttgtgggctgggctcgtggtgtctcattctcatgtctttggggtggtgtttctcttaaaaagcttgccatttccagtaggaggaggatgtcgctgctgagactgtgggacagctaggctcagagggagtctgacttcggggcacccggaggtgaggtctcagtgcctgttgctgctctttgccttctttagaggacagtgtgcagctttctgactgaatgccctgctgttgtgatatgttgctggaaatgctgtttggggtcatggagccttgcttaaagggctgtggtttggtgagaagggctcgagctttttgggaatgcttaagtggaagcatctgggcttggctctgccaaaggaggctggtggtggagcagggacatgtgacaggacttgggctgtgtcttcagtggaaggaccagaaagcaaaaggaatccttccagtgggttcagcagaactaggctccagcacaaatgttcttaaggatatcctggacctcgcctgacagggagtggctgggaatacccggtgcataaaactcactaacctggtatagcgggaaaaagacgctaagcaagaaatattgcattcatcccctgccaccacccagcactgccagcctgtgtctagattcagggccctttctgcagttctgatagatctcagcccccactggcctgagcttaactgactaatcagaacagcctgatctaggatgtttaggttgaaacaaggaaccttgtatgcgccaaatatttttgttgctgtaaagctttgaacaaatgtttgctcttaggagttactgatactatgattagatggggaccagttaagcatgcttgttcaccttcagtggcattcttctattttctcctcttcagcttcttttaggctacttaagcttctattcattgacaaaacaaaacaaagctctgcctcttcacttttattagactccgatattcactgaaggcattcagcaactctgatagcaacgttctcagcagcctggcccctctgtcctgctatggctcctctttgtcctgacaggatatctcgctgtgttgggctcctctgtcctgagggaaatttagcacaatggccttgtccctcattgtgatataaagccagtgtctgtgggctctgccattgctctgaggagctgtcttcgcaggccaggtgtgcggcttctcctctccactgtcagatctgatcctgtgggggtcgtgacctctggatgttataggacctgtggaggacaggtacagcttgtggccctgggcagaaggtggggacaacttgaactgctacgctgagagccttgccagtgtagaccggtgacctctttatttcctttcattttctcccttttagaatgggagctgagctccggggtcagagatatggccctgcctgtgagggccttaccacttagacaaaagtgccctggagaagtctgtcctgggagtggcgagggggacccagtcagaagtagtcacttccatctgggggatggatgggagaggatccttggagataatgatgatggaatttggcctcaaaacaggagtgggagttgagcaggtagaacgaaggacttcagctaaaacactgaagaagccccaaaagcagaagcaagctggggacaatagcttggctgttgctcagggcaggagccagatatggccaggagaattaaaactgctggggttgtgaactcccacccagttttgaatctctacagtcccacaatgtgtctcttttcacctgaattttataaataggtaaaatgaggttcattaatgttaaagagcttgtcggggcacagctcatgaaggaaagaacttggatctacatgcaggtctgactacagaacccactctcctaactgctctgtgggtccttaacttcgtctccaggtccccaagcacccctttgttgcctgagtgatagaaagctggtgaagcgttgtgaatgctgggaagccttggtaagatttgtgaaatagacccaccctcctggcagcagtgtggaggatgaggggtgtgggggggcggtgaggctggaggcagagaaactggttaggaagccagtgcagccactctgatgggagatgacggcagggcaggtgaagatgaggggacagatctgaaagagagggaggagattttaccggatctggtgcccagttggatgtgggtaacaaaagggaaggtccaaggctgactcccaggtttttatcttggtgaccatgggggcatcaccaaggtgggatgggaagcatttgggtcccacccattgtgagaatatagagagggaggtgggtgctcaggatgggaagagtttggggctgttgtaggggaacatgctgcaacctcactccagtccccactatctcccaggctttagcttcccatggacaatgaattggttattttatcaataaatctgtaaacacttatccagtgcttacagaatgggggaccccacagggacccagacacgtggcacagttttcagggagatggctgtgcacagctgctgtcattcctttccttcaggatgaaaaaagatgatcagggagatcccatttaggtagtcagaattaagtatgattacctggaagagctggcttgatgggaatttagcagggacagctgtaggcatgggcataaaagctggaaagcagtgcagacagccaattaactaacaattaggatcagatgccttagtgataaggcatctggtgaggatggggcagaggtctgccaaaaggtatgtatggtaaaagttaaagccgtgaccaagtaggttgagtccatatgatgatagaccatgatttctactgtgtggctggtggccagcccctgaggctgtctaagcaaaagggtgcctggtgcagggctgtgtttgcattccatcagttcctcaactttggtcagaatcagaatcacccgaatggctagatcagccataaaggtcaggctctctacttacaggaggctgggcctcttgcttgattagttctcagggtggttctgattaacagcaaagtttgaggaccacgagataggtgaatcttcagtgcagagtgaatggggagggctgttcggaggagggtaaccggttaggaggctattgtagtcatctagggtgaggtaatacagggacaggtgaggctgtgtgagcagatgagatcaccagtagcgtgagtttggagagaagtgctctggtcttattcagcagcatttggtgcacctgactgcgccctctatccagaaaccctttggttcgcttatgggtgccactctcacttctggctgctcctcctgtctcctttgtccattcctcttctccccggtggctgcatggtggagtgtttcagggagtcctggggcttcctctgtttttataccacttcttaagtcacttcatgcaattgcttaaatacatctttatgaagatgcctcccaaattgacatctccatcccagacttctctgtaaacatcagactcctatttccaaatggctactcagcgtaacttcctaggtgtctataggcctcttaagctgaacatttctaaaaccaatctcctgatttcacccccagacaccccacattgttgctcctgcaggcctccacattctctaggtactcagggcaaaaaccgtgtaggcacacttgactctgctctctcatgcccatgtccagtttatcagtaaatcttatgggctttgtccccaaggtatatcaggaattagaacatctaattcattacggtctgagtcacttcatctcttgccgggtttcctgtgttcactgctgcgtcccctgcagtctattttccaagaagcagccagagtaatccttttaaaaggttaagtcagatcatgtcaactctatcctcagaaccctccaaatgggtttctgtctcaggaaagtggaagaacaggaggaaaaatggtgtgcatcctcaggcaaattgcctaatctgttttctcatctgtaacagggggagaataattcctaactggtatggggattaagtgagataatgttggataaacccttagcaaatagctaacagttatctgcccaatatatggtaactaaagaggagacagatgccgcattaatttaatcttggcactgtgcctgccatgccacatgtattatttcttttaatcttttttatttcttttaatcttaatcaccactatatatccacacaatttaaagactcaaataattgtatgtaatttgttaaaacagccacctcttcacctccccaccccattgttcttcctcagatgcagctgcttaatttttttagtcatgtatttttatccgtatctctagaaaaatgcttgttctgctgctttattattttccccccatttgtcattatctgttcttattgaattaaacaaagtcttcaccaattatgtaagtctgttaagatgttcagatgcaccaggtgttctgtcaatttcatatgactgaggaagtctctcccagagcttttgaactggctgaccttgcaggcttgctacagaactgtaccctagcatctcccttatggccatgaccttgtgtccttttgagtttatgtctctcttgttaaatgagcagttaaattaaatgtttaggttcagcctgcaatgtttacctgagttctgtcttgtttacatttgcccaaaacaatgaaattgattttatactgattttacagatgagacaattgaggctaaaagaggttaaaagactcacagccattatgcagcagagcccatgttttcactcaagtctgtctgtatataaaagctgtactctctctcctttgccctttaggaagaaagtagttgttggttaatatgggatgtgattgagaatttagcgctgccatcaaattccttcatatctgtctttgtcctttttatttttggatgctccaaatggcttcttgctccactctaccaaagaggtttcttagatcctttaaagaggctttctcttaagcttagggatagcaaaaggtatttcttaaaataaccatttaagagcagctatggcttatgggaggcctgtaaattattgggaaaagactccaatttcttgtaatatagtgacacttctttatcatctgtttgccacttggggaagggagaggtaggaaaggagttaggttctgtggttgtggtggggttcttggctgaggcctccttccccaggccttgatttccaggcagagacactggcccctgtctagtggcagctgctaaggagtcaggtcttggctctggctcaactgtgtccaaggctcagaatatcctggaggcacagggaatagcagtgacttccagatctgttcctagttcatttcagcatccagggctatgtgagcctgctccaaacatcaattacaacctaaccatttttattgagagaaaagaagcttagaaatggaattcagcgtgggtggagtaaacaaaggtttacttgcttccgacttaccttcatcagtggttgctgcctacttcaaattttcttttgccaaacatgaaaggagttaacacagtatataaatcactgtttgcctcagaacataccagatgatggggttcaattgtgactcactttctaaattttagaacacatacagatcttgctccctaatcaacttccaggtgccaaactggcctttgtgtggtgcagttcatgtggctgtggcatgtcatcataccttgccattctaaaacatggcttttcctcactggctgcatttacagctaaggggtgtgggatcgttttctccctcactggtagcgaagagaagggttaagtcctgtaatgagcaggacccccagcctcagatgctgtcccagataggaagatgacagcacacacataggcctgtgagtgaaggaaggatgaattgtggatggactgcattttttcttaaacaacataccctgccttatctttatggccagggatgagacagtgtctcagtatcagaagccagcctgctcattagggtcaaaatgccagctatgttaagtgtccagagagaatgaaaagtgctttggtcccatgtaacaactgtctctgtattgtgtgtgctaagagcaatatccttctctgtgtccacttctttctttcctgggcggttgggtgcccctcgtacagtccccatggcacattgttgattcctctgttgtccatgctgtgtaaggcccttgggtagctgctgtagctctcctctcattgctggggagcatgatttaaattctacatcccggttcacgcctgtattcccagcactttgggaggccaaggtgggtggatcacgaggtcaggagatcgagaccatcctggctaacacggtgaaaccccatctctactaaaaatacagaaaattagccaggcgtggtggcgggcacctgtagtcctagctactcgggaggctgagtgaggagaatggcatgaacccgggaggcggaggttgcagtgagctgagattgcaccactgcactccagcctgggcaacagggtgagactccatctaaaaaaaaaaaaaaaaaaaaaaaaaatctacttcccaccatctgcttagctgtcaccctgatttttcacatgtcgcttgggattttggcttgggttctggctctctctgtcttctccctggtgtgttgcttctggagcttggtgcacttaagccccatatccctgaggagccctggctccctaggagatgctgtgtccctgtgggaggaaccgatgtggaagacactgaacgcactgcatgtcatcagacagcatgtttacctctgagacctgtgatactatgatatacagtagccccctcttacccatggttttgctttcctgggattcagttacccaaggtaccgtccagtaaggtattttgaaagagacagggccaggcatggtggctcacgcctgtaatcccagcactttgggaggccgaggtgggtagatcacttgaggccaggagttcaagaccagcctggccaacatggtgaaatcctgtcttctacccaaaatacaaaaattagctgggcgtggtggtacacacccataatcccagctgcttaggaggatgaggcacaagaatcgcttgagcctggaaggtgcaggttgcagtgagccgagatcatgccactgtactctagcctaggtgacagagtgagaccctgtctcaaacaaaaacaaaaacaaaacaaaacaaaaaatcacattcacataatgtttttacagtgtattataattgttctatgttattactaattattgttaatctcttactgtgccgtgcctaatttataaattaaacttcatcagaggtctgtagatacaggaaacatcgtattctatatatagggcttggtaccatccactgtttcaggcattcactggggctcttggagcgtgtcctccaaggataaggggggactactataataaaaaaagtatatatttggtctccttccagtttgctagcacagaaaaggggcaacttttgttattcataataagcgcctttcaaccttactcagctttatgctaatgaggccactcctgcaggatgggctggttaccagagaaaccaacctggtgattagagggttagaactttcagccccactcccaatcctcccgactcctaccttggggaggagagtggggctgaagcttgagttcaatcaccaaggactgagcgacccatgattggattaatcatatctatggaatggaacttctataagaaaccctaaatgaaggaaggggtttggagaacttccaggttggtgaacgcgtggaagtgctgctgggtagcagccctggagaggctatggaagctccatgcatccctccccactcctcagtcccttgccctatgtatctcttccatttggctgcttctgtgttgtcagaaactacacatcagctcctaggattcttatgaaagcacattgtatgataatggatttaagtggttttgtggtcttgtatgcatatgtggaaccctctgtaatgtttccttgttttgtatttgaattttcaggaagaggaaaataggctggcaaaaagagtcatggcttctgatgctagtcatgcactgtgaataggatacaccttgaatcatgtttcacttcaggccagctcccacaggtccacccagcttgctgtttgccaagtacaaactcatcgctgggcagagggcccatgggtcttgttttatggcccttctgttgcgggggcacatagcctgggccctctgggtttgacaccctgtcatgtttacatctgaggccacctgatttgttaggcattggcatccaggcccctgatgctgtgggtgtgattcccaggctcctctcatgcattgcccttgtactgcatatgtgaattccatggaaggctttgactcatcttgagcagctgggtgctcctgcgtaatctcatcaaccattttggcctttgccaactacatcctgcccttacatgcttccctggctttcctgtgcaccacactctctgcctggaacagcattctcctcctcatcttctgagaaagcttctatcatccttcaagacccagggaacttgcacacctgcctctatcaacataccttgcactgtgtcataattatttgttcatacttccgtctcttccactagattgtgtggttcatgggggcagatactaggtctgatttatcagtatccttctagggcctagcacaatgctggctgcatggatctgtccatttattcataagtatctatctgttacacagtgggaacctgggagtaaacaaggcagacagggtccctctgcctctgtgggaaggtggccagttagcaaggaaacaaatacatagaacaagatactgtggatttgttgtgctttgaaggggctgctttacgtggtgccggggggcggtgtggggaagccctctctgatactttggatctgagacctgaaggatgagaataaatcagctgtgcagacaactaggaagtgagctcagggtagggggatggcaggcgtattgcagaggagggaaggtcttggagggctcgggagcagacaggagaccagtgctgctgaagcatgagccatgtggggagagatgtgagcatggcctggcctgatcctgaaacctgcttcataggccacagtaaggagtttggaattttccccttagagaaagagcagtgggaaggatttggagggattatttcaaacttttaatatcccttatgctgaacaggtgagagtctgcagattgtttccttcctcctgcttccccccttttccctgctacctcttcttttatcctggccaaagctggcctccattcaggccccaggatttccacaccgtattcgctctgtagcggcctggctgctcctctcacctcggagcagctctgttccttgttgcagccttttctggctcctgccagggccctgaggtgccactgaagttccccgacaccctgtgagctcccattctcattccctctaagctaactgtgcagtggttcttgacccccgaggctgaatgcctgcttctgaaccttccttggccttagcacctgtaaatccctgccctctccccctccacaagcatggttgcttatcttccttccccatgcctgccgcctccaaacgaaccagcctcctgagtttatctggttctccctccctgcacctacctatttttgtttaaagtttcctctgagctggcaaaaatatgtcctgatgttatatcctcacttaaaaaaaaagctaacatattgaacactttgtgcaaaggaatgtgcttagtgctctctacataattttaatcatgacatctatgagttagatgctgttatccccattttacagatgaggaaactgaggctcagagatcacacagtacatagcagagctgggtctgaactcaagctatctgactttggagcctgtggatttaactattatttcctagtgcagtccggtgtggttccttggtcttgagatccttatccacaccatctctgaagccattcctgggtggtgcccattttcctgtcttcactctaaatgtcccacttcacaggaaaaactggcggagagcctcagaaccacctgtttcctctgctgcaccatgcttgagtgtggaagccgtgcccctgttctccacagcgtgtatggccattcggcacatgtgtagatttgctgaatgagcaaacagcaactcctccagtttacagacgtgagctaattctcttgggattacaagtgctattgtaaatccctccttgctacccagggagagggtggggaacaagaaaaatgagaggaggctgcaggaagagggtttaaactaaagaccttccttgaggtagagttgtccagagatggaagcaattgcctgagggacaggggaggggcattgggcagttcccctttgctatagctaggggatacagcattaaggtagtggccggactgtgtatccttggaggtgttcatctgccctgaaaagatgggattctgaacctcaaatcgtgctgggtagagtggatctaagatggtcagttatggtgctcctgggtgctgtctctacatccttgtggcctgtagacttcctaggcagtgcaccctttcccaattggaggagtggaagtggcatttgagccctctcagcctggctcacacccacccaaggaaagcactgcaggcctagggcaaatgcagatgtaagacagttaaatgcctgcagggattgtcccaggccctgcccttgtgctgcattgccttgtacgccctgacagtgtccctgttaggtgtgctgctctcctacgccacttagtggcgcctttcacagtggggtcggagcttctggaacctgggactccaattgttacacctggtgaggtgttaacaattgccgtcttgctgccacaggtgactctggagagccctggtggtttttcattacagaagtgaatgggattgtgtgctaaagattcatggaaaaagcactcatgccaagagggaaaaggccatggagatgcagaaactacatgtcggctactatgattcttatgaaaacacgttgtgtgatgatggaatgaaagatttttgcgatcttgtgtgcgtaacatggaactctctgtaatttttcctttgttctgtatttgaattttcagtaagaagaggaggaggccaggcaggcaaaaggagtcatggcttctgatgctagtcatgcgctggaagctgccctggagcaaatggacgggatcattgcaggtacgcccagggaaccccagcaaccaaggtctcatcctccacattccaggaactgcttctctccttttacttttttttttttttttggcatagagaaaatccccttttgttatatttatttttcagtggtgttattgtgtatgtaatctcttttttttctttgatacgaacttatacaactctctgatgtctggtgtgatcgttctggtctctgctgagacagtgtggatgtacctaccatctaccgtctcagtttggattctggctgtgaggcagtttgggttcagtgagactgattctaatgtaaaattttcagagcttttcatggcttattatagctgatctgaaacttgaaatctagcagactttgccacctaatgcaggtgtcagcgtcctcagatggtctccagtgtgtttcagagatgaaaggcagttttgtattgattcaattaatgattcaaattttctttatgccatattgttttttatccctctcaactgtttggttttaatatttgcattagccagtaggggactttttcttagaaaagatctagcaaagctgtggttaatttgaaaggactatcaattagctgttccagctgattcctttcttcatgggagcaaccagaagcctatattgattagaccaaacgttttgttggaaatctttccagaaggtcctaagtcttctgactttacctgatacacttcagtggcctcattggtagattggatgtgcttctttggaactttgctcttcattgtttgagctgtggctggaagagagcgtggaggaaggtattgggccaagtgtggctagaccccaggaagtacacagagtacctgacactgccctttctcaggcatttgcttttccttcccattggagggtttcatctgacttacagagggctcttggtgtttgagcctgaagtgggagagtatgcctgtgtcttgcagcttcttcaggttattgttggtaatgtgatgtattctagctatcatctgtctgcttctcaatttctcagttgatagagggcccttgagaagccatgactaatgtcctgcttttcagagaatccatagactgggatgtcgtgatgtttaatactgagtgtcaacttgattgaattgaaggatgcagcaaagtattgatcccgggtgtgtctgtgagagtgttgccaaaggagattaacatttgagtcagtggactggggaaggcagactcacccttaatctgggtaggcaccatctaataagctgccaactaatataaaacaggcagaaaaacatgaaaagtctagactagcttagcctcccagcctacatccttctcccgtgctggatgcttcctgcccccaaacatcagacttcaagttcttcagctttaggactcagactggcttccctgctcctcagtttgcagacggcctattgtgggaccttgtggtcgtgtgagttaatagtacttaataaactcccctttatatctatatctatagatatagatatctatagatatctatctcctattagttctgtccctctggaatacagatgtcctgttctaggttagggtctctgatgccttattgaggagaaagagtcaagaaagtggatttcctagcaatccttttagagatactgacctgtgagctcctcggggtctcacgtgcattgggataatagctacaggatcattccctgagaatgcctgaggcagtcatcacttcagagccttcagccaaagagcaaaggggagactgagcgagtccctggcagacctctttgatggttgtcagggagggatgaaaatactatcttttctctacgtattatctctgctgctttgtcaaaggtcatttgattatatttttgtgatatatattcaggtctatttctgaactctgtattctgtttcatggatttattttttctttcaccaataccacactgtgttgattactgtagctttagtaagtcttgaagttgggtactgtcagtcctccaactttgttcttcagtgttgtgttggctaccttttgcctcttcgtataaaatttagagtcagttttttgatcacaaagtaactttctgggattttgattgcaattgcatttaacttagatcatgttgggaagaactgacactttcacaatattgaatttttgagagatgaatcagacttctaaagaaaagtagccttgtgtggggtcagtacctctttctgactcctgatttctccatacaggcattcctgaaatgacagagcctctggcaaaattcattttgtctctgagagacattatgtggctggatccttaaggccttgccttgacccaggatctgcagttgagaatctgggatgtgtgtggagagaggggccctaagtgtgggttgtgtgaaacccaggagacctaatcttctgatcttccagtacaaactgctctatccttccatttccttagtcctccatcttggaaggttctatctagaagggctcctgggcttttctgtctggaacaggtatgagagttttgtagagagaaggcattctttgcaaattggttctttgcagattggtagggaggaatacctgtagccagactacttgtttgaaaacctagctctacaacaagttacttacatggtctgtgcctcagtttcctcatattagaaatgagaatagtaatacccatcttagagagttgcctgtgttgacatgcgtaaggtgcttagaacagtgcctggcacatagtaagcactataaaatgttagctcttgatagattaatgagggactaaaaataatcttcatcatgttgaatcttttctggggacggggtagtattctatttattaaagctcttatttctcccatctgagttttgtggttttcattgtataaggcttgtgcatccattgctggatttgcccagggtctgcagatttaatacgtggtcttctgattgctctctgcatctgttcttgctcccttatagactgtttcccacagagctgtagagtaaacctgaaaatgtaaattaagtcatatcactcctctctccaaaactcctcaatggcttcccatctcaggataaagtttaaagcccttaccacggccagcaaggtcttagcatggcttggctttcgtggccctttatgcatcccttttacgttcccagggtgtatctcactttaaccatgagcttgcccccccctctcctggaatgccctcctccagatctaggcttatgctgaaatgttaccgtaccggaaggccttccctgactgtgtctatcatgcattcccacataactctgttcttgtatcttgtttatacttctttatagcacttatcacctgacctatcacattcatatttgcctctttgtttattgtctgcctcctgcaccagcatgtaagtttcttaaggacagaggctctgccactgtatctccagtgccataattggtggttttaggcattttagttaataagcatttaatacatgctagatgtttttttttcatttgcttttgtgactaggatctccttttcattggttaggaggtatacatataggtttctgtatacatcttctatctggctgcatactgaacttcatttattttctctattttcacccttgtttcactgattcttttggaataacaaattattattattttttttgaagactagtagtttgtatgtcccatgaaccatccctgaagtagtaactggctcacacagatatttgacaggagctatttgacagattattcaacactgaggttactagtgagtatctggagggcatgttttctatgctattcttgataaaaagaatgatcattcttttgaatgccttgttcaggttactttttctcaagattgctgaggacacttttcctcatttttatgatggcattaggatggctgaaccaaattgggccaaagaggttaagaatttttgtggttattaacatggactacagagttggactgtaggggtttgaatcccagctcagccatttagtgctggctgtgggatctttggacaaattgcttaattcttctgagcctcaatttacttatcgataaaatagcagtaataatagtacctgtctcatattattgtgagggttgaattaatgcagataaggcacctagaaagtgcttaattgatgtaagttatttgttttattgatattagtattaaattatttttaccccccaagatcatagtgctgagatttgattccagggccatctgagtctcttccaggctccttttattcctgggctggtttttatgttgatgcatggggctgtctgtaggagaaaagaattaactgagggaaggatacttttctgctcttgctcacaatccctaagccagagtggttttgttcttgtctctcttacgttatttcttctaagcaagggttcctttgcttaagggtggcacagctaaagaagtttgaaaactggcaccacaccacagatcttgcagaaatgacatttttgtgtgaacatttaaatcttcctctctttatttatgttctcttattaattttagattgcatgatgtcaagtagtgccaccaccactgccaaaacacaactgcttttccatcaaagtactcaagtacccaaagaatgtattttctcacagttaccacgtatttcaacggaaaaaacctttatgggcttcctggacctcccaaatagtaaccacttacacagaaacaacacagattcctactaaaatggatgtactgtattcagtgatcactagtaatcatatactatgtaacaaggaattgcctcttactaattacagtaggctgggttactgtttactttccaaaactccttctaaaaagagtgcactttgggcatgtgatatcaatgtttatgtaattaagcttttagtgcaaaaaaaagtctgtctcctcctgcatcaactaaaacagtgcaaacagtgcgggatgattatcactcctgtaaacaatcagaccaggagtactctgagaggacatcctaatgcgcaagtggtaaatatgcccctccagagccacggtgcgatggcctttgtctcaggtggtcaatgttgggaggtgtgagagagagaaattggttcttgtaaatgcaaaaagaaatgccttgtaagcaggactattaaatgaaactccttgtaaagttgaattcttgaaatctgaatggctgaatcccaggtgactagactagactagactagactagactagattgggtctatactagattgggacctcagtattttatatcagaaagttgggaaagggtggctgttaaagactctaggatctttgtcaataatgacttggttctaatatgaaagaccattattatagtttccagtaggatgttaacctttgatctagtcttcctcctgattagtccctgtgattctgcttgcaaattcactgtaattgaattacactgttgacaattgaaattgaactctatattgcttaattacctccctctggatggcctagagcaactgccacagacactaattttgcatggagcttaatttgtgaactgacaggttcagtggctactttgtcaggccacttctggcaggggaccagagagccacgtggtcaggacacagaaggccacttactcctcttggctctgcatgaggttactcatgcagttatgtacaagcagtactcactgaggaggaatagttaagaggagtctgttttatgacagttaaagaagttgccctgtcagctggggcctttctgccaactctgattagcgtctgggtttgtaaaaagaaaacaacaaaagattgtgcaggggcagagaaagttctgatcaagaccgagattgttcacgttggcttgtgaatgaagtcagctgtggtgctgaggactgttgagtccatactctgaacagtccttgactgatcttgtccccggcttctctgaggtgcagcagcatatagcattcatcagtatcggactcgctgtttcccattgcaggttgtgagagccctgctaggactttgttcagaagagttggagtgggggtcttaggagtgtctaaggggcagagctatcaaagactgccctttgtatgaagaggtcaaaacagctactggggcacccgctgtttgacagccctcattccatttttccctcactggtagaccccatctcccagtcctttatggaactgtgcctcgttttccattctctgaaagagtttggataaggctggaactatgtgttccttaaatatttactatagttgtaggtataggaactgagctgcaaaactgtgtgggcctcgtgtattcttgtttgaagatttttttcttttaatggtgtggacaggttttaattttttaattgagtcttggcaagttaagtttttctagaaatgtgtccattttactgaggctttccattttgttatcatcaagttggccattatattttatctaaagtactttgttagattagaattattctttaatgtttgatagaattaacatataaaagcatttggcctggtgtgttctgtgtggaaaaaaatttaaactacgattaaatttctttataagacggccaggtgcagtggctaacgcttgtaatcccagcactttgggaggccgaggcgggcgaatcacgaggtcaggagattgagaccatcctggctaacacagtgaaaccccgtctctactaaaagtacaaaaaattagccgggtgtggtggcgggcacttgtagtcccagctactcgggaggctgaggcaggagaatggcatgaacccaggaggtggagcttgcaatgatcgtgccactgcactccagcctgggtgacagagccagactctgtctcaaaaaataaaataaataatacttgactcttagaatgctttaattctcatcactgccccatcttccacattattttcgttcagtattctagtatctttgtattctccaaattattgttttttcagttgatagcattttgtttaacagttttaacaacctctccagtcatagttgattctttcatcctgctttttttgcatgatagttttcttccttaaaatttgatagtctgtcagtaatagattgtattagtcgtcatttgaaaaatgtccttaaatgttcataatcttgaatgatagtttatcttgtacaggcttgtaggttggtcactatccataggtattattttgtggtcacagggatttattgctaatgagaagtctggcaatctgtatctgtcttctgtctctggttgtttttaaacttcttatttatctttggtgttcttcagtttcactgtgttgtttcttgggtggatttgttttgatgtatcattcttgggactcagtgagtgtctttaagctgagaggactcaagttttccattctgaaaaattcatagccattttctttgttgtctctgcttcatcctctgtattcttctggaattcctgaagaattgtgttggaccttgtcctccttttttaattccatgcttcctaactcctcttttatatttttcacttgtgtctctgtttgcagcattcttcaaatctatcttcctctccaataattctctcatctgctatttaacctgttcacttaattaatttgcttggctgcattctttattttggtttgtattttttttttcagattttcctattttttaaaatcatgctttccttttctttaaggtttttatttcttccttttctcctttaattatgtaaaacatatgacatatgcccaaatattcccaaatagacaaaatatttactcatattagtgtattgatttagttacgtgtttaagcactaagtaaaaggctttcaataattcaaaataatatgttaatttatgaacttcttgtctcattggcacttttttttttttttttttttgagacagagtcttgctctgttgcccaggctggagtacagtggcataatcttggctcactgaaacctccatctcctgggttcaagcaattctcagcctcctgagtaattgggattacaggtgcccaccaccattcccatcactggcacatctgatgaaataattttattcaagctttttatatttatctttgtttctatcattttgagcgctctttttgaataatcctagcattctagagcagttgtagagcatttggggatgcagattcatatttgtaggtctgggatgggatccgagactgtatttctaatgaactctcaggttttgctattgctactcctgtggacccctcttttaagtggcaaggttttagaacatgccatccttacttggaatttgttttaaatacaacactttaaaaattcacatatgatgctgtcatcagctatttcatctcatgccaaagaactccatttacgtggtaaaaggttagactttaaaagtttatcttgtctatatgtcttaattgtacaaaatatatattttgcatgaatgaagataggctaagttatattgcagtgagaaactactcaaatgtcagtagtttgaaacacaaaggtttatttcttgtacacattgcaagttccctgagatctgccaagagctctggtccttgtcatcttcacttgaacacagactgattgagtctccactattgccagaagtcagggcaggtggaagagatatgaggaattgtgtactggctcttagactttctcccacagtgatacacatggtttctgtttattggccaaaggaagttatgtgaccatgagtgacttcaagggacagaactgtgagcctactatgaatgcaagtagaggagaacaaaatatctgaacaaccccagtcactaccacagacatccctatgtgctttcgaaagcgatcattaaaaggctttcagctggctgcggtggctcacgcctatatcccagcactttgggaggctgaggcaggcagatcacgaggtcaggagttcgagaccagcctgggcaatatggcaaaaccccgtctctactaaaaaaatacaaaaattagccaggcgtggtggcgcgtgcctgtactcccacctactcgggaggctgaggcaggagaattgctggaacctgggaggcggaggttgcagtgagctgagatcacgccactgcactccagcctgggtaacagagcaactctgtctcaaaaaaaaaaaaagaaagaaaaaaaggctttcaatgaaatcctataacacttgcattgtatgtggtcttatcctcaaaaataattattaaatcttcattaaattttggttttgctccttaaaataaaaattctcaggtgacctctataaccatcaaagctagacttcattgaggtgatctgctagtgccatggtttcagcttaagcatcattttagtatcacctgggaaactttttattaccccaggtcacacctcagaccaattaaattagaatccctggaggagggcccaggcatctggagtttgtaaaaccgctcaggtgacttcaatgtgcattgaaagttgaaaatatttgtgctactctaaatactgctttgttgctcaaaatgaaataaatagaattccccaaagagaaactttaggcttgactgtaagttgaattacccttttctgagaaatctggggggcaaatcttgccttatatttaggcatatccagcattagtggtttatggtgtcttctaaattttcctgttaattccaggttttagggcacacattttttttatttgttttctattttgatttgtttcccactgtggttgtaatttttttacaggaggtaattgtgggaaatgtgtgtggagtgtggaaatgagcctcctgggagattttgcaattgctaatgctgggctttaggtgttgcactattctggaccattttgtgtgcatgtgtgttgatttctggtttgggatttcggtagtcagtgcatagtagaaatttggcactataccagtggtatgcagaggcctgtaggcttgatgtctcactggggggtgagggagggtgtatatgtgtggtattataaacacctagggggttacttagcatactgcaagcttccctgccgttgggtgaattttctcagatccatttatgaaataggcaatactttggggtactttctttctataggggtctcactttcaacttactgctttcactggaggcattaaaacctcaagccccaatctcggttcctccctatatctgggtattttgcccctgggctactctagagtcagcttgaattaatttcactgttgagttcactctttgtttctggtacccaaggtttttactgtctttcaagcttggctccatgttaaaaaataaaataaaataagagtgttatctttttcagcttttctgtttgttcattgtgggtaagggggactcctggcagttgagtatgtcctgtttccagaaggttcccccttaagcagcacatggctagcttaccaagaggcctgctctgagattttctgaaatgattgttctgtgaaaatactaccaggtttttccccctttcactaatgcaattatagagcgagggaaagctaatcaacagcacaaggaagaaacctgtctgggtttactcacttaatttcctgcccaaataaaggcctgaattcttccatattgtctagcatcctgtggggactttgaaagaacaagagaacctagagtccctgtgcaaactaaatgtcaaacttgaatctctcacttagagtcaacaaatttaaagtttaaaacaaattgttataaaagtaatgaaaattaatattgtcaacatttgggtatttctctgtatatatatataccatatacatataattgttttactgaataaggcaagtatttccccatgttactgagtctttagataattgttttttatacagctatatgaatcatattctttctttcagaagttatttaaacattcaccaatttggggggatttttcccctactttttgaaaattaagatgctgctgagattattcttatatattaatctttgactacgtgtctggttatatttccttagcttaactttctagaattggacttgctaggtcaaaaggcatgaatatttttcctgtatcttgccaaattgcttttcagaaagattaggccagtctttgtgtctattaacagtgtatgagggtacccttatgaacagcatatgagcttgccaacattaattatcattgcatttgcattttcaacaatttacgtaggtgaaaattgaatatcatttttaaatgttctatttaccaatgcaaaaacattttctttccatatttttaaattttacttctgttttttaattccagaactgcccatataagaaccttgtgcctattttgtgtgtgagaagtggcttggggactttttcttattgatagataaggtctctttttgtatgaaggctatactgagcttttgttgtaattgatacgagtaggtttgtttgtttgttttgagacagagttttgttcttgttgcccaggctggagtgcaatggcacaatctcagctcactgcaacctctgcctcccaggttcaagcgatttttctgcctcagccttaagtagctggggttacaggggcctgccaccatgcttggctaatttttgtatttttagtagagaaggggttttgccatgttggccaggccggtctcgaactcctgacctcgggtggtctgcctgcctcggcctcccaaagtactaggattacaggcgtgagccaccatgcctggcctacaagtaggtttttcaggctataatttgtcttttaattttgtttttaatattccagaagttaattttatgtagtcaggtttattgttcttttatgtcttgctcaattgctcttgtgcctataaaatcttcctctcactcagttttgacctatcttctctttgtatttctagttcagttttttaagtgtgtaatctttgtctgtctaaattttatttttgtgtatggtgtataataaagatcttatttttttctgtgagggtaattctagccacatattttagcagtgtatggcaagtgcctcttgattgtacttctcagaatattctcagctatttttattggttagttattttactgtgtaacataaattaccccaaacataacatcatacaataataaacatttatcatctgtttctatctgccaggaattcaggagcggtttagttgggtggttctggcttaggtctcttaaagagttatagttaagatattagctggggctacagtcatctgaaggcttttctggggctggagcagcagtccctaacctttttggcaccagggaacagttttgtcgaagacagtttttccatggacctggggagtcgggggaaagtttcaggatgaaactgttctacctcagatcaccaggcatttgttagattctgataaggagtgagcaacctagatccctcgcatgcacagttcacaatagggttcacacacctatgagaatctaacgccaccagtgatctgacaggaggcggagctcaggcgtaatgctcattggcccactgctcacctcctgctgtgcagcccagttcctaacaggccatggactggtaccagtctgtggctagggctgggaacacctgggctggaggatcccttccacagtggctcactcatatggccattggtagaagggcttagttccttgatgtctgctgacaggtagccatatttcctcactatatggacttttccatagggatgattgagtgtccttataacatggcagcagccttcccccagagtgagtggcctgatacaataaagcagaaggagtcacagtgctctttataacctagccttggaagtgacattcctgtcatatcctatcatttctgtcatattctactggtgacacagagcaaccgtgatataatatccacaaattacgaatattaagaggaatgggtcactgacggcttcttggaggctggttatcaaactcttcctctgagaggaaatttagaattgtatctccctttgtatagatgtttattcaatatcattttgtcatttacatcccaaagccccatggtggcatctggaagtttcttcttcccttagttttctgccctgtaaccttatctgattcttaaatttaaagtcaagtggcgtttgtcatctgaggcttttctgtcactgtcattacaactagctcagggacaaaatatttatcttttcacttccctcatctagtatttattgactattggttttgttaaagtaataaaagaaatataagtttcaaagaaatagaaattaaagttttatatatatatatatatatatatatatatatatatatatatatatatacacgcacacacacatatgcctgtaaaacttggcacagatatacatgtactcacatacatgtacacacgcatactctgaatagtaggaaagaatcccaaagctttagggcagagagggtcacagagaaaggaagagacttttccaaggccacacagtgatataaagttaatgaaaacccagatcttccatccaccttttagcctgactcactcttcccacatttatgaaatacttaaactggatggctacgtgtttaaaattcatgtgtacagaatggagagggattacttagcaatggtttggagattggaggtcttgctctgcttctgtccgttttcttccctgaagtttggctgtggctgttctaagtccactcttaattggatttgtaggagccagaaagtgctgagcacacatcacagtggtgggtaattgggcagtttcctggctccccagagcctctgacttgtttgtggatggtgatccatgattccctgtatcatgcattttcagaaagcaaactggcaatcaaatggtaattgtttccatctgtgtggatttctgcctggcaaggaggaggttggctctgagaagagtaaagggacctggaattggatgtcaggcctgcagcataccatggatgcggtggccccaagctcacattttccagtagagtcctaatttcaaatctttcatctggttggccttataaataatgcaaatgccctagaaattccaccacctaaaccatattttctaaagtgtttcttactgctgaaaggagcacagacttcctttgttagactgttgccccagttttgatttgaaaaatgtatcactgaacttacggaaaggagacttttgctgctgctgctgttgttaaataggtgtaagaatggtggaacaggccaggcgcagtggctcacgcctgtaatcccagcactttggtaggccaatttgggtggatcatgaggtcaggagattgagaccatcctggctaacacagtgaaaccccatctctactaaaaaatacaaaaaattagccaggcgtggtggcgggcacctgcagtcccagctactcgggaggctgaggcaggagaatggcatgaacctgggaggcggagcttgcagtgagccgagattgcaccactgcactccagcctgggtgacagagcaagactccgtctcaaaaaaaaaaaaagaatagtggaacagttgaatttggggcatatcaaattagaaagagctgacccaatataccagatctctgaggacattgaagcactctctctctagatactcattcaggtatatgtgcgggcattttgtcagattccttttcagtgtctactgggtagagtgcatgatgctgggaactcagttaaatgtaatatggactctctctcagactccacagcccacaataaggagatgaggtatggatatacataataataatgcaaatttaagagcatatagagatatataggggatataaagatcttctaactgggaagatccagaaagattccagttcactaaaccctcaccaaaatgaatacagtaattgtcatctagtgctgtgggataagccaacccaaacatagtggcttaaaactaccatcgtttctttgtaatttcatgatttgagtagcactctgcaggtgtgtctcctccctgttccacttggtgtcagtcggggtggctcatgggggcttggaagatcccagatggcttcattcacatgtctgtcaccacagctgggagggccaagaaaggtggggctgtctttctagccaggtaactgggctttgttacatggcagtttagggtcaaagagagaaagagtggaacctgttagacctcttaaggcccaggcccagagctggtacagagtcacttccactgctttctgttgatcagagaaagtcaccaggccagcccagagtcaagatccatccctttatcagaggagtggaatgcacacacaggaatggaagaatctctggtggccaactgtgtaatctatgactttaatataaagaaaaaaattctaaaagctgaagaatgagatcttactgtctaaacgtagtttatggtccctagtgaggactggctgtgctttcccagttgtctaagtgtgtgagcttcatacatcagtcccaaagggtacagtcatccacctctgtatgcctatttttacactgtccagcccgagattagataaagatgatttctggaaagtttacattgtgagtgattcagctggggtccaggtggccttccaggtttctttatttaaagatggggtctcactctgttgcccaggctggagagtagtgactattcgcaagccagatattgtgcactacagcctggaactcctagactcaagtgatcctcccgcttcagcctcccaagtagctgagactacaggcgtgcaccgccatgcccagctcacccccagcttcttatctgtccctttcaccgtttcttcaccacctttgctctttactagtaccttgctcagggtgtccacccttcttactgagttttcacctctctctcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttggtgagtagtcccgtggcctgattgggaaccactggggaatgtaatggtgcagcccatggagtgccactgctgactggggctgttgagtcatctgtataccttccagccttttcttccatcccactttggccaacgctgcagggtggcccttcttatcaaggagtatagagcccagtcaagcgacttaagctatgccctctgcccttccatggtccacagttggcctctcctgaggaaatccagggccagagaagggcaaacatttaagatttcacacacacacacacacaccctcgaattacatgtactgcttattgagttctaatccctggctggtgtctctaccctcggctagatcccactaccccttgtttcttaccacaaacaaaagactggttacctcattgatttaaaaaaaagcttgacaaatttcttaggaggcaatgttttcttatttttgcatttctttggtaaaaaggctaaacttttgaaaattagtttattcgtattcctctgtatggtctctaaacttttgattctatatcctgtatctggacaaagaatgcatttcccatatacatattcacatgcagcattttatttttgagacagggtcttgctctgtcacccaggctggagtgcagtgtggcttgatcatggctcactgcagcctcgacctcccaggctcaagggaattctcccaactcttgctcccagaagtgtaccacctctgcagaagtgcgagccacacctggctaattaaaaaaaaaattttgtgtgtgtggagatggggtttccctatgttgtccaggttggtcttgaaatcttggctcaaacaatccacccacctcggcctcccaaaagtgctaggattataagcgtgagccactgcacctggccagtatttcactaatatacctaaattataaaaataccacaaaacagaattttaaagttttttatttgtacaaattgtggggtacatgtgaaatttccttacatgtatataacacatagtgatcaagtcagtcagggtatttagggtatccactgttcaccaaaatagagttttaaaggataggttaaaaaatagttcccatatttttccctgtacacccagaaatcaccttgagcctcttggatgcacctctcccactctagtctattcgtagtctatgctgttgttttctattaggattttagtgtttttcttatctatttgaatgaccttttattagccgtttgctttatttgtagcatatattttcctcactctgtttttaaataacgtttaggtgctttctgagacacagaattttaaacaactgtacttgactctatcagtctttcctattttggtttcttgttttccttttggccctagcaacgcctttcccaacctcagaacagataactgttcacctgtatcttcctctagtaagtttatggtttgatttttattttatggttaactccaatccatcaacaatattttttagcatttggtataaacaatgaatctaacttttaaaacagtttttggaaatttattaaaaatatttttgatccaaaggcagttgacattgttgttggttttttcaagatgcattggtagaaaacagcttgcattcagatttgcagttttgtcttggggttatttacaatggtttagggaatgccttcctttgaagagatttccctaaaagtgattgcattcataaatcttctagagtaattatggccatcactaacctatgcatggcgaagcaagtacttttagggggtcagaagttcatataaacattccaagttgtaagggctgcatgttaaggtttttattctggacagagatagcctgtctgtgttttagatcttgcagacctaaagtcattttatgatcagcacatccacattccacacaaggtcttaatctgtatgggaatagaattcagactggtgagcaaactcatcaagtgctttagattgacacttttagttagaagttgttgctgctcaaattttggtctgtggctcagcagctttcttatcccctcgtagcttgtgaaaaatgcagactatgggctcccatctcacacttgctgaaccatctccaggtgactcgtaagcacattaaagtttaagaagcgctgcgttcaaccctggagactcagttgaattatttttttaaagtcccatgtgggttaggattggagttggaactagtaagatggtttgaaggattaggcagcactgcccagcgccttctcatgcatgatgtctgtgcatcccttgcatatttgctcccttctcctctgtagacacattggcattgttcacacctagaattcctgcttggccatgacactggcctgacatggtccaactctgcctcgtgacacctatatcagttgggatactttttccagtaaaatgatgtaaacaataacaagatagaccactaacaagatgtccagaagacagacagtcccagggttaaataagtggctctgagtgacctcatgggtactggttcttcccatcttttttctttgccatcctcaaggggtggtttttgctcaggcacatcccataacagttgcaagatggccactagaactgcaggcaacatgtccttacaagacacaactatacaactgtgtgcagaggtagagaatcatttctttagtatgtttttgttgtttttaatcaggagggaaactctctgcaaccccctagcagacttcccatttagctgcagtggccagaatttgttcacctgtgcataccctagctgcaagggaggctgggaaagcaagtattggcacttccacctgccatagagggaggtggcctctgtcagaaaagaatgatgatagagtgggggaaagtggccctcaggaagacagctcagagtgactgccacagacttctgttaggtttgagtttactcttgttggctgacaaattctttccatgttttctcaatatgttttctttttaaactcaagtttctaaggaaaaggatctgattgacccagttaattatttttgagcgaagtcctccagatcaatgaagaagcgttaagtgtaaaagaaatagacattaaagacttttaatttattcacaagctatggatgcacaccttaggtccagtgtctaccccagagtgaatcaactgttagcagaggggagggattacatagtgggaaatgtatcttgtactgctgctgctcatctgggactgcagatcttctggcactggagcatctgtggtccatcagaagaatgggctgctgagaagcaggggtagatgtggaggagtggtccatagttagaataggacaaatagcagactagtcctgggctctctatgtcttacatgaaaagggcactcctagtcctagtgcctcctattgggtagctgtttctttgtggtagggctggttcctcttcttctgggtcctggcagagctaaagcacagctgggccagcacagttggcagaagtaggagtgctgttggccaggactttgcctggagatgggtataaaacagaggcgactagttctaaagcccaagtggagcagacctgcccaggagtcagtggcactgggttaagtgagtttcccatgctctggagtctaaactagcatcctgctccttggtaagtataatgaggagaagtgggctctgggcctagaagggcatgtgcaaggctttcttaatggggataccctctggggcctcagtggggcaaggaacaaagggcttggattcccttggtctaggagcagtatttcctctggaaagttggtgaatgaggaccttgtatagagggtgtcttggggtctaagatgggctgggacctggcctgcagaggaagcatcagggaggctgtcctgcctgtggtgcagcagagcagtgttaccctcaggagatgggaaggtagtcctttacaactggaagacacagccaagctcagggtcagtgctcatggaggatgaagctgaggccctggctggaaggctgaggcagctcttttgtgatgggaacagagctgagttctagaaaaggggcagcctcctccttctctgtttactatggtgaaatgtaggatgatgccctcgggagggtgtggttatttcagttcaggagccccagaaccccacaggtggtcctgaagcccagaaagggaagcagtgctcatcagtggccctggcatatgctggcatgtaatcatcagtggccctggcatgtggtacctggcccaggcaagaaggacccggtacaactgtgaccacttccaggattttggctgtgccttgagtggggctttcccatggtctgaaaggggtgtctctacccctccacacctgcttggcttggctggtggttagtggcatagatctttggctaggttgggtggtggaaaccttagacaggatagccagtcagattcagatgggctctacagggctggggatagccagttagctgggaggagtagacctaggctgatacacagtgttgattcgtgtcccaggtctttgggtgacgcccagaagataccagagccagcagagtctccatatgaagtagccatgggtgcttctctaacagtatgttatgtacacccttcatctcctaccagccagccagtctgttctgctgtttaatacattgggtatgggccaaggagattcttggtgaagtttcaagatgaagccagagaaagggcaggcaaacccagcagcaaagtgaaggcaagtcaaggaagagctcaggctccagggtgaggggtggtgcttggcagagaacccacagaagggctgtatgtactctaggccctgtttggaactggggtacatggagtaggcttggccatccaataggaacccaggcttttctttgcaaggtctcaagagtcctggtcagtgtgcttgagcaggtgaaagcagattgaaccagggtgagggagtatggaaggtaggaaggagttaaaaggccagggttctaccctggctctaccactcatgagcctcttcttcacttctgtgggactcagtttccctactggaaatgacagctgagtttgaaagtgtctgcaagatctggccaagcattccaattctgcagtttgttctgggggctatatggagtggtctctttgtaagcaccagcctttgcctccctcagtcttgacctcttgggttccaaagtgtggagacaggttaggaacctctcagtttactgctgcccttatgttagagcttgatggaggcccacatctcaacagtggagaggcaaatctgtttaccatattgaaaaacctgaagagttgctctcctgaatgagcagcctctgctggccccagctgggataagtgctcacctctgatagcccagcagtcagttcaggtgccctcagttacctttttaactagtttcccaagaaacaaagaaacccagacccaggctggggagcacagccacccccccttctcagctccaaaccaccttgtcacagatggcggtttcttcagctcccagctcctcaaacaaagcccatacattcctgccagattcagcttgcaatctttcattctgtccaagaagcaaatctgtttaccatattgaaaagctagaggagttgcaaaaaaaaaagtggagagaaaaagctgttttatgaattataaaatgtgagcttgaatttttttaccatgggattcatttctgtatctccagaatggaaaacaaaagatagtcaggatacgtgtgtgttgaacatttcaattttgaaaagttacagaaggagttttgtaggtaaaccttttcctctggatcttagaggagggaaaatttggtgcttatttttcaagaaaaaaagtagagcctgtgtgagccgatttccagcatgttttcttacctcccctgtgacaggtgtgaacttgagtgagagatgagaaaggagtaggtgtgtccgtgctttctttctgcgctcagctcccaaggggctcctgggccgggctcaggtggcatcagtggtggttctttgtccctgtgcagtgctggaagaagccactaggtgggagtcagggacaaatgctgggaagtgaaatcccaaagaatgaggtcagcatgggcttcatatgagaaaacagcttttaatttttctttttcagacaaagataacataagcacctctcattattgaaactgcttaactgcacctgggtcagctggcaaagataattctttgccattttccttagaaacagtggacaaagggcagtcaagagagggctccactgtttagggtgggggagaagagacagggctggtcctgggatcatagacctgaccttcccctgtggatgtggggagacctctccagacttcttgactgcagtgccttctgctggggtgctagtaggttggccccttccattcctgcaggcatttcctagcccacagtttatgtcacgccctgccctagagaagcttcctgtcccctgggggattttgaatgcccttttcctgacacagcagccaagactgggggccttcagccactgcaaatttagcagtttcaattttcctggatcttgatccctgccccccaaagtaaatttaccctactaaattctagcaatccggctcctttcagacctgacctaaagagactatttcagcctctaagaaccaatgtttataaatgaccaagaatgtgcaaacactggtgaaagagcaaataaatccttccccactatatttcctgcttcaggcccaggggccgtggtggacagtgttgccaggttagcataacttgaggtctgagcacgtagacacccacttaccctccacctacaaaagaaaatcctgccagagatacactaccaagagccttctgccctttcagatacctgctagtgggcaggcaggctccagggaatttatgcttctaggcaagtttgtttagtaatctatgtttcgaagaatgttttgtttgttttgttttgttttgttttttgagacggagttttactcttattgcccaggctggagtgcaatagtgtgatattggctcactgcaatctccacctcccaggttcaagcaattctcctgccccagcctcccgattagctgggattgcagttgtgcaccaccacacccggctaatttttgtatttttcgtagagacggtgtttcaccaggttgacgaggctgatcttgaactcctgacctcaggtgatctgcccacctcagcctccgaaagtgctgggaatacaggcatgagccaccatacctggccttgaggaacttttgaaagcggtttcctaacttcttactcctccaagtgttgtcctgggaccagtagtacgagcatcacctgggagcttgtcagcagtgcacaacagcaggccccatacccaatctactgaaccagaatctgcatttttactagaaccccctcaggtccaggcagttcattctggatggggaagcactgtcctaacccagggattagcaaaccatggcccacagttagcccactgcatatttcttacactcatcagctaagaatgatttttacatttttcaagactgaagaaaaatcacaagaatgttttgagatgggaaaataatataaaattcacattttggtgtccataaataaagttttactagtacacagccacacactggtttaggtattggctgtggctgcttttgcactgcaaataggagagttgagtatgagatagactacatggcccaccaaacccaaatatttgccatctggcgctttacaggaaaagtctgccgacctttgtactgatctattttggaggtgcattctccatgcatgtgttctgtggaggcttgagctgcagtggccaggacttcctccacagcactcttcactcccttcccccgcctccccttctcagcgggcccactgtgcaccatgtctgttgaaggacacaagtttacatctgacttatgaggatttatgagggagtgtcctggcagctgccacctatggcccagaggtgaaggctcagggctgagcggagcccaggatgcctgtaggtgataggtcagtggaacagcacgtgaccatgagattcctctcagtttacagttctgcctgataagatgctgctgatttctggtaggcagcaggagtaacacctcagggggcctcagctcctttttcagccattccctcaagtacttggaattccagccaggtaggtggcaatcctggggttctcttctagaccctaggacaggggtggagcaagctacagtgactttccccggcaaacctgaccaccctggcctcttagctgtgtttttactcccagaatgctcagcctcacagtctcctgcccttttcccacagctggctgctgcatgttgcaggcagtaatgaatctgtttgtagatgagcaaagtacttccaggaaggccttcgggactgttaggtcactgtagtgacccgtatttgtgtaccctttgtgcttcctgaggacttctgtcttcagagaggggtccagtgagtctgagacaccacctcacaggagcagtataatgggagcagcaagcccaggcccccgagctcccaataacaaggggagcctagacctttgggagtaactacctcggccaattaaaagctgggcttctagccttttgggagtcatggactgttctgataatctgacaactctttttcagataaagatttatgaatacaaatagtagtactttctatatatttgacgaacatatttaggggctcatctgatccctggaatcccatctgtaaatcaagtgaggtgccctggacaggatggacttctagggcagtggtgcagccatgggtttgccttgccaggccagtgtgatgagggagccacgacagggacccagctgcccctgggggtggggtgagtgagcgaggaggtgccttagcttctgaatccatcccatttcactcagcccttcccctttccctcctgccaacctgctcctaggtcttttggggtgttaatttgtgatttttgagttgaattacaacgtaagtaaaatgtacttggtgtttaaggaaaaacaaggctgagataagacttgctacttgagaatgccataaaaatgtcaagaatttagctgcagtttatctggattcttccctcccttcctcccttttctgtccctttctctcccctaccctgcaccccccacctttgttcatcacacattgagttgagctaacagaggaaatgggccccgtcttttcctttttgtgtcgaacatctttaccctggagaaacggaccttcaagtctctttccttcacatagaattttagtcttactttaccagtcttatcatttgagccttattctttcatccaaaaaatgtttaaattcgtactgtgtgctaagaattgtaggcatggaagtaggagaagtgagttggaaatcagacacacttctgacagtctggtgcaataggagtggtccagtgtgacaaggtcagtgatgaagtagagaggggaatttaggtgctcaggaagggatagaagagggacacctgagccacagctctatgtaagctgggagtgagcaaggctgatgagagcagccacattggccacctttctcttttctcttttctcctctcttgtaccagaacctaaggaagagcactgcactcctcccaggagaggggagaattttccaccatcctgtagaggctggaaccttgcgccacctctccctgtccagctcccaaatcagcttgtctacctcctcttccttggagtcccagatatacctttattgcataccatatgataattcttaacccagggcatgaagtttttcatttgccttggatgcggggaaaatgtgtattgactggatgaatttcttcatttgacttgttcaggcttttagacagagaaaaaccaacctactgacccctgtacctttagagatgttcttccttggcaacatcctgccatagcacgggcagggaacctgggctgggtgggtcacactgtgctgtggagcagggccagaggtgaggagcaaggggctagagctcagcgcatgggcagcaaagcctgcttttcctttctggcctctgtctgggtgtgtctccaggaatttactcctccccttatgccagctgctggctagagctctcctccttgccgcctctgtgatctctgtgggctggcccagcctgccggggactgtgctgccaggcattgtttctccccttttgggccctgcttctggccctggtggacattgaagccatgctgaggggcatgcggcatgaggggcatgaaggactgctcttcagactgggagttccaggaaaccccggaggtgacccccaagggaactgggaaggcccaggcagtcacaagctgtgcatctgcaagtcctttgccacagcagagctcggggccttgcgtgtaaccacagttcccaccgtgtaaccacagttcccaccgcacccacatcaaaggtcactttgataatcagccatagccaaaggccacacattaagggctggggaagggagaaaagctgtttttagtggggagctctcaaaggagatgggaataggaggaggtggggggtggcatctagggagtgctggaggggccacctggagagcctgcatgtgacctgccctgaaaggaggaaaacagctgcagctccaggtctccgccagcctttccaaggcccctgtctacccagcactgctccctgagtctcatggaaatgcacgtgaagcagcctcaacctttccacctccttggtttgtaaagcaggtagcccagagtgggggacagccagagaggcaggaccctccagccctggcccctgttcagaatgtggcccccagggtgccctggctggtggccaacagtccagggccagactcccctgagtttgcggcagttggtctctaatggatggtaccaccagtgccaaggacagcaaacgctctgtgctgggcccgtcgcacagcaggaccaagaacccagactggagctgcttttttttggaaacaacaggctttcctcagggcacagcccgtcactcgcctggaaaatgggtgggcgtgggcttcagggcgggggtcaggctgtgtgtgggaaccagtgagctcctccaagagcagcacttatttttagtcttctccccagtcccaaataaactgagagcagctgggagccctgggtaaatgcagagtgaagcagagacaggaaatcggggctctcagtaatgagttccagccactccagaagggggaagccagacaaggaattttcttcaggactgtttccctctggcaggctccggtattatcactgagaatggtcccgtgtgtgtgtgcgtgtgtgtcatgtttacaacttctgtccaagtcttctttcttttttctctacctttgtgtgacatttgatttctccgcagggctctgaatcccagtcctggtgcgtgtgcgtgcatgtatgtgcgtgtgtgtgtgtgtgtgtgtgtgtgtgtgtgtttgttggggtggtcggggaggacactgaagcagcacggtctgctctgtgtcgctgtgtgtctgaaactgtctagggagaggctgaaggacgcaggccagggaagtggggaaatttgaacacagcttggagttcttgaggggggagggggcagaggcaaggaagaggagagaactggtctccagccaggaaaagggctttttccaccaaggcatctaactgctgacatgggtgcccagcatggatggggacattgatgtttacaagcatttctcgtggctgaagagggtaagtgactggctgctttgtctgggtctccgtggagataagtgagggggagacgctttggggtgttttggggtgtgtgtgcctgtgtgtggtagggggaggtattgtccagcaaagccctgctgtggccaagttcttcatgagaatctaattatagacaccagggagaaaacagtcagctgtctttgtttctccactgacattctagtgaatgagcctctgtacagaaaggcaagaatggagtgaggaaagttggttattttaactttggcacctaaacagtcagaggctccaaacaccgtgaccagaagaatgtgcccaccgcttttcagtttgaggacacagggaggaagctgctgcctttttaaatgcattggattcggaagttgtttaactcgttctcactctgatgttatccggtggagcacacatctgctgtcagcagaatgagcttctgcatttccggaggaaagctttcagggagttctctttgaatgctctgaagctgagggtttatgttgcaagttgttcatgccctttctttagaggataaacctgagtgtgtggtatgagcaaggaatgaacggacgttgggggctggagtagcatcatactcctagaattcaggctgtttcctcttttgtggctgcctttaaattggctaagataggtatgaatttattttcacacgaagggattttaggctgagtgtttttcagaggcaggaagggcaaaagcagctgacaggttagagatttgacattgtaactgcagaaggacagaagaaccaggaagtgtccagcttggaaggggcatgcagatgcccggaccccgactcccggacactgagctggctggcttttgtgtgagtgcagcagcactcattcagcaaatctgtactgagtttgggtactgggtgtatagtagtgagcaaaatagaaccagcctcttgtggatcttctacctaatactggagatgtaggtgaaacagtcccaggaaataaacctcagattacaaacaataagtgtgcctggaggaagaacagaagacacgggactgctgttttgatggagaagggggttggggcggtcagggagtttgaggaaattatacttcgctgaaaactgaaagagcagtaagaatgagtcaggtgaagaatggggtgaagaacattccaggcaaatggggcataggggatgatgtatatacaaaggtcctaaagcaagatggagtctgctgattgtccagattgagagagagcccatgtggctgagcacagtgatggcagacagaggcgggcagaggctgggatcacgcaggacagtgaaggccacggtaaggcttttgggcaacctggtttgtgtgctgggggacttgtagcagggaagtgacatgggatacattggggggggtctagtttgtattttaagaaaattactctagctgtgatgtggtatatggtaagctatgttgggaaaagtgaggcaactgaacacaattatagggctggagggcttggagggatgggatagtacaaacccctcatttaacaaagcccaagaggggctaagaacctcatggtattagtgtcatagctattagtggtgcagcctggtcttgaaccctgttctctatctcccagtctagttctctttattcattttctctgccaaatatgtataaaattattgctttagaacccagcagaaatcctgtctgtgcccagcccctagggcatcacagtcaccagaaagcatgctgagatgaccagacgttttggcaaaggtttgcatcatcttaggttttttttttaagccccactggggagatactgaaaggaaatatgtaagaaatgcactgaccatcacttggtccttctttccctgtatcccaaatgaagcttttaatcaagaaatcctttcagccaacatgtgcctgggattgtcagagccttgtcccagcccctggggcagatactgtaactctgcctgctacaggagaagttatgtgtgtggaggaactaattttgcatgtgatgcaatgtaagaaggcccttcttgtcccaagacccagggtatgctggctcctgtggacagttggaagtttgcttagggaaactttaagcaaggagactttagaaacccccaggatgactcatagcaaaacagatatttttcttctacttttagaattttaaagagcattttacaaaagcaaaactcaaagtgtagacatgtcattggcagtgtgataagagtattttcactattctctaccctaaacactactgccagatttttaaaatcttcttaaaaaaaaaaacaaaaaaaacaaattccctttcgtcctgtgaccccagtgatgagcccccctggactcacccttaatctggaagaaaaatcaggcccttcggcttgcttggcctttgagaccattagcagcccaacctcaacttacctttttagttttatcttttatatctaccctgatgagctcccaagtgtatttcttcccttttctgagcttttaccacagatgaccacctcctctctaactctcatccacttcaactgactccatccaggctgtcttttcccaggaaacctctgctggccctccctccccacctcctgtagcccaggtctgcagcacttcccatctgcatggctcacccaccctttctcctgtgcttcagctgaggtggtgtggagagctggtttctctgaactcatgcttttgaaggtagaaacactatcgtcttcattctcctttacagagggcatagattctggaagaagaggttcctggtgccagagcaggagcccttgccctttgagcagtccaaggtggtggtgtctcagggcaaaggggagatacttatgttcagagaggcatggagctggaggggaaatatttgctcagaaaagaaatcttgctccagggcctgtgtgggatgggatagtatatactattaatattacagttaagaacatggagtctggagtgaggcctgaattagaatcctggcattgccacgtttaccagctgtgtgatccaaggtaaattatctcaaaagtctggatttctttaactataaaataagggagataatagtacctaccacatacaggctttatgaggactcagtaagatagtacgattagtgcagtatcatgcatgtaggaaatactcaataacatgcttgctattaactgctattggtgattatcaggaagggagaagttgaaagaggaacagatggaaccaggttctctcctagaattgcctctcaggccattcagtgcttcagctttatgacccttcccatactccagatcaaggtctcaaaccaagcatattgaagacctagaaaaggcagctgcaacctgggccaccataggtgaccagaggcctcattggctgctggatctggccagcttggctgtggttgctgagtgaaggctgatcagggctgatgctctagttcattctcctaacagacaaagcctagggataaggtagtctcttgccacaagtatccagagggactcagtcacaaacagctcacacctgttctacattgagtccagtggatccaacccacacaaccatgaacacacctctaaaaatagctccgagcagggtctgtgggacccacccactgctctttcggcaagagttcattttcccaggaacagaaatcccagactgtcagcatcttcacactgcttcctggcttccagcactctcagtgcttaagcaaattccaactgtaggtcacaaagaaaatggaatcactacaggtcccccatgcagttggctcaggttctgcagtaaaaagtggaattaactcaagctgctaatgtgagactttattctgtgtcatctggtgctcaaatggttgatctagtagcctggccacttgggccagaagagctgcaaaggcagacacggaggtctcctcactccagacactgacttgccttgcattcatgttggactgcagtgaaagttacagaaataggcagcagcttctgtgaaggctgttcctactagttaagagcatggatcctggatctagattccttgggctcatatctcacctctgtgtagacttgggcaatttatttaaccttcctagaattcaatttccttgattatatatatggataaacaattctatagatagatagatagatagatttttttttttttgagacagagtctaggtctgtcacccaggctggagtgcagtggcacaatcttggctcacttcaacctccttctcctagcttcaagcgattctcctgcctcagcctcccgagtagctgggattacaggcatacaccgccatgcccagctaattttttgtatttttagtagagatggggttttgccatgttagccagtctggtctcgaactcctgatctcagatgatgcgcccgcctcagcctcccaaagtgctgggattacaggcgtgagccaccgtgcccagccaattcaatgtatgttaagtgcttaggaagcactttataagtgttagagttatggggaggatgacatcgatcagaactgacaacctctggttactcgggagccaggtacccaaccttgattctgaaaagagaggtttttcaatcctatgggaaaggcaacagtggatatggtcacccaagggcactagcttcctcaatttcctatgatacctcctatttctggccaacacacccgagatgcctgtacattatgtttcctggtataatttagaagctagaattctgccatctctgacatccagcacctgtaactcctgccagctccttgaagagaggcctcttttacccagtgggatttaacaaactggcatcacaccagggtcatttgctgaacaacttgtgggcactacagagcagcacagccattgttggttttgtggactggcagcagcacttagggatcctttgactcatccctgcttttctctgtcccttcctccatagcagctctttcacacttttccattagtcttcaaccttatactcccctttcaactgatgtcactaccaatgtcataggaaaaaaaaaaaaaaaccagccaaactgagatgagtctcttcaccctccctccctttcaccgcaaaatgtaactgtatttcagcatcctgtttcatgggccaggagtcccttctctcagccaaggctatcccagtatcctgtccttgacccaatcctgttccagctcctcttgttgctctgattgtttcttctctcagctcctccctgcctatctgtcccttgcccttggtggaaaatgcttctcctcaattctcagggaaaaaacaaatcaaaactatctttgaccctgtgcttgtctcttcatgctgccttataacttaccttcctttcactgttaagattcttggtgagttgttagcctgctcgttcatctctactccctcctggtcactcctgaagccagtgagcactaactttgttcctatagtcatcttttaaattccttctgtaatgttatttttgctgcctctagttcccaggcaatcttccccatacattttcctttgtattcatttccatttggaaatcttgtaggattaatggcattcttgtgacccgaggagcagctccttactttggctcttgcctaattctgtgttctcaaactttggatctttcatgccgaagagacaccaggctctaaagcctccaggggagctaagacagtcacagcgcccactccaccctaactgtagcacccagtcctgctgcactgtctctgaaggtgttttcagtaataatgactcagtgcatctattggagttggcaaggtgaggacagtcttcaaagagtcttctctttttactctcctcctggctttcacatcctctcattacaggataccagcacacatacaaatgctatttctgcagcccagtgctgtaagctttttatgtgtccagctaccagataaagagaatttagcagtgaccaagctcagccaaggttataattttggggaaaaaaaaaatcttggtaaatgtgtttctctacaaatctagctccccaggaagatcagttaggagcttcatcccagccccttggttggagagctgatggccagtttatcttcagggtgtcctgtgtttgctatgttagttctggaagaccagaatatctgaagggtagtgattgtcatagcttcatgggtagcatgtctgtattgggaaggctatttccaaagctgctgttctcacattctcctaggggtattcctttaaagccttcagactcaatcattcaaatggtgcctccactgtaaagcctcttctctcttttgaaggtgaaatgtttttgtctctcctctatgcccctgccattcatgtgcatacaactctttatgatagtacttattacatcctgctgcaaaggttgatttcttttttccttctgtccttattccctgtaatactacagagctttttaagggcagggactaaatcattgtttagcacagaaagtggcacctagtgggtgctcaggattattcaagtcatttcataaatacattcatgacgtgtgatgatgtgaacattggtcaaccaagaagctatttatttgctgtttatgaactctgctttgttcttccttaaaagaggacatttagatcattggatgatagcctcatcagcaatacttaacctccccttatatataattgaggggaggagggaataagggtcaaggtcaggataggctttctcttgttggactcctggtagccgaggatctgactgcactctattcacattgcatttggaagaaatttctttaacactgtgacaaagatggtagattggcttgaccgttcttcacctagaaaaagcagaactggtcctgggaatactcaggtttataataaatgccagaaagccctaaaactccttaataaaaaaatctaggggaagttttcttttttataagaacctgcctacactcatactactgggttcccttggtgttgggtaaccagagtcctgtaacaggaattgactgtagcttttgtgatccaatcatttttgtttatttatttattttggtccccttacttttaaggtttatgtcttctaagtttctaaaaggggttgcatgtgagtggtgcttctgagcttaagatatagccttagtaactttgatatctcccctgatgccctgtgcctggcagctatggttcacttgtaactagttttctggattttgataagatcctcttgactaggcagcctggaaacactacacattttcttttgttttcttattcagctaaaaatacatgtcatctaaatggctaaataaggaagaaccattttaaggcttatccaggacaaggcttacccaacgtgctgtgttcaaaatctcagcgtatttacaggcaaagagccatcatataatttaacatgctctgaccagttgggacagtgtatgtactgtggccaagatcctgaaggcactggaatttatagcttattagaagcactgaaggaaatgtaactctttacctggccaagatgacaactattgatatcaaaaaaaggaaggcagatgcattttgaggatcccaaggcaagagctctgagaagcaactgttggcttcaaaaaccaacatgatgctagagctgtcacactggggagccgactgttttaggttttcccacactccttacttgtataccaatgacacccctgttgtgatctagcccttgccccatttgactactctggaaccaactccttcccctagttcaatgaagtacagtgccagcaggaagtctcctgggtcatgccagttggggagtgctacagaactgccctcatccagcatccctgaggtgtaccagagcacatgtgaagagtgtgttctccttgcaaatggccagccaggccataaagcagtcatgctgcccaccacaaatctgcaggaccccagccatggcatcaagcactcaccctgtctagagctccaaggagagactaacatggctatcccttggccaagctacagtggaagggctaggccaggagagagcattgtcatagatctgaacagccactgcagtcagagggtgatgtctttgaggaggccgctgggggttaacttggctgaaaagttcatgtttaacccaaatttgaactaacctctagattggaacagaaataaaaacccaagtgtttatgattggttattactagctataaaaattcccagtgtactcattataaacatgtatgtagcacataatacttagagtacacaataaaacacttgtacgaaagaaaaatatgtggccatgaatgtatgactcaaaaatgtgagcacttgttcagggatagtggagaagtgaactcatctttggcaatgtggcccaaagacatgatcccagggctattagctaatggtgggttctgcgttgtcactgtcacagaggctttctttttgttttgttttttcatttcaagcctgaaagtattttggttattgttcccttgggttgtttgtacagatcttcatagatatttcttaggcatcctgatcagaaatattgcccctgttgttctcttacacaaaaagagtgaattaattaaaactttttgtagaaggcattaaatgatgccttctaactcatgcttctaactgaatgttggtcttttagattaaacaaagctaaatcatttataagttagctaaattcatttgttaaattataatttaaaaatcatttccatattcctatgattattcaaaaactgtttatatcacacaggaatttttagagcaccctactataaagagcactctgtagttttagtgccacacgttttcaggtatgctgacctaacttgaccctttctgttgctccgtgaagcatgattttttctattgaaaggatggaaagcctgagatgaggtaacctacttgagattacacatggttaggtgcagccccagcctcctaattattcttggtttgtcctctttctgcagagaaggtggtcccttggggaggaggatgcaataggaattctgtaaatgaatatggaagcaccacaagaaagtccccagggatcccctgacttgaagttcagctgggccaaatgaggggaacagggaacccagagctctcagcctcccagcgcccagacctggcatttgtacagctgtgtctgacatgtaattctttcgacataacttcttaaacagttgttagatctatttctgttatttacccttcatttattcattttctgattcattttctgataatatcttttagactttagctcctgtttatttcttgttttgtttgaacttactttttcatatcacacatcctgctccccacctccaccaaccccggttgatgcccatgggcctgttgcatcttgtattcattccctgtcttaacctttttgctctacatgggaaataagaatggaagcaaacaggtggtggatagaaagccatctattccacacacaaaggacactgagtgccctttttatcctagtacatcccacacagacactccctgtgccacaaagtagatctcaattagcccctgatgataatcctggtttgaactatagttggcttaggactgacagccctgtcttaaaaattgccactttaagcaaatcaagcaatagtggcagaattcctttgcaattcagaactatatccaaatagcaggaattctttcctacaagtctgtttccaaaggagtaaattttagtcagttgatcaccttttgagacaaatgtattaaccagaacttttggttgcaaataacagaaactcagtttgaactaggccaagagggaaccaacaggaagggctggaatatatctctgcctttaggcagcgtgcaccggggatgagaatgcctccagtctttttcttggcttttgtttgcttttctgtgcacactgggttcatagctgtctcttgctgcaaaccagctttttccacgtggagcaggacatggccactgacaacctcagaactgtggcaccaccactaccatgctctgttcccaagtttaaaaattcagaggaaggatttcaacaagtcaagcctggatcaagtggcagggagatgaggatctttctaagaagatggcagccctcatttataccacataattacagtaaaggcgatgatctcagcctagtctacacaaacaatagattccattaaagcagggtgctgattctctgccaagactgatacaagtcttctctgtttcttttccttagcaagaaaacaaggggaacaatttggctgatctagggttcgccacaattcatggtgaagtttcttttttggacctgacatatcccctgaaaaatctcatccctaaaatgcaatgttctccaaggtgcagaaatcttgatttctttgagtatgccagcaaccagctctctgtgcatgaggaacttatcaagagtaaatttcttactcagtgaccaaggggagggatgggagaggtagggacaggacctggtttaggttaggctagtatcattgtacggtccaaactgccccttatgtggggacttaactatccctgctggaatcttgctggtcagtcagtcctctccctcctggctactcacagttctctctctgtcctctccctgctgaggctgattgactatcatgatcaactccaggatcccaaccatagaataccctgcacagctgatacattttcctgaggcccctctcagttagggatggcttagaaaatacccacaccttaggctgttaattgctcaagctgcacattaggcttgcccagccacggcagtggtagcagtttgggtcttacagaaacagaccctaggataacctgtaagaatcaaggaggtgtgttgtcactgtttctgaagacactctggaatattactcccaaggcctagggaagaccttgatatgacaactctgtgctgtgttttatatttgcctccgcgaggtctgaattttagaggatgaattccttgtgtccaagacttttttcagcctcttgagagcaacacttgatagacacaaaggtggcttggcttcaatgatcttgactaagggtgctgagttcttaaaaatatccattcgagaagcccttgtcttgattcagttccgtgatataggagaggtagtatgtttcactgtggcattctttagtcaaaattgaagaggatgtggaaatgtctggagttaacagttctccacagggcacacagatcacatggttctcactatatttttaggtaactaacctgaattacagtatcagaaatagctctgaccatttgaatgaatggtctgaaaatttgaatgagaagattgacttttccctgtcacatttgtagcaataaccatcagaacagagggggaggaagtttgatcaaatatatgtaacacagcttaccattggcaggtctagcctagtggctaatgtcattggttgagtaaaaattagctctttcttatattcatctgtggattgagcatccttaacaagtataacgggggtggatgatactctcctttatagtcacttgccatcccacagtggggaacaatagaaaattagcatgtaggccaggcacggtggctcatgcctgtaatctcagcactttgggaggccaaggtgggcagatcacaaggtcaagagattgagactatcctggccaacgtggtgaaaccccatctctaccaaaaatacaaaaaattagctgggcatggtggtgcatgcctgtagacccagctactcaagaggctgaggcaggaggatcgcttgaacccaggaggcagaggttgcagtgagcctagatcgcaccactgcactccagcctggtgacagaacaagactctgtctcaaaaagaacaaccccctcccaaaaaaaaaaaaacctcagaaaattagcacgtagcatccttcagaatttgattggactttcttctctgtgaaatgtgggcatggtttttgcaacctgacttcatgcgtggagagctgggcaactgctctatcgctgacttacctaatcaggaacatggacaagacttttcagagacacctcaaacctggaatcatgcagggatccactatccatccaagccttctatttgcaattccactattaaagaagcaggtatacttgttgaccaagcaagctgtctttaaagtagagcaaaacagagatgtgtcctaactcagtcttttaaaatatttttctcaataaattggaatcccattttgataaccacaaagcttattatgccttgatgatgtagtcattttataatgcaagaatgataccagaacgtgattgaacctgttgccaggttataagaatacagaatatacagattcacccaaaggcaaatccttaccttaggctgatgagtattagcattcagcaagacaatcctcttcttggccctgttctcagatgctttccaagtttttctccaggcagaggtggcatttgatcctggcctatgcccttctgaagaacgcagttttttttaacatcctagtcctatatagatcatgaaaacacatggctctgacttcatcaaaagcaaaggatagtgatactgtgggtttccatctggaacattatctttcactgctgtttacctttaaaaagcttgctggagaacggtgattttgaaggacctgtagaagaggaagatgcactgttcctctagaacagtgattggggtgggggagggacctgtctgccatgcacaccactgctgtatggaccagtatgcctgctaggaaaggagttggctcctcgaatctgttataggaggggcaaatatgaggaaccactgttctaggtcctctaacagtgcttctagattttcaaatatattttaattactcaatagaaacattttgtaagaaactcaaacattatgtcaaagtgctctgaacagtgcctggcacatgttgagcacaaggtgcttgctgtgtatttacagcactgtgcctggaccatattatattagtctccatggaattgctttcacctttggcccatattgtccactagcctctgaactattctgagaacatcacacaaaagtaatgagttctactgggctctgtttactataagggtgtcatggatattgctgatcccatcacacaaaatctgtctatgaaaacgtgaagtttctcccttgctccggaataattatgcttctcctaggcaattgatttgattttaccatactgatctgcggatcctgttaactgattgtgcctctctttttttactggctgctagcgtggatctagatttttgatcccccttctagcatgtgctatagaatctaggtcatacattttattaactgaatttatgatttcaactttcttactcttttttttgtcaactagtaaaaatagttacctctctgggtgattgtatgggtagaccttttattataatgaagaatatactgcacaccatttgaataaggcatagttggtacagtggcttgctggagtctctggaagaagtcttgcctttggtcttctctccttcatttcctgccagagaatgggcggctgccagtgctaggtggctccgtgtccatgtggacttcggcactggggttctacctgcagagcttcacttggacacctgggtcctgtttaattctctgtccactggaaatcaccatcatgtgagttctttgacagagaagaagttgacctgctattaagaattattctcctaccttttcttctctggttctgagaaaatatagattataatatattcttggattctagtcagagaatttgatcatgtgagaaccggaatattaatttaacaacaataaactgccattaacaaagaagtcagttgtgattgttaaggttctttgtctgtggcatgaaagagcttccataacaatgaacaagacataggctccagaggggctggagcagaagacagtggtgtggcagcaggtgctgcctggcacagctggcctggggagtggcccctgggcctgtcctctggctgcaccttcaacaaacaatcaatgaatctttcactagtgcgcatccagggtttgaatgcggtatgcttggtccacatttctgttctaggactgggcatggctctgttgcctccctcacctatgcagtgcattgggaaggggtgggatgaggggaggaaggaggtgccttttctcatggagggtggtgggagagcccatgctaaaagttgaaatgtggggaaatggcctaggacaaggtggcccaactctgggtctctcacatctgcctctttgcacaattaagactttcctctagggtggtagacacctccctcgtgaatattgaagtgctgatttcactggaccagctcagattgtataatactcagttccacatttagcaatcagatctactttttcaaactgccaagcctctgggtggcctattgcagaccagtctgatttcagtcttccatttgcatggaggaaggaggtgttggggccagcttggtgacattagctccttctctcctgtctgcccacaaccaggtcagacacacccaagaaagtgacacctcctttctctgcttgggacatttgtaagattctgcctctcctctgacatttcacatcctctccctttcctctcttttctatagtttctggctacctgtaatttccttagcttttgctctggcatccctctggctattatttaagttcttctcaagatgttttgtcttagcttgcttctctcagctctagcactggggaaatgtgatctgccagcctggctaccaaagctcttattggagggtgggattggggtgggaagggacgtgtgaatgaagggccttgtagttgacatcctccatccttcatgctcactgtgatgttcaggatgggcctccatgcagcaaggtgtgccttggcttcaggggaccctggcatgagaattaggagataccaagatctgtgcagaagctgttcccatgtagtcccttggagaacggtgccagctctccaatctcctcaaagagcagaccctcattgtcgccatgcctctggaggctgtgcctctggctaacccagacccagcatgtcaagtcaagcactgctgggcctagagtttcacagaggccctcctggccaggagtgaggtcatccaggaggtggttgtgccaacttccagggcgcacttttcagtggcatgtgatctggttctcctcatggtagttttgaaatcttgtggtttcctgttttgatgattggttttgtacatataatcagtgaaactatcctcacaaattacatgcatcccttatttcatttagaagttggtaagatgtttttccaaccttttaagtgtattcttttttttctgtcctctttagtcccaggtaaaccaccacagtgctgctagtaatgaaacctaccaggaacgcttggcacgtctagaaggggataaggagtccctcatattgcaggtgggtactttttggtgagaatcggcttatcctgttacctcctactatgtagcttcccctaagtggaagggaagcccaagagattttctctgttggaatttttctccttccaatgcctatgtttttagaaaagacttttcctgaaataaaacattaagtaactgaggggacaatttaactctagacttggcttaggggggctgtgaattcagtcattcatttatcatgcactcccaagcacccgcttctatacactggcagccccatgaccaggctgatttccaggtgctaagaatgaacaaaatgggccctgtcccccagaagctcctgagtcttgcgagggaggggagatatatcctcatgccactaataaaacagagctgtgggtgatacaggcctaagggtgaatgctaatgaatcaagtccaaattgtctgaagctggatctagactgatccctttaatgccaaatcccctggagctggtaacaggggctaagcctttgatagctgtcttgcttgaaagagaggagctccaaaaccttttacggagaaagatcatcaagggagctttttcgctgttgaaagtttgtgtgccttggtaggacatagagttaggtattctcataagaaggctgttgaagaagcaggcccagcactttgctgtgttagctcttgaaaatataaattgattaagcaagcatttactcaaggtctggtatgcatcagatattaattagtgatttggaaaatataaaggctagtatcctaatcccagctccttaaaagcttaaagggtgatgagttagactggtggtagaatgaagggaggggttgagcggggcctggaacccaccccaggctatgggctttagcttggagcactaaggttatgaggtggcagtgtgtttgttttttctctttttaccttacttattttactctttcattgtattttatgaacataagggtaatgaatgattttaaaaacctttaaaattctaaaaatgtgaagaagcaggttaacacttcggccttttttccagtgttgttggttttttttcttttgcctctattgtaaataactgagctcataccaaatatatagttttacattccagttttgtatttttcttcacttcattgatttcttcattataaaataattgggtatctacaacttgtgagatgctggttttagatgctgggataaagcagtgaaagaagcagactaaattcccattcttgtggatcttccatttgaaagagagagagtgggccaggtgcagtggctcatgcctgtaatcccagcactttgggaggctgaggcaggtgaatcacctgaggttaggagttggagaccagcttgaccagcatggtgaaaccctgtctctactgaaaatacaaaaataagccaggcatggtgatgggtgcctgtaatcccagcactttgggaggctgaggcaggtgaatcacctgaggttaggagttggagaccagcttgaccagcatggtgaaaccctgtctctactgaaaatacaaaaataagccaggcatggtgatgggtgcctgtaatcccagctactcggaaggctgacgtaggagaattgattgaacccaggaggtggaggttgcagtgagccaacatcgcatcactgtgctccagcctgggcaacagagcgagactccatctcaaaaaaaaaaaaaaaaaaaaagaaaaaggagagtgtgaattgacaataagccaatacattaactatttcaggtgctggtaagaacgctggaaaaaagtaaagcaggatgaggattgtgtagtaaaaggaagatctcctttacaggaggaagccaaggagggagccatgcagatacctggagaagtgcattccaggcagagcaggcagtcagtccagcccacacactgaggcaagagtgtgcttggggtgtgggaagaacagcaagtggccattgtgcctgcagtctgtgctcaaaagggtggtgcgagctgcctttagaaaggtagcaagggccagattgaatagcacattgtagcacagatgtttgagggatgtgtaatttgaaactcttatcccaatgacatgattaatgaaagagtatccaatgtaagattttgcagcaaacagtatgaaattgcaaacttttgaaccaggacccttcatgattgaaatagcacattcctatttacagaggattacaatttaatttttcaaagtcctgtgtaataatgctccctttcacattcatagttttctaaaattccaaattcttgaataatccccatttaaataatcctaacacaattgggaagctgcttgccagtaaagtcagaagttgaccctagtagtttctactctactgggagcttatgggcagactccaggagtgtctgttaagtgatcactgctgttctgcagtggagctggttaggcagattctcagcagggtagagcctcttgcttaatgcacacagcagcttagccagactgaattaatttagagtccttggcccagaaagttttcctggttctactcatagaacaaggcaaatcacacataacaaaatactttgtttctaggattagttaaaaacaaaaccagaatctcttgtatcttcattataatgtaactccttaggaaaaggatttttatcctttttttttttttttaacttctgtatcctccagtacctaaaattatgcctagcatctattagggtctcaaaaatagttgtttttagtgaacaaaggtcacattttatgacctttatgtattttgtctggatttcctacatcccttcatttgtaatacttagaatcagcgttgaggttcagaaagcccctggagctgaacaattagctatagaatgctagagatcctatgattccttgagtatcaccaacacatggcctcaaggcatggtatagaccatagaaatgtttaaccctcataataagattaaccagaaaacatccttcacaaacagaaactctggattccagtgagcaaagcccacccccagagtcctgcccttttgaaagtagagttagttcaggatggctgagagtgttgggccacagggattaataaacacccacccacaaaggtttgcgtgtaaggtggaccaagttgatagaaagagcccgttcttgtttttttttttttttttaacattttttttggttaaaagtggaatgttaaccatgtgtcaactccaggaatatgtttcaataattcattaatcatttgggaaaataaaaatggagatcttaaagtaggcatattaatttagattagttcctttttaaacaggcgctttataattcagaaagtttatctaaacactcataaatgaattcacatcaactcatgcaccatctattattccatttcagactgagaaataattctggataatctatatgtaaatggcaacaactctaaccaaaaaggtctaaaggatctcagtttatcaactgctaatttcttcactttggggaggacactcattctctctcttcttgctttgaaccatctcttaataaagaaaaaggatcctggggccgtttgctaatagagaaggctatgaaaaccattgttaatatatagttagtgcataatttgaatgacttcctgtaaatgagtttttactaattaatatttttaatagggattctcagcgttcttcagaaagatgactttttttctgccaccgtatgtgtaatgtggcttctctatatttatgacttagagtcatgttttggcctgtgaagcacaataacctttctggagccaagttttgtcagtgctaatacatgccctttacagcccacattccttaattgcatcaaaacactcacctgataggtgagcagtcctcacacccttatgagagaggtaaggtcattggttagtttccatgaagtttggaccgctcttccacacgaggttgcagaagtgctggcaagccagctgagatgtgccttgaggtcggggctgttctggaagaggaataaggagcaggagtccagcccagaggcagctcctgtggctgttgggtgttttactcttgagtctatcaagagcagtaaacgtgacccatgtcatcagagcagtggccgagactccctggtaaggtaagaatctaactgcagctgccttcgttcaggacacttcctccacctgccactcagcaaaaatcaaaatcgttcactgtgtgtaagagtcagtggtgagatttaacggctcccctgaggtggggaggctttcctgcaccatgtcaaatccctggtcctccaccattgctttatttcctggaacaggtgagtgtcctcacagaccaagtagaagcccagggagaaaagattcgagacctggaagtgtgtctggaaggacaccaggtgaaactcaatgctgctgaagagatgcttcaacaggtaagggcgggtgcactgaaggcccttgggtgccgaagcagctcatgtgctgaagcccctttgtgtgcccaggctacagccctcgctgtctgctttcccatcctgcctgggggcgggattggctgctcagttgtacggtgtttatacagcaggtgaaaccaacctgaacgttgagagtggcagagggggtagggaagggaagggctgccctgagatgaataacctgctgagctggttagacagattcccagacagcactttctccagacctggtgcagtgagggagcgctcggctgggggcctcaccctcatcctgtgggtgccatctggagttttagaaagtcaattctcagctgattctatgcccctttcccatctcgctctgcctcttcctactgtatatagtttttaaaataaaaatattatataaataaccttttagtataatttaatagatatcaaaatggaaaaagatatttaactgttccctaccattcaaataatgtcttctccttgttttctttttgtccttgttatgtgtacatgtactttccaaatctgtaatcacaagagatatgcaatttagtcctcagattttgtatgcttaatattatatttttcccatttaaaatttttgctgtattgtcatctttactatcacctataatagattttcttagtaaaagtatcagaattgacttaactttttttcaattcctaaatatttttactgtattataaataatgagctacaattttttaggaaggggtgttgaatttttattgtatcaaaacttcagaatttgttgagaagcgaattaggtttttaaatgaaatgtattaatatatctaatcttaaattttccttaagtcattcttacattttaagttatcttgaaaattaaacaatgactgaagtttatgtgtgtatgccttataactcctggcatagtacttggcacataaaaggtactcacaattacttaaagaacaaaagtttgttccttaaaatgagtggattcaattagaggactacttataatctttcctccaaaagcgctagcattttttttttaattgtcatgatcagcataagactcagattgtttcttgacagcatactggtgaacacaggctttgcattttacctttggtctcatgacaaatgtcatgagaattaatctggtgtttgttagttttgtttgagtgcctttgaagaactttatacaaatgtaagtcagtgtttttatatatatgtcttcataaaaacccgtttcaatgattcaggaacttttgtttgttatcttttcattgctgattaataaattaccacattcttggcgccatttgattttctacttaggttgtgtgccatttctcttgttcataatatttcctaaaaatctgactagcaaaaggaattgaggctttttttttttaattgaatctttcttttgaagacccaggaaagaaaatagcctgatggaaaaaaatctcaaatgatgaaagtattttcacaaagagtgcagaaaacaacctactagattgtgttttcaagtctgcacaaggtgtgtttttgaggtgagaaggataagggaagaagatgatggaatggtgtaaacaatccagaaagagagcaagaacatttgaatacggaagggaacgtgtcagaaggttgatgtttcaggaaggctatgctgggagagtaaccacataatcagaggtcaacagaatgctgcattgtagtgcctgagttatctgactgcctgtgctggcttctctgagccttctctacatagctctctatgacagtgtttctgctccattgtcaaagtctctgtgtcaaggagtctgattgtgatgcccagcaccacctggggagaggctgtctagttcctctaaacatcatcccatggatggcattttagacttttttaaagtcataaactcaattactttttttttttttttttttgagacggagtctttctcagttgcccaggctggagtgcggtggcgcgatctcggctcactgcaacctccgcctcctgggttcacgccattctcctgccttagcctcccaagtagctgggactacaggtgcctgccaccacgcccggctaattttttttttttttttttttgtagttttagtagagacggggtttcaccatgttagccaggatggtctcaatctcctgacctcatgatccacccgccttggcctcccaaagtgctgggattacaggtgtgagccactgcgcccggcctcaattaccttttttagcccgtttattctaaaccctctttcctgtgtgctgtgggtttggtattgggcgtgtggtaccatgtgccatagagggtagatgtcttaacctggcatattttggagtatggtagccacttctgagtttcaaagattcctgaacttgaccaagttatttttctgcccataagctttcattgtattctctcaaactgtcaagggtcaaatgatagcagtgtgcagtgctcctttcttaacaaattgagttcaagccataggacacatctgagcctcatcttccactcatgtgttcgctgggctgggtggcaccagagcttgagatcttttgagttcccagatctaaatccaaagttgaatgttcggccgcacatgctattgctttcctgaagtctgtttgatgctgtttgtgaagacacttgattcttgcaccacagtgctgatgcaatatctctggcttggagtatgtgtgtattctctgagctagggacaggcaaacacttgcctgatttgactgagatatcctgggctgcagggcccttggcttctggtggtaggagcaagaatgactcatggcctagaggcagagaatggaggcaaacaattgcctctttctgccagcctcagaaaccattcctgcctggagccaaggcgagcctgctgctcaaagcctctgaaggaaatcctttcactgtctcagtgtgcgcccttctaactgcctgtagataaggtgcttcctcggggtttgctgctcctgataaccctgcatgctggagacatcctgtctgaaggcagcagctgctgttctactccagttgactgcccatgtaggcctggtaatgctagatattctcatttttcacaagagactcaaaatccagatctaaagagttaaggatctctgcttttaaaatattagcagctaatttaagttttttaaaatgctgtgtgaatcatacagtacatacctataggtcaagcctggcctgcaggcctccaatctgcaacctctgctctagacttggccccttctacaggctggaataactccagggggacttggggaaagccaaatcaatgaggatagcccaaaccttgtgcttaaaggggctccaagaaccccattgagctgtctctctccatgctgctctcctgaccaatgtcaaccttcctccaggagcacaagaggtgaggagttagttccttacctagttcatgaacaatatactcactgtatccccaaccacaacatcctcagtctgtcgctgctcagggctgacctcccaactcccatctgtttttgtctacacatgaactcatccagcctccagaaagagcaagaagacctctcttggggttagacaggcaaatcagaaccaaccagagccagcaaaggggcaggtccacatgagcccacctagattatgaacacttttcagggcaaaataatgtttctgttttgcagcccacggcaggatgtgggatgggaagggaacatgatagctacaagcatctctcaggactgctacaagcagacagctacaagcatctcatagctgtcgacatacacatatagacataccttgtagctgtctacatagacagctacaagcatctctcaggactgcctatggaagcacctagtcagatgtggtcttagactcactgagcatgtctggattgcccaggaaactttccccattaagaagagttatttctcggccaggcgctgtggctcatgcctgtaatcccagcactttgggaggccgaggtggacggataacctgaggtcaggagttcgagaacagcctgaccaacatggtgaaaccccgtctctactaaaaatacaaaattagacaggtgtggtggtacataactgtaatcccagcactttgggaggccgaggtggatggataacccgaggtcaggagttcgagaacagcctgaccaacatggtgaaaccccgtctctactaaaaatacaaaattagacaggtgtggtggtacatacctgtaatcccagctacttgggaggctgagtcaggagaatcgctggaacccgagagacggaggttgcagtgagccaagatcacgccattgcactccagcctgggcaacaagaatgaaactcaaaaaaaaaaaaaaaaaaaaaaaagaagagtcatttctcaaaaggatctttaagggagggacagtctgagtcagttttcactggtctggtattgtctgagcctgaaaatagaactcacagtgctgggctctgcctctttggtccttaagcagatcaaggcattgctcagctgcacagtgaggctatcagaggccagggcccagaattgtacactagggtttccggcatggaccagcgatgttcttgtgactgcctcaaactatgctggcaacaaaaatctctgtatcatggggagggtttccctggtctgtgatataatcgaggcctgtggtggcattttctaaagtagccactgtgagctcactggggtctagtaggttcctgcacaataagctcctctgcctctgatcactgacccttctctagaggaggaagaagctgatgctactcggtggataagaggttttacatggagctggtggtcaaatggagcattttccagagactggccatttacagatataatcaatgtaaacagaaacaatgttcaatgtcaaaacaacacagggaaagggaggactgtggggagcaagtaagggcataatcctgcttttgggaaaccttggacaacaccagcctctatttctatcctccctaccgacccagagcttcagggtttaggcaacttcattttttttacttttaggtgaggttggggagtgacaaatataggggattaagagttcatggatatgggtttctatagatttgctatttgctattgatctgggaaagtcagtgtacctgtttccttattagtagagaatgaggatgacaatatggactctgtattgcctacctcttacttctcagagttatagtaaagttattccactgttattaagcatgagctatcacacagtgagtcaagacactgagcctaagacacaggcctagtagatggctggtaaacttcccaggagagcctttaagcaggtatttctatctcaaagagaatattaaacagagctgtgtacatgttccggtgggaacacaaatctgtctgaggtgggtaagacagtgattcagaagtgaagaaaacaggaatttttcaaatattccccaaaattccctctggggatctatgagctaatgagtttcttcatgcttatcccatgtgatgttgggaatccagactacagggcaaagtagatactttaactccattttacagataagagtgaggttcagagagatgattgagttagtgaggactgagcctggcctcaaactcgagttgactacaagcacctcttctctgcacagtgttactcatgaaagagacttccctgcaagacctgggccttttacttcaaagggcaaagagacttatttttcctttcatgcctttccatggcccactctttcattctggtttcaggttgccagtctggctgcagtcctctgtcattggtcggtaacaccctgggtcatattccacacttaaagatggaggtaattgcttcaagatgtggccctttaaggagagaataggttgaaaggcaaattctttttttcagctttagtcagagcctgagttttggaaaaaggaaatgatgagttgctccgagatataaactttctttcatctcttagaagaagtatttgtccttctgaaaaggttagtggcagttttgtccattgattttttttctaaacctttattacccagtttcatggtccatcacagtaagtaaaacaaaccaccctcccccagaccacctccctccttatttgcacagggaaccttcaaacaattgggagcagaagcagaatgatgcctgtgaagcctttgccccttatcctcagctcgctgcctcccctcaactccctccccatatactgcggtagctgcatgactccagcaggattccaccatgaaggtcaggaagccttcagcagggggcaagcattgcctggcgaggatgtgggtgctccagacagcctggatcagagttgactccagtcttgggtgagaatgagattaagggctccaagaatgttttccttacaggattgacagaataaaggcagccagcaaagaaaatggagaagaaaaaagaaaggtcaggaaaaccgagagcaaggaagattggggtggctaggagtaccttacattgagtggataaagggcgagacagttaagatctgagaaatgcaagctgcatctcaaagtttgtacattggttccaggactatttctgtgccctagttggtgaaggcagaagccaggttcaggcaggcagaaatcttgttgaggagtgacacacacatacacacacatgcacccacacacacccacctactcacccacccatacacgcacacacacccccccatacctactcacccacccatacacacagacacaccctccacacacctactcacccagccatacacacacacaccccacacacacacctactcacccacccatccacacacacacacccccacacccatgcatttgtccagcaagaggacatgggagttgacggtgttagctttgagggcaaggtcaagacggaagtttctttagaatgtcagaaatttgatcatgtttatagcctgaggattgggagctgatggtgagggagagattaaatgcctgccagagtagatgattgatggccctaacctagagtagcacagagcttggtgggaacttactcaaaggcagtacagaagtgagggagagtccaggaccatgtgagcaggagccattctgagttaccagctggagggagaaacaggaccagaactcagagaacagagccaaaggctgctggttgaccaggaagttaccgtaaggtttatcaagttgtatgggaatgtatgaagagtcaggagactgagaaatagccagaaatgggaaggtcagtcaggggcaattcaggagcaaattctggaagcattgtatcctttgatgggtactttttatgtgcacctggaagtattctgaactagggaacagttttcaaaggtgaaagaaccctgcagaaaagatggcaatgtacaattgtcgcagtttatccttggaaaggaactatgggcttgctgtttctaagacagggatttaagatatatgaatgagagatgatgctaggaaactttgaaatagaacttacattcagtgaacagatgcattttatcttttcagcaaatacgaggagagattatttgaggagaagagggagacatggtaggggtttagggcttgagcagaacagaaaagacttggaacagttcctgaaaggagtcagccagagacaaacacaagttttgccaggcagtattggaagatcagctgtaattagatagcacaaatttgtacagaaaccaactggcatcattaattgcctttcactagcaatttttaagctgtggagagtggaatcacgacaaaagactaacaaatgcacatgaggcctgttacagggatgagatcccatgaggattttctgctgtggtatgaatacaattggaatgactcacctcaaggtacagagttgataaggagaacaatgttgcttcaaggaagttgataaaccaggaaaatagagttactaagtaactagtggccgcagaagaaattagaggttgagtgagcaagtgggacagatgaaaggtcagaagattgtggccagaggagagaatttcagagctgaagattttagaagcaaagcaaacacattctggatacacgtgagatccaagtggtgactgtgctactgagaagctgaacgaaatggaaagcaaagcctgttggagctgaggtcaaagaatgtgaagccagagtggatactgaatgggaaagttaataacaaggatgtggaagctattgaggagacggagtgcgcctaaagtaggtagaaaagctgttgatcaagtcaaaagcctgaaggaagtaggttggttccttcggtttggggagaatgtggtataagtgaagagcactgtcttagaatagcaggatagatgcagatggtcggggggcaaaatactggcttggaagcagccctggaatagggagcacagtgttctataagttgggttggtggaagctgagtggtctccaattgaaatgacggggaagaatgtgtaatattgttgaaaaaacatgattcactttatgttggaagtagaaggagcaattgaggatgtaggataagttaactcctattaaagcacacattttagagatcacagttcataatagtggctacgggccttgctggatctggagatggggaagtagagctggactgggataagtttgttgaaggctgattttgagtttagggaccaaaacagtaatcatgacaggggcaaggggaagatgatcatgaaaggtagaagcacatgctaatagatataagctagaagagaataagtaaatgttctgttattagtgaactatatgaaattaagcaacctcaggtttctaattaaaatgttagtgtgtccaattgtgaatgtctgtttggaatgttagtgtggctaattcaaacactggcatgaccaattggaatggctgttggaactagtgaaaatattgtcttcatcagctggaaccattggtatgactaatcacaacctggtagttaaaatagggattttggcaatgatggaagcagagtagactcttagctttcaaaagagatacattatgaaactttaaaaaatcacatcaaagcagtattttgaatgctgatcagaagacaaaactgcatgaattttttttttttttttttttttttttttttttttttttttttgagacagagtctcactgtgtcgcccaggctggagtgcagtggcacgatctcggctaactgcaagctctgcctcccaggttcacgccattctcctgcctcagcctccccagtagctgggactacaggtgcccaccaccacacctggctaattttttgtatttttagtagagacggggtttcaccatgttcgtcaggatggtctcaatctcctgacctcgtgatccgcccgcctcggcctcccaaagtgctgggattacaggcgtgagccaccgcgcccggccttttttttttttttttttaagacagggtctcactgtcgcctaggctggagcactgtggcatgatcacagctcactgcagcctcaacctcccaggttcaatcaatcctcccacctcagcctctcaagtagctggaactacttgaggcccatgccaccacgggtgctaattttttttttgcgtatgtattttttgtagaggcagggttccactatgttgtctaggctgatctcaaactcctggggctcaaatgatccacccacctcagcctcccaaagtgctaggcatgagccactgtgcccaggctgagcatcaccttaaggtgttcaagtactcaatagtggctttgttttattagtaattgtcatgtatctaggcactggcatctggtaggtatttaaaaacatatttgttgaataaaagaatgaagtctcttgggggatttttttttttccctgagatctcagtagtctgaagacattttcttgtggaccttgacctgtgcacttgttccttttcccctttgcattggcagctgggaagctcacatgtacattatagtccatctctagctgtttatagaagtttatggcatagattttctactaactctgactttaacttattttcctacctgctttaatttttatgatttattttttaatttgaaatatctattttgcaaactgcctaaacacattttgggaataaggtaggtaggcagaaggatggagaactagagaatgaggtaataaagaaagagagggaggtagggaaaggaaagaagggtaagagagtaggtggtgtgggggatgattacatcttaagatactcacgtactcaagactcagagactcagataacttattttatgtgccctcacactcagggaagaactgcttaaggccctttgtggcctgcatagccttagcactgggtcctgataggtagtatgtgctcaatgaaatcttggcaatttgagtgggcatttcctgggctcattgaatatttgttgattgcctattttagcatgtttttttaaatgtctcttaaaatgcttggacttctttctctgtttgggaaactgtgatacaatagactaaaatgagttctggagtcaaacagacttttgtttgaacactaactctgcttgctgggtgtggtggttgacgcctataatcccagcactttgggagactgaggtgggtgaattactggagatcaggagttcaagaccagcctggccaacatggtgaaaccccgtctctactaaaaatacaaaatccgctgggcgtggtggcatgcgcctgtaatcccggctactcgggaggctgaggcaggagaatcgcttgaacctgggaggtggaggttgtggtgagccgagatcgtgccattgcactccagcctgggcaaaaagagcgaaacgctgtctcaaaaaaacaaacaaacaaacaaacaaaaataactctgctgctgattggcttgtgtccttggccaaaagatttatgtactctctcttggcctgtttcctcatctgtcaaattgggataatatttattgccaactcatttggagggtttattaagaagatgtatacaaaagcaccagcagtctctggtacagaggaggcactcaacaaatttcagttctccattgcattggacgcactcatctggctgactcctagtggccaagtagcctgtgctctggctgcagtgctccacctctgccttgtgagccagcttccagtctggctggcccaggaagagctggcctccttaccccagagctcggggagctcattatgctgagttgctgggcttcaagagagatacccatcccctcagactagcagatgaacagtttgttgcctacctttcccaggtaggctgttgcccagcctgttggcctggggaatcatgtattccaagtcaaaaatttctgtcccgtgtggtttgattcataatctgaggacggttccaaatctgtgacctcatagtgtttgagtcagagtgttgagattgccattcttgtgctgagcttgggttgcccaagatgatacaaaatgttcagaccatggcaggatatcgtatattttccttctgttcatttggcccattgctttcctggttgctgtgtctattctccttgccacaacctttgtagccagtgtctaccatgtgccgggattttggacctcataggacattgccctttgccaatggaaaaatatgtttccctggactttaggaaatgctcctgatttttgaggtcctttataattcatattacttctaagtgggtgtcttgcctatcatctttattttttaccttgtttatgcttatgaagtgtttttattagtgacaggtttgttgtcaaagccctgggttatttggttatagtctgctactgttctagtgatggcaggactagtaataacctccctggtctgtcttcacaattgggaaagaacaatcttcttatttacattccagagtggccagattgtaattttggaacagcccaggaaagatccatctcacataagattcctatgtaatcattcaacactctttgcacatctactttgtgttctagctcctgtctaggttcattgcagtgaagtcttgtattggaacatgttgaaaactgggctgagcattggttgagcccagaaagtgatctagaaattttggctttgaaaaaaatatattgttaacttaagcgaggacctactgctttgtcttttaaaaaattgagaaatttcgttctttgaaagtatccattcacttttctctacatggaaataatgaataatggtctctatgggcaaacacatttgagaaatgtagctcaccttgtctatcaaagcacagtgggtggtattgggggtgcgctatccctgagtagcccagcatcagcccaggcccatccataataggcctgtgactctcatgtagcagtctcaattctgtgttgttgaacacacaacttaggtgttgccttatgtgctgtaaatgaagccagagctgttcttattgccatagtggtttctgatttcgagatctgtttttgcttgcaggagctgctaagccgcacatctcttgagacccagaagctcgatctgatgactgaagtgtctgagctgaagctcaagctggttggcatggagaaggagcagagagagcaggaggagaagcagagaaaagcagaggtaagggtgagtgtgtactgtcctaagctcagacctgggaaggctgtcataatgtgaatttaggccatctggtcaactcccagcctggaagctattgggtgccagaaatatctatacactagagatgcagtgatctgttaataccaagttatcaggttttgctgtggctgcaaatttcagcaatatccaaaccagccagttttggctctaaggctttatctgccctcaaactgctgacaaggatggaaagagaagcaatagttggggaagaataagacaaaatgtggagggacacaagatgtcttctgtgagaaccaaggaaatgacgacgtaccggaatgaagtcagcctcccaataggccattgacactggatccaaggagtctggaaacgtttcttgacgtgcgtttcactgacccagatggaacctcgggtgatgtgtttctcttttcctgatgggtcttatggagcatgccatgtgcaggccttctcttagagaatgttttcctaattttgtttttcagtctttgtatgccattggctggaacatgccagactcttttttaaataaatgtttagagaattttacactcagagctcctttgagagcaggcagcctgttttaaccttagataaccgtcttcctgtgcctctacctttaagttcttcttatattcacacctagcaatgagagatatgaaagaagataggttttaggtttagaaacacctcgctcatttactgacctaactgcttaatagttctatgaacttcaagctggctacttaatctttctgaacttcaatttctttatctggttaaaatggataactgtgtggtaaagtccaaataaaatcgtgaaagttaagtacctgtcatagtatttggcattttgtgagcacctggtatgtcttcatctccttccttcatttaggctaaagatggatattgttcccttctgataagtgccagcattagtgcatactgacatctgccatgtttgctgagtaaacacactggtgattagaatatttctaatgtgtgagcatgttccttgcattgcttttgagaacatgttcattaattagaagtacagttgccaaaagaagatatccccaataagctgagaacagtagcttgtattgactaagagtccaggctgatgaatcagatctcctggctttaaactgagctcagtggctttgtgaccttggtcacgtaatttaacttcccagacctgtttcttctgtaagatggaggtagtaatacttccaatttctttggttattctgaggagtgaatgagacaatgtatgtggaacccttagcatagtaatagttagcttttattgatcacttactgatagtattgttaagcatgttggaaatgaaaatgtagacatagatacattatttacatattgcaaagtttatacagcctgaaagctaatctgtgtgaagtgctagttgaattaaatgttgagggagaagtaactgaattttcttctggtttgaagtattttaccaatgtttcaacctgcacaattgtatgtgaacatacattaggactttgggggcagaattccataaactctgtgagaaggcttaaagtggcagacactcaactcaaagtcacttaagagaaaaagggaggagagagacctatgtcacataacttgaaaagtctagtgtttgaaagaatacaatatgactagatccgggtaatctcacagtgtcactagaaattagtctcagttgtatcacctggttctgctttagccttattctcaagaaggttctccccaggtggtgacagagatagccatcagtagctccggaatgatatcctgccagccaggcaacttctgcagtcaaagaggtgctttctcaaaggttccagcaaaagcctcaagattgcatctcattgggccactttgggtcatatacctggttctacaccagtcaccgcagggatctgtgcatgaggggtgggaggtgcgaatatgaaagtcagcccgtgtgtggaagtatacagagttagcaccaagctaggataatgcagtccctttacagggacatcagaaaggaaggagagctcccacttctgggacaagaagcactaatgcagtcattttactgtttgcttttttctttcttttctgaaggactatttttaaatctgaattttttgtttttgtttttcatcagtctgttcatacataaggcgacgtagaccctgagtgtctggcctcagtcctaccagataacagcccttcccagttgctagtacaaatattaggtttccacgtggaggaattctgtaggctgttcaaacctgtgataatcagtgagcagccacatggcctgaaacaaattcctcgttcttgtaattgcacataatctttgctggtatgcacagaacttctacctctatttgtgagtgtctggagcaaccaggggtttaaaaccacagggtactgcttaagctgcactattgtcatgtgcatggagatgtttattttgagtgagacattttgctaaggtcaccagaggttgtaattgcatgaataaagggaacgctgcttcccatactatactgctgctgttttttccagtgagtgtatttagcctaagggctcattgtgtgtggtttggaacaggcaggattcttttttttttccccctcaggtgtgagatagccagatctgaaatacagtttctcagcttagctcaggctttatcctcaaattctgttttatgttttaatgaaaagaagagaatgcttgtggcaagagcattgccaccacaatgtcactagaaattagtctcagttgtatcacttggttttagttctagttctaattttagttcacactgctccttctctgattctgatcatagcccaagccagcatcttgctgcttgttttaagttgtggaaatgattaccgacagtcattctgtaagacctagggacttgcaggcgcaggttccttgatggccagccttgctcaagagtgagtagtggcccagatgagatgtgggtgaatactaggtttcctgtttaccttttctcatcagccttttgcaatgattcagggtcatatgagggtactgaagattgggtgaattagacgtattcctgaaaagtaggactacagaagagtgattgacgtggaaagtaaataccaaaatcaagaggatgaagcatgaaagaaagagatccagaggtaaaggaaaacctctgtgtggacacagatcaaagcattgcaaaggcgtgttgctcagatgggccttccccaagaaagaaatctggcttctccatgctgtggaggtgccagcaacctgcagttggaccccactgtggcaactagagggttctgtgaatagctatcagagcagcctgttaagaagggagcagggaccccagatatgctaggaaggggagtcagcccaactgatcaggggtacacgtgagcaagaagagaacagggaagaatctttaggatttcctgcagaaaatggaaacatctcacagcacaagtgatgatgccatcatttcttcttccttgtggttaggaccctgggagaaagggattctgatttctgaactgaggcaacagagtgatggacttggaacacagagtgagatctgggaagattgtgtttgctcagagatgagctggcctaataggagagtttttttattcttgtttttattttctttatttactcatttgcatcagtgtaggaaatatactcccacaattcaaaaatcaagtgttcaaaagggtatatagcaaaaggtctctttcaacacctgtcctccagtcagcagtcaggaagcagtgccatcagtttgtatccgtccagagttatattatgtgtggacaagtacattcatgtggatacacacagacacacacactttccctcatttttatacaaatgtacactattctagacctttctttttaaatttagcagtcttggagttctttttacaccaagtatgttttttaaaacttcctcattcatatctatgtctgcatattgttctaccatccaacaatagcctaatttatttaatcagtcgtctctcagtggacatttaggtggtttccaagtttctgctattacaaataatgctgtagtgaataatcttgtatatatgtaaagatattgatgtggaatttatgggtcaaggagtacatgaacttgaaattttgacagatatttccaaattgccctctctagaacatagaggttatattcccatgagcaatgtaatgtatataaactgagcctgaaaaaagaaagaactaagtaaaattgtgtacaagattaacaggtaagatggaattggaaacaactgtgattatgggaggtgcccagtagtttcacatagaaaagaaccataaagaagaactttaatggttggcaaagtgtgattaaaaaacaaagtgagctgaggttaaaacacaggacagcaattataacctcataaatgccacctagacatcatgatgtggaacccagaatggaacagagctacaaaagggtctgctttatgggagggaaacagacctgttaggaggtgggccagccctggagataaagaattatgaagctaggccaggtgtggtggctcatgcctgtaatcccagtactttgggaggctgaggagactggatcacttgaggtcaggagtttgaggtcagcctggccaacatagtgaaaccccatctctactaaaacatacaaaaattagccaggcatggtggtacacacttgtagtccagctacttgggagactgagacatgagaattgcttgaacctgggaggtggaggttgcagtgagccgagatcgtgccactgcactccagcctgggagacagagtgagactccgtctcaaaaaaaaaaaaaaaaaagaattataaagctaagttgaaatgccaagcctgtggacagacataccagaaaacaatgacaacacatggctcaggagaattaaggcagagtagcccagaagttttgggtacaccacacactgagcagagggatgaaaatagatgtgttcctgatgcaggtctccaaactgactgatgcacacaaggggcagtaatggagggaggggagtagcaacctatttgttagctcctaaatatctcccagctgaattctgaagcatttgaatgtttacttgtttgtttttctcacttgctttcactctactcagagggtagaagacaaaactaggaaaactgcctttctagctccaacattgaagcaaaaggagaaactggtttatgaagtaaaagtgataggtaccttgagagaaagtggtcattgttatttgaatgttcacgagagtgagcatggaaaaactaggcataaacagacatgcactgtagacttgggtaaatcataactctgacaatttaaaaataaaatggatggggaactgtcgaatagaggaagacccaagaatattgaactacttaaatataattctgactgtgcaatctcacagataataccaataaaaaggaagagtttagaggtctcttgaaaggaagtagttttcagaggggcttctacaaaaggcagaaaggacatatgctaaagacaaaagtgcacctgcatgaccagtgtcaggaaggggacatccgaaactaaaggacaatgctgaggacaacacaaagccatacacacacatacacacgcacacacaaacacccacacacagttatgttcttaaaaagaaaaaatggacttgattccatggatgcctctgacagatacaaaaaatttaggacaatagtcccccaaagtgcttgctataagttaattttaaggaatcaggaaaatcaaatgagttgctagaaaactggaaatgaaccatttccttcttgattttcaaaatggcaaaagtttgatagattcagtaaattttagtctgttgagtttggggccaactctatgatggtttgcaagaagggaggagacaaagtagggatccgtgtcctcaaggagtgagtctcgtcagattggccttatcggtttggccgggaatgtgtcgtgtggtagaccaggtaaatccacatttcagtgaagtgttgcaaaaacgttgcttgagataatcttgtagacaggatggaggaatagaagatgaatatactgaaataggcatattgatgcctgagttcagggtttgggtacatattgtcatggataagtgtgatgtgtgccatatgtcccctgtgcataggtgctgacacgttgggtgtttgggtaaggggagtcggtgtgtgtatcatgcatatgtggagagaggacgtgtttgtgtgtgtgccccagtgtgcacccatctctgctattgcttctgcttggatgaagagtttcttctagactccatgcctcggtgttgacacaacaatatggcacaaaggagctgttggggatttgttcgaactgcaagacaggcatctggatggggcaggcctgaggaaaaatgccatgtcttttggttctgttgtggaaagtggagggccgtcgacagtgaccactgagtgccacctgctccctgccccatgcacacttcctctgtgctgttctcttaaggagttctgcgtctgagagctgtctgacctggagtgcttttctcttctttcttttccttcctacagtcggttctgaatgtgatcagtgagctgcaggagcagatgtgtaggctgcagctggacatccacaggcagattcaagagcgcctgttactcagtagggaccaccctgaggaggtggcggccagcgacggtgtggccgagccccagccctgcagccaggactgtgcctgttgggaggggtcacctgtaggaaccacacttaagtatatcagagcatgcgtgtgtggggcatttcactggtggaggggctggggtttctcctaaccagaacagagtgcagtggcttggcatggatctgttgttacctctgggcagagcttggactcactcaatcctcttgggatgtgaggtgagctcagtgaccctcactgagcagggtctgagcaggtgaggccaaccctcaaacaggtggcactcatctcctttagggctgggaatgaggtgcaccaggtgctccgagtgatggggcatttgtgccacaggaagcctcatgattccccttctcaggtatgtgactcagatactgattcctcttcccaggctgggagattaaacaaacttttgtttcacatgattttttttttaaggaaaagaagtattatgaaaaagaatcctttcaagtttatgttcaaagaggtttacccccagtgaaaaaataaaatacaagttttcatatgctgtgaataattaagtcatcatctgaatttccaggaaaaatcccccccacataatcacatcagggtgattttataacaacagggccatgtggggctctatctgactgggattctggacttggctctccacacgggggtaacctggtcctctgtgactttgctgatggcaggtgatggcagcttcagcagagataaccctatgcctcgaaggaggcctcctgttgaagaggacttggaagccccccaagaaaagaccgaggtcacagcagccatgagtactacagaggataccctggctctgtaggaagttactatggtccatactcaattagggagcctgttgaaaatctagacataggtgttgcgggaagggatttggttggaaagatttcctgctgcattaaaggacagcggggaaataggaaagtcaagatgtaaatgtagacttggatagagaagccttgagagggtgttggcgcatgacctatgttgagtaggttactccagcaagacttttaaaggaaggaaaaacgtgtgtgtactaatgttggtagtcaatgatggacaacaagtaacatagaaggaagaggatgttccagaggtcacggagcctggagaggatgatttctgtatacccacagtggcagcccctcaggcagtaggaacctgtacacttctgattctgatatcagctggcctgacaccctctccaacaaactgagtaacctggctaggatacaaggctgagcagaagaaccctcaacttgtgggcattggagcctctcaggcagggccaataatgtcctcagagaatgattctgggtctgctgcaagtcaaagcaggtatctgaggccttgacatccagtgatgcagatcatggatgcaataaccttagctgagaagttttctttttcttttttttttagctgggattacaggcacttgccaccacgcccggctaacttttgtatttttagtagagatagggtttcaccatgttagccaggctggtttcgaactcctcatctcaagtgatccacccacctcggcttcccaaagtgctgggattacaggcgtgagccaccatgccatccagaagtttttttttttttttttttgtcttgtttttaacgggcatcagcatatgctcacctcaactagaaggcaatcttaaaaaatgaccctacaaaattcaagggtaagcaatgtcaactttgtggtggattatctcagaaggccaagacctccaggccagttaaataatgacttaagtttcatgtgtgcattcattgacaaatagtatacacctactatgtgccaggcactgcaggataatcagaggttagcaaatacctcatggagtttacagtttagtaggagagctagctattagctgtcatacaaataaatatttaattgcaaattatgtaggaggtacacagagtacaacaagagaatatagcagaggggcctgatatagtagggaggtcaggatagctttactcagggagacctgaaggatgggcaggagttaacctggcagaaaattccagacagagggaatgttgtctgcgaagacctaagttggagagaggaactgaaaattatccatgtggctagagcataactagggagaaagagtgatccaagaggcaggcagggagctgtcaggtcacgggttgaagtttatgagctttgagaagcatgggagtgccatgatctgatgtatggtttgatcatatcactcccccagatgccatggggtcagttgctttgagaggagcaagacaacagaggagcaaccaatgaattgactgtccaggctgtcagtgctaattgctagaccagagtggtggtgcctgagtgggaaagaaatgagacattcaagttgttttcctggaagtagaattaataaagcttggggacgaattgcatacatagaggaggaaggacagggagatgcagaggatagatcctatgtttctggataggccgttagatagatggatatggcatttagtgagatgagagtaactaggaggggagttgagcattccacttggcacctgacagtccggaggtgcctatgcagcatccatgtgatgttaagtaggaagtttgttgtgtgagactgcagttcagaaagcctatggaagtaattatctttatgccagttcttctgatgggagctagtcagcaggaccaattgtctgttaaggaaatcttggttcaagataacagtgcttagtggagtcatctttatagaaggagtagtttcacaaacaagggtcctagagtcagaatatatgggcttgaattccagctccaccacttactagctaaatgagtaagagaaaattgtttgtgtcacttccccactcagcaaccttcagtgactccctactgcccaaagaatggcatcggaactcatcatgtgtattctcatcctcaagcctttaccttagggcctcaccttaacttcccagcctcatcttccactgtgtgcctacaccctcagctctagccgcatgagttatctccctttctgtctcctatctttactcctccctggatgccttctccctcccttctttcttcaaatcaatctcttcctctgaactggaacacccattttggcatctatatttggcccttaacatttgttcccttagggttcctctatgaggcctttcaggatcacaggccccctcttctatcttccttcactcccagcacagagagatgctcccaattagcctgctttctactactttgcatcacagggaagaagctgcctcatttcagcatctctattcttcccactccgaagcctcgcctgcctgcctatactcatgtgtgtgatgttggcataccccacagaggacatagatgtcagagaaaggggcaggcagaacaggttctaaaactaaaaggaaagttttcactttcttatgtctggaactccctggcctttgttttttaacggccatacagctttcctgaaacaagggacgtgtttaaagattaaagctgttatgtggagcttgatgtggttgctgcaccccatatgcatgagcttaaccaggttggtaaatcaagagcacatcttttaaccatcagaactttgtctttctccctcatcccctaggagttactgcaagagctcaggcacctcaaaatcaaagtggaagagttggaaaatgaaaggaatcagtatgaatggaagctaaaggccactaaggtaaacggcactcctgatgcttatggagagagtatgagggccttgtggggagggtctgcattccaacttgggggtttccagtagcctaagtttgaaaatgcaaatcaaccctccagtgtggacacacagcagtgcccagatggtgcagtagacagacttgatccaggaaagatcctcatggagaatgcccgtgagattatgaattggtcaattgtagtaacccagtctgcttcctctccctgcaccccatagcacctggctgaagctgggccaagaaggggctaggagtggggagagcaggtgagtggcaggcagtgaatcatgcgtcctaaagcagatcttggatgcatcattttaaattcagtagtcccttctagaatcagtttttcaaaaaaataggcatgctttatatttggcacaaaatatattcctaaaaatggcataaacttcgaattatttcttcaatcaaatcatgtttctcttaaactagggagcctgcaatttaaaggacaccaataataaattctattgtgaaataaatttcttccctgtcccctttgtttcttccttcttttcctatactaaagtgcagagatcaaaactagtgggttacattcagcccatgaatttttttggcctgcacattggattttaaaacgttaaattgttatttaaatttcaggaagtttacattaggctacagttaggtttcctttgggagtatggggaggtgggaggctcacacctgccttcccctactgtgtctgcagtgccacccaagggcattactggatgtttttattagagttttcttaacttctagtttgtatttttattttttgtgcaagttagttgctaattattataaaaacaataacacacactatagagaattttcaaaccataaaaaattaaaggaataaaaagcactcataccacccaggcactaccattgctaatatttccttccgtgtattattctcttctgttttaggtctgtgttaggccattcttgcattgctacaggtaaatagcttagactaggtaatttataaagaagaggtttaattggctcagggtactgcaggttttacaggaagcatggtggtcacatctgctcagcttctagtgaagcctcagggagttttcaatcatggcagaaggaaaaagcaggagcaagtgagagaaaggagaggaggtgccacaaacttttaaaccaccagatctcgtgagaactcactcacagttgcgaggacagcaccaagagggtggtgccaccattcatgagaaatctatccccatgatccattcacctcctaccagggcccacctccaatatcggggattacaattcaacatgagatttggcaggaacaaatattcaaacatcagggtctctctatctcagtgtctctgtctcttaatttttattgttgataatttacatgcaattttataacatgctgttacttaaaattttatgacttctcatgttatcaaaagaaagcactgaacatatataaatatttatgtaatctagtgtataaatataaaatcatttgattaaccattttacagataatgaaatggatgtacagagagattaactttcccaagattttacagctatttggtaccaagcctgggcagtcagacccatctgtgtcctggcctgtgtgtatctgagtgtagttttgtatgtgtatgcttcacaggcaccagctctaggggcactggttttgtccagtagctcagaaccttccatcacaacaccccactcaaacaagccctgtcttggggaaacctttgaagttgtacataccgccctctgtcataaaaccaaataacacttttctttttaacaccccagctctttgtcttggcatgtagacctttgagatgctaagggttatttaataactaccaggtgtggagcacttcctatgtgccagaatgtaccaagctatttgcacacattttatcatccataaaatcacccagtgaggtatatgtttttttattctcacttgactgggaaggaaacagaggctcagcgtggccaagctgaggttcacatctgggtctctgtcattcccgtgccttcatgctgtttccaacatcatcctgattccctgcagagaaaaccagcactgtttttggaagtttttcacttttctgcttcaggcctctcagtctctgaaggggattcatctcccagtgcaatggcagtagggcatggtccctgggtttaatgaggcacagcacttgcagggacccagagcatccgtctctgcccaactgcctgtctgcatagctatctcagaccttgtgccacacagccctagccatggtgactgtggccataggaacagtggcagtagcatacacagtcaagtagaaggtctctggactgttcttggccttcccaactgcggagacagagatcgctcaaaggataacagagcacctatagtttctggcctatttctgtggaaattggcacaaggcaggttgggcccagtcacttggtctgtagggtccatggtatatacctacaggacctcccatagaggcagggctcaggaaggagagccctcatagtgccacgtgctagattctctcttgatcggtccacattgctgaattcccaactgtggggccagcagacaagcatcaggtatccagatttctaacagagacgagtgcccatcctgtccacaaagaaagggagaaatgggcatggagaggtgcaagaaaagttaaaggaatatctttcaagaatcatctggcctttgtagaaatggaggttgagagtcccaaagctaatatcttcagaagccattgtcaccatgagtcataagcccatgggcatctttgccctgagtgagctctgataaactgctccatagctgcatgtctcagaaagtgggttacacagcaggacccagctcttggcctctgtgagtggagcccagagtggagggacagtgcttcattatgaactttggaataaggaaaccctaccccttgtcatctctttatatggtcatccctgtcccatttgggggatgttagggaaggttattcagaaacccttgcggtgggctgagggagcccaagcctggtaagagtggccttcatctgtcctgttaactcagaagcagacacacggtggtgggtggagccctgacattggagcaggcaggccagggtttgcatcctggcctggtcaccaagtagctctgtgactgacacagaatcttgtactactcccgttttctccctgatgacttacggagatattgtttcctcgggtggttgcttgtgaggatttgatgtaagaaagcagtgagcacgggggctgatcagggtgcgtgctcagtccatgcgctgaaactgaacacaaggcctgtccagcaacagagttgccaacagggccagtactcatttaattacttggggttggtcagatattaacttgggcctttgtggaattgaacagcccatactataaccttgaggaccaaagtgggacatgattgggccaacacatggggaaggggtggccagaggagaagcctttgctgtcttttattgaccggctccacggtcgatgctcatcccttttcttacctggtttgatgctgagagaattgaaccgattatccacaaagaaaagaataggatgagaggagcaaatagcagtagcatttattgagcacttagtatatactaaatattggactaggttgttgataaccattatcttaaacctaattgcagtcccatgaagtaggtgtagtttttcccattttatagatgagctgagactcagaaaggttaacttacttgctcaaggtcacccaactaggaaatgagagaatcaaggtttgtttgactccaaaatccaggtacctcttcggacaggacctatacaattctgatctcctgatgagtatgggaaagcatgaacaaccacacctagtgttgtgtgtggatttaacctgcactacttaatggcgacatgggaaccatctagtgcagctgcctgtttgtgtgcaaatatgaatgtatgtgtgtacttatgagctgtgtatacaatgtttttttttgcaaaagtatgtaaatgaagcactcctgaatgcttgtacatctgtatatgagtgagcgtgcacacatgcctggaggttgggcagaggcagtgactgtacccaaagggtaggagcgtgtggagggagggagcccttggcttaccttttcttcagcagtggtgatttggcttccgctgcattttctctgtgggttggaaagatgaaaactgcatgcacttgttatagtggtgtctctaaatgttactgtatgagtgagtatcttgggagaagaaagaccatgtccagaatatcctcctctgcaccaaggacagccctcccattgcacacaatcccagctcctcatcacaatcctaatcctcacagtgcaggggagagaaactggtcaggtaggaagatgcaggggaagaagcacattgatggccagagccgtggggagggccaggatggcctagaagagtgagttcactcagcagagttccacctgtggagagggcagtgagcccctgctcctgctcacctcttctcctaactcctgatgcaccctggtgcctgatggggtctggactctgacgggaggcacttcatcatgatttggcagtccttctgacctggtagggatcctctgttgctcttccaggctgaagtcgcccagctgcaagaacaggtggccctgaaagatgcagaaattgagcgtctgcacagccagctctcccggacagcagctctccacagtgagagtcacacagagagaggtgactagcttgactctgacaaaatgcagttgtctgggtccctgggtctactcttataagtgagcatgtgtttctataaatgagtgtgcatatgtgcttgtgtgtgtagccatgctaatggacatgcatgtatgtgtgcaagcgtggccaagtgaatggatgcaccagtttgtgtgtttgtgtgtgtccctataatgcagcgctcttgtggaatcattcccatggaaccctcccctaactagaaggtttttctcagatgcacagaagttctgtgcagccacctctggagcttttactgaaaatgtaggaaatacctaactctttcatttgactgaaaggccttacttttgtgtcatcaccaaaggggaggctttagaaatttactcagtcatttcatggatacctgcctgatgcctgtataaggccctgagactacagaaacaagtcagttctttttcattcttgagatttcaaatcttacttctcagaaagacctttcttggccaccctaactcaaataggtgctcccagtcctattattctctaattcatcatccttcctttttcctgcctagcacttattataacttaccagtgttgtgtgttatccccactcaggggtaaggactatatttttcttgtttaagagcatatctacaaagcccagcacaatatttggcccattgtaggatcctaagaaatacttcttgaataagtgaaaggatggtgaatggtccctgaggagttcaagtcttgctgatcaaaaatagaggataaatcctcaactactgtaatgaacacataaatctttatggctgtttgccatgtatacaaagtgatcatacacctttcaacttgtccactgactaccaggctgcagagcaatgccgaagatcatatagtcctacggattggtgccactacctagtcacatcctggcctcagcactgcaagcttagcttggatccccagctggggtgtggaagccatgcaacaatggcttaggctggagaaggaaattagtgatcaatgtgctcgtccctctccgagcttttctcagtgtccgcccaagccactgggtgtgttgcctacctgccaaggcctgcttgtagaggctgggttctactaagacaccctggactatctctgatgctaagcctggacagagagtgccccatgccacaacttctaggccaggcagccttcccagtctacccctcctcttcccacagtctaagcctcccaggccctaccccactccattactgggtactttctagagctggtccttgggtcatttgctgccgaaggtaggttctgaccagtggatcagggttggcagtcttcatctagagcttactgccctccccagcaaagtgagctgcagagctgatgttagctacctagagcctaaataatgagcaagcaattctccactttattctgaaaatgaatctccacaactatttacacaaagtccatagatctactgttgctattcttgttagatacaacaagcatcccaaaagaaaatgggaggcctatatatttgttcccttgtacttttttttttttatatagacatccctattcccatttaggaagaggcatagatccttctttgaacaatctagctatgtgccaattcctagagtatctggcaaatgacctccagcttccttaggctcttcaaaacagttaaggaatcaacagagtccctcttgggtccaaactgagagaaggccttggattttccaccacagaccaacagagatttctcagcccatagggaaattctggtttatgatgaaataagattgtttatcctcaacccagcatttgcatatatgtatatatcccaatacatctaaacatttgttagtcaattttgactatatcattttaaattaagccaagtaccaactcttttacataatttttatttcccagtcttcactcaactgtagatttttttaaatgttaaattctcctcttcctacaatttgtcagactgtatgattttcttcaaagccagtcagaagcccaggtgcatgcctactcaagttgtaaaggataaaaatgtctatattcttaggagatgttggttttgaaagatttttggcttcctctgtcctctcgagtacatgggcattttgattttgcccataaatgtctataaagagaagacagagtactagcttccttcatttagtagtctagcaaatatttaaggaggccgattctgtagcagacaccatcccggcctctttaaagaactaaaggagccatgttcacatggcaagtcttcatttgaacttgggggacatcatagcaagtgcggatagctgtctgtatttatataaataattatttctatacctgaattcttttagaccaagaaattcaacgtctgaaaatggggatggaaactttgctgcttgccaatgaagataaggtaagatggtcattgggtagccctgtcttttccatgcttacatccctggctgtgtttggtccctgctggtctctgatattctggacaggaccatgcttatcatgccattgacatagggatatgtcaggagaatgacttgtgccttctagagacttggcctcagccacctgtttttggctttgataactggaaagtttgtctaaatggaatctcctaaaggcagattatagccctgcctgttcctgctggtgtggggggaaaaaaatactgctgtgatcactgccaatatcatagctcctgctggaactcctagcacaacagcccaccagtctcccatgtgcatgacctgacaatagaaccatcatagagacacttggcagtatgcagtgcctcagtttaccctgccatcttatatccttcgcatctaatttcggcacagtcataaatagccacctctataaataaagagtgcctggctggtataaacatcatctctgaggatcacaaccctgcattttacagatgaggaaacagactcagagtgcttaagtaatttggcccaaggtcaggtaactagtaaatagcacagccagctttcacacccaagtttgtctatgacctgtgtggtctcccaagttcctttcaaggcctttgccttgaaagaaacgatcttctctgggaatttcctctgtagtatgaggtatctcagactcctagggaacaaatgagtatattgagataaatatgacagctttattttagtctttttttgtgtcgctccagagggcaacactaggaccagaaggcagatttcaatggccacttcaggaaggtagggagacagtgagtttcgtgcttctgaaaatgtttaagccctgtgaagggtgtctcagatgactcacagtcttcaggtagagcgtgaatgcctgcagatgcctatgaggcagaccactgaaatcccagctctgtggaatggggcctggacactcttttcctttggttccacgtgggatttcttctccttgtgccaagaacatagcgtgggttccaaaatgaaatcatctgagatgccagcatagcattaatctaaatctctacttgcactatggcaggaccgtcggatagaggagcttacggggctgttaaaccagtaccggaaggtaaaggagattgtgatggtcactcaaggtaagagcaagggcgatcctaccgttgtctctgaaagatattccatcagctgtgttaaagccaggggcagttctgctagcagctgtttcacctctgtttcagagaagactccctactggagaacagagctgtttagacttttctgcatgatgagaacttagcagttgttgatttccagaaatactaccaaatggaagtcagcttagggccttcagggactatccagatcaccaagaatataaagcttgtgaattccccacccttggaaggtctcttatgcatcttcccaggacacgccttagaggcagcaagtgcagttaaacctggatcaaaaatcaactcagtgccatcattggggattagagctcatccacctcctagaaaatctaaagttccgcagcagactcagagggccctctgggagccttcctcgagttgctgggcctgagttgctataggaagtcacaggacagagagagctgctgtgttttatatttgctgcccagactgaatgcaacatgcaagcagcatcagggttcttatgggcatagtggtgcatgtgccgggctgccttcattgttcatgccattgacctgggctcccatcatagatcctgaggaagcagctgtttcacagcacagggctgctttgaaggatattcaggaacctctgattctggctgagcttctgctgcttcttgggaagaagccaagcctctgccaggatgtgactgactggtcactggccagggcctctgccagccctcacacacagccctcttttttttctctttttgagatggagtgttactctgtcacccaggttggagtgcagtggcacaatctcagctcaccgtaacctctgcctcccaagtttaagcaattcttgtgcctcagcctcctgagtagccgggattacaggcactggccactatacctggctaatttttgtatttttagtggagatggggtttcaacatgttgaccaggctagactcgaactcctgaccttaagtgatccgcctgcctcagcctcccaaagtgctgagattacaggcgtgagccaaagcacctggcctcacagccatctttttaagatcatgggtcaagtcactctcagggccttgattgcctatagctaaggagtgagaggtttggaggcaggggtacattacctctgttctgcagataaactttgaccttgaaatgatcctgatgccagcccttgctcagatgccctgaagaatcttcagaatcacactcttactgtccctttatatatttcttagtccttcttaatgaaggagaaacaatgttagaattttgtggtacgattataggtttctgaacatgaattcaacaattcagtcttactaccttaatgcttgcagggccttcggagagaactctctcaatcaatgaagaagaaccggagggaggtttcagcaagtggaacgctacaaataaggaccctgaagaattatttaaacaagaggtactgtgtttccatccatgacgtagggtttcagcaggtcctccgagcttgccctgagcttgagggaggatctagtcagacacgtgtcaggtgcacatcttggcaggtgaatacttaaattaatatagtgcccctcaggctgtgatggggatgggcgagcaagaggctgaggctctggcctgtgctctggttggaggcagcatggtggatactggaactttcaaggataggagttctcctttttaatcaggctcctagtttatttttatcttttttttctctggaatgtaagcatagaccaaaggtgatgtttgatttatctaccaccctttctccaaggtctgcagtaatgcccgatacccagtagaattcaacaaatatttgttgaatgaacgaacatgtcttgctcatttagaggaattaactgcaacctctgaaatgccgcattcctgcttgacagatacgcccttcagcccctatagccaggacacagattttccttctcatctatttcgtttgtttaaaatctggtcctattgtatgaatctctctagacttaagctagatacaaataaacaaataaacaagacctcaggtgaaggaggggcttcagcctagggtccaaaagattcctgaaaacgtcacactatcaaattgaaaagaatcttagtgcttcagttcaacctttttaattaaggagcaaaagcatcatccagtgagccagttattgactcagaacaagcaccccagattgctggcaattacagaatagcggtgtccaagtcttaccaagtcttactggatacctccacgtggtcactgtgatgaacattgtatctggcagaatatggacttgaacccaggtctgaccacaatgcccaggtatttaaaactatactataatgccagcgttgttgttatagtagaccaagaggatgctaggatctagagaaaagaggcagtactggagacatgggactgtcttctttcataacctccattagctcaaggtggctccgcctgtgatgctaggtgcactgctgaaggcacagtgttgtggtaggtacaatactgaagacacgggactgtattatttcataccatcattagctcatggtctttccccctgtaatgttctttcctttcttgccttaaccagttctcatttctcaaaattcagctcagcttttctcctctctaaagctttctcagccttccctctggtgagagggagcccctctctcccactgttcccatattgtgttacaggtgttggagccataagagcattgcacattattctgttatcctagtgtacttgtctgtctcccagatgtggggagtgcttgctccagacctggcacagggcctggcagggagtagatgttgctgatgtttgtcgggtgaccatatcaaatgggattttctcattgaaagcaacaaaatttggctctggctaacctaagccaaaaagaatgtttttaaaagagtctgcagtggctcgctgaatgaaaggaaaagctgaagaaccaagatcagaaagggaaggagcagaaaaagcccaagaacccaggtctcaggactgtactactgggatatgaacatgatctaagctctagggtccaggaaggagaggcaagctggcccagatggactgataagcctaccacacccccttgcatcttgaaagagcaaggcatctataatgatgtatccaccatggctgcacccagggaggaaatgtctccctaaaaggaatcatgtgaagcagggggaaagatggtgggtggtccccaaacagactgtcctctaccgtgactcttctgtctctggtgcagatgcctccaagatgtagctctcctacagtggggccacctccattgccacagaaatcactggaaaccaggtaagaggcctgggcatttccccacagccactgtgctctcaggcttgccttggggctgccgaagtagatggtgatgaccgtgaatggtgagcatggccactgagtcctaggtgcacctgcccctctgttgttagggcagttacaaaccaggcctacctcttttggccacagaagggcttctcatccttcaggctgagggtgtggatcattgtcactgagaaaggatctggccaaggattagagcctcagaggagaggtggctgcaactcatctgtgtcttatagcagctcctcagagctgagagcatcccgtgatgtgtgttccttttgtcagcctctgcctcctgctcttagagtgaatttagccctttgacagtcgaagctttctagggaaggccatgtcttctcatagcaattggtctaattgctttaaggatgcttcacaacaatgaactaataatgggctcgcctctgaggtcatttgactgccatctgtcttgttccctctaaaataaacctaaatctagttccctatgtccgtacttcagcacacattttgaaattgagccccatgtaagggagacatggaggcttcactaccaaggtactggcaaccactaccaggctgcctttcagctaaggtgttggggcagatgaccacaagcatcacagaaactccccagaatggtgctgagtctccagagcctgcactctgagtccactttccagaaagcagttgttcccttgagcctttagcccagaggaaaatggtaatgttagagaagttgatcaggcagtccttagttttggagaataagaattgtggtttatgagttcactgagggaaaggtcaacaccaaggaactcggactgaccagatttacaagagactaatattttttaaaatgatgacttactcgtataatctgagaaatatgactgccaaggagacttggcacaggttacccttgtgaccactggtggcattgcctcttgacacatttggtgcctttctctgcaaaatagaccctgagagagccagatgagtctgagcagactagatgggcatgcagatccagagcagagtgtggcagggtcctagcaagtgatgttctggagccatggctggttaatgtgttcatctctactctaaggaggcccaggtccctcctccctggattactcttagactcagacaagcccagcatcagcacctttcccctcttttgacactgtagaccttggccttttatgaccgcacaattgtcacctcagtgcagcagaattgagtgtattctggctttttgtgcaatgccaagaacatttcatttggatttaagtgaccctgtcatgcccttactaacacattattggaccagtctgtcccccaaggtgggccagtctcattttgtatgtaaaggctattatgagagggtatttttttttcttgactttgaacctaagcccaagaccatcggttaagcatttgaaatgtcctctgcatgagtgataacatgtacctccttctcataactatttctttcttttgtgtttttttcagggctcagaaaaagctctcttgtagtctagaagacttgagaagtgaatctgtggataaggtcggctcatcaacctatccttaaagatgactgagttacttttttgggcctagcatagtactgggatatacaggcaggtcctggtccctaccttgtagaggattttataaagttgtagaggaagcaggaattacatgaacattttgagaaaattaactgggtgtggcccaaagcatcttagaggaaggacaattcaggaaatgttgcctggagttgatgagagaagatgttgagatcagcaaagcttggttagagtctgctgagcaatagcaggttttggaagatggtggagagtaggaggaggtaaggtcagagccatgagacagatcaagccagggaagatcttgactactagtcctatatccctggggcacttggggacatcgtatagatttttttaatgatgaattaatgtgaataaaggagatgatcccaaggaaagatgtgggatcgtcaggatgttggagagtgagctgttgtaagagtctggaaagatggaggagggtcttgtggctccttatataggagtagcccttgatcatgtgggtggacctcatgctgcaggggacagtagcaggctcttgagcttggtcattagagaccaagggagcctgccctgatagagacccttcagtgagcctgtgctgcataccatcccttggtctccaataatgttcatcagcctccttgttgatacagtggagaaccataaaggctgaagtctgcaggagccctgggatcattcagtggctctgctcccatggtcacgtgtctctcggttgccatggtcatgttgctggcagctgcccaggacatctgtccatggagttggacagggatctttcctgccctggatggtgattacttgacatgaagatgtggagggaggggatgcgcctttcagatttaagcaaacaggtagtcctgagttgttgctgtttgtgaataacacaagtctctttttctccacataaacgaaatcctcatgttactccatagtgtatggatgggaaccagcccttcccggtgttagaacccaaggtacattgacttcgtgccccgtcgtctatttgtggttacactgtttgctagtattttaatttagcaagtcatagttttcataaccttaaaatgtgccaactgtaaggagtaagagggcaagaggaaagacgcaacttttctctcccattttatttttatgtgcactcagctatttaatatgcttttgctatcattatctgtgggacaggatttattattatcacctccattttataggctcagagaaattaatctttaacaaagtaatctagatttaatcactgggaaggggattgctacgatctcagcacactgaagaacgtgacagctctcatcctttctgtgctgatatgtcatggttaaaaaaacacaagtgtacactcagtcccgctttgatgaacaagttatgttataaaaattccattaggactgatcttctccagggaagcctgttgtggaagaggattaagtttttaggccagtgcacaaaatgttgagcccataaagaaatgaagattcatataattagcatgatttcagccacacccaaccaccatttataacattatatggaaaatgtattgtgaggctgatggcatttcccttctctgtcccctgcctccatgtccatatgaaacatggagcttctcattgcttgctgacttctgcctgagagggtcattttatattttcacggtaaaatggggcatctctgctcctccacatctgcgtaagagaaagatcttttctgcacgtctgcatctatataaggggcttctctactcttccatatttgtagcagttggttcttcaagtgggcagccattccttgggccatctgaactgtatagcaaaagtcttctgcctgctcccctgcccaggtgctctgcaacacagtcccttgagcctggggttggtgtggtccctttgtgaactgaaaggcttcctatggcgtcagctgttaaatcgctcagcagtcccccctcccacctcagcgtcacagaggtcattcgcaggtgtttctaaagcacacctgtaagtgaccacctgctcctttggaaacacacccagctcacaggctcaaggtttaagacgccaatttgattaccaagaaatataagtaacgtagaactatttataaagaaaaaaatgctccagattaaaagattaattcttacatggttttggccataatcacaatcttatacaacctcagttattcaacatgaccaccctcccctctcacccacatacaccaccgtcctccccagaatagctacacaggtgcagaaccgctccacagtcatctttctgcagcatccctaactgtagtgtctggcccttgcttaaactggctcttgctttctgtgactgagagctcatttcattggaagacatcctttgtattcttttgcagctgtgtgagcttctctaaaatgtgcatctgctgatcctctccctccacatctagcccatggaaaaagtcaatctcccctactcctgacagctctggaatttaagtccctcatgccctctctgagtgctctgttctctgggctgaacatcaccttctcatgtgcatggatcacaagccttttaagctgctacttagtcttcttaggctcagcgctagtttctcaatgtattcttcaagttctgccctggaccagacttggagtgtgatattctagatgtagtctgaccagtgcctgccgtggtctaaggactcctcttctagattgctatttctttaggccctgggtatgtgatatttcctgtgcttctccttatccactgtccgctgtgtgctaggccctgtggatatgttatttcctggcaaacctgaggtaggaattgttattctccatttagaaatgaccagaggtcctgagaggtggaagagaaacagctctgtctgagttggtctgactcaaagcctaggccctttccactctggcatgctgcttctctgttgtaatttaaagcagctggataatcagttctacactactcccttggctggggcttctgttcccctacagccaggaggattgttctttttggagacaggagaaacagaactggagttgagcatccttgtttcctctgcgtcacgtcttgacattgcactgccttccacatcagtgagtcatttcttcccagcccttattcttggcctgagcagagctcagagagccctttccattgtccttgattcctttttgctgtctttcttacaggtcggggctgccttttaaaccccatccttgggttaggtatgtgttctccttgcatctcagctcctcagggagctccccgggtggcccacttgcttccttggctgtctctgccctgccttgagggagcatgcgtgatgatgcaaccagaaacacgtttttgagagctcttcccccctccatatgtcgtatataatagggagcttggagtcatgcccttcaggtctctaacatctttgaacactaccttctcacagtcagtggttcctgggtctgactgcattagtataatctgagataatctgagatccttgttaaaaatatagacatctggggtgtgcttccagagggactgaatcagggactgggcactgggaattcatgttgttttacaagtgctccaggtaattatgaagagcagccggcacatgaactaccacttggaaactgtgggtcttgaccgtatgtctgatcatgtctaatcttcacctcatgggtcatcacaaacttgaaaatctcatagccttcctctctgaaggttctagttacttctactccaccagccagttctttcagaattcagtttcctctcactgtatctctcctttctgaactatttatggggagttaatagtcaatgttcaatgaatgaactgaatctcaaacaatttctaggacatatgtttataagcaaattgaattggaaatatattggatatttggcctttagctaaatggaacttcataagatgtctcagtcacagcagccttccattactgttgtgacttgccagtttgaaatctgttttgttttttatattactttcttcaggatctaatcaggtgatccacagttgattcctttagtgacattgcttcaatttctcttttcttttattctcactttcacagcacattccactgtgtttctctcaggtttgcagattaagagaggccattgtatgcctctttaccaaataagtgctatcttcttcctcatttaatcaacttgtttctttgggacctttccatggccagggtccaagcatggagctggctgcactgaggctctacctcgtgcagactatgatcctaagttcccaaaggagctttgttggcatgtagtcctctggcccatttcttgttgtcagctcccccaagggtgtgtgtgtatcttcatgcttgccttaacatgatgttttttaagaagccatgatcacaatatagggattttttcttcttttgctccacatttaaactataatttcccttctgtaccatagccgctctcaggcaagatccatatcatttatgcagttggtcaggccctcacagagatctgcccttttctggtctgagtaagggttccaattagcagaagcacctctctcctcaccacaggaaagcaaatctgggggaaacagaggagcccagaccagactgagctcagtttcctctcttgcaggattgttattttacatatatatgtatgtatgtatgataaaacactaggcagcttttattagaatgccaattttcatatccaaagagcttacagagtaattcacggctgttaattcattgagtctctgagcactaggccagacagcaaaggccgctttgcaagacagcttcacttcctgttagagtcagtttcagtcagccccagatttgcacttgactctgtccctgtcttactgtgtggccttgggaaagtttcttccttccttggaactctggtcccctttctcggactagctaaataatctttgaggggtgttcaagtcaccatatgtgaaaaatggctcttgcaaaacagggagttgttctgtatccaaggatttcctaactgaggctgacagttaagtcggtatctctctctttctctcaccttccaataggacagccctttcttggcggagcacaaatatcccactttacctgggaagctttcaggagccacgcccaatggagaggctgccaaatctcctcccaccatctgccagcctgacgccacggggagcagcctgctgaggctgagtgagtgtccagccctggtgctggtggcctctgagcagtgtccttggcactttcaatgattgtataagatccctgcacctaccaccacaatccacaattggagaatggtggggtgggtggctggaacaagttgtaccttggggtggtcccacctccccagaggctccccctgggcgagctgttttctaaggtcagcactctacagtctcagcaaaccagggtgtgtgtatcccctacttcttttcggctgcagcttttcacccttatttcctctcttcttctcttcctcctctcgaactctttcctgtccttcctagcattgttttccctcctctcagacacccccttctacccttcctgcccctggtgcttccttcctctgtcattctgatcttctctctcctgtctccaccttcttctctgcagcttccctattccccgtaggagggtatcatgcactccaagtgggagcatttccttaggcaaatgaagtcagtggccaatgggcaagggtgtcggtctgcaggtatcctttcggtgcgtaagacctgaaaccacagaggcttttgctgcttttcattcaaaataagccatctttccccaccagcagcaaaagattcaatggccccggaagggaacattctggtcctggcagggttcttcctgaggctcctcagcctcagctcttccctgagctggcccatgcattggcctagtgaaggccagctctgccgttggctgcaggaacttcagataaacccttgaatgagtgtgttctagtgacactcaaactggactcactatggcttcagattgttctagtctgagctgagtgagcccaggcacctgcacaagagctgcctgtggcctggagtattcagcccctgctgctgtcccttcctttccctgggtgtggacacctcagcctgtcacaaaggggccccaggaacacttggtcccctcacatgaaacctcttctcagtgtcagtcaccactcaccccctccttctccatgggattatttttctttctgtttgagtttttctctcttgctcgatgacactcttttgtttatttctttgcttccccgtaactctgttgggctggactttggcctctcttgtttcttcatgtggcttctctgcttcttggttcactggagatcgtggccggagtgtcagtgcccccgtattaggtactgtacccattccaggtgaggtggagagtgagaatgcctttgtttccctaccctaaccctccccttcaccagcactcagccagggacccactactgcctgcgttcctgcatctccctctgaggaaaaagaagctgcttgttggaataatccacaagtactttggaccccaaatccttaaaattaaagacattagctcacctagatttgaaatattgagcacactaatttctcagcaaggaagcctggagtccccactagtctctgggatcttggtatggagttctgccctgaaggcagaactgggcagattctctggactcccactgaaggggagggcccaggcttggggaagaagggttccaggggtcacatccttacattcacattcattgccttcttccaatctcaggagacacagaaagtggctgggacgacactgctgtggtcaatgacctctcatccacatcatcgggcactgaatcaggtcctcagtctcctctgacaccagatggtaaacggaatcccaaaggcattaagaagttctggggaaagtaagttggtgccgttgatcctaattatattgcttagaatttttctttttgattgggcaaagagtctatgtaagcccctggtccaatagacactgaaacagcagtcaaaacagagtgttcatgttcaaagagaagaatctgagatattttccagggccaagagaaggagaagtatgaaagacacccattgaatatatccagttgcctttcatgtcatgcatcctaagcacccacccattccacacaccctgaacataatctctgcagcttatattacattggatctggcacagacacagatgagactgtattctcccttcttaggagtcagtctgttttaagaaatctttgaaaaacctttgaaagccaagtacttgctggcccaactgatccactttgtgacatgaggcagaaactggggcctcctacaaggcatcaaactttgctttgacttctatggcaagtgaccaaatcccagaggcaggatccgaattgaggcttgagtctggccaaggagctgcgacaggttgtgatccttgatctctgggaaggtacggagaagcagtgctgccgagagtccctgtgctggcctgcatggccttgcaaaagaggaagcacagtgactgtaggctttctgactattccatgaccgtctccatggattcttctccatgcagaatccgaagaactcagtcaggaaatttctacactgacacgctggggatggcagagtttcgacgaggtgggctccgggcaaccgcagggccaagactctctaggaccagggactccaagggacagaaaaggtaaggcttgacccactttcctttgatctccctgctctgaaaaagaagtatctcccttcaaacctgcatgggtgaatctttactcctgtgttttgcggaaacccctttccatattctcttccccagtcaagcagtccctacagtacgtcatttccagcacaatatctcctaagttctgagttactcagccaagatcagtactcctggaggtcttccacaggattggaatgtgacattttatatctaaccaaaaggcaaaaagtaagctgtaactctcttcagtttagtcacctcaagattgccatataccaatgcagagtacaggtaattactggttatgatatgtatcattcagatgtccgttctcagaaataatatagtctagattccaattaaggaagaaaagcatttccctaaatgcatcatattgtttgcagacctgcatcccctgcggaagggagtcttagcttattttgcacatggatatgatactgcacttccctggcttgccaaacaggtttctagtcttaccaggtcctcctcgtgcatgagacctgggacctttccagatccatttattcttcgatgagtatccccagactccaggaagcttgaaaagaagcatgagaatgtgtagaccattagcttttagaggctagagaatctaaggacatagtctaagtaagtcagagaccaattcagagcccttagaaagtgagccagggaaagctttacctgtatattcaataattagatattctaatttacttggcaattttctcaatgtagacattactgttgtttctgatttatctgagctgaaaaaaaatcaagctatagtaagcttgaatgattgatctttgttttaattctggctagttcttgaaggattgactctagaaggggaatcattgggtcagggtataaaaactttcctaagacccctcagcattgtccctagagtaggagagcatggttagggagctatctgtattctgacagtcactttagggtatggggtgaccagggtcagtagctttctttgccaaaggaaaaaactgcagttccagccacaggctgctttgttcaaatgtctttgtgctttatgaaccgtaacagtggatgagaaagggaagacgtatgaagaagtcctgatgagattgttatgtttatcgtaatggtgcaaaatgaatttgctcgtggaaaagaaaggccttgtgactcttaactagaaattgatatatgttaatgtcctctggtgatatttataatttctagatattaatatttaggtgtagctttaaaactgttgttgctagtattctttaggaaaagtactttgatactgaaagcctccagccccaacctttttttgttcaataaaacaattgatttttttttaaatatgatatttgataacattgtgtaggcactctctctcagattatggatgaacacattttattttctttcttctcccaggtaaagttttacagagttacattccagtcagcactgctggacagagtgcgcctattacacccacatccttgtcagcattgagtagttaaatttttctttttcaaagttttctacttttatgaacctccaaatttcctttttattggtaatttagttttcatgtttgtccttttaattcttttgtgaattatctgcatttttgttcattattattattgtatttcttatagatttctaactgttctctattaagatattaagtcatgtctagtaattgtgacaaagtatttttaggtttgtagcagaattttacttttgcttctgatactttgatacatggaatttttatgtttatatagaattaggttcatccactttgtgaattctttcatcattttgttttaaatttttttctgtgatttttaaaaactttgaataatccatttaggaattattatagtttgtgagtttattatgagttactatttttgagaaaaaggcagtaaagtataatgtttaaggcaaacaggctctagagccacatggctggatcccacctttgcggagtgtttttttcctgagttgatctactgactgtattgcccttcaggactccagctttaggagaggtccccaatcctactgctcccctaccctgggccccattttgtttccttttcctacacgcatggtgagtcagattcatcatgaatgtaaagatgcttaagcttcagggaccctcctttgtatggagcccttccagggtccagagaaagtctgatcatagtgttaacagggccaggtgttttgaaaattttgcctaaaaaaggtattttaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcccgccactgcactccagcctgggcgacagagcaagactccgtctcaaaaaaaaaaaaaaaaaaaaaaaaaaaaaaaaaggtattttaaacacaaccagttttaagactgctgactatttttactgcaactttcccttggtctatacttttccttgtaacagatggtgttagggcagctgtgggggttttggaggacttgctaaggggaagttgacctggggatccatgtagtttgggtttaggggggtatgtgtgtgcatgtggtttgcagtcactgcatgtttagttttgttaggtttaattcactagctttcctactgcacaaatggcttccaggatttcttctacttcccattgtgccgattcgctcagtgctctgtactcactaatgaactgtaaattataaatgtgccatgtgctctccccctactgtgagaagagcatatttgagaaatctcagctacatcatttgaactgcaatttgaaaggatgttttggaatgtgtcaacaaaacaaatggtttggctgtatatgaagggtatcttctctgtcatctccaaattatttcccagcgtgttcagtggtgccctggctgaggatatgggagatgctggcactgagaggagctgaggaggaggtgcagaagctgggtctgattctgtgtgaacacctcaaggcttaggagggaggagaggattcgcaaaacaaaaaatgggaagactactggagatgatgcccagagctctaggtggttttgaaaaggtcgatagcacagaggttttccaattatgatctcaaaaacacttatttcccctttagagctgaaatgttaggttcacaaagactaggcaaaaaataaaagttaaaaaatttaaaaaagaactgaaatgtccctcagatatgtttgtttttcccacttccaagaaacaaggaaacaaatgaaataaaaaccaaatataatataaaacaaaagtgataaaatgagcattgaaatttgagagaaattattctttcttacattaaaaaacaaattataaacaaaaaatccagatcacaccaaaagcagtaatttgctaagagcaagaggtaaggtttaaacaaaaggagtgagtagccctctagattgttgttcatataagatgaatgatatgaatccattgggaaaaggttgaaatttcttgctgagtttacatgatgtactgacagtgacaaagataacataaaactcatgtactgccgcaaggacatagacaacacatgagttaaatgaactttgtcaattcaaagaatgtttaagattagccatagcgttagaaaacttgaatgcgttatagttttacaactcacatataaaagacatttgatagaggcctttctaaatttaaatgattctaaaaatgtacgtgacaataccagttataaattgtgaagataaaacttcttaactattgtcatagaagataaatattgatcagtcatgctagaagaaagactaaatcaaccgtctgttgtcatagaatatattataaagttgtggacatacaaagaagcagtcaaagagtatccacccaaaatacaagagtaaagaagtactatagctggatacagtagctcagacctgtagtcccagctacttgggaggctgaggcaggaggattgcttgagcccaggagctcaaggctgtaataagctgtaattacatcactacactccagcctgggcagcaaagccagaccccatctctaaaaataattaattactaacaccctgtctctaaaataaataccccatctctgaaataacaaataccctgtctcaaaaaagaatcaaactatagaggtacatcaagattttatataatgaaatatttctagattttgtgatttttttttcagttttgcaaaacttgcaattttttgtggcttgttttctaattctaaatattccctttgtttctaattgtatattcaaattttatactattttgaagagaaagtttgtaagttccaggcctcgtaaaatattttcaggacccatgaaagcccaggttccagattatgattgatcagtccctgccccagggtatacattatctctaacatttgatctaaaatggggcattcttatcatgcttatcctttgaggaattccctcactttaacaacagctcaaccaggcatttaaaaaaatatgttttaatctaatatgttaggggtactttgaaggaatctttctggtctttgaaggaatatctacgatattctataaatcctcatttatgaacataaagttgctctgtcgaatcccccctaaaaaaatgactctattgggatttttagtgtgctattcacactttaaatgaaaaatggatgtctttaagaattgatggctttataaaacccagtcatcctgtctaggaacataatctagcttttcatttattcatgtccttttttatctagctcagttgactgctgcagtcaatacctctccccacccccgcaatccccacacataatcacacaaggccaaacatctcttgttaaggcaattcctagacgttttataatgttggttgctatgagtgggatttttaaattgttttaacagtagcattagtatctgtgcattgatggtattagaaaattattgatctttgtatgtaacatacgttacatatgtttatatgtgtatttcgtaagtggccacctcactgagctttcttgggttttctaaatgggcagtcctgacatctgtaaagaatggctttatttctgcctaatagctatacttcttgttcttatttatctctaatactggctatgactctcagaccagtgttgttagtactgatgaaaaatatattgtccttttattgactttaatgtgaatgttcctcctgttttgttaataagtaatgtgctagctgttgttgattggcaagtttttgcttttagttttgggtgttttgttttttttctttttaatgttaagagaactgaccctcttaaatgctaagaaaagtagttttctaagcattttcctaaaaagatgattccgcctaatgaggccacagctctggacttgtggcatgtatatgtgtgtatgcggacctaggacatgtgaacatgatctcaggagggccatacaggctgccccattctctaagtagcctgagatttgaaattcagatcttgtgttattaagaaaactctagggtctacctcctatgagtgtgttgtagtggaattttgttcagcagaatcccatgatggaggttgtttgttaaaaaacaggttttttgttttgttttttcttttcttttcttttgtttgtgagacatgattagattcagaacctcaggctctcccactaacaggaatatgctgttttcctgcttcccagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggtaagggctcagcttggggagaggaggctcccatttctccccaaagcatggggaggccagggtccgccactcctgtcacacatacacacaggaggatggatggaggaggctgagagttcctctgtagctgcaggttggcatcccagggcacggtgtggagatacactgccatactcagagcatctccacccagacacagctttctctgagggccaaattgcctgccaaaatttcacatgtggtcttcatcttttaatttcaggagctaggaattaagcacccactccacaggaagaagcttgttttagcagtgaaagccatcaacaccaaacaggaggagaagtctgcactgctagaccacatttgggtgacaagtaaggataggcatatatgtattaagaatgtctctggcagcaactaagagtagaaagaattttcctgttaaatgggtacctcaaggacagctgtctccttgtaaaaagcagaggaattactaaacttttgggggaataaaacgaacctcaaaatataatttgctcccctttttttggtgtctacattctctcattctcatgaatcctgacacatctggggtttttgtatttgtagggtggcttgatgatattggcttaccccagtacaaagaccagtttcatgaatctagagttgacagacgaatgctgcaatacctaactgtggtgaggactttttctttaaatatttcagttgtccctgtgagcactcagctcacgtgtacccatggtggttattttaaacttgattccatatattcttaaggccttgaaatagtatcatttgtcacaaaagaggtcccaagtagcagagtacaaaccactgtgataagctattggtgtctccacgtgcaccttcctgagatgtggttgacttgtctatgcttggtctggtgagggacatcaggggtcttttgtcactttggaaactctggtttataaaccaaactttcctctttcagaacgatttactcttcttaaaagtcaccagccaactacatcatctcagcatcaaatgtgccattcacgtgctgcatgtcaacaagttcaacccccactgcctgcaccggcggccagctgatgaggtgagaccacaaatagtatctctccaggtagccctgagccaggacccctgaaacatcgagcatgagcaaacaagaatgacatcataaaagcactgttttttgcaccatggtgcctgggattcttttgtttgcttgtgcttcctgttgccccaaacatccgttacctgcactttgtgtctcacagtagccatagacctctaagctcccaccctccactggggagacacatgctataaagtcatcatagtgattaaaggagatgaggagatggtgcaaaggagagggggagggaaagacaaaatggaaagatgggtgtcacagtagaagagaagagaagagacagaggagggggaagaggagcccgtagaagctagacatttcagaataggtatccctacttgtagatccaaaattaactgacttccaggcccaggtacaggggatccatgagtagtcttgctagagaagaaatagtatacgtaaataacagcaccccaagtcttgaagaaataactgattatgttccatgaacttcggagttcttggtggacccccaaactgaagattgtcagtcacatcctatctcctctgttcctgggaactaggtctaaccttgctgtaaaattaactcagcttcctgggctgctacctttgctgtctatctcctattttctccttattcaaccaacatgttttgaatgtcttgtatatgtcaggcacagcgctgtgcatttttaagaccacagtgctacgtgagagcacttaggaataagtaccttaaggtgtgctcccctaaaatcattggccacaccagggagatctttcatctataaaccacttggattgtaaaattgacagtcatctttaaagttctgttgaatcactgaaagaataactataatgtcctcatttatttgtctcaaagttagctggaaaatgatggagtaacagaattctggattcagatatctcagtgtggaagatcttcaaagattcagtgggagctctatttcctagaaactggggaggctggtgctctggcagatggggtgggtcactaagcttgagggccttctattgttgtgatgcgtctggggcagggttacttaccggggctgactccacagaggaccatggtgggacctattaagcctaacttcctcactctccttctccctctgacagagtaacctttctccttcagaagttgtacagtggtccaaccacagggtgatggagtggttacgatctgtggacctggcagagtatgcacccaatcttcgagggagtggagtccatggaggcctcattgtgagtggctctctggcctagcccacctgccttggtgcaaatgggatattcagaaacttatttattaaggacaaggcacaaaagctaacgaaaaaaaataggtacttcatctggaggtcttgcataatttgatgtctcaaagtattttgataacttgtccttgagaattaatatacctcatggaagcaagatgccttctggcagcacctccttggcatgagacttgaggattctaggtcgatgggttgcatggagaccaacgcttacaaggcgagggaacagcagggctgaggaagggacggggaagccgtaaaaatgcagcttcccacttgctgcaataggatccctatcactactcagatctgtcagtggcaaagccagaggggaaatgaggaagtgtggtggcttggatgtcatccagagaagatcctgagagacagcctcaccaaagaggtcccagttctctgctggtctgtgaaaacaaggtggtcagtcagcacatgtgctagtatgtgctcagagccaggccctgtgccagccagtgagtggagtgggactcagaacaagtgactgagctcctgtccctcctctggaggcacccccagccccaacaggccagtctctcagcatcctccccctcgagccatttgtatttgctcctggccaggcttgtctctggttccttcttagatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccgggtgagttgcagagcctttctgggtgggccctgggctgcctcctggccctcacgcagcacagcacctggcgcgatgcccacagccagagcagcatgcgcagcctggacaaagaggatctttcagcttctgctgtgggcttgtggtctgtgaggccagtctttgttaagccagttctccaccagtttggagtccaaggaagacagtgcaggtttctttacctagaaaatatgtgcaggaagcacctatcctcaggtggcttagagctcgtcctctaccccactgctgctgtgactcaccttgcagagcggaagcgctccgagtctggctttccttcggtcaggcctgcctgcgtgccgcaatgccgtgggatcttggtcaaagctgtcctgctgatataggaagtgcttccaatggaagctggttccatttgtcttgtttcgtgaagtggccagcacacagatacccagaggtccccaggtctttcaagcaccaacactactcactggggctcccagaatcccacaaagccctttagacctgcctgagccacagcatcctcagaccacattcttcccagactacagaccaacaggcaacctctggaggccaggctggtcctatccctggtagtgttgatgcttcatgcccagctacaactcaggcacagacctccttccccaggggagcaagacaggaagtatgtctgggggagtcaggcagaaacagtgctggatgacgctagggcagggagcaacctggggctatcctacgcgcctttagatggtgccaggtgctgagatgggaaagggttggggtgccagcagctgtgctgaggcaagttctctgtgcttcgcctcaaatgcagacctcaagtacattctaaaggaactcccagttcatctatggaaataagaaagtcactttggtggggcagccaggcatgagtttcaggcatagtattggaggggcagctcttattgttcaagattatttacctattggcctttctgcagcatagaaattgcttccaagagctctgttttgttcagagtctttctaggagcagtttacattattcctctccttgagtgcctgctcttaaattttaagtatattgtcagtcatacctgcacactgccttgattgccttctcataatcttgcattttctgtgttttagccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaagcagctcaccatatctttaactttgttggggaaaaagagctgagggtagctggaaatggagtcctacggattgcagagctgaagagccggtggcactgagcctagtcctcagccaggtgcatgctcaggattcaccaggggggtagagcaaggcgggaccccctcccatagccttcagaggaggtccgtggccgcactgcttcagaatttgcttccctctgtgaagccgagggggcttcaagtctcatgcacatcctgaccatagggtccatctgtcgtgcagacctcaaagctgagtgctttcagtggcatgagcccccccagtgaaggggatggtggggagacaagaaggcaccttgctggaaagactctctttcatgtgttttgctggcttctctattactgacttagctaggctcataaccatggtgggggctggtctgtctgctggcagaactgaaagagatctgtccccttgatttagaggctgactgactgataatgactgataatggctcctccagatgggccttgtctggctgggactgaggtagagatgtgccttgccagtctggactcctggtcagaagactctagtttgcccccaggcagtgcttggctcccctcaatcccctgggcctcatcgcagaagagtaacaccacgtcaccgctgtctgatggcctgggcacggcctgatgactccattccattgtagcactctgattctgtaccagatggaggctatgctaagatttgcttcttaaactaccagcagcctcaggcatggtctgttgccacaggccactgcctcctgggaggtgagagatgtggggacaagcttgccagctggcaatgctgctgatagatcctggtacccaggtccactggatgacaagtgctcattcaggctgatgcctggccactggagttgtagagccagtcagggcaggctttgtcccttgtttcttatgttgcggtacagggatctctgcatgtgcctgttttcaaaacctgcatggaactgttgtgccactgattctctgcaccctcaagtaagtcctgttccctttgtgggcttgttttcctacctataaaacaagggaggggttacacttggtgccctccaaatttacagaggatgtttccaaatctacagtgtctaagtaggtttagggaaggaggaagagaccagcattacctgagaaggaggggcaggagggaggctcttgagtagtgaggaaggatgcccacctatgtcagggcattggtgtctgagctcctgttgcctggtagcaggagtctagcatcctgaaggccttcattcctactgctctctgctcctggaaatagctggaacattgaacacgtgcagaagggctgcttctgacaagcttgtgtcttgcctctgtgtaccctgaatgccagttcccagtggggccccaggagaggtatgcatgcagtgtgggacattgatgcctttccccaggaaacaggagcagcatgtgctccacccacctgtcactcctcagggcctggcccactccttgcctgtccctccagagaagcatgccctggagaagccaggcttgagcacgacaggacttgcatgccatctctctgaatcacaagctgcatccatgtgtgctgaccaggctgctgcccattttacagatggcaccttcggaaggtaccgtgacgcagatagggctcctctcccaagacattcaccgccttacggtaggactctgaccctctccccacagtcagactggtgccagggaggcccagtgagtttggtgtggtgtggtgtggtatgcacaaggcctgggggacggcgaagaatggtgcttagtgctggggtcacagcctgagcctgagccagccacgaggcagaaagcagcccaggggccttctctgttggcctgttactggaccttgagcccctaagggcagtggggaggctcatcggctgttagccaaagccagctaaagcacactagatctcaggtcctcttcccaggcttagagatgaggaaaccaagatgctcagcaactctagatcacctgtctcatcagcctagagcccaggctgcatcctgtcctagtggacacttccaccctctgcccagagacatatgcatttcctatcgtgcctctgactttgtgggtatcacagagtgttgacaggcttgtgagcacatcctggcacgcccgaaaggacaaaccatatcatggggaagcagtttggcctcgaaaagcagctttggagtgaggctgaagtccctgctctgacttcactagctctgtgaccttggatgtcattctctcctgagctttggcttagttatctgtaaagcagggctaatgacatcctccttgccaggcttataggcagactagagctggcaggaaaaggccagccacagagcacaggatttgtttttgaggatccatcactcccaaggccttttagttcttggacattccatcactgagcctattggctatagtgtctgtccccatcgaggcccctgtccctgtactttgcttgcttgtctagcaaggcccattgggatgacaggacaaggacagggacacacgactctccttgttttcaaggacaaaacaggaaagtctccctgactccaaacaggatcagttttactcaacgtttttatttattggcccacccatgaaaggaatctgcccacacttgcccttatgatctaggcctttggtggcctgaaaatagaaaatttatttctaagatgaacaatttatttttatcttaatagtgttgtttattctgacccaatactcagggtttcttgggacactataaacttatagtgcacctgtgtcagatgcagccctcacccagtgccctctagttccggtgcagctgccgcagggcagcctggaccaaaactctattaaactgacccttcggctgtgtccttttcagacaatgctgagccaggaccagctgctgaatgactctcgcctgcctgcccccaactctgatgactggagatgactttcttcgtggctgagagcgtagggaggcatgtgtgggggccccggagcctttgcttctgtggggagcgggcacacagccccctctgcaagcccagtccgggctggcagggtgtctcagacaggctgctgacaggcatgaagcagagctgtgggacaggtgtccaggggtggccccagggtccatgtgtgtcttcaaccatgctgcgctcttcaccgcaggcttcataccttttgtacttttatacgtggactgcagaccactttgtgggagggcagtgacatatcagcacacagactcgatggctcgtgatattcctggtgacagcctggaggctctcacactcgaggggaagagctgttagttcataaaacctgctggaaaaaaagttccgaaaaactgttttgaatgttctgtagagactgtgttttgtgaaatggtcaccaggaggtccctccggggctgcttcacagaacgtgctttttccattcttgggactgtggctgggcaaggcaggtgtttagggtatgagcgggtaaagcaacgaggctccttacccacagcactgcctgactctatctcccgtcatctgcaaggggtatctgtgcgactcccagcttggagcagaggcgtccccaacacgtgcacaccctgccttctgcctccacccaagctgacacacagcctcctcccaggccttgcccttggagcagctcaggcgtaatgtctgattaaatagctcccccaagtggaaggcccttgagcacctcaagctccgtgtttccaccccaactcaccaacttcccaaacatgtctgtttcctctccactctttagtccttcctccctccaggcgtctgctcaggcccttccctcactagggaatgcatttttctcctagtccccttcatgagggaaaatcctgtctctcaaggcacggcaaagagaccatctctcaggaagccttcccgcatgatccagttacaggtagctctcccacagtgccgtgtctgcccttgagccagagcacagctcaccttgaagtttcttgtcgtcttaccatacccgtcctcaccacaaacttggagcacctgctctgcactggctcctgtagacagtcctccagttgccaaggagatctgtgctcctaagttcctcatccacccactccttcgcatgtgtgtgttaagaaccttccatgccagggctagagatacaggcatgaatgccaaggtccctgcctaaaggtgcttacagtgtagtggagtacagaccagtttcaaacaagactctgccaaaggttacagatgctccaatattagtttctgcagcctaaaagagcatgttgtcattttttttttattatactttaagttttagggtacatgtgcacattgtgcaggttagttacatatgtatacatgtgccatgctggtgcactgcacccactaactcgtcatctagcattaggtatatctccaggtgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaataatgctgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttttttcttgtaaatttgttggagttcattgtagattctggatattagccctttgtcagatgagtaggttgcgaaaattttctcccattttgtaggttgcctgttcactctgatggtagtttccttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacctttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttgttctgttccattgatctatatctctgttttggtaccagtaccatgctgttttggttactgtagccttgtagtatagtttgaagtcaggtagtgtgatgcctccagctttgttcttttggcttaggattgacttggcaatgtgggctcttttttggttccatatgaactttaaagtagttttttccaattctgtgaagaaaggcattggtagcttgatggggatggcattgaatctgtaaattaccttgggcagtatggccattttgacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggaattcactcatgatttggctctctgtttgtctgttgttggtatataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaataccttttatttccttctcctgcctaattgccctggccagaacttccaacactgtgttgaataggagtggtgagagagggcatccctgtcttgtgcccgttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcgtggtttttgtccttggctctgtttatatgctggattacatttattgatttgcgtctattaaaccagccttgcatcccagggatgaagcccacttgatcatggtgaataagctttttgatgtgctgctggattcgttttgccagtattttattgaggatttttgcatcaatgttcatcaaggatattggtctaaaattctctttttttgttgtgtctctgccaggttttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtgcattcagagattcaacttcttcctggtttagtgttgggagagtgtatgtgtcgaggaatttatccatttcttctagattttctagtttatttgcgtagaggtgtttgtagtatgctctgatggtagtttgtatttctgtgggatcggtggtgatatcccctgtatcattttttattgtgtctatttgattcttctctctttttttctttattagttttgctagcagtctatcaattttgttaatcctttcaaaaaaccagctcctggattcattaattttttgaagggttttttgtgtctctatttccttcagttctgctctgattttagttatttcttgccttctgctagcttttgaatatgtttgctcttgcttttctagttcttttaattgtgatgtcagggtgtcaattttggatctttcctgctttctcttgtgggcatttagtgctataaatttccctctacacactgctttgaatgtgtcccagagattctggtatgttgtgtctctgttctcgttggtttcaaagaacatctttatttctgccttcatttcgttatgttccaagtagtcattcaggagcaggttgttcagtttccatgcagtcgggtggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaatatgtatattctcttgatttggggtggagagttctgtagatgtctattaggtccacttggtgcagagctgagttcaattcctgcgtatcctttgttgactttgtctcgtttatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactagggttgcaacccctgcctttttttgttttccatttgcttggtagatcttcctccatccttttattttgagcctatgtgtgtctctgcacgtgagatgggtttcctgaatacagcacactgatgggtcttgactctttatccagtttgccagtctgtgtcttttaattggagcatttagtccatttacatttaaagttaatattgttatgtgtgaatttgatcctgtcattatgatgttagctggttattttgctcgttagttgatgcagtttcttcctagtcttgatggtctttacattgtggcatgattttgcagcgactggtaccggttgttcctttccatgtttagcacttccttcaggagctcttttagggcaggcctagtggtgacaaaatctctcagcatttgcttgtctgtaaagtgttttatttctccttcacttatgaagcttagtttggctggatgtgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttccttcgtttcaactttggtgaatctgacaattatgtgtcttggagttgctcttctcgaggagtatctttctggcgttctctgtatttcctgaatctgaacgttggcctgccttgctagattggggaagttctcctggataatatcctgcagagtgttctccaacttggttccattctccccatcacattcaggtccaccaatcagacatagatttggtcttttcacatagtcccatatttcttggaggctttgttcatttctttttattcttttttctctaaacttcccttctcgcttcatttcttttatttcatcttccatcactgataccctttcttccagttgatcgcatcggctcctgaggcttctgcattcttcacgtagttctcaagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttctgttgttggtgaggagctgcattcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgctgtgtgaggtgtcggtgtgcccctgctggggggtgcctcccagttaggctgctcaggggtcagtggtcagggacccacttgaggaggcagtctgcccgttctcagatctgcagctgcgagctgggagaaccactgctctcttcaaagctgtcagacagggacatttaagtctgtagaagttacttctgtctttttgtttgtctgttccctgcccccagaggtggagcctacagaggcaggcaggcctccttgagctgtggtgggctccacccagttcgagcttcccggctgctttgtttacctaagcaagcctgggtaatggcgggcgcccctcccccagcctcgc

SEQ ID NO: 344 - DNA, 288468 bp, Homo sapiens
ctgcacaccaggagattatatcctgcacctggctcagagggtcctacgcccacagagcctcgctctttgctagcacagcagtctgagatcaaactgcaaggtggcagcgaggctgggggaggggcgcctgccattgctcaggattgagtaggtaaacaaagcagcctggaagcttgaactgggtggagcccaccacagctcaaggaggcctgcctgcctctgtaggctccacctctgggggcagggcacagaccaacaaaagacagcaataacctctgcagacttaaatgtccctgtctgacagctttgaagagagtagtggttctcccagcacacagcagcttgagatctgagaacaggcagactgcctcctcaagtgggtccctgacccccgagtagcctaactgggaggcaccccccagtaggggcggactgacacctcacacagccgggtactcctctgagacaaaacttccagaggaatgatcaagcagcagcatttgagattcaccaatatccaccgttctgcagccaccgctgctgatacccaggcaaacagggtctggagtggacctccagtaaactccaacagacctgcagctgagggtcctgactgttagaaggaaaactaacaaacagaaaggacatccacaccaaaaacccatctgtacatcaccatcatcaaagaccaaaagtagataaaaccacaaagatgggggaaaaagcagagcagaaaaaccggaaacactaaaaatcagagcgcctctcctcctccaaaggaacgcagctcctcaccagcaacggaacaaagctggatggagaatgactttgacgagttgagagaggaaggcttcagaagatcaaactactctgagctaaaggaggaagtttgaaccaatggcaaagaagttaaaaatttgaaaaaaaattagactaatggataactagaataaccaaagcagagaagtccttaaaggacctgatggagctgaaaaccacagcacaagaactacatgatgaatgcacaagcctcagtaaccaatgtgatcaactggaagaaagggtatcagtgatggaagattaaatgaatgaaatgaagtgtgaagagaagttcagagaaaaaagaataaaaagaaatgaacaaagcctccatgaaatatgggactatgtgaaaagaccaaatctatgtctaattggtgtacctgaaagtgatggggagaatggaaccaagttgaaaaacactctgcaggatattatccaggagaacttccccaatctagcaacgcaggccaacattcacattcaggaaatacagagaacgccacaaagatagtcctcgagaagagcaactccaagacacataattgtcagattcaccaaagttgaaatgaaggaaaatatgttaagggcagccagagagaaaggtcgggttacccacaaagggaagctcatcagactaacagctgatctctcggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaaaaactggtaccagccactgcaaaaacatgtcaaattgtgaagaccatcaaggctaggaagaaactgcatcaactgacgagcaaaataaccagctaacatcataatgacaggatcagattcacacataacaatactaaccttaaatgtaaatgggctaaatgctccaattaaaaggcacagactggcaaattggataagagtcaagacccattaatgtgctgtattcaggaaacccatctcaagtgcagagacacacataggctcaaaataaagggatggaggaagatctacaaagcaaatggaaaacaaaaaaaaaaaaacaggggttgcaatcctagtctctgataaaacagactttaaaccaccaaagatcaaaagagacaaagaaggccattacataatggtaaagggatcaattcaacaagaagaacgaactatcctaaatatatatgcacccgatacaggagcacccagattcataaagccagtccttagtgacctacaaagagacttagactcccacacaataataatgggagactttaacaccccactgtcaatattagacagatcaacgagacagaaagttaaaaggatatccaggaattgaactcagctctgcaccaagcggacctaatagacattacagaactctccaccccaaatcaacagaagatacattcttttcagcaccacaccacacctattccaaaatttaccacatagttggaagtaaagcactcctcagcaaatgtaaaagaacagaaattataacaaactatctctcagaccacagtgcaatcaaactagaactcaggattaagaaactcattcaaaaccactcaactacatggaaactgaacaacctgctcctgaatgactactgggtacataatgaaatgaaggcagaaataaagaggttctttgaaatcaatgagaacaaagacacaacataccagaatctctgggacacattcaaagcagtgtgtagagggaaatttatagcactaaatgcccacaagagaaagaaggaaagatctaaaattgacaccctaacatcacaattaaaagaactagagaagcaagagcaaacacattcaaaagctagcagacggcaagaaataactaaggtcagagcagatcagaaggaaatagagacacaagaaacccttcaaaaaatcaatgaatctaggagctggttttttgaaaggttcaacaaaattgatagactgctagaaagactaataaagaagaaaagagagaagaatcaaatagatgcaataaaaaatgacaaaggggatatcaccaccaatcccatagaagtacaaactaccatcagagaatactataaacacctctacacaaataaactagaaaatctagaagaaatggataaattcctcgacacgtacaccctcccaagactaaaccaggaagaaatttaatctctgaatagaccaataacaagctctgaaattgaggcaataattaatagcttaccaaccaaaaaaagtccaggaccagatggattcacagccgaattctaccagaggtacaaggaggagctgttaccattccttctgaaactattccaatcaatagaaaaagagggaatcctccctaactcattttatgaggccagcatcatcctgataccaaagcctggcagagacacaacaaaaaaaaagagaattttagaccaatatccttgatgaacattgatgcgaaaatcctcaataaaatactggcaaaccaaatccagcaacacatcaaaaagcttatcgaccatgatcaagtgggcttcatccctgggatgcaaggctggttcaacatacgaaaatcaataaatataatccagcatataaacagaaccaaagacaaaaaccacatgattatctcaatagatgcagaaaaggcctttgacaaaatttaaaacccttcatgctaaaaactctcaataaattaggtattgatgggatgtatctcaaaataataagagctatctatgacaaacccacagccaatgtcatactgaatggacaaaaactggaagcattccctttgaaaactggcacaagacagggttgccctctctcactactcctattcaacatagtgttggcagttctggccagggcaattaggcaggagaaggaaataaagggtattcaattaggaaaagaggaagtcaaattgtccctgtttgcagatgacatgattgtgtatctagaaaaccccaatgtctcagcccaaaatctccttaagctgagaagcaacttcagcaaagtctcaggatacaaaatcaatgtgcaaaaatcacaagcattcttatacaccaataacagacaaacagagagccaaatcatgagtgaattcccactcataattgcttcaaagagaataaaatgcctaggaatccaacttacaagggatgtgaaggacctcttcaaggagaactacaaaccactgctcaatgaaataaaagaggatacaaacaaataggagaacattccatgctcatgggtaggaagaatcaatatggtggaaatggccatactgcccaaggtaatttatagattcaatgccatccccatcaagctacccatgactttcttcacagaattggaaaaaactactttaaatttcatatgcaaccaaaaaagagcccacattgccaagtcaatcctaagccaaaagaacaaagctggaggcatcatgctacctgacttcaaactatactacaaggctacagtaaccaaaacagcatggtactggtaccaaaacagagatatagaccaatggaacacaacagagcactcagaaataatgccacatatctacaactatctgatttttgacaaacctgagaaaaacaagcaatggggaaaggattccctatttaataaatggtgctgggaaaactggctagccatatgtagaaagctgaaactggatcccttccttacaccttatacaaaaattaattcaaggtggattaaagacttacatgttagacctaaaaccataaaaaccctagaagaaaacctaggcaataccattcaggcatgggcaaggacttcatgtctaaaacaccaaaagcaatggcaacaaaagccaaaattgacaaatgggatctaattaaactaaagagcttctgcacagcaaaagaaaccaccattggagtgaagaggcaacccacagaatgggagaaaattttttcaacctactcatctgacaaagggctaatatccagaatctacaatgaactcaaacaaatttacaagaagaaaacaaacaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaaatcaggaaacaacaggtgctggagaggatgtggagaaataggaacacttttacactgttggtgggactgtaaactagttcaaccattgtggaagtcagtgtggcgattcttcagggatctagaactagaaataccatttgacccagccatcccattactgggtatatacccaaaggagtataaatatgctgctgtaaagacacatgcacacgtatgtttattgcagcactattcacaatagcaaagacttggaaccaacccaaatgtccaacaatgatagactggattaagaaaatgtggcacatatacgccatggaatactatgccgccataaaaaatgatgagttcatgtcctttgtttggacatggatgaagctggaaaccatctttctcagcaaactatcgcaaggacaaagcagcaaacaccgcatgttcccactcataggtgagaattgaacaatgagaacacatggacacgtgaaggggaacatcacacactggggactgttgtggggtgggggagaggggagggattgcattaggagatatacctaatgctaaatgacgagttaatgggtggagcacaccaacatggcacaggtatacatatgtaagaaacctgcacgttgtgcacatgtaccctaaaacttaaagtataataataataaaaaaagtaaaatattttccaacaccttacttgaagaagaaagtataatcaattatccttagatcttatatcctgtttctcaaccagcaaaggagagataactatcagattgcatatctttctgaatgaggtatttgacttataatttaatgtttggtaattttaatgatttcttagtaaaagtatggtcaaattatgagacagcaaataagtgttcatgtccaaagtagtgattattgaaatgtcatgtatttacaaagaagtctggactggaagtcacatgaactgtatgttagttctgtctctgtttgtaattagtgtgatgctatgtgagtcattactcatctttgggtctttatttctttatctgcaaattaagaaagaagaacaaaatgatatttaggttcctttgaagatcttctagtcaatgtctctcattctacatttataattagatgatctttttaaacatatttaggggtacaatatactttcccagagaatatcattgatctgattactctttcctataactccttaaagcatttactggtaagagtggacaagcagttaatcaggcactgttctgccactcatgttttttattattgttatgttacctatttatctatctggtctccagaattagtttgtagtccccttaaggatgaagatggtgtcttgtctttttgaccctcctcatttgaaattataatagataaccctaactataatgaaaatagttgatacacttaaaatttgattatattaataaattgcaatatactctcaaaatagttgtctttttccaatatttgtaacagcactggatgactcttgggctttaggcaggttatttcacttttctgggatctaattttgtactcagaaaatggaagaattgagctacattatctgtaagatcccttcttagtgtactagtctttttaaaatgctatggaagggccacgtgaggtggctcatgcctgtaatcctggcactttgggaggctgaggagggaggatcacttgtggccaggagtttgagaccagcgtggccaaagtagtgaaaacccgtttgtaacagaatttgtgactttcaactgggcacatgtccaatcagaataaagatgacatttttcagcctcctttgtaaaaggtatggtcataagattaagttctaggaactggaatataagagctgtggtgtacataaagtgatgaagaaatgcccttcacctttcgtccttcctgctagctggaatgtggatgtaagagttggagctcaagcagccatttaatgaccttaggaatgaaattcatggatggtggcctgatttcaagcaaagctacagtgctcctgctctgattttagctagtcatcttcagtccacttttcttggtttatctgactcctgactagattttttttcctctttgcacaccttaaattctcaactaagacactatgaacaggacaaaattaagttccccccaatgttttttaaaaactccagctttaggacaaaattaagttccccccaatgttttttaaaaactccagctttaaactaaactttcatgggttcttccacaaataaaagacatactaaaaaatccgaagatatatataattttagtgaaatgttgagaagggataaacttctcaaagaacagtaattttgcaagataaatatttataaggtttaaatatgttctatatcagactgaattctgagaatttcagaaagtgatgatagtacaatatacataagaagttgttctgaagaaaggcaggctctaagtagctaagcaaatattattaaatgccaaacaattctatacatttaaatgtcaggattattttgttggcatttctcttgaaaacaatttttaaagagatgcatctttagatacatcttaattttaaaaattgcagaagtcatacttctaataagttgctactgtgatacgtattggtattggattttcttttaactttccattttgttattagctaatttacacgaaacttctctaagcatcacactactctcaactatgaggtttatgtttttaaatatatgccttttctattttttttttttttcagatgggggtgtctcactatgttgcctaggctggcctcgaatttctaggttcaaatgatcctcccaactcagcctttagggtaactataactgcaggcacgctccaccacacctggcttaaatgtattttctgaatagttataaaaactacttacctaggtgatatcgcattacattctcactaattgcaagattagaagacagattatagagttgttaaataatacaatcaactaaaattaatggaaatattgaatatggtaggttcccaatattagactgttgcattattgagtccataccgtgacatttttgaggtttgcacctttgaaaaagtgttacacatagattcttttaagacaatgtttctcaaattatggcaagggaaccacttgcatcagaattgctggagtgtttatttaaaatgctaatttccagacctctcaaaagatctagtgaatcaatctctacctgtggcttaaaaattttaactttaacctccgtctcaacagattttcaagtacgtttaagtttcagaacctctgttctactgctgcaatgaagtttaaagctgattcaagttattccttccatacctccatgccaatatcacaatcattcctttttcactctgcctccgttataattttgacttcatgacaaggcagggctgatttgctggatgatcaacgtttacttttaagtagagagggctgtctctagatagttacagaggacatggatagtcatacctatcagtcaactgacaggaaaaggataagtctaacaaaagtacagttcctagatttcaaaaccatttttttgaactaatctgggaggagtatagttgtaatataaggaatgactttgtgttaaagaaaggacaggataacttaatagaggtctcccatctcattctgtcacggtgcttttgggttccggtgatgaatgtgttcattttatgtggcttgctctgggtaaataacccagtgccctatcagctctgcagcccgcggccagcggcagtgtgtgcgcgctaatgacggcggaaggtgcctgggggagggcctggggaggggctggccagcgctatcgcgcccctggcacttcctaagagactgagccctttctctgcagctgcagcttggattccacgctttccctccagaggaaagaagccctccatctaaatcagctgtcttctccacatccctcctttttctctccgccagacgccacccctaccccttctattgtgttgtgccttttcattttagccccgcttcctacgtagagccctaacctcctttgtagcgagggcacttgagaatttctgaacctcgagttgtaatggagctgtatggaaaggtaagcaggcgaaaggagttccttggggtgcttagccagaaatctcgctttcacgcacttcggtgtgcgggttgtgtgtgtgactatgtacgcgcgcgcgacttctcagtgcaattatgcggataaaccactttccttatgtgtgtaccgttaatcgtctttctcccctacgtttggtgaatgagattgtaaaactgccccactctgcctaaggaaacgtagaaactttcccgattcggatggggaggggtagggcggagagtcccagagaccagctctggcttcgtttgcattggaaattagcacaaggtagtgttgtttcctaatcagaaaatcaccatctacttccgaaggcgatagttagcaaagaaaaatctccagctgagataagctggggtcacattcgcctgcccctggcgaggaaaagagcaggggagactgggagaggtaacccaggagcgtttggaaaggagtagggaggctccgcggccgagcccgactggcggatcgagcctgtttaatggtttgcttgcttgccgggagttgtagttcaccgctcgcccgtttgccgggaacacccggagggcgagactacagctcccaggagtgcacggggctcctcggcagtacgcgtgtgcggcgccaggagaggacagctccagtgctgatgttggagccggttagcgaaccccaagagtgcagagtgtggagcgtggagcgccgggactgtgcacgcttgaccggaagcccagaccagtgcggtcctagccagagagaaaggacatttgccaacaatgagacacgaagcgcccatgcaggtgggtccataaagaaagagtggcctcgggaggaattgaaagagatgcttttccccttgctccgcgcacaagcagttcaacgtaaggaaaggtctaggcggtcacccgcggagatgcggctctgtgacatgaccctgggaacagagttgggtttctttacgctctgtgtggctgtgattggggctgtcttgatgagggatcgggctattcgcaatctttctaggctctgtaaagaggataagagtgtctgtctaaaatgaaaacccaagcaaacaaaagtcagaggagcatgcaatctcgtgttggcattgatctcctctcttggcatccggggtttgagatcgcggtgaaaactcacggatttaaggcagatagatcagattcggggttgaaggctccccactggagtcggcatagagcgaattccgcttggttaaaggcgcattaaataaagagaagccaatgttaggctcctcaaagtcccctttcttcagttaggctcccagtatcagcaaaaaatagcaaacacatcggggcttggcatatccctgagctatgccagcatcactgtccacacaactggtttactctgttttggagacagccccctctgagctttcctgtgttatgtgcccatttgttctccgattccccatttcaatcacattcttaggtttgtttcctttgagaaatgcaaaggactctggtgcagaagtaccactgcctaagcatcttgcttaagttttgtttttaagtaaagatgagtgataattctcgtctctatgtactaccagttaacgttaaacatcagcttgtgtttattaatcaagcagtgatcctactgtgtaacagaaaggcattttatgagtggggttgagagaagaatagaaaacatcatttggaatgtgctgtctctcctgagaacccacctctgctgccaaacccaagagtataaatatttgacattaattcggacttcagcgttttccaactggtttcttcatgaatcaaggactttaaacatatgctttgatttacttttaatttattttatgggttatgtatattaagaaccccttactggactgttagatgaaaaatctatagaatttaattgtttgttgggtgattatataagggaagtcctcaaattacctatgagttattgaaaatttgatttgttccagggaacagtggcccctttgtgtgtcttctaatacctctatttgtgacttagcttttcattatagacctgatgtgaaaagaatctgaacagacaataaaggtacaggctgttgcaatcaagatatattggtttatgataattttctattactggagatactaccaggagccaactggctaaattaatcatatttaattataagtaaacactaattgtagactttaaaagtagatcattatacttcactatgtatatgtatattaaaacatgtacatcttaaatttacacaataaaaaagatttccaagaatttttgaaaaataaagtagattgttaatatttaaagtaaactatgtatgcactgatattttttcaatcaaaataaattacgaaaaatttaaccacactgtatatcaattttgctttcttacagagttgcttagaatgttcagaaaggtcattaaaatattacagaactgtattaatgtttcaggaaacagttaaaattattttttgtgttcaccaactatgtagtaggcactgtgattttctattttagtcaaaactttaatgaagaactaaaataaaaataaggtaaaatgaaattaatttgcttgtggatggagttattgtcatatttataatgtatttttagtcgttggactaagtttttgaaatttaaaatttccaaatgctgtcatgagtaatgtacattttaggaaatcaaagacttttttagcatatttaattaaagcacatacattaattcaatttaactaataaattgttgttatggtgaccccatctccattattatcaattttcaaaaatatgtaataatagataggataaaaactataagcttactctgaatattttaaagtaacaagtaatgtttcagcaccgatatttctgaattgtaatcacatttcacgtgactttgatatatgacaatgcaacaagataaataattgactttttttttcatttaaagactgaaccacatcatcattttaaatatatgccccaaatatttttttacttaggtctgtagaagatgactcacaagcaaaacctcattttatggttccataaaataagagatttcttctctgcttttaaaaaatatttagttcatttgttgatgtgaaagaaaatgagctttttaatgtatttgcttatttcccaatttacttcttgtattttcttaaatcaaagaatccttttaaaaatcatgtaaggtcttttaaaaagcatttgatgtatctatataaataagttgatgttctgttcgaggtagttatctttgatatgtgcctattttatgaagagtatttctttctgaattgagggaaaatgagggataattgttttttatagtaactaccaaaataatatacagtgataatctctgacatctttatttcctttctaatctaaataaccaggaatagcatttggtaagtgtcccaagtgataggcttagaattctaatgcaggagatggtcatttgtatcttctcattcagtgtatacatgaatcctgaaggccaaatgagatgagaaataacagttctcatgacttgaggacaagactctggttaacaaattgtcatttgattcaggagccacattgaacaaattctagtttatctagtgctttacctgtgctgagccctgtgacttagatttcattgtatttgtgtgtatgtataaaacaatttttatatgtatatatactatataacaatcatacatatctatggatatattttacaagagtatttacaaatatatttaaaaatcctagcagtcactattaccctaattataggcatgatcactcgaacttattaagactaaataactttcccactaggatagagtaaaatttccgccagatctctctgtctggaaaacccacgttctttcctctgttacttttgattccccaagaagacataaattggtggtgtaaagaatgagacaactattgatataatttgagtcattcatttggttcagaagaaagaaaaattggccctatcttcttcttataaaataaacttgcataaactaaacagaatatttgaaaaggggcaatgttttaaaaatggtttgcttctatctattataatttctggcagggtcacgtactctcttacaggaccaaagtggaattcattgtctctgactaaatgcttacttttccaatttgttatccacaagcttttggggtcacttcataaatgcagtcttctgactattgaggaaaattcaaagaaatatatctacccaaaacatggagcagagtgccaaaaaaaaatgtttggctaaagatgaggaggattgaagaaggactatagatgtaggctgaagatgaagtggagctaaaaaccattagttatatattaaagttagccatactgtacacaacaccaaattacaaagaattaaagtctaaatatcactgttttatttggctatggaaagtacatggcatttttgcacttcattattgttgaattcctaaccatatccatcctcagtgatcatccctctatctttctgagaaatggacatgtagtcctcatcctttacagaaacagaaaatccctaattgactttagagaaatgagaaattcttccttactccatttgggctaattgctcaagtatccacttttcttctgtaaaaggaagtggaggatagcaagaaaacttaacctatagcaaaaattcacttttgtagtataagaatgcttttccattgaaactgcaaaattatcataattttctgccaccattctaagcttatactggaattggcaagtcctttcttcaccatcatattccaggaaggaaatatatgtttatgctgaggaataggttttcttgaaactactcttgcccactcaactcgctaaatacaagcagctgggccacctcaaaaaaatgttcttttatatagattaaaggttttccaaccatttttccctttcttaaattaatgtggctcagaggttctgtgggaatcatcttagcaggtcagtctattaccaaggatactacagcctgtgaagattaaatctttgagagttattcagaataacatagatctttagcatttttcgttcattagtttataggtttttagataatatttatatacattgaaatgcacaaatcttaagtgaacaatttgataaattttgacaaatgtataaatctgtgtaacacacaccattataaagatatagaacatttctaatcatccctgagtattccttcatggtttttcctaattaatatacctatgcagtaaacttttttaggtgagacttgaacttgagatccctgggttctcctgaccaatcacgggttagctgtgggattttcctgtgtctcctctctccctgggaaggttcaaaagtcactcagccctgcagagtgacttaaccataggagtttgatttgttctagaacttcatatagttctgtagaacatgcagtatgaacatactgtggaacaaaaaaatatgttcttgtttgagtctggcttatttcgttcagcataatgtgtatgagattcatccatgttgttgcatgtttcaataattcattccattttattgctgaatattatacttttaaaatcaatttaatatacttttaaaattcattatcctgtttatgaacttggaggtaatttctaatttggggatactaagaataaggctataaatgttttttctattgttcttttttatgataatatcttttcacttctcttgggtaaatacctaaaagtaaaattgctggaataaatggtaagtatatattaagctttataagaaacaatcaaatcttttgccaaagtgggaggaccggcaattctcaccagcaatgtatgagagagttttagtggctccacatcttcaacagcatgtaatgtcagtggtctttttagttttggccacttggtaatgagtgttttctggtatctgattatgatttaaatttgaattttcctaatgatgaacggtttttagtatatttttatgtgcttattggccacttatatatcttcccttgtgaatcatgggttttaaccttttatgcatctggggggtttgtttttattgtttagttgcaagagatctttcatcttcagtttagtcctttgtcaagtcaggtagatatataaataaaggtttctcccagttggtggcttgtacattcatattctaaatagtgccttttggtgaggatttttttgaattttgatgaaatttaggttaattaattatacctggggtctgtatccagactctgatctgtttgtcctgactctgcgtccagaggccttgctatatttatttctagttttctttaagattccataagaatttcaacataaactatcatattatttacaaatagagatagtttatttcttccttcccaaagactctctttttttccccatatcttattgaatagaatagaacaaccagtacaatgttgaatagacgtgatgacagcggacatccttatcttgttccccattttaagagggaagaccttccgttttttatcatcaagtgtgaaattagctgtagggttttgttactatgtttctttgttttggtatagatattatttattatattgaacaaatttgatttctcggttgatgagaaaatttgtttttaacataagtgggtgtcaaatattgtcaaatgcttgttctacatctattgatgtgattgtgtggtttatctactttattttgttggatttcatggatggattttttagctaatctggcattccttagataaaccctattggtcatgatatattgtcctttctatatatagctggattaagcttgattatattttgttaagtatttttttgcattagtcatgatggatattgggctatgattttctcttaatgccttcatgaagttatagtattggaattatgcttataaaacaagctgagaagtactctttgcccctcagttttctgaataattttgttgcataagattagcatagtttggtttgttaaatgtctactagagttcaccatgaagccagcggagcctggagttttctttctgaaaattttaaataagagttttaatttttaaagatttcattgatatactaatatctctattatctatctatgtatctccctttagtatattgtattaggcagaatagcatccctcccaaaattctccatggcctaaccctgtaacgtgtgaataggttacattttgtaacagaatggactccgcaggtataattaatattataaactttcaaatagggagattaacctgcattatcaggttggtccaatctaattacaatacctcttaaaagtagagaactttctctcattgaatttagagtgttgtggcagaagtcagtttcaaaacatgaaaagaattgttggggtgaagatgaagaaggctgtgtgtcaaggaagcagggacctcagtcctacaaccaccagcaactggattatgctgacaatctgaatgagtttggaagtggaatctttcctagactgtccagatcaaaggccagtccagccaacacattgattttagctgggtggacctgagcaaagtgagcagaggacctagctgagatttctggctcagaaaacaataagtgggtgtggttttaaatatccattatagctgcaatcgaaaactaaatatgcatataaaaatttttctatttcattgtgagtcagttttggtaaattgtgtttttcacttcatttttccaatttattaacacaaagttgttaaaaacatttttaataccttttaaatatctctaggatctgtagtgatatcccctttctttcctaatactgatcatctgaggtttctccgtctctctcatgccagtcttactaaatgtttatatcagtattaatgtcaacttttacctttgttaattttatttagtttgtattttattgattttagctgttgttttaaaaactatatttgtgtttcttatacttacttagtagaagcttttctttatttagattcttaaggtataaatttggttcacttatttatttatttatttatttattttgaaggcagagtctcactctgttgcccaggctggagtgcagtggctggatctcagctcattgcaatctctacctcctgggttcaagcgattctcctgcctcagcctcctgagtagctgggaacacaggcgcccaccaccacacccagctaatttttgcatttttcgtagagacatagggtttcaccatgttggccaggctggtcttgaactcctggcctcaagtgatccacctgcttcagcctcccaaagtgctgggattacaggtgtgagccactgtgcctgtcaggtcactgattttaaatatttcttttctgctaataaatataagcactagaaatcataaatttccctctaagtactgcttaagctggcaagcacaaatttctgaatgtagtatttacattacattttatttcaaactatttggcacttatgatgtttttgtttaatccatgggtttaaaagtatatttaatttccaaatacttgggtatttttacagatattttattgatactgatgactagttaaattctattgctactatggaagatattctttaagattttaattttctaaaattgttgacttgtttttagttcagcatgtggactgactttatgaacattccatgtgtgcttgtgtgtgctgtagttgtgcagtgtagtagtctctaaatatcattagggttatggcattgtgtggtgttgctaagacctttaatatccttatcgatttttggtctatttatactatcaattactgttaaagaggttttcaaatctccagctattattgtcaatttgcctacttatccttttagttcttttgagttttttcatatattttgatactctgttattaggtatacacacataattttaaatgtgtctgcctgagtaatttttccttttatattatgaaatgtcccactttatctccagcaatactccttgtcttaaagtctatattgtctgatattaatagagaatgcagacactcttgccttcttaatagtattttcatagtatatatatatatatatatataattttatttattttcaacttatatgtgtctctatatttaaagtgtgaatcttgtggtcagtatagagttgggcttttcatttttttccagtttgaaaaatcactgcctttttcttggtccattttcatatattacaattatcagtatgattgaatttaagtctaccattttgtttttttaatttattctgtttctttttctttctctgtttcgtttttatattcttttttgcttaattacatatttttaggtatttcaattcctgtattggcttttcttttctttttctattttttttttttttttcgagatggagttttgcacttgttgcgcaggctggagtgcagtggcacgatctcggctcactgcaacctctgcctcccgggttcaagcgattctcctgcctcagctttctgagtagctgaaattacaggcatgtgcaaccacacccagctaatttttgtatttttagtagagacagggtttcaccatgttggccacacccatctcgaactcctgacctcaggtgatccacctgcgtcggcctcctaaagtgctgggattacaggcgtgagccactgcacccagccctctatgttggcttttcaactgtgtatctttgtgtatttttggtgtttatcctacggattacaatatgcatatttaacttattatacagtctacttagagttaatattatattacttctcataaaatatagtaattttgctatgatataatttcatttacctcattctttgtgaaattgttgtcatatgttacatctatatttgttataaatctccaataaagttttataattttagctttcaatagcaatctgtatttttttaattaagagaagaaaaaatgtatatttatttgtgtttgtctttcacctatgtaccatttctggtacatagtttctatctggtatcatttttcttcagcctgaacaacctcgattagcatttcctgtaggatagatctgctggcaattcattctcttagtttttgttcatctgataatggttttttaaaattttgccttcatttttgaataagagttttgcctgcatataaaatttcttgttgattttttcagcaatttaaatatgctgtttcgttgtctgctgatctcctttataatgtgagttcagctgttcttcatattattgtgcccttgtatgtaatgtcatttttttcatctgactgttttcaagattttctgtttaactttgagtttaaacaatttgactataatgtgcctagatgtcgttttatttatatttagtcagattggcgaattggataagcttctcagatacataagtttatatttttccctaattggaaatatatttagccattacatctttaagtattttttcatccaattattctcttctttttccttttgatattgccaattacatgtatgttagaattctaatatcatcccacaactaactgaggctcggttcattaaaaaatttttcctttatatttgtcagattgtatgatttctattgatttattttaagttcaatgactttttcttgtgtcatcttcagtcttttgttaagcctgtccaggaattgttcattttagttattgtacttttccttttaggctcagtagtggctctttttacactagaaacttgtttccaagtgaagacagatattaactcttgggatgaggtacttgagtattgaaagaggttaataagattaatttataatagtgtgcagaaactaaggaagcacagtaattaactgagcttcttataaaaaaggtgatagagaaatgtaaataataacattagtgctttgattatcttttgtagatatttttggaaaaatacttatgtttacatttccatgtcatttaattacatttctattgagcattgttcttgtgatactgtacttttttatgtgtttttcaaattaaattgtgggcttcaagatactttttgaaattttaacaaggtgcaaaattgtaaaaataaaataactttaacaattactttcttttgccaacttatgtattccttaatggcgtcaactctgcagaaacaaaatgccttttccaacaccaacatgtttcagattggtttgaagtgtgctgtcagttctgttgagataatgaagtatttttgcattcactaaacaatgaagccataggagtaagtattctaggtcttcagtcctctagtgaatggtgaaaagaaagggtcagtggttccttgctgtactctccagcaagctggttggcttggggatagtattagtaacttaggtctagcgaccttcaaaaaaaccacattttatgcctccttggcctcctatctgcgaaaaacatggaatcatagccacttagctcctacagtcttagctttttatgtctggctacccgaatcataatctaacggtaagaggtaaggtcatcagcctctcatcacttgtctgctgccacttgtttaactctagctcatcaaagatcaatgggcgttacttgctagccaccaagtggcttggatgatagagaaacttacaagccaacactgatgaataatttctgttcaagtggccatagctcaagggatactaaagagcctgaagaacagatatgtttaccaactggcaaattatgaccctcctgtgactctcacctattggtgttagctctaatagaagatagtttttctttagaatgtttgatccactgaacacctgtctgagtggcaggactgatgaaaaagaataacagaaacacagcacacctgtgatgtgaacattcttttatgaatgtgcatgggtgggtttgttctttgtaataaataatagtagcagtagcttttgaatggaaagcagggatgattatgactatgaaagtggctttgtaagtcatcctaattggtacagttatacaatttggaaacaaaaacatgtagattatgaatacaccaagtttttcacagataatccagatattcctttgtctcgtaagtgcatggacaacaaggtgcttgttcctatacatgacctaccttgatggatgaaataagggaggcaagatatcaagatctagaaccaatatttatagcaaatctcaggaggaatttttcaatggctctttttttaatgttttgatattttttaaatgtttagtgtttttaaaaatgtttaatgatgaaaacttattgggaaacaaatgtattaatattaacatgtaggcttttttttttttttttaccccagtgggaatttttagagtaccttactagatatttttaggagaggttttctttataccacatagcactggatatgtccattctgtttactctttctcctcaggaagaggtattcttgtaagagctattcctcattttgtgttctccatttggacacaggtctcctttagctgtcaatgctttctaatggagcgagggggaagtaaagcccgattgtgtttatttttaaaaatgactgatggagaaagtcaaggccttcttccacagagtttagcagagcagagttgcatagctttgagaacatatttactgtttcctactaggttgtccctcctcaaagtctagtagggtgcttgcagtgagttatatcactggtcctcagaaggttctggcttttaccagggcagagataattgatgaaacacatttctcagaattcagcttgactgggcagactgggcattgtagggtatagacccttctctgcaagagtcaacatcatgatggtgagatctgctgagctatatcaccaagaagggtgtctggtgaagacagcagctggtggagagctctaggatcatatttccatgttcccagggatcttggcctaaatgtcagattactcagtcacctcatagtatatccctgaggccttgaccacatatatgtgtcctggcttccatatgaacgtttgttaatccagtgatttctaaacctgactgatgaaaagaatatatgaagtgtttgaaaaaatgacagatttctggcctcactctaaatattctaattctcccgaatttcaggggagttccgcatgtctgagaattttggttctagtgtaccctaaaagtatttcattttgtattcctaaataaaaatgtatccaactggagagaacaggtatttgaaaacacaatgtctggtgttttttgctgccaagaaatgatgagaaaccttatgtatattttatcatatccacaagaaaagttttgaacgattctttacattttgttgctaagagagaggcccttcatttttacaaattgacatctgcatatagaaagtgtgaatgtcaagaatgtttgatgagttttttctaatgttttaaacttacttttgttttatctaagttgtataaggggaagatggctgcttggctattgggagggatgtggggtttggactttcaaccaattctcttgtttgcatgccccagccaaaactagggtgacccaccacctagctggctggttttagcactgaaagttctgctgtgtaccatgaaaatcctcattcccaggcaaactaggacaattggtaaccctacccataccctataatcaagacacttggtatctccaattccaaggcctttccaggttctgccaggcaagagttcttgtgaggtttttcagcaggcttaggattctgctttctcaagtctattcactttcagattccaaacttttgttgacctttcttttctactcttgtctcctgtctacttctctctgtctataaagattttgctcttgtgaaatccctttactattattgtagagaggtttagggaaaggatggtgatcgccacatatgcaagattttacatatatagtaaatatatatataaatatataatactatataatacatattatatataaatatataatactatataatacatatattatatataaatatataatactatataatacataatatattatatataaatatataatatataatacataatatataaatatataatatataatacataatatattatatataaatatataatatataatacataatatattatatataaatatataatatataatacataatatataaatatataatacataatatataaatatataatatataatacataatatattatatataaatttataatatataatacataatatattatatataaatttataatatataatacataatatataatattatatttaatatataatacataatatataatattatattttaatatataatacataatatattatatataaatatataataatatgatacataatatattacatataaacatataataatatataatgcataatataatatataaatatataataatataatacataatatatattatataatatatataatacataatatatattatataataatatataatacataatatatattatataatatatataatacataatatataatataataatatatactacataatatatattatataataatatatactacataatatattatataataatatatactacataaatattatataatatatactacacaatatattatataatatatactacacaatatattatataatatatactacacaatatatattatataatatgtaatacacaatatatattatataatcattatatataagcatataacaatacatagtacattatatataagcatataacaatacatagtacattatatataagcatataacaatacatagtacattatatataagcatataacaatacatagtacattatatataagcatataacaatatatagttcattatatataagcatataacaatatatagttcattatatataagcatataacaatatatagttcattatatataagcatataacaatatatagttcattatatataagcatataacaatatatagttcattatatataagcatataacaatatatagtacattatatataagtatataatataatatagtacattatatataagtatataatataatatagtacattatatataagtatataacatataatacattatatataagtatataacatataatacattatatataagtatataacatgtaatacattatatataagtatacgataacatgtaatacattatatataagtatacgataacatgtaatacattatatataagtatacgataacatgtaatacattatatataagtatacgataacatgtaatacattatatataagtatacgataacatgtaatacattatatataagtatacgataacatgtaatacattatatataagtatacgataacatgtaatacattatatataagtatacgataacatgtaatacattatatataagtatacgataacatgtaatacattatatataagtatacgataacatgtaatacattatatataagtatacgataacatgtaatacattatatataagtatacgataacatgtaatacattatatataagtatacgataacatgtaatacattatatataagtatatgataatatgtaatacattatatatatatatatagctgaaagccttttaatgattcccaatattgaaataatgatattgtagacttcggtgattttccaaattcagtatcagagattaagttaaactttacccaaacacacttcaaagctgtaggagaggacagttttcctacagtgctttgagttcctggggttccctttcttatcttttcttaccacttggattcttccccttattagtctagacatgaaactcagctctctccaggtttctacaaaattccacttgctcttaaggatttcatgagtttagcagatttttagaagttattcagtgtcaggcagtgttctaggacaggtcctatcacagggaatatggcctttggctacgttctcctccttgtagtgtgtctggatcacagaacacttctatctaaacacagatgcctcagtgtcttagcttctaccccaagaggtatattgataaatactttttgtggcatatcataacaattgaaaataggagaaaatttgagtcatctatttcagaaattatgaaagtctcaggaaagtgttgggtgttaaaaccttttgccctctgaagttaggtaataagagaaagcatattctgtaaaactaaccatttgcatttcagagaatagcattggtgggaattcaagaagaagaatatcaaagataatcatggaagcctcacttgagcgtttaacacataccaacacttttcctttgctcatctcgctattcttattatagatgaggaaactgcagcttaggataggtaaaaacaaaacaaaataaaacaaaaaccttgcctaaatgttcatgagtagcaaaggagcaaatagcagggctgggattccttctttggcagcctgactcagggcatgtgctcttatccatactcacatcccactaagaatgtggaatgctctttttcagagatgcatctgcatgcacgtaactttagaaatagaaaataggtggaatggtattttcctacttcttactacactgtgatttataaggcctggattaccagtagctgggtcctgtctgccatcccaggactgcaaagcttccacatttctgagcagggaccagggcctgagcttcaggactacatctgaatctagtcctgagcttcaggaccatatcattgcagctgtcaggattgcattgtcagggtctaggggctctcctagccactgtcattcctgttccagcagaccttgcttacaatcctctctctgtgttctggggttctcctttactctgctgctgccaagactcagtgtgggctatctccactctgggaaaccgctggaaccaaactggaagtaaactacatactatgggctgagagaagaacactggcctttgatactagtaggaacagttttcacatggtttgataaaattcatctcctttttcttttttttttcttttttattatactttaagttcagttttgtgtagattctgaatattagtcctttgtcagatgtatagattgtgaagattttctcccactctgtggattgtctgtttactctgctgactgttccttttgatgtgcaaaagctctttagtttaattaggtcccagctgtttatctttgtttttactgcatttgcttttgggttcttggtcatgaaatccttgcctaagccaatgtctagaagggtttttccaatgttatcttctacatttttatagtttcacgtcttaggtttaagtccttaatccatcttcagttgatttttgtttaaggtgaaagatgaggatccagtttcattctcctacatgtggctagccaattatcccagcaccagttgttgaaaaagggggactttatgtttttgtttgctttgtcgaaaatcagttggctgtaagtatttgcgtttatttctgggttctctattctgttccattggtctacggatctatttttatatcagtaccatgatgttttggtgactatggccttatagtttagtttgaaatcaggtagtatgatgcctccagatttgttctttttgcttaatcttgctttggctatgcaggctctttttggtttcatatgaattttagaatttttttttctaattctgtgaagaataatggtgatatttttatggggattgcattggatttgcagattgcttttggcagtatggtcattttcacaatattgattctacccatacatgagcatgggatgtgtttccatttgtttgtgtcatctatgatttctttcagtaatgttttgtagttttccctgtagaggtcttttgcctcctcggttaggtatattcctaagtatttttatttatttatttttgcagctaatgtgaaaggaattgagtttttgatttgactctctgcttagttgctgttggtgtatagaagaggtactgatttgtgtacattaatcttttatctggaaactttgctgaattcttttatcagttctaggagctttctggaggagtctttagggttttcaaggtaaactatcttatcatcagcaaacagtgacagtttcacttcctctttcctgatctggatgccctttatttctttctcgtctgattactttgggatcagactttcaatacgatgttgaagaggagtggtgagagtgggcatccttgtcttgttccagttctcagagggaatgctttcaacttttccccattcagtgttatgttggctgtgggtttgtcacagatggcttttattacattgagggatgtcccttgtatgccaattttgctgaaagttttaattataaagggatgctggattttgttgaatgcttttccttcatctattgagaccatcatgtgatttttgtttttaattctgttatctggtgtatcacatttattgacttatgtatgttaaactgtccctgcatatctggtatgaaaccctcttgatcatggtggattatctttttaatatgttgttggattcggttagctagtattctgttaaggattttagcatctgtgttcttcagggatatcagtctgtagttttctttattggttgtgtcctttcctgattttggtattaaggtgatgctggcttcatagaatgaagtagggagggttccttctttctctatcttgtggaatagtatcaaaaggattggtaccaattcttctttgaatgtctggtagaattctgctgtgaatctgtctgttcctggacttttttatgttggtaattttttaattaccatttcaatctcactgcttgtttttggtctgttcagggtatctgattcttcctgatttaagctaggagggttgtattttttccaggaatttatccatctcttctaagttttccagtttacgtgcataaaggtgttcatagagccttgactgatcttttgtatttcagtggtgtcagctgtaatatcacctgtttagtttcttagtgagattatttggattttctctctttttttcttggttaatcttgctaatggtctatcaattttatttatcttttcaaagaaccagctttttgtttcatttatcttttgtattttttgtttgtttgtttctttcaatttcatttagttctgctctgatcttggttatttccttccttatgctgcttttgtgtttgtttttttcttgttctagttacttgaggtgcaaccttagactgtctgtttgtgctcttcagactttctgatgtgggtgtttaaggctatgaactttcctcttagtactgccttagctgtatcccagaggttttgataggttgtgtcattattgtcattcagttcaaagaatttttaaatttccatcctgatttttttttgacccagtgttcattcaggagcaggtcatttaacttccatgtatttgcgtggttttgaaggttccttttggaattgatttccagttttattccactgtggtctaagagaatgcttgatataattttaattttcttaaattttttgaggtttcttttatgacctatcatatggtctatcttggagaaagttccatgtgctgttgaatagaatgtgtattctgcagttgttggatgaaatgttctatatatatctgttaagtccatttgttccaaggtatagtttaaatccattgtttcttttttgattttctgtcttgatgacctgtctagtgctgtcagtggagtattgatgtcccccactagtactgtgttgctatctatctcatttcttaggtctgctaataattgttttataaatttgggagcattaggtgcatatgtttaggattgtgatattttcctgttggataaggccttttaccattatataatgtccctctttgtctcttttaaccactgttgctttaaagtttgttttgtctgatatacaaatagctatccctgctcacttttggtgttcatttgcatgaaatgcctttttccagccctttaagtttatgtgagtccttatgttttaggggagtctcctaaaggcaggagatagttggttggtgagtttttatccattctgcgattctgtatcttttattaagtggagcattaaggccatttacattcaatgttagtattgaaatatgaggtaccattgtattcatcatgcaatggtatttttgttttataggtcctgtgtgatttatgctttaataaggttctgttttgatgtgtttccaggatttgtttcaaggtttagagctccttttagcagttcttgtagtgatggcttggtaacggtgaattctctcagcatttgcttgtctgaatatgactgtatctttccttcatatatgatgcttagtttcgctgcatacagaattcttggctgataatcgttttgtttgaggaagctgaagatatggccccaatcccttctagctcgtagggtttcttctgagaaatctgctgttaatctgataggttttcctttataggttacctggtgcttctgtctcacagctcttaagattctttcctttgtcttaactttgaataacctgatgacaatgtgcctaggtgaagatctttttgtgatacatttcccaggtgttccttgcgcttcttgtatttgaatgtctagatctctagcaaggctggggaagttttcctcaattattcccccaaatatgttttccaagcttttagaattgtcttcttcaggaacactgattattctaaggtttggtcatttaacataatcccagaccccttgggggctttgttcatattttcttattcttttttgtctttgttggattgggttaattcaaagaccttgtcttcaagctctgaatttcttttttctacttgttcaattctattgctgagattttcctgagcatttcacatttctaaaggtgtgtccaaagcttcctgaatttttgattgttttttatttaagctatttccttgaatatttctcccttcacttcttgtatcattttttggatttccttacattgggtttcagctttctctggtccctccctgattagcttaataactaactgccttaattctttttcaggcaaatcagggatttcttcttggtttggattcattgctggtgaactagtgtgatttttaggggtgttgaagagccttgttttgtcatattatgagggttggttttctggttccttctcatttgggtaggctctgtcagagggaaggtctagggctgaaggctgttgttcagatttcttttttgtcccacaaggtattctcttcatgtagtactctcccccttttcctgtggatgtggcttcctgtgagccaaactgcagtgattgttgtctgtcttctgggtctagccacccagccagtctacctggctccagcctggtactggaggttgtctgcacagagtcctgtgatgtgaaccatctgtgggtctctcaggtgtggatatcagtgcctattccactggaggtggcagagggtacagtggattctgtgaaggtccttagctttggtggtttaatgctctatttttgtcctggttggccttctgccaggaggtggcactttgcagaaagcatcagctgtagtagtgtggagagggaccggcggtaggcggggccttagacctcccaagattatatgccctttgtcttccactaccagaaaggtgggtaggtagggaaggactatggggagtgggactaggcctgtctgagctcagactctctttgagtgggtcttgcttcagctgctgtggggcatgggggtgagatttccaggacactggagttgtggaagtattatggctgcctctgctgagtcatggaggttgtcaggaaagtaggggaaagccggtagtcacaggcctcacccagctcctgtgcaaactgaagggctggtctcactcacactgtgaccccaacaacagccccaattctgtttccaggtggagggcaagatgggcttgaaaacttgcccgaggctgtctgcctcccagctgtgaaagaaaaaggctttagttcttccccagcctgtgaagtctgcaagctggattcagatttgtgctcttccctgagttctggccaggaagatttttgccctattaaaattgttacaaagttcacctagagaattccttctccctgtggagttttaaccgctgctcctctggccaccgtccagatggatccctgtggtgccaggcaggaatgggctgcttggggacccagagagctcgcagggcctttctgctgcttcctctacccctatatttctcttggcttggctctctaatttaactcagctccaggtaaagtctgaaacttctcccacaagcaaaccttcaacttctccagtggggtgtgtttgggagaggagggcctccctttctcacttctacagttggggcactcacagtatttggggtgtctcctgggtcctgcaggagcagtctgcttccatcagagggtctgtgggtcctctcagaattgctgtttttttcttgcggtcaatctggagctaaaattcacagtgcaagcctccatacactgctctgtacaggtgcaatctagtcctgcctcccatgcaccatgattatctctcctctcagattcccttaatttcatctttaaaatggagatgattttggttctgcatgtgaggagcttggaagtcatcacttccatcttcacactagaaaaaagctgaacaaactaaaaatcaacaactcttcttatatctatcagagaaatgaagtcacagggcaaatcactgccccttgtaattggagtgacagacaggcagataaagaatatcacaacttaacggagcagaaacttctgtgggaactagcactgaagtagaaaaacctgaactggctgggcgcggtggctcacacctgtaatcctagtactttgggaggccgaggcaggaggatctcttgaggtcaggagttcaagatcatcttggccaacatagtgaaaccctgtttctactaaaaatacaaaaattagccgaatgtgttggtgggcaccaagcgcttgtaatccctgctacttgggaggctgagacaggagtctcgcttacacccgggaggtagaggttgcggtgagccaagatcgtgccattgcactccaacctgggtgacaagagtgaaactccatctcaaaaaataaaaaagaggtcttccgttccaagatggccaaataggaacagctctggtctgcagctcccagcatgttcgacactgaagacgggtgatttctgcatttccaactgaggtacctggttcatctcattaggactggttggacagtgggtgcagcccacggagggtgagctgaagcagggtggggcatcacctcagctgggaagcacaaggggtcagggatttccctttcctagccaagggaagccatgacagactgtatctggaaaaatgggacactctgcccaaatactgtgcttctcccacggtcttagcaacaggcagaccaggaaattctctcctgtgtgtggcttggcaggtcccacaccaacgcagccttgctcactgatagcacagcagtctgagattgacctgcaaggtggcagcctgatgggggaggggcatccaccattgctgaggcttgaataggtaaagtggctgagaagcacaaattgggcagagcccaccgcagctcagcaaggcctactgcctctatagactccccctctgtgggcagggcatagctgaacaaaaggcagcagaaacttctgcagacttaaacgtccctgtctgacagctctgaagagagcagtggttctcccagcacagggtttgagctctgagaatggacaggctgcctcttcaagtgggtccctgagccccatgtagcctaactgggagacacctcccagtagggtccgacagacctcatacaggtgggtgctcctctgggatgaaacttccagaggaaggatcaggcagcaatatatgctattctgcaatatttgctgttctgcagtctctgctggtaatacccaggcaaacacggtctggagtagtggacctccagcaaactccaacagacctgcagctgagggacctgttagaaggaaaactaacaaacagaaagaaatagcatcgacatcaacaaaaaggacatccacaccaaaaccccatctgtaggtcacaaacatcagagaccaaaggtagataaaaccacagatggggagaaaccagagcagaaaagctgaaaattccaaaaaccagcgcgcctcttctcctccaaaagatcgcagctccttgccagcaacagaacaaagctggatggagaatgactgacgagttgacagaagtaggcttcagaaggtcagtaataacaaacatctctgagctaaacgagcatgttctaacctgtcacaaggaaggtaaaaaccttgaaaaaaggttagatgaatggctaactagaataaacagtgtagaaaggaccttaagtgacttgatggagttgaaaactgtggcatgagaactttgtgatgtatgcacaaacttcaatagccaattcgatcaagtggaagaaaggatatcagtgattgagaatcaaattaatgaaataaagcaagaagacaagattagagaaaaaagagtaaaaagaaatgaacaaagcctccaagaaatatagaactatgtgaaaagaccaaatctacgtttgattagtgtacctgaaagtgacggggagaatggaaccaagttggaaaacactcttcaggatattatccaggagaacttccccaacctagcaaggcaggccaacattcaaattcaggaaatacagagaacaccacaaagatactcctcaagaatcacaaccccaagacacataattgtcagattcaccaaggttgaaatgaaggaaaaagtgttaagggcagccagagagaaaggtcgggttacccacaaagggaagcccattagactaacagctgatctctcggcagaaaccctacaagtgagaagagagtgggggccaatattcaacattcttaaagaaaagaattttcatcccagaatctcatatccagccaaactaagcttcataagtgaaggagaaataaaatcctttacagacaagcaaatcctttacagacaagcaaatgctgagagattttgtcaccaccaggcctgccttacaagagctcctgaaggaagcactaaacatggaaggaaacaaccggtaccagccactgcaaaaacatcccaaattgtaaagaccatcaatgctatgaagaaactgcatcaattaatgggcaaaataaccagctaacatcataatgacagggtcaaattcacacataacaatattaaccttaaatgtaaatgggctaaataccccaattaaaagacacagactggcaaattggataaagagtccaaacccatcagtgtactgtattcaggagacccatcttatgtgcagagacatgtgtaggcttaaaataaagggatggaggaagatctaccaagcaaatggaaagcaaaaaaagagcaggggttgcatctgacaaagggctaatatccagaatctacaaagaatctacaaagaacttaaacaaatttacaagaaaaaaacaaccccatcaaaaattgggcaaaggatatgaacagacacttctcaaaagaagacatttatgcagccaaaagacacatgaaaaaatgctcatcatcactggccatcagagaaatgcaaatcaaaactacaatgagatactaactcatgctagttagaatggcgatcattaaaaagtcaggaaacaacagatgctggagaggatgtggagaaataggaacacttttacactgttgatgggagtgtaaattaatttaaccattgtgcaaaacagtgtggcagttcctcaaggatctggaactagaaataccatttgactcagagatcccattactgggtatatacccaaatgattataaatcatgctactataaagacacatgcacatgtatatttattgtggcactattcacaatagcaaagacttggaaccaacccaaatatccatcaaaggtagactggattaagaaaatgtggcacatatacaccgtggaatactatgcagccataaaaaaggatgagttcatatcctttgtagggacatggatgaagctggaaaccatcattctcagcaaactatcacacaaggacagaaaaccaaacacagcatgttctcactcttaggtgggaattgaacaatgagaacacttggacttagggcaggaaacatcacacactgggacatgttggggagtggggaggagggggagggatagcattaggagaaatacctaatgtaaatgacgtgttaatgggtgcagcaaaccaacatggcacatgtgtacctatgtaacaaacccgcatgttgtgcacatgtacctagaacttaaagtataataaagaaaagaaaaacctgaactataattgcattgctggatgctcagtgtggaccagtcagagagaaaaattccagggggtgccagtcttggggagccccttcatactttttacattttaccttcaggagccctagcaggtcctccagtgaagatcagagaaaaatgtctcatttttccagcaggggaaagggggaagtagcctttgaaatgtaccagaaggttctgttcctttaaaagggggatgctaatggttgaactagttacaccttctagggatagtgcaaagattaggtgtgataatacatgtaaagcacatagagcatgtaagacccgtgctgctgttattatttagccatattcctatacataagctgagggttattcacctctactaaagaagctacacatgagttggacatccagagaaaggctgaaaggagaaaggtgaaatttagctggaggaatgcctttatacctttaaaatgtatagtggtttgcatcttgaaagcattaccataatttggcatactattgtatacattctcctatgaatcccataaaatagttattcattccctgctaaggtaaagaaaaaagataaataaaatttctgaatctgaccttttccgggcccctttacttcagaagccaggattaggatttaaactttccagcgtcttggccacttcttgttccctgggcagccctttcagcttgatggtgagttgtaagcagtgaactggttcctgcaagagcaaacagtagcagatacatggagaaattgctggccagagattgcaaagcacatcacaattctaatcgattctgagagacaaacgtggagacctgcaaacctgtgcacagatgaggacttttaccaggagaaatcgcctggagtccagatgacagacttttggaaatgctaacttgaaatgttttctttcttggctttaaaaatttagcctttactttgaagctgtcagaaaaaaatgatttttgtttttctgtgtgtgtgtgtgtgtgtgtgtgtgtgtacatacgtttttatttctcttgggcaaatccctaggagtgggattgttaggtcatatggtaaatacaatttaacttcatgagaaactgctaaactgtttgtcagagaggctgtgccattttaaacagtctcagcagcaatttatgagcattccagttgctccacatccttgccagcaattgttgtcaggttttaatttttttttctaattgtagctgttataataggtatacagtggtatctcactggggtcttaatttacattttctaatattaacaatgttgagtatgttttttgtttgcaatttgccattttcttttctttttttcacaggtgacaatgattgaggtttgaatttatgtgtttctgcacttccaatacatatatcccatccttatttttacccttctaatttcaaagaataattgcatttttttttggataatttaccctagttcctccttccattctttaccttagcagggaatgacttagactattatcaatagtagtagctggaacatagtaactttatttatttaacttttaagtttaggggtacatgcgcaggtttgtatataggtaaatttgtgtcatggagtttgttgtacagattatttcatcatccaggtattaagcccagtaccccttagttatttttcctaatcctctccctcctccccacccttcactgttctataggccccagtgtattttgttcccctctatgtgtccgtgtgttctcatcatttagctaccactcgtaagtgagaacatgaagtatttggttttctgttcttgagttagtttgccaagaataatggcctccagctccatcccatgttcctgcaaaagacatttttatggctgcataggattgccacattttctttatccagtctaccattggtgggcatttaggttgattccatatctttgctattgtgaatagggcgataatgaacatatatgtgcatgtctctttataatagaacaatgtctggtcctttgggtatatacccagtggtgagatcgctgggtctaatggcatttctgtttttaggtctttggggaattgccacactgtcttccacaatggttgaactaatttacactcctaccgacagtatataagcattcctttttctctgcagccttgccagaatctgttattttttgattttttagtaatagccattctgactggtgtgaaatggtatctcattgtggttttgatttgcatttctgtaatgatcagtgatgttgacctttttttcatgtgtttgttggccacatgtatgtctgcatttgaaaagtgtctgttcatgcactttacctactttttaatggagtttttaattgttctcttgtagatttgtttaagttcctcatagatgcagtatattagacatttgttagaggcatagtttgcaaaaaatttttcctattctgtaggttgtctgttcactctgttggtagtttctgttgctgtacagaagctctttagtttaattagaacctatttgccaatttttgcttttgttgcagttggttttggcatcttttgtcatgaaatctttgcctgctcctatgtcaataatggtattgcctaggttgtcttccagggtttttatagttgtgttttatatttaagcctttaatccatcttgagttagtttttgtatatcgtgtaaggaaggggtccagtttcaatcttctgcatactgctagcccgttctcccagcaccatttattgaatagggagtcctttccccattgcttgtttttgtcaggtttgttgaagatcagacagttgtaggtgtgcggtcttatttctgggttctctattctgttccattggtctatatgtcttgtttttgtaccagtatcatgctgttttggttattatagccctgtagtatagtttgaagttgggtagcatgatgcctccagctttgttctttttgcttaagattgccttggctattcatgctcttttttggttcaatatgaattttaaaatatttttttctagttctgtgaagaatatcattggtagttaaataggaatatcattgaatctataaattgctttgggcagtatacccattttaatgatattgcttcttcctatccatgagcaaggactatttttccatttgtttgtgtcatctctgatttctttgagcagtgttttgtagttgtttttgtagaaatctttcagttccctggttagctggttagctggttagctgtgttcctaggtgtgtgtgtgtgtgtgtgtgtgtgtgtgtgtgtatatatatatatatatatatatatatgtatatatatatatatgtatatatatatttggcagttgtgaatggaattgtattcctgatgtagctttcaacttgactgttattggtgtttaggaatactagtgatttttgcgcattaatatttttgtatcacgagactttgctgaagttgtttatcagcttaaggagcttttgggccaaggctacggggttttctaaatataggatcatgtagtctgcaaacagggatagtttgactccctgtcttcctatttggatgcctttgatttctttctcttgcctgattgccctgaccaggacttccaatactgtgttgaataggagtggtgaaagagggcatccttgtcttgtgctggttttcaaggggaatgcttccagcttttgcccattcagtatgaaacgtaataactttgaaacaacttatttttgtttttcctcatcagatccacagaatggcttagtacagtttagatttgtgagtggccaagtgaattcctgtaagtaatttctttttcctgtgttgtttgaaaaacaaatgtgaacaactctgaaggaggctgtggttacatgttttaatcagaggtaaccgatttggttcctggtcaatagaacttctgggaaaacagtagttaaaatttaaaatgacacaacaattaaatccatgatctattcactgctattgaaccaaggcctacctggagcaacaacacagtggctttccaagacaccaacttttaaaggttaagaatttgcttcacattttgaattccttaatgacattctgttgaggtctcacccgtagatttatatattcaacaggctaaaaagttaattgttatttgtctaaaaagtgattaccattttgatgagggccttagatgaacacataaaatacatactgatcaaatttaggaatgacaaatctgaaaaagataactaatatttttgatgaagggattgtcagatcacaattgaattgtaaatcaaagcaaacaagaggaaatttaacagaatacacataaaggttgacactttcataaaaaaataagttgtcaaatatagaatgggaatagaagaaacctatgttcataacagttaatgtgaaaatagtgatgagcattttaagtcaagtgtgataagatataatggtttcattctactttggactaagtaggtaaatatctagaatattgtgaccaattatgaaagccacacatgggactttgaaaatctgaagaggtgtcagttttaacctagcaggatgtgttcaatttttcagacacgtcctatgtggaagagaggctaaatcagttgggatcatccaagcaggaggagagaaagcttatggagcccgaggggttccttcagatacctgaagttctctctatgctgtaaaggcttcttcacagcatagtaaacatcttgctgctcagtgtgaaggatgaagctaggacaacaacctcagatgatggatgccatgaaagggacatgggatgggtgggaagttgcacggcctttgaagattctttccaactctatggttatttgttatttgaagttcaagattaatgccatttgaagagttatttttgtatatcttttatgaaatttgatgttccccttgactgttcctattttcaaatttcagctatgtttccccatgaaaattttgagaatgttcacatgactttagtatttagagatatcagtaaacttacatagtgcctgtctgtaaacctctttgacattcgtatgctgtcaaattgcttcacttgtggtctcagcaagattagggctgtttctttcttcatcctctgagctaggatttatttcattattctgaagttatacaaaaacacacatacattccaaatgcatatctttttggctctttgtggaatcttattaggtgtgttaaattaggaaatagtacaaaaaaaaacccatgaacagtcttcaagagtaagtgagttaataacttttcctaattaattctttagaggctcttcctgagaagaattttgctgggtgcacatgtccaccagctctgtgtccctcctagaccccctcttttgcccccattaccttctttgctgctaccacaacaaggtatattagcccttgaaattaaagatgttgctgtcccagttgtgcttgtcttcacctaaatgcatacagtcatattccaaaagactatatattagtgatatctatatagttcacccttcatatacatgagctcccgtgtgtggagtgaactaattgcagatataaaatatttgggaaaaaatttcatgtgtactgaacatgtatagactttttttcttgttatcatttcctaaataatacagaataataaccactgtttacatagcatttacattgtgttaggtattataaataatctgtacataatttaaactgtacaggagaatatgcataagtcatatgtgaataccacaccattttatatcaagtacttgagccatctgcagattgtggtgtccatgggaggtactggaatcaacccctatagataccgagggacaattatgtttcttcaggttttgaaaccaacttaattttggaatgggacctgaagttgatagcagcagtcttcattacaacttttgaggtatcctagagatcctcgggcctcagtttgaatgccaccgtagggttatggggctgtaacagatagtaagctatcaggccaagtaagtgagcagctctaggaaatatatagtgtctcttttctggctgtggcttagctgaacattcttaccagacccccaaatccagtctggttcatatgaaaaaaggtaaaataatcttcttaatgaaggccatttttaggcctgtttgaatttagcagctcatataggagaggagcattaaatgatgaaaggacaatgtctgcaggaatagcactgccaaataaaacagttaactggctttctgggggaccagaaatcatcatggcaaaagatcattgttcaaactagtggtcaagagttgcaatcctacttttgccctttggccggcatgtgttggggaaagttgaccttagtatgtgggctggtgggccaaaaaagaaagtgatgctatctgcctgttttagaggccgacctctgcccactgggaagcgtttgttataggttttcacaatttctaaatatatttgtgtggctgtatagacttaaaaagagaaatgcttaagcttatgtttaataagaaaatgtaaaatgcaatttgagtctttattatccttaactttcatgaaatacccacgggttttttgtttgtccttattcttatacataaaattgtgttatcttgctggcattaagtatttgtagaagagaaatacacaatctcaccatttccctttttcctttttcctcagttttctgtaaacatacgtgtacacacacacagacacacacacacacacacacacacacccctgacttcaggtaaccagtgttgtcctagatgaggctgagcactgtttcctgtttctaacatttttccatctcttggagcctctcccttttcctccccctaccccaaagagaaacaagtaactattaatcagcttttatgggaaatggaaaatagactctctagcctagcattgtacaatagagttttctgcaattatgccaatgttctgtatttgcactgtccagtatagtagccattagtcatatgctgctattttgcacttgaaatgtggctagtaggattgaggaactgaatttctaattttgtttcatgttaatgtaaatttaaatcaccatatgtgactagtggctaccatattaaacagaataacaattgccaaataatttatagcatcagaaactgtgctgagcaaatgtactaatcagtgggatgcaacattctaaatacctcttttctatattgagccaaatggtacttagaagtaatgcaatatcatttttgatagatgttaagatgatcatcaaaaaagatgaataaaagccaatatccacctaaagcatttgtaattgattgtagagaccattttctattttatgctagatgctttacatatcgctttacagctgtatcatctattattttcacaagaattccaagttagatattatattttcccatttcatctaaggcaggaaactgcagcacaccaatttaaaataacaaaccaaggtcacacagccagtaaagagtggagccaagttttgaacccaggtcaggctctcctttgatgcatttcacaatgaatatttccgacatgatcttctagggcacttgcgcatgcctccctagtcgtcatttggaagtagggcaggtgtcaagaacatgagccctggcaccacactgcttgtttgaatcctgcctctactattaacacctatatgaagttgagcaagttacttaataatatctctgggcctcaattttctcattttaatatggaaatattaaaagtacccatctcattgggttactgtgagggattaaataagttagtatccggcacattgtttgaactatatatatttgccatcataattatttttaatttaaaagacactgccctttatgttaggatgttgatttgatatgataataaatgaagtagagatatgctttgggtgtgcttccctatgaaataagagagattcgaatcattcagataattcaggaagaaataccctgctgttcagccactttggtgtctctgtcagtaggattataaagtttcagagcccacatgccctggccaatttctcatctctttgcttgtcatgttacccttatagacatcccctttggtgtctttgattggttctgaatgctgagcagtgacatgcaccaacacagctggaaaggcctgtaagatttgctattctgtcttccagcagggaattattgccatggataccaatatcagaggaagactggggagcactcaccactcgcctcctgagtgtctgacatctgtttctggcaaggccaataatgagtatgctgctagcttcatatcaaatgagagtctgatctacacctattttgtttttgttttgttttgtttttatcacagatggcctctgcccaagatgccaggtacggccagaaagactcctctgatcagaactttgactacatgttcaaattactcatcatcggcaatagcagtgtggggaaaacatcttttctattccgttatgcagatgactcctttacatctgcattcgtcagcacagttgggatcgatttcaaagtaaaaactgtattcaaaaatgaaaagagaatcaagcttcagatttgggtaagtggctttgaactggcagtgttcttcaggctggggtgttgaacatatccatttgtaagggagaaactttctgccttgttctatccccagggcatccacaagcctcaatttccagcttctttgctgcagaacattctgtttcaaagaaagtagtggtgatgcctctttaagacatgaggggtgaattattattatgccttgttgtcatgtggtgctccttaagagtcttcagaataaaaaaaaaatccaaacctctatcttgttggtggtggaaggaacactttaagtctggctttgccttttatgatctctgtaaccttgagaaagtctgtgactccttctctgacatttttgtaatctataaaataagctaagtggttctgggtttttaggtcacagaaagcagcctctcctgggcatttcaaagaagaagataaacaaccaaatataggaaaagtgtaggtttagacccttcataaagctccagatagaacttcagagatggtctatttatactgtgcaaactgttttcaactctaagagctatgtttatatatgcaaataaaacaaatgaaatgaaatatttatttgaaacagggtctttccaaagtagaaggttctcccaaagttttgagaccatttggttagctttttgcctctccttacctccagaagaagatcagaggtagcttagccaaactggtgggataaatttaggagaccagtgagcaaaaaacagaggaaaatctatgtggatagcaggtccaaggcaatataaaagatggagcagccaatttaaaaaaattgttacaccaaaaaagactgatgtagtaaatattttatggacatcgtaatatgtacataggaagaatgtttctacagtaagttttggcacctttttcctattcctttgtacctctgccactcaaattgatttgatctgtaatcaggcatttcccaagaggtgttttctagctccttctgagacatttacaacagctactaccatttggtgctggtgccaggattgatcaataggactgacaataaccctcccttcataaatatggaaagctaaaaacaaaaaacaaacaaatcgcagagtagaggattttaacttttttaaaaaagaaaacagccctttatttaaaaatctgtataaactgaatgacctttacacatcctaaaggtcttattaaagtagaaatttaaagtaatatttaaagaggcaggtatatacacagacaggtaccttcttatgtagcttacaataggctgttactattttacttgttctaactctagagtctttcaaatctaattataaatcacgtaagaatttgtacaagtagaccttaggctgggcatattccctgctccatcattccccaaagccatttttattgggagtgttccttttcagaaacttgacctcaattaatggagatacctatcacacactcctctgtatggagacagaaaaagctttgtccattgcttcaagtatgggtcctgattcattctcttccttttgaattgcaggcaatccaattgttatatgatacatttcgtattaagttttaaggaaggttccttaattctcaggggctttggtgaatggaaaattaaattaatttggaaacgatacatcccttaactccatgacaatgttctttttactaatatgaaagaacaatcattcctctggttgatagctccactttttcctctcttctttctgtcatagagataattaaaaatagtggttagaatcatttagataaagcatcagcatggtgtgttaagccagtcttataatttctggcaaattttcagtgtaggtttttgacagaaattctttgttgaggtgcaaaattatctatcttcaatgtaaatcagatatatttcaaataatataaattatttttcacacttaaaaattattttctttaaaacaatgctggtaccaggccagtgctaattcactcaccttttttttttggcattgaaataagttatttatgtctacatctcacttctggatgaatatagctcttctctgagccaaccaaagctcagatccctgagctgcttctactctaatacctcctcatgctgctcagtttccataagttcatgaaaaagtctctgaaatattattatcttcagatttgcctctaatcttctacaatctactagtttcttattaaaaaaaaaaccctttaagtctatagacagtcaggcctgggacctcattctagggcctccattctcctgctctgtggatgcccacactcccatcagggttcagccacttgggaatccttcactttcccccatcgtcagtcacaatagtagattaatagccattactatcattgcaattaaaacataatccaatttcttcctctttaggtacattaggagctcttaaggcacatctgattttaggagtgtgaaaatcagttttataatagtgtatacaatactgtatactattatatgtactattgtggtctgttagattgtgaaacatttaaaagaagtacaatacaaagattttgtgcttatggaacttgtagtatagttagaaaaggaaattaacactcgttggataattatgtacttctataagcaaatatcaaattgtataaatattatgcatagctagcatttattgaatacataccatatgttaggcattatctttgccttatttctaattctcacaacccaacttttaatttattactatcctattttacctgagaaatctgcatgtaggacagttaaataagtgaaataacttgttcagggttgcacatgctgaatggctaagaggggattccaagctaggtctatcacattctaacactgcgctaattaagagtcttcttgactaatgtggtggttattttttttgaaaatggcaatcttgagtgatgcatctgggatggtgaaatgtttttgaaagagttcacattgaaggcatgcaggagaagaaataatgaggagcaacagtggtatgcttaagtataggcattcctatgataattccaggaatccttgcattatgctataatataagtgtgctggaaattatttagttgtaggtagttatgattgtttaacaactctcacaaatcacttatttggaaatatatttagcacagatggcttgtcatctcattgtgctttaataaccaagcagtgaactgctcttcccaacttatagtatttttatgcatttatattatgtgtaaataattcattaagatccacatcatcttagcctattatatatttcaaagaaaagaggcaaaatggtttcatagtatgaaagccatcgtgggttgaaacactataccattttctctaccaagacaggtttcagacattgatttaatttggatcactctattcattttaaactgcccccaaatagaactgtttctaagttaggaaaccaagatatagagaggctaagcgatttgaccttaccttacagttagtaccagagcagagcctaaaatccaggtctcctgctaggtgggctagtctggtttctactacattatacttcttctcaaggtaagtgttgtatgacaaaaattgtaataaatctcaacctggttgtcagtggaatcctccagctatagaaaaaaatcaaacttgaggccaggtttcaagtatgatttttgtttttatttttatttttttgagaaggagtctcaccctcttgcccagcctggagtgcagtggtgcaatcttggcccactgcaacctctgcctcccaggttcaagcaattctccagcctcagcctccagagtagctgggattacaggtgtgtgccagcacacctggttaatttttatatttttaggggagatggggtttcaccatgttggccaagctggtctcaaactcctgacctcaagtgatccactcgcctcagcctcccaaagtgctgggattacaggcatgagccaccacgcctggcctcaagtggcatttttactgggtcaggaaggaagagcctgagtgggaaagcgctcctcattttctacttgatggtttgctttcttgtcacgtgctgcatagggattttctgattcttcaaactggattagtagatttgcaacagtctacattcaaataaagcattttaacaagtaatagacacatttatacttcctgaatgcgttacacctcctctctgtggaagcaggaaagaatgggagggtcagagtacgcagggttcagattagctagtttgaacaacttcaacttactctgggacacaggaacgatccctcagttgcctggcacttaataagtcctggagcgattagggcaggtggatagtggcccagagtgtgaaagccctataatggaggtggttgggagtgtgtgctctggattggttggtttgcctttgaaaagagtgctccagtaagttgtttactatctctagaaactggctaatcctgggagggtcagtccctgcagaatcagtgaggccccaaatgtcaaagcatcagaatacaaaaaataaaaaatctaaaaataaaagacatggttaatatggagggaaagttcttggggcctcaggggcagtctctgtcactaatttcactctgacaaatgctgtgattcccaactgtctcactacaggattggtatatttttgggtctcagtatttggagacctagtacattgagtcaggaaaagatctgacagattttctggctcaacctcctcatttgatgatactactaataatagcaacatttatcaagcccagtgctgacccataaaataagcactttatgtttccatgcattttaaaatttattttttgcaacaaccaaataaaccaaggtggtattattagctctcttttatagcaaggaaacagaaaaccagaaagacaaagtgatttgcccaaggttatagtcacaagcaggattccaacctgggcactgagcgcaaagcccatgtacttgaccacatggtagaagagatccagggaggccaagtgatttgtcagaagtttcagatctgatattaaattccacatattttaattcatagcaagtactttttccatgctgtataattactcagtatctttcagtagtttcttatgacctgtccaagatattatttatagttacagaaaagaaccagttgttttgcttggaacttactatctggcagcatgagcactttgtgcattatctgttttgtgtttaaaacacatagatatgcacagaaggagggactggaacacattcaactaacttcttcctgcacatttctggaatgctgtttctgctgttggagaacgtgaacataaagaaaagggcatgaaagaaggagtctaatggcataaatacctacaggaaaatatttctgcctataatctttgcatttggtgctcaggtggcctagtcaccctacccattgattccaggaaaacaatcaggtcctctggtctatttataaggaaacaacactttctgcccaggcaagcttcttaagaaaaccaccaaagccagtgacagctgccaagaccattcttggtgctgtcatttgtatgctcttttcccccatcacatttcttctaacttagcatctgcttttcctgagagattgagaaaggcaagatttagttttactcttgagagaaagctgatactgtgtctgaaatgtcaagatgcctgaaaacattcactctgtcaggcagctgaacgcaggagctcctacatcccactgtgtttaaccactcttctcagcattgacaaaatacaaaggatggtacgggcattgttcctggcttaatagagcttaccaactgcatgggaagacaggaaaacaaacatagaagaaaggatcaacctgtggatcagtaactgtgttctgccaaggggtagagtggcctagtggcttgagcagggactttggagtctggtgacccagggttcaaatgttgtccctgattctcactagggtttgacctcaagccctgacttctctgtgcttccatttcctcgtttatgtagtggggggaaataacacctacccctgagctgttaagtatttgctatggtaaattatacttagttcaatactgggcacaaaccaggcactcacaaatgttagttttcttcttttctaaaaatagtgtaccaaaattcagacttttgtattcaattaagtaatttaattgaatccaatacttgttggtgcctactgtgtgccaggcactgtgccaggcattggacatataatggtagagcacgccaagggtctgccatatggagccataaggagatcgaattccactgctgctataaatggtccaaaaggcctgagcacagcacacacagggaggatgcccaacaccatcctggggactcgggaaggtttcctgggtgtaacaacaatgggaaggggaagcctattttaggtgatcagtgcggattgatacaagatgctaactgagctaacaaagcctgattttcctcccattttgcccctgtttgagcagaggtggattgatactgttggggcttgaagcttttacagtttgccagtcctctttaaggaaaaagatacacaatgtctttcttatgaataagtgacagaaagcaggtgaccatacaaacacattgctaaagcccacttggaaggtacccaaagcctaatctttaatcagcttcatggaaatccacctctacttttgtcgaaaatttacctgtgattctatagggactgacagacacatgtgggagatgggaaacattgacaactagtaccaaagagcaatgtacagtggaacatgcaggcaaagatgtgtgaagacagtgggataaagaagaggcatcggggcaggagactggatttgagacctctctgtgtaaccttgggacaaatgacttcacctttctgggaagcagttatctgatctgtaaaatgaagaggatccactcaactgaaaaaaaaacaaacaaaaaaaacccccaatctggcattcagtgatccctaatgtgccacatacagctgtgtgtggtttataggtagtgagttatctaatcctcacaaaaaccctgtgagatagatgctattcttgtctttagtttacaaatgagtaaactgaggcatagagtgtgtgaataccttgcccagggtcacatagacaagaagtggctagcagatttaagtatggaccacctagctttggagctttttctcttaatccattctgctgcaccctttctctataagtacaacatttgagtaattgctctcgaccagccactgtgcatattttatttgcaatgctggaaattttatttttaacctcaaaatgttggtattaatattgctctttataaggtaagaggaaaccaagactcagagagtttaaataattcccccctggtcacataactctttatactgcttatagagtaacttcaagccttataactgattaaaataataaatcaaatggtagccaacaatcaatggaggaaaaagtttttccaggaatacataaggtaaaatggacaaatcatgacattatattccatccagattaatctctttcatgatcctctagtcagcccaattcctacaggacttctatcccaagactgctaagcagctctcaaagcttctaaaaattcaaataccggccgggcactgtggcttatgcctgtaatcccagcactttgggaggccgaggtgggtggatcacgaggtcaggagtttgagaccagcctgaccaacgtggtgaaaacccgtctctactaaaaatacaaaaattagccgggtgttgtggtgcacgcctgtaatcccagctacttaggaggctgagacaggagaatcgcttgaacctgggaggtggaggttgcagtgagccgagatcacgccattgcactccagcctgggtgacagagtgagactctgtctcaaaaaaaaaaaaaaaattggaataccatagttttggtaacagagaacggcagttctgtgtaactgaaatttcaggtaagtaaagcttcacattatgagaactttaaaccaattaaatcttttaatgaaaattcttctaatatgtgctgcacatttgtttatcataagggaaaaaaagaacatgaaagataagccaacttgacgctcaggattatcagcatctgatgatgttttctgtatacttggttctacttagtatgttttcttttctttcttcagtgtcaaactgtccgtcttcatgtttctagctgctttcctttctcattctaatttttagctttcattaagtttcttttttcttataaaccatgttcattgtcatttgttagccaagttgagaggaaagtggctcaatatgtaggtatgaagatcttttaaattagtatgcatgagctttgtagtaggggcactggggagatctaatttagtctcacagaagcctccctttgcactgttttgtaatcttcataaatttaccaaccaaaatgtttaatctgcctgaacacattggtgttacttttatattaggcctattctagacttacttggttctaaatccccctaagacaaaaatatcacacagtggttttgtgatcaagaatgggccccaaagccaggctgtctgagttcaaattatggctgtaagatttgtggatattatgaccttggacaagttaattaacttctccatgccagtgttttcatctgtaaactggggacaataataatattttgcttatagtcttatcgtaaagatgaaataaaatgatatttacaaagttcttagcacaatacctggcatatagtaagtactcaagaaacaaatcattattatttctctcaacagcctttattttatgggccaaacctatttaacgccatactttctgaaatagcaagtagtagtactttttttggtaaataaattgccagtttgcaggcaggtatttatatgaagaacttcaattttggtgtcctgaagtaatgatatatacaagcatattgacaaggtggcatatcttctggattgctctctggatcacctggattgctctcaccaaccactggtaaattttaatatgcccaagtgcagtgagctgtgttgttgaggtgtttcctggtgttttggagccatctatgcatttaaatagagtcatcaactgcacaggaaaggcaaaaccatacagcttatttattaaatgctcataaaattgatgccctgccctagagcaaaacaattataaatcactggatccacagagagctgtaattcacctattgggatatgatttcctcaggatattgcctactgatgtcagcagcttctggtctaagatgtgagctgtgtccatgccaccaggtcacctgtagttatttttctattgattcatttacagttatactgaactgaccagtttttctggcattaaacacagctactcgggaggctgaggcaggagaatggcgtgaacccgggaagcggagcttgcagtgagccgagattgcgccactgcagtccgcagtccggcctgggcgacagagcgagactccgtcttaaaaaaaaaaaaaaaaaaaaaaaaaaaaaaaaaaaaaaaaaaaaaaaacacagcttaaattcggtgcaaattaagcatttaattaccccatatttatttttcaagccagacttaagaaaaaagtacagcatttttctagttggatagtacttattttcagtagtaggcatattcttctttttccttgtgcttttactttcctaacactaattttgctagtcctgaacattgccactgtggcagctaaacagcgagataagagatagcaaatgtgagcatcacttgatacaaatcactttgctgaaggtgctgatgcatatgaagggaaggaaagcaaggtctccatcttgttttactatctctggagcaactaaatcaatttaaaaatgtttacaaagcatcggggccaggcgcaaaggctcacgcatgtaatcctagcacattgggaagctgaggcaggcagatcacgaggtcaggagattgagaccatcctggctaacacggtgaaaccccgtctctactaaaaatacaaaaagttagctgggcgtggtggcaggcgcctgtagtcccagctacttgggaggctgaggcaggagaatcgcttgaacctgggaggcaggggttgcagtgagccgagatcgtaccactgcactccagcctgggcgacaaggcaagactccgtctcaaaaaaaaaaaaaaaaaaaaaacagtttacaaagcatcgtgtgagaaacaatagagaaacaacagaaaagtacaaaggagacataaaataaaaaagagttgaagtaggtaaagtatgagacagggttttggagaaaaacaaagaggataattttagggagtttaatgattttacaaaggtgtgtgcaggcttagggaagtaataagggaagatgcagactccagagctagcatcagagagtcattaccacccccttggactgaagggaacagagaaagagcagttaggaaagacctgtagctgtagtaataggagaaggacattacattagagccttggccttttagaacacagccactgccaatcagtagctcatcatggaaggggccacagatgccttggacctctcattcatcccaccttctgatctcttgcctgtgcttctcatgggttgaacccaccttgaggttagtggaacagggtggcaactgctctgttttagcagttcacaaaacttagtccccggagcacagggtagggtgagatttggtaaggagtggatctggaaagcaaagaaacatatccagcacaagaaagaagggctgggattcagagggtgccttccgccttgccaggctgagcacgctccctgctgcctgagcaaggttcccacacaacaacagccgacccacactggcctctgacaaacatgtttcctccaaaagataagtcaatctgttttttataaagggctgggcatggtggctcatgcctgtaatcctgacactttgggaggtggaggcgagaggattgcttgagtacccagaagttcaataccagcttgggcaacatagtgagacctcacttctggaaaaaaaaaaaaaaaaaaaaaaaaaaaaggtgaaatttatttaattatttatttaatttttaaaaacacttgaaaagaatattacttgttataattaaattcttctcactcttttggtaatctggcaggtggtagatttttttaaattttttttgttggagatggcaatcctccgtcaattacccatttgtatttatttattaacattattttggttttggaagcccaaatatctgggattcagtgatgtggagggtagtatagacgcccctgggctatgtatagctggacagtataaaggaagcagctggagagccaggcaggggctgtattttagtcaaacaactcctggtgcagcttaaagcaccagacatttatgaatgactgcagtgtgctacgcaaagtgctaggccatggaggagagggagccaagagtttttaagcttcctatcttctagtaacttactaaataatgacatagaaacaggcgtggaaataaacaaaagaccagccaaatgagaataggcttagctatagcaaagggatcagccaccatcacttgcattttggcagagactcaaaggcaagcagaggagtgggaaagctttataatggaaaaaaggggagcgtttatgtatgccctggttgcaggctgttagcatggggaaactgtaggcatgctaacaagaagtgagacatcctatgttattggctggtggtgcatattttgctttctttgattgatcctaaattggaagcagggacaaaaattggggaagctgtcagtgattaatcaagtcctggaccttttgggaaaattattacaaaagtttttgctaagcctccaagattgtcactaattagagcagtgtggcttcccgcaagtctgacttctaacaggctggctttcctggtgtttattgtagataaggaggttggtttcctgggaaggttgctgcaggttgtgggtcaaagttctgcttttacatgtgttctgggtgttgtctatttgtacgttgagtctcacaaatatacctaactcagaaccaactttaataagagcagcaagagagatagcacaagaaaaagtaaagggttttgggtgtctgatagcttggctctaggcaagttattaaactctgtaatgcattggttttaattttctataaaataaggataataatatttgccttgcaggcaaaatatatttggcttgtagggctgttttaaggaattacctaacatgtgtattgtgcctcttttggtgttctcatattttttgaactcatttcacccttaaaaactattgaggtcatcaatgaccttgtttttatgtgggttatatctactgatatttaatgtattataaattaaaatgaagaaaattaaaaatatttattttcattttaaaataacaataaacccattgtatgtacacataaagaacatattttaatgaaaaataactgcattttgaaagacagtacaattagtgagaaaagtggcatttaaaaaaatctcattatatctggcttaatcaaagacagctgatttttcatatctgtttccttattcaacctgttgctgtatcacacatcatgtaacctctggaaatttccactgtacactcatgggagaaagacaatgagaaaggcaaataaaaacttggtattcttgtgagagtagttttcaattcagagaccctctgaaagactttaggaaccttcagaccacattttcaataccactgctctagaccatagaaggcactcatataaatcattaataatattagcagaagactacagcagtgttggcatttatcacaaggggcacttctttatagaggtctgtcttgataaagaggccttgttgttgtcaatgattggaaaactcctatatgctggcagattaaaggcaggagatcttctgacaataggtggcttccctggaagccaggtctgaggctcaggacgaagagtgcaggtcttgcaaatgaagactaaaccagagagaagttcttatttttcagcagtatctgagtgagagaatgagtaaatgaaaacacaaatacacaccctttataccagttattttcaacaatatggcaacagcaagtgcaaaggactggaaaataggtcctgtggccccacctcactgctcaaatctggctcactggagcaacagtcttcccagttctgagaagagaggcaggtgacaaatatgatgaatcctccttcctccatcctccatttgctttacaaactgggcaactgagtggagaagccattgggttttctggcaaaattctgaaaaagggagcatagctggtgaaaacaagctcctggaatctgaaatcccagtctttcaaagtttatcagaagctaaatgttcaattacatgaagttatgcatgactgataggctaatgtctcaaatatttaatggtatttaaattttaaaatagtagtttgtgaagcaaaggaatgaatgagctttcagcaacaagttaaatcatgggtcatcttccctggactcttcagattagagtccctgtgtgaaggctgactcagactcacaaggcatattattgacactttactgtaattgagggggagaaatggactgatataaattatttcattttaattaaacaatggatctgtcctcctactataagaaaggaaaaaggtaatagttttgttttttggggtttttcctctcttcaaattttgcaaagcaattaaccttcaggttaagacaaaactcagaatattttatctctaccacttaatttgtcacaaatttacagtcaattggaaatataataaaagagtgagaattgaaagcatttttcttactttgctgtatggctagcttctgcaaatgctgtagcaagttctgtacatgtggttttgagaatgaaattctaaattgagttttataatgacataaaggctgaaagcagagattaaaggagagaggcttcttactcagagactggtgaaaatccagatctgctgagacctttcagcctggccttgatggtgacacatgaaagtgattctacagttgggaggcactcaagtttgcagatggcctgatctcacaatatgagagagattcacatatgaaagcaaccagacaaagaaggctgtagaaactagaagcctgggtgaacagttttttacgctggggtttatcagaaccattgtctcccagaggagtgtctggtcaataattttaacataggaaccatggtctctacagacctcaaagtgtggtcccagagtcagtcccttgtcggaatcacttggggaatttgttataactgtagattttgaaccccatgtcaagcctactgaattcatatctctctgtaaacagaagcagggaatatggatttctaataaacttcccaggtgataactgccattctgagaaacagttcatcctgtcatattgtgtctgttcacggagggctgaagggaggtctacttcagtctataaacattgatgatggatcggggaaggggcagaccaaggtctttttctcagacctccttctgttttctgtagccagataacagtcttagattggcccaaatatggcagcaggctgtaggcctattcttcgagtggctgtggacagagggtatatgtgcctggagaatagcatcaaagcttaagagcttctgacatactgtatttgacaatggttctacttgctctttcatccccttctcttctttccctaccagcctattaccatccccttccctctctccatgactgaatacagtcccacttctgtctgattgctaactttgctttggattctttctctttcctcctattcactacattcttagctattgaagtttagaagcattttctctccattcaccttcatctcagttttctattctagtctctgaactggacatgaagcaaaatgggaggttctaatactatctctgtctcaaccaaagagatgtttgtctccttaagctttttggcatttcccacagtgatttgcaaatttctttttatgtcatggagtcatgtctttaaaggaaggcatatggaaaattccaatgactagagggaactgacctgttttcagcaggctaggaagcatacggtttcatttcttcaacttcccaaccccttacctagaggaaggcagagagggctcatcctggaaaaccattgctctacaacatcttttagaatgagggcagaagaacctacagacacatctctggcagactccatccatggggtaagcccctttagagatggcagatcttatggaaagagcccataaagtctcttaaaactagactataggaaggaaagtagagggggaggcacaaacgtaaagacatctagcccacagggaatctgccgtaactctaacataacttgtgtatttgtgtgataaggattcattagtaaatagtgccaggaaaaacatttaatatggacattctctccaggtagagaagagaaaaaaattgagatgagaccaacagttaaaactttccatatctgaataaaagtcatattattaagagatacatgaataatctatcgttcagattttgatttttcttaactgcctcttccactaagttatatgggctcctaagggttatgggctggacattatttaattcaggagtctcagcatctagcattattggcccacaggagatctcagtacatattgaattaatgaatgggtatagtaatatctaacagagttatgatcatgctcgtttaccctatacatatttacttgttaaatttgtttgtttgggccacgtgtggtggctcacgcctataatcccagcactttgggaggccgaggtgggcggatcatgaggtccagagattgagaccatcctggttaacacggtgaaaccccatctctactaaaaaatacaaaaaaaaaaaaaattagccgggcatggtggctggtgcctgtagtcccagctactcaggaggctgaggcaggagaatggcgtcaacccaggaggcagagcttgcagtgagctgagattgcgccactgcactccagcttgggcaacagagcaagactccatctcaaaaaaaaaaaaaaattgtttgtttgtactcctaaattttatttagatatttttagttctcacaatcatcactgttcttctttcccattatttcaggagttcaggttgagggatatttattcacaccattgaaaagtttaaagaaatattatacagggaaataagatcacttgggagaactctgccttccagaagcaagtgtagcattctggttaggagcacaggccctgatgtcaaactgtctgggttcaaatgctgaatcagctccattctagaggcttcctaacttctctcaattctagtttctttatctgtataatgggcatattagaatatctcccttatagtatggttatgaggaataatcaggataaaacatgcaattcatttaacacagaacctcataaatggtaagactcaagaaatattagttcttgttattatttgtggcttagaccaagaaaaaattcaacatccaatctcagaaagttgtgttttgccactttgaaactttcccctgttaatataaaactactaaatcagagtgccccaccatcaccacctcaggtcacacctccctgactctctccttgagaaaaatagaaagttgtgcaagatgcctcccaaatattataaactttgggccccacagaacctgggtctgtggcagttcccaagtcagtgggggagaaaagctgaagcagtgtagtaacaatatattggaggttgctgatcctcttcgcagaagaagatgaagacttatttcaagatgaagacttttaattggactaaaataaactgatagagatagtgaggtaaagacagaatgtgagataatataagcaaaaaagcagcactttttgatacaagtgcattattgaattcaattaactaaaggtaccacagtaaggttgatgtttgatgtaaaaacactcaaagaggtgacaagaatattttctgtccagtgttcagtgagtgaagggataagtcatcagagctatcacgtgtccagagtcacaacactggaatacccatctagatgtaaaagttatcagctctcctctgtttttcttgaagacaaagtgggaagagatgtgctaaaatggcaaaggaaaagtttaagatcaaatgcataaggaagactgtcttgttttgtcaaacatgggaagttacatggggaggttgctgtccattcttaatgggaactttccaaaggaatgcattttaatctgggtgcaatggtgtaaagaaagaaagcagtgaattggtgacttataaaggctcctgcctccaaaaaaaccctttttaaattaaagggtgtcatctggcacacagaatagttccctgagcttacaggaatgatttctacagatattttttagccagacggagaattgtcatcctgggagtcaaaatcagactaattttttccagacctagaaacctcctgggacttggctagtgcaggtgcctgtcaggaccagggtttgtacatcgtcagattctttcttcctcctctagccccagaggctgtgctctagagcatactttacctctagagtagttgtcccctgagcatttgttttctttcctgacacaggaaggaagataaatactgttctgtcacagtttgagaaggcagtccatgatcatgatatagctaataaggtgctcaggagggaagagttcactagatggtggacaacgcgtggtgtttggtaataggagatatatgcaaaatttgtgttaacaggttatttaattctggttactaatttatacctgcatttgggaagtagagaaaagaacacattgaaaatcactgagtatattaaaaataaaatgctgtcaaattaggaaagttaaagaacgggccaaagagaatatagtattacattaattacctgtttgactcattgcgctcaagccagcaaacttgaggcagctgaaataattactgtatttattattttggctccaccccagcttgaaaaccaatccttcttggatgaagagaatatataaaatcaaaacatacttgttcacctgctcagtttcaaagagatcttctgtctggtcttcctggtatcccaatttcctagaaactggtttccctgttcttctatcccagctctctagtagatgggttcctgcccaaatgtgcttccctagtatcccagtccttttagaaactacattcctgatgtgaatgctaatctctgtattcagtttgggttctggtcaagtatccatcataactggaacgttgaatcctgtcttttgactcatgtcctactgtggatgcctcttgattagccatcaccttgcttttgcatttctgcccctttatttacttttgccttatttatctgcctgcactgtgttcttgagtcttctgatttgactccctatatcccagtccatcgtttggattttatatccaccaaatgctttctccagtctattttcaattatgttaatatcattttgccagcctcctctaattagaaaagaacaaataaagaggaacaaaatgtgcctgaccaggatgaaaaataaatcacccagaaagtggtgaatcataagccttggaattgtctccttttcgttcccgaagaacattgttgcaatgagaaggcaataacagaccaccaaaaagataggaagggcatatgagaatttcaatctccttatttttgtgatgtcaaggcctttcatatgtgtccttaaagttcctgcatttgtaaaatttttgcatattcaatacatcacataaaaaattttggaaaacctgatgaggagcatatgaaaattggaagcatgaataggaaagaaacttttaataataggttagttatttgttgctgttgttgttaaattcacaattagtggaaagtaaccatggaaagaatgggcatgttgagagagcattatcattttttttttatttcaaagaactttttttttttttttactattcagtttgaatggtttaataatctcttccaattccccatccctgatgtcacaaaagtgtcatatttggaaaaccaaaaggtttaataatcttttagtaagcctttctggcttcctgaactcaagaaagaaaatcaaacaaaacaagtgttgaacattcaagctgtattctgtaattttttacctgcttttcttcttcctttgttcttctgtcttcctctttccctttgtctctcctgctatcactcactctctctctaaatgactagatattcattatccggatatattctgttgctggaacagtaaaagatctgtgatttctatccccgaagactccagattttttctgggattttcctataaaaagacttaactgaagaagaatagacaggatttagagaaactctttaaattttggatatactataagttccaaaattaatatattcctttgaaagataaaaatttttaaaaggaaaggtggaaagacagaaaaagtagttggagctacccactcaaggcttagtcataattaactttaatactgaagtagattttttggaaagatgattagctttcattagtgttttaaaagtacatatgttcattgtagaaaatgtgcaaatacaaaaagtagaaagaaaaagacatcactggaaatcttactacccaaaggtaactatttggcatacagctttccgatttttccctatatatatgttccatattttaaagaaaatatacatatgatatcaccaactgtgttttcacatatatgttatgaatcttttctaaaatatttaaatatacattgaaatcctggttataagtagcaacacaggagtaatttatttaagcaataccttattactggcttttcttttttcctgattatttttgtcattataaataatgataattttcaatggtataaatacctctttgggtggataagtcccagaaaatagaattttgaggttcttacagttatgttgcctagttgacatcctaattgctgtgattttacacttccaacaagagggcatgagatgcctatttctttgaaccctgcaatgcttgtcataattattcttttgattgccagttttgaattcattatattttccctttcatcttttgaggtgtcttttcatttgcatttttttctttataagttactaacttttctattgttctgtgcatctttattttcattgatttgtgaggctttttcctcttataaataagcttgtttttcctgaaaataagcttttctaattctttgcattttgtttatggcatgttttggtcatccttaattttttttattctcatggagttatatttatcaattattttcttaaaaataaatgtatccaaaagacaagccatactaatgttaaaaccattataacattttctaaagtccgtgttattttataattataacccactttacaactcacatagatatatgttaggtgtgagtataatagaaacctcagcagactaagaacctgtagaaaagcaatgtcagaacagagaaacaaagttcagaattgaaaatagcaggaaacagacattatatgtcacctcgggcactgaacgtatgcaagctgtatatggatcactgttagaagctcttgaagcagttgacatcaacactaggaaatgatctttctttgttcagtagatcaaaatatagtaacaggtgtgtagcaggtgcctctgagttccctacaaggttccttggcctgcatctgatgttagccccaatggcagcgtgggcaggtctgtgcacagtcagcatcccacctcaagcacaccatgcctgccttactgcatttgccaaggcttttctgatggcacagctccctagatctacacttgcaagtgtggcctggaagtgcagtgccttgaaacactgccactctcacactaaccctcatctgatagaagaccagagccaggagataagttattgagtcttccctctttcgaatggacaattctggaaagctttctgtatgcttttcagataatagctgtactgaaacacccttgctcattgaaatgagtgagctaggaaaggagaaaaagacaatgtaaagatacattatcgatgaccttgattttttttaaagatacattatgaaggtatgcatgatatatctttacattgtctttttcttctttcctgtctcaccctccctgtcttagtcagcttgggctgctataggaaaatactataaacaagttgctcaaacaacaaaaattattttctcacagttctgaaggctgggaagtccaggatacctgtgccagcagattcagtttctggtgaaggctctcttcctggtttgtagacagctgccttcctctgtgtcctcacatggcagagagaggagagagagccctgatctctcttcttttaaggacaataatctcatcatggggaccacctcctcatgacttcatctaagcctgtttaccttccacaggcctcgcctccaaatgtcatcacgctggggattagggcttcaatatatgaattttgggagaacacaaactttcagtctcctcagtcttgctccctgttgcttcactcctttttcccagaatcacctcccaaataaaccacctgctcaccacaagttccctcctcaggctccacttttaaaggaactcaaattcaaatagtgtcttctctaaaacttatctgttaactgtgcttggatgatataaaatcatgttttttcaaagatctattttataattgtaaagatgttacccttccttccccagtgatgtttcattgtcatgaattcctaacatttccattctctttctttatccacagattctgtcaattaatcaatgattttttaaatgtactagggaagcttactacataaagggaatctactgcacacaggggcataatataaaagtgcagtcatgctgggtattcccagtgcctttttaaagtgtgggcttgatttctttcccagcctctctccaaccaacaaagactaaagagagagaaaggggagcagcctctcctggttcctttcctgaagtcaagctcattctggcctcttggaaaggaggaacttccagctgctggcagccaatatgtctgcctgctttggagctatttttcatgacctatatctctgccaggaaaatgaatgtcaggaatgtacatcagaacttgtaaagtaggatagccttcccctctgcctttcccccaaaccttacgcgtttaaaataactcggagtgtggaatgaggaagggaagattgaggctgactatgcaattattcagactatattatttctatttggataaacattgatcccacaaatgccaggaaagttggcaatcaccattgtagagagtgctccattaaaatttatgagccaacatactgtgaggacataattattatttataattacttccatgatgctcagtgctggttttgagactatcttgtgtcaggtggtatataagatgccactgaaatatctgaccctaaaaatcctctcataagtgtggccaaaggatactgaaatgaaacagtagaatagaaaatcagatgtctttcagagacagtgttgtcagagaaggtgtcttctgtaggatgctaatcacacttaacatcattttataaagaggacatcaattcttctgctgttaactggtactctagtgcaatattgtaattatactaactttccgatcatctgacaacagaggcttccaaaagacagttttagttgagttacctttttggtattttgtactcttgttttaggaataaagaaatacatatttttcttaatcagatcattccttggattgtgatttatcccatcaaaccaaccatcctggagccatgttcataaatgaactgctttagctgcttttgatctctcctgcaggctgactgtcatcacctgtcagcaacttcatataataagatctggtgtgctctgtcagtttgtatcagagcaaagttaatgtgtgagtgcaaaaagagttgacccctaaaagaatggaggtgtgctatgtgctggtgcaggctgtactcagtagtcaatagaatgcgtagagtctctgtaaatgtggtatttaaggaacaggctgttttcactgtgtaccgttgtttagtttttccaatcctcctgctgtggcccacttacgaaggagaaaacaagagagtgcacagaagcctgccaccatggtagctccgccagtgtgcgtggtaacaatttattttcatattggtcaaaatgttctaaataattttaacaccagaaatagcatggaaatggggaactaaattataaatgaaaaaccaggagaaatgctaaggatgggacatttcttctccatttctgattttttctttccaactggcacccatgatgggagcactctggcctctcttctactccttactcagcattacccagagtggcacatctgactagtgagttgggagagaaaacaaaacaagcaaacaaaccttctgcaggagtttgctgtctgctctgttcctcagggctgcaggtttcaggaagacctgtcccttcagcaccatctaggtggaccagtaacttctatgactggggagaagtctgtctacctctagggttttcacacctaagccgctgtctccaatgtcagcctcatctattaactgttttgttctttttctccactttttgttttaaaaaagagttattatttatgtttttttgtgttgtaaaatttctggaatatgtctgaccaatattggcttgtggcaagtgtagttgttaagagcacaggctccttgggcacataacataactcccttgtgcctcagttctcctctagaaaataaggacaatagtagtaacacctgtgcatagggctggctattgtgggtacactgcaccttgtctagcctaacttcctttctatgagccatttctattatcaagccatgccatttgcatgatgagctgcatttgctgtcagcctaatgttgattctaaacatggtgaactgttttgaaccattactgaactatagaactctagaaccaagtgagacttaagcaatcttagctttaggttctagttcaatggaagataaaactgaggcacccagacctgaaataattcatgggaggttgtacacggtagcaccaaagctggacattccatctgaccagactccagatctattgatttttcttctacctgagctttctttctctcttataactatttctgtcgactactctcctcacattcactcttccaatttaatgcagttactaagtctagtcaccaaccacattctacctacaagggattctataccaggcctcaataaaattttaagcattataaaacaacaacagtaataatagatagtgctccctgagattcacagtatatttttcctgttagagaaagctgagttgtgacttgcctgaagtaatcatgtaagaaaagcctactagaaaaacagtgctattgacttgtgatggatggtttttcctttataaccaagaacatttttaaagtcatatatgtatttcttgattgctcttttaacttcacttcttcctccctagagaactcactcttctgtttgaaacatcgcggggagtgcaaactaaatacagtattgaagtaaaatccctgcaaagctaatgaactattttatgtaaagtaaggcaggaaaccatttcagtagtggtggtgtaattaattggttgtggccacacagaggcaagattttagaaatgggcaatttataatagggatcttagaaggtcacatgtgatgaattgaaaggtagaaaatcattactttcaatcatgcatcaacctggaagccaaatcagactctttaatgtatgttttcaactgagagcagtttgcctaaatttcaaaaaggaaaatgtgatacatttgccaacagtctgcctgtatagctaattaccaattacatatcataaagaatctgatacctgtcatgttgtaacagatttcccaagcatggggcatgtggctgagcatactagcagataattagagtcataacagctaaaagaacattgtccttttaagctgaaagaacattgtccttttaagctgaaagaacattgtccttttaaaatcctcaatcttatttcaatatggaataatcctttttcagtgaatttaggataaatgacataagtatcagttggccggcttatttttatgcatgttcagctattctgattctggtgacacctgtggcatttatttttaggaccctagtaaactataactttttttttctttctatatagcttagaattattcttctatttaattatgtttagaagttggaatccattagctgggcatggtggtggacacctgtaatcccagctgcttgggaggctcaggcatgagaatcatttgaacctgggaggtgaaggttccagtgagccgagattgcaatactgcactccaacatgggcgatagagtgagaaactctgtctcaaaaaaattggaatccaggttaaattggtcacaatgttaccaagtcagaaagctcacaatgcagattgcaaaatactaatgaggacatcactgattttcatctatatcaaggtgtgtttaaattgctaaagcaatactgttttagttttagtttttgtttttgagatggagtctcgctctgttgcccaggctggagtgcaggggtgtgatctcagctcactgcaacctccgcctcctgggttcgagagattctcctgcctcagcccccgaggagctgggattacaggcacctgccatgatgcctgactaattttcgtacttttagtagagtcagagtttcaccaagtgggtcagggtggtctcgaactcctgacctcaggtgatccacctgcctcagcctcccaaagtgctgaattacaggcgtgaaccactgcacccagccgagcaatactggttttattttccacaaatactggccctctatgacataatatttgtggaataaaagaacaacaaaacattctattaattattttgtgagaaattgagtcagatagtagcctaagattaagaatatggattctacgaattggatttcaattctagctctgccacgtattagctggatgactgtaatggaattacttctctgagcttcagttgtttcttctagggataatggtaatgataccaacttttcagagtgctgagaggatttgatggcataatttgtgtaagatgcctagccccgtgcctgcatggtaggtggaagatacaaataactcataattatgatatctgagacatcaggcaccgggagaaaaagccagtcacttttaaggaaactcagttccattttagactgtaaagtttgagtctctgtggagtggagttgtcagtgggtctcaagcctggcatagaggtcaagattaaagattaagattttggagctataaataggttgaatcgagaatcaagaagaaatgttcccatcctaactatttctcctggttcttcatttaaagtttagctccttattttcatgctatttctggtataaaaattatttaaaatattttgtccaatataaaaagaaagcgttaccatgcacacttgcagagctaccatgatggcaggcttctctgcactctatctttttcccatccctaagtgggccacagcaggaggactggaaaagctaaacaggagcacacagtgagaacagcctgtcccttaagcagtgcatttacagagaacaaatgaaattctgatttggctatttcttggttaataaccaaaccgagtaattcaagaatcaagtaatattaatgagaaagtgatttatgatcaaagcagctatcatttgggaaacagaatttcccagagagtgtttgaggtagtggagacactaggaaaggaaaggagatgtgattcagatgaaggctcctgaatatggctacaaggtagtcagtagacatattaggatcattcagggtcaaatgagactgaacacatttccctctgtaaggtttattaggcttcagtgcgtcagcaagtgccaggggctgattattagcaccacagtatataaattgagagatcaccagattctaattttctcttgtacctctcctaaatgaatgtgtagagcatgtatttccatgaccaatcatgtgtctcacttctaatagaagaaaatatgcttcagatttacaaagatgcatgaaatacaactagctggaaatacagaagaaatgtagcaccaattactctttgagtaagataattgttggaagttttaaaagtgataaaaagtaagggcacaatattcattcatccacctacccacctacccaccgtcatgaacatccaccctttgccaggcatcgtgttcaaagaggaagaagataaagatctgccttttcaaaatcagacaagtgaaaatataagacagggtcattagtgtaatttgtgaaagactggaagtaactaagcagtggatatcatagcattttcatggaagagtgcaggaatgctttctggaaaaactgataacttccctgagccctgaggtcaagaacgaattaattgaagagtgaaggattggtgttgagggtcaggaatttccaggcagagggagcagaatgaggtgaagtggacctggggcccacagataactgggacctgactggtcaggtagggcctggaggtgagtaactaaggacactctttcccacgttaggagaggagagactgattccagaaacaaatgtcgttcacattcagtgttgcctattaggatttggacagggccataagtgggctctggagtgtgcgggacattctacccgcactgaacctcattattgacccttggttaaaagtttcacaaaaggagcgaagtcgaatgattttctccttttgggatatgcctgatttctattttggcttcattctttgagtgctaggaagcctctggagcaccacccatcctcatcccaaggctgagttaggggccccctttctgttctcatagcgtcttctctcactgcacctagcatagtgtgttgtaactgacacaaacagcttctatctcagtctctcgagaagcataaaacaatgtatttatttaatacctctgcatccttaatgctcggcacagtgcctgacacactaagcattgataaaggttcattgaaacaattagtctacaaatacatgagttagatattctggtgaattttaagaaaatctattatacataaggttttctcggtggaaaaaaaaagaaaacattaacagcgcaagcttcacaccagtaacccaccgagcaaagtacaatgttctctctaggcacttgacagactcccaggcctgctgtggggttagagtgagaaggaagaacaaacctttcactggtgtacactaagctccttcagatgggtggggagtgctgtacgtggagggcagggcacacagtgaaaatagaggcattgaaatcaattttgcgtgctgcccagttttgcctccagctttctgtgatcacactctctcaccacttgtgggggcagggaaagccggccccatgcatctctagggtgggttttagtgcattcattaaatggcaagaccagtgatcagtcatggccgacatattcaattaggagtcttgcaaataattctcctcaagctgccccttggcaccttctgctgtatagttttaaagtgtacagaatcagctaaggagaatagtaatcacactctatattgcttatcctgtgttgcaggctggaattattagttctaggtccacctataaagtatccagatatagaggcacagtattgcttgatccaatattcctctttagaaactggacctcaaatcaaatgtagatcctctgttttgaaaagctactggataaggcacttaagccaattaaaagtaaagtcagctctcaggatgataaaaatcccaacataacagctttgtagctacaaagatactgtattagtccgttctcagactgctataaagaacttcccaacactgggtaattttattaaggaaaaaggtttaattgtctcacagttctgcatggctggggagccctcaggaaacttacaattatggcagaaggtgaaggggaggcaagtttagaccttctcacatgggagcaggagagagaagagtgagaaaaggaggaacttgccaaacacttataaaaccatcagatctcgtgagcactcactcattatcatgagaacagcatgggggaaccacgcccatgatccaatcacctccctcccactgggcccccctcgacacgtggggattatggggattacaattcaagatgagatttcagtggggacacagccaaaccatatcagatactttagctattttttaataaactgaataatcattttctctctccaaaactttgagatctatactttggctgacagtccgtgccttcaggcagcctcacaagaatatctgagaacagacagtattgcgttgcatccagggtaagtaaccaccataaaattttttcaatgacacgttgaagttaacaataatcctaacccttggatgtaatcatgcacacaatctcacatgaacctgaattaactaaccaggtctccatagtgaaaggatccacgttcctttgataatgagtatgatgtagcactttgacactcttgttctctttacaacaactgtttggggttaaatcaatgtggttatcatgttttgaagatggaaaacagctgaataaaaaaatgtgacatagtatagggaatataatatcatttttagattataaaaaccacagtttttatctaagttttgaaatgaaataattccatgggtataagctgatgactttgcttccctgggccacagtttcctcactggaaaatgagagctaaaactaaaaagtcatgaaagtccttctaagaaataaagtccactggttcatggagaattctacatcctaaagttaattaacagaagaccccaggttggcctccctaattgcgttttaatttactttttctcagcacactgcttttctagtagtaatgattttgtttatttacccatccacccatccatgcattcaacaaacacttattcgatgagtcccgtagattctgtgctgtgtgtgcaaagatgaacaagactccctgcttagtgtcttctcttagagagatcacaatctaatatgtgattgcttgggttttgagtttgtgaaatgagcttctcaatataaatggaaatctctcatagttttctgtaacgtaaagggaaatcatgcttcaaaatgtaatgaagtagaaaataaaaacaaaatattctcctgtttcttgaaaagattttaccacaagatctggaaacttgtttcttgaaaagaacctaaaggtctttgtggaatatttcatagcctctaagagagacaagtctgaacttagaatttgctcatctttatcagtgtaaaatagatgcattaaaatactcaagtattttatgccatatttttatcagagcaagctataaaagatacaaaagatcttaaaagatgctataaaacctccaaatctaaggaggttaatgcaataaaatttaattctgagtcatgtaaagtccaattctgattttctcctgggggacagttctcctgagcagccccatggggcttctgtcttatggcttgtggctatctcaaggcttcatcatcctgtagcttcaagatttccctgttgttgggaaaatgatctcacacccagtgcttaatcaccgaggttataaaccaaacatcagtttccttcacattccttcggcaagaactggtcacatggtcccaccatgctgaaaaggaagcctagaaatgtcctggctagacagccacttcccagtaaacatcttagttggttatgttatggtaaagagttgctgtctcaagtcccgcaattgctctaccacctgctggtccactgggagctcctgaacctccctacggtctggtgaccaaatgcccaaaactaagtaggatctaagacattgtttcaaagttctgcctggaatcccttctgattagttgatgcctattcagtactgattattaaatatttgacatagcacgtcagcatctagtatctttgcaagctccattttccaaactcactggcactaacttgcttgctgtggtcactgacctctaatttcagatctcttcctttggacctgatgattggtaccttcctgaagtgcttcatctttccttgccaggatacagacctacttctctcaaaccctcacttaaggcgacccatctccaccttactgtctgcccatttcccctcccaggtctcttaaccaccccagaggagccccacattctcttaaccaccccagaggaggctccaaggcacccagaatcttcataatttccctttctgggtctcttactgtcacgcttcaccaagcccgacaagctcttgtctctccctgcttacgatttccctctcagtcttcctcccacaaagagagattttcatccccacctcatcgaaatctgggtgaccaatattatctttccaggaaactctgaactctgtagccaaagcagtgaacacatctctgctaacgttttaatggtctgcccatcacagacagcacatttgcctgacatctggagactgctgaagataaagccttagctcaaaaagcagcactctctgttgttttttcaggcactacagcagcatcaaactgcacttttcctcccctgtctatggtgacctctaattctttcttccttgcatttctgactttctgcctttctgtttataatttacaatttatatggaaagaattttcaacatctgaccattacaaactgaaagaaattgcataatattgctcttggacctagaattaagtgggtttacaaatcccaactcatgtagccagggaccttttaaataaataaacattaaatactggctttgtaccagttaacattttcttaaatatgatatgagggtttctaactctggtctccattcaaatttaagatgcaagatatatatttggggctagtgatttagtaatatcaggtaagagatcagagtctatgaagaaggagaggaaataagagaaatgaagtgagacagtaaaaagagggaagggagagagaaggctagcatacagaaaagagtagcagtcaagaaacttgaaaagaacaaaatgtaaaattctggtttttgaatgatgaatgacaaataataatgaatgaatttgcaagtaatacggtttaactggttgaataaggagaacccctcagaatttctgatacatgtgataattggcatacgtgtgctaaacattatcaatagagcatgatggagtcctttcatacctcagtttatcagctttcataattatagttgtaaattatactaaggaaactactcctgtataaatacatatggtcatatttgctaagcctcttttatcatctctaaaggtgtatctgcagatggtttgagtccaggcttttaacagccatgattccccctatgaattactgagaattggctaggaaatttctgagacttatttggtaaataacttccacaacattcttgtacattccggtaagaaaatatacaagtctaaaagaccagtctcaagggcaaagaaaaggggaaaactaggacctgaaatagaaaacagctttgaatgtttttatcaagcaggatcactcattattcagagaaatcactttctctgtgccaagactgaactgggcatttggatccataggagctaggtaatgtctttgcaacatttggagcctgtaatgtgtcactgacatgagaatattgaacttgggcaaattagaccctatttaaaatcaggttgtttctattcactatgcaacctgcaggatcagcaatagaagtagcaaccccagtgctttcacataaactatgtcacatcacagagttgtgaggtagaaatgctgatctgcactagctgtggccacagtaccattgaccacttgcttaatcatgactgacactgagtgtatttttctagcttcctatctctttttcatgttttctgtcaccattaaatgagtcaatatttgaaactgttagtggttctttggatcagttgtctttaaagtgacaaggatggtggaggtgatggtaatggtagaggtgatattcactccagggggtgcacgagataatacattagcatgaaatgttagaaaatctatttatactattaaaatctatttttatgtatgttcttttgtttgcacatatttctgatattagtacagtagtaatatataatttattatgtatgcatgtgtatgcaatccaaataaaactaagcattatatggacttgatttcaacttcaatgaatttatttaattattcattcatccaacaaacatcgtttagcacctattttgttccaagcactatgctgggcattgagaatatgatcgtaatcaagataaacccaagtcctacattcagtagtagagtcggtatccactgaggactggttccaggaccacccccatccctataccaaaattgcctgatgctcgggtctcttagataaaatggtgtagtgtttacatataacgtacgcacatcctctgcatactttaaatcatctctagattacttataatacctaatacaatgtaaatgctatgtaaataattataatgttgtattgttatttgtattctattttattgttgtattattatcttttattggtttctttgtcctgaatattttccatacttggttgtttgaatccatgtttgcagaactgatggatctggagggcaggctgtaattctaagggtgataagtgctatgtaatcttataataggggcacttggcctagtctgcgattgggagctgtcaaggaaggcttctgacttattattcttgtatagttttcttttcaagttggaaaatattttacaatgttctctaaggaattgtcccataaagtatagcatctacaatcaatttatattctctaagtatatggagcgtctatatacttagagaatataaattgattgtagatgctatacttagagaatattaatgatcaccattaatatagtgtctacaatcaatttatattctccaaggaggagaaacttatctttttttcttaaaacttattttttttcttaaaatgtaatgagttatattttttcttttctccattgtctactataaagatgaaatcattattgcatgaactgtacagtcagaagtattattatatctaagcttagagcaggttgtccagaggctgctattattccaccagggtataacaggagagatgcagttaattatacattgcaacttgcagtttcaaacctctggtactggtacatacacatatacacatctatatatttagatgtttaggggtttttatcttgataaaggaaaaaaaaaaaaacaagagaaaagatgaaataaatgtgttgatgacagtttgttaattctgtgccagtaccttggctttaattactgtagctttataatagtttcagtatttggaaggatactatttctctccatattgtttattgctagaaattttcctctattacttttccagataaactttagaaaaattcgataactttcaaaataaaaatctgttgggttttttaaaaatcacgttgaatttgcacgcaatttagggaaaaaaaagctatttttgtattattatactttaacttctaggatacaagtgcagaatgtgcaggtttgttacataggtatacatgtgccatggtggtttgcagcacccatcaacccgtcatctactaatgtagatgtttctcctaatgctatccctccccttgccccccaccctctgacaggccccagtgtgtgatgttcccctccctgtgcccacatgttctcattgttcaactcccacttatgagtgagaacatgcagtgtttggttttctgttcctgtgttagttccatctcacgccagttagaatggtgatcattaaaaagtcaggaaacaacagatgctggagaggatgtggaaaaataggaatgcttttacactgttggtgggagtgtaaattagatcaaccattgtagaagacagtgtggcgattcctcaaggatctagaaccagaaataccatttgacccagcaatcccattactgggtgtatacccaaaggattataaatcattctactataaaaacacatgcacacatatgtttattgcagcagtattcacaatagcaaagacttggaatcaacccaaatacccatcaattatagactggataaagaaagtgtggcacatatacaccatggaatactatggagtcctaaaaaagaatgagttcgtgtcctttgcaggaatatggatgaagctggaaaccatcattctcagcagaaaatctctattttcacaatattgtgatgaggtgttggtaagacatttatttggtgatggccactgaagcacatgagagatacaggaactagtaacaaagatctggacatcattagtcttgagctgatagttgaagtcatagaaagatacattttatctcaacttaaaaacaattatcatcaagttttgtgcatcctaattcccacaatcttctattcacatgtaatctacttatggtgcccattattcatatcataccagcagccttaagaatatacaaagtgttttacattaaataaccccagaactgaatcccaaaactataaaactttatattttctgactttctgactaatttaatgttttctgcattttctttttcttcatcatcaccttgctggcctaatttcttcaggtggcactttttgttagatgagctggcttagtctaagcatttgattttaaagcttagagcaatctaagggtttctaaagcattcttaggtccactactggactataatatatcatgtaggtaatgaagtattgcttggagtgtgcaatgtacccaagggaaatcatttttaaaggcagatattaaaaggttttcttggtagaggatttatggattctttccaaagagcttagcaagttaagttatattttaaatggggaaataagaaacaattacaaaacaattttactttaccctacaagattcaaatccaacttctcaactagattatatgacagagtatatatgtgattatgccatttaattataatttaaatgtttttaagtcacaggaacaatctctattacaaagaggttgcttaaataattacttatataattacttttcccatttttaaatgaaatcttcatatttagatgagaaaaatttcaggaaattcccattgtgataaaaagtcattataaggtttgtgtaaagcaagcagcagtgaagtcctttcatatcatgctctcactctctcttctcctctttttccctctctctctctccaatgtatcccaaaattgcatttgaaaatcttttactgtatagctgtctttccaaaaatgcttaaacatgtttgatagtgatgattcagactcatttgttcatgtattccttcattcaacatttattgggtgcctattacgtcccaggcaatatcccaggtagtggggatataatgtacaaatgcctcagagagcttatatttctgtaggtgagacaaacagtaagtgatgaaatataaattatgcacatataattttaggtagtgataaattacatatatacatactctttttctctgtacttataattttatttatgatagatattatacagaaaataaagcaggatacaagggacaaagacagacctatatgatcagggttgctaaatacacagctttgctctcatgcctccaaagttatgcagatcagcaagaagaacaaataaaccatctacaacttaagttctcatcataattaagatagcaagatacaaaacctcagggaatactttagtcaagttttcttcctgtggcaccaactaaaaatgagcctcatccagtcaagagatgaatgaggagtctttggcaaaaggttttgcagtgaccaatgaaatacattaaaaacaaagatgggacaagtgtggaagaattgtataaaaggacatgttttgacaatctagaaatagcaaacttaagaaatggagaagagacagagaaagataaaaccggaatcgctctttgattgtcgtgtaattgttgggaggcaaaggctctagtttaaggctgacaaaccaaatagtagaatgttaagggaactaagaactaggtcattatgaaaggtaaagagtaaaactaatgactgcaacaagccatcttaattaacaaaattttttttaaaaagagcaaggaaacattatttggagaattaaatatggtaaatacaatgccatggtaaatataacccaaaatattatgacagatttgagatcaagcatatttgccatatcaatactatatggtcacatcacctgttaaaaagaaaagggtttcagaatggctgacaaagtaaaacctaactcttttttttttttttttttttttttgagacggagtctcgctctgtcacccaggctggagtgcagtgacgcagtctcggctcactgcaagctccgcctcccgggttcacgcctttctcctgcctcagcctctccgagtagctgggactacaggcgcccgccaccacgcccggctaatttttttgtatttttagtagagacggggtttcaccgtggtctcgatctcctgacctcgtgatccacccgccttggcctcccaaagtgctgggattacaagcgtgagccaccgcgcccggccctaaacctaactcttacatggttgataagaggcacaccaaacaaagagacttagaaaggctaaaataaaggtatcaacagagatacgtaaggcagacgctgaccaaaaacaactagaagttttgatctagtttacacacaaagtagacttatagcccaaacctacagaatgggataaataaaacatttcataataccaaagacctctatttttcagcatggtgactataactaatcataatgtactttgtatttgacagttgctaagagagtagatcttaaatgttctcaccacatacacaaaaaataagtatgtgaggtgatggatatgttaattatcttgaattaaccattccataatgtatacatatatcaaaacaccatattgtatgcccaaaatgtgtacatttgtatctggcaattaaaaacattttaaaaaataaaaataaaaatgtaatgctaaagtcaataagtcacaataaagttatagcagtttttaatatctcgcctcaaataacataaacatgtttataaagtagaaatacacagaaacatactagtaatactctaaaagataggttaagtggataaaaatgaagtaagcatatacattataagaggaaatgacacaaaggtgaggagaggggacagagggtgactgtgggagtccctttagaatgagtggtcagggctcgactggtgggaacataaaccagtacaaccactatggaaaacagtgtggagattccttaaagaactaaaagcagaaccaccatttgatccaacagtcccactactgggtatctacccagaggaaaagaagtcattataccaaaaagatacttgcacacgcatgtttatagcagcacagttcacaattgcaaaatcgtggaaccaactcaaatgcccatcaagcaactagtggataaagaaactgtggtatatttataagatggaatactgctcagccataaaaaggaatgaattaacaatgttttcagcaacctggatgagattggacactattattctgagtgaagtaactcaggaatggaaaaccaaacattgtatgttctcactgatatgtgtgagctaagctatgaggacacaaaggcataagactgatacaatggactttgaggactttggggggaagaatgggaagggggtgaggtttatctaaaagactacaaatagggtgcagtgtatactgctcaggtgatgggtgcaccaaaatctcacaaatcaccactaaagaacttacttatgtaaccaaataccacctatactccaataatttatagaaaaaaaaaaaaggaaagagtattcggggaaggactttccaaagagatgacatttgagagagatctgaatgacgatgtgtgcatcatgtgaagattggaagaacaacatttgaacttagagagcagcagtacaatagctcttaggagagaaaagacctggagttctcacagatccgcaggaaggtcactagcatttaagcaaagttagaaagggaaagaatggcagatggtgaggtgggagaagcagacaagggccagaccataataggccttatatataggctgtgctgagaaggtctgattttattctaagtgccaaaggaatcctctggaggatttcaaggagaagagtgacatgatctcacagaatgtaccttcacacaagatagacttttattctgtttttctcttagttttatcccccctaaaactgctgttgtttgtccatgctatgctttttctttaactgctagttttatccttaacataaattatggaaagtattcaatgcaataaatctagtttgtgaaaaggcccatgaaaaatttatttttaaatgcaaaaagtaagccaccagaataaaaattagctacgtttttatctcagagtgatgatagctccaaaactaattagtgaaagaaggggacactgtatatcactgcacacttaaaaatacagagaaaggaaagaaagtttgggaagaataaaactgcttcatacgtgtctattatgttgcaggtatagtattagacaatttgcctatatcgggtcatttaatcctcccaaaaatattctgtgagattacattatccctaacttatagtaggacagactaaaacctaaacccacccagcgactttcacaatgttcatctgctaaagaagtgggaaatttgggatttaaacccagtcctgcttccgtattcaccaaggtgagtatgggaggaaaggactgtggttatcagcttgaggagattttgggctgagacgatggggttttctagatatgcaatcatgtcatctgcaaacaggaaaggattgtgggaaaggattgtggtttagaaatgagaaaggagaactttacttttaaacaatcaatagaatatgatttagcagcctactggaaattatgccatggttaatgaaaagataaaaacattccttattgtttgcatcagttatctcttacagcctaaccatggtaaggtttagtggcgtaaaatgacaatttccttagcctactattctgtgggtcagcaatttggactgggtttagctgggtggctcttctggtcctgattagattctctaatcatgatgcatctgtgatcagcagcagggtagcactacttctgagagttaattggctattgtctgggcagtggagcaataaggcaatggggttactgagccaagtgtatttcatcatctagcagaccaccctgggtttgtctagatgaagatttgccaaaattttgagagagggaggaagcatgcaaggcttcttaagatctagactcagaactggaacattatcactgtagtcatttgtattggccagagcaagtcgcaagtccagcccaaattcaaaggagtagggaaatagctgtcacttctatgacaggagagatgggagaagccacaaagtcacatcataaaaggggaatgaagacgggtaggttttgaaaatcatggctattttcgcaatctaccatgttaggcaaaaaaacttttataatcacacagtgaattaatcacataggaaaacaattctcaatactgctgtttgagatatatacatatgcccatgcatgtgcagatatgtaggtatatatatatatacacatgcacatatataaattatatgtccaaattatgtgtttttatttcaaattttaaaatatactgaagtgaaattatatgtcttcttctgaaagaggtaatgccttcactatatgctttttctttggttcctttgagaatatgcctggcacacaataaactctcaacagagattggatgaccagttatttgcaggcatcatgtaatctttttctccctttcgccccagaggaaaaataagcaatcttttatttttatatcactcatttgccaatgaaaggaatagacttcattgcttttctaagtagcagatactgtatccctccagaatctgaagtaagtagaatattcagttatgctcttgtgtttataccaagaaaacagttagttttctactttcctccagtagaaccaagcttcatttcccccactgattttcttatagaaaagaaagtaagtctgaaaacttgtcaatattaaactttcaaagaaataataaaattaattttttctcaagcagctgaaaaatggttgtaatcccctgaccatcagtcttatgatgatccctttttttcttaagcttgttttgttttgagacaaggtctggctctatcgcccaggctggaatgcagtgacatgatctcggctcactgcaacctctgcctcctgggctcaagccatcctcccacctcaggctcttgagtagatgggactacaggcacatgccaccatgcctggctaatttttgtgttttttgtagagacagcgatttggtcatgttgcccaggctagtcttgaattcttgaactcaagcaatccgcccgcctcggcctcccaaagtgctgggattacaggtgtgagccaccacacctggcttttcttaaattcctaatacagcaattaccttgggatgaagaaataaaacaaaacaaagcaaacaaacaaaaaatttaatacccccttcctatctatgcaaggtagatagatgtgaaccatattagatgattgcctaagcctatgatattttagcagtgcattatggaaattctaattgttatttcttgcctgggatttgaaaagtaaaagatgaaatagtccctgagactgacagttactatgtggtataaacttccatcatgagaagtataatatttattcttcttcccattcactcccaccccaagccatgcagaaacaacatgagaggacgacgtaaatagacttgcaaagatgtctcatcctgttgcctggagttggagggatatatctcatatattttccataccatattgtattttttaagaacaaaaatttggcaaatattctttattttgatctgccaatggcagccccattttatcacatgaatcagatgagagaaggagcccacattagtcagtgtaattaatgccaacaagatagaccaacgctgattagtgacttaaaggaatatatggttatttctttatctgaagcaggttgggtagcccttttgtatggttttccttgaagctcaaggctgcaggctacttccatctttcaagtctgccattttagattcctttattttaatcataaggaaaaaagagagagcatggagagggcgcactcttacctggcatggactgaaagtgagacctcactattgtcaaatcccattggcaagagtgagtcataggacccatctaccatggatgcttgaagctgggggaatgcagaggagcacatgcaaattaggtgggaactaacagcctctctcacacagagaggtatgcagacaagcttgattaacacggactctatcaaaatcaaaacatgataatgttcctgcctccccaaaattcatctcttattttaaggtcctattaaagtattaattgtgggtatttcatttctttcaggaaataaacatgggatattcattatgtgaaaaaaaagaaactagaatatatcttaaagtatagtcatgtctcatgggcttttcattagaattttgtgacctactgcaggtattattatactcagtaaaataagcaaactcaggaattataaatgactgcatcaaaatatcacttgaaatcatgtgccgatatctttttttcttccatggtatttctaatatacatttccatgtttataatatgccattcatagcagacagtctgtagcaacccaaaggaattgttaatttcctggaaccaaacattggctgcttaaagatattctttgtttacatttttttcatatttgctattgcatgcctgactaagtggctccaataatttaagggttaaagacccattggagcaaatgacaatgcagctgattgattagagaagtcctagatgaaatagatctagctttgatcaaacacacaagatctgtctctcaattgatgacctgcctgtatctagtgtggtggcaatgcttgagagcagggacactgcaagataggtcttaaaggttagacaaggctagtttactgaatccattaaccctatttctaagagctgctaattgctggaactattggccctgtcttacctcccttttccttagcttcctctgaagctcacatgatattattatgtatgcacactgaggaagagatggacagaggggttagagaacgcatgcaaaacagaatgaacagttgtaaaagcaaaaagaaactagaatattaatcatttttagtgtgagcaggaaaagacttagcagaggtaaatattcagggaagagatacttaatccttctcactgctcattctctcccacatcccaggtccttatttgatggaatcaggtcaggagtgatgagatcttttttagaagggaggtcctttttaatttagtcttttacatcagctcttgtgggaggtctcctttaggtcttagatcctgctcactctctctatttctggatagtggggaagaggatattgtgcccttttcttggaaattattagactctggaaggggcaaaattgtagatagagcagagaaagcagagctgactgctgccaatttgtcagagcccatggagacaggaaaggaggcggcagaaatagaggggtgtgctgttgttcaataatacaaaattatgattgtagagttttcttcatgctgattcctttcacagaacatgctgaacttgaataagccttacagcagattcttcctctggtgagaaggaggggttgaaggaaaaaatcatagtcatataaattatattatttatatccatactgatatagttattaaacaccaagccaagtatattaaaattaattcttacagcaaccacatggggaaggtattaataagaccatttatcagctaagaaagcagaagataaataattggcccaaatgtcgtatatcttataaaaaagatctgagattcaaatccattgagctggatgaatctcagaaacatgcaaaacaaagaaagccagacacagaagagaatataccacaagataccatttacatgaaattcaaggacagacaaaaagtaagctgtggtgatagaaaccagatcagcagttaattgggtgaggggtaggaggggattgatttcaaaggggtatgagggaactctttttggatgatggatatgctctatttcttaattgtggtagttcaattatgtttgtcagaacttattgaactgtatgtaaaaatggatgtcttttattgcatgtaagttttaacacaatgaaggctatgatcctgtcaatgttgtatcttcttccctcaaggagaatataagcacggaattgcttgccattgaagaaagagctgtttatgtttcttttgtgtcaataatataaatagtacttctgcatttttctagttaactactgaacatttcattgtatttaattaatagggacagaaaagttatgtctaaatatacaaagtatgcaaagtgaagaatccaggcattccttcgcttcttttttttttcaaattaaaaagaaagcatggtttagagaattaaaatattcaaatgattgctttaatttttgcttttatctgtagacattatatatgtaaagataaggctttgttgaccactgcctaggcgaccccactggcaaatgtgtattataaaattcataccaattcatatcaaagggatagaattagtagatccatccttgggcagacattctgtcctgtaaacacatttcaaaaagtgattttggataaaaatttctttatcatttgttgaaaaattaattttgatcatcttactcctaagaatttcaagtttaaaatattaaaatgtaactaaattcatttggatgaaatagaagggaaagatttattcaaatgtaactattagctaaaagtaaatgttacttgggcaaaagagctgaacagacacttgaccaaagatgacattcagatggccaataagggtaagaaaagttgcttatcatcattagttattagggaaattcaaattaaaccatagtgggataccaccacacacatattagaatggatgcagtagaaaacaaaaattaaaaaatgaaaacaaacaaaaaacggcaaaaagctgaaaatgataagaactggcaaacttgcaaagcaattggtggcaggagtgtgaaatagtatggccatcctgaaaaaccctttggcactttcttataaaactaagcaagtgcatgttttatatcttcttagtatcgtaatagtgctttgcctgtgataggctttccatagatgtattttagaataacgagatgaatgcatgacatttcattctattttacatattttggaatagggacctttgataagtttatttttcctaaaaccccatgaagtcatggaattacacttatagaaattcagcgcagtccagcaatcaattgctgaacatttatcccagaggaatgaaaacttacattttcatagaaatctgtacgtacgtatttataacagcattatttttaatagcttcaaactggaaacaacctagatttccttcaatagatgaatcattaaacaaatgtggcaaatccatactatcgaatacaactgagcgataaagagaaatgcactattgataacacagtaacctggatgaatcttcagggaattatgctgagtgaaaaggccaatctccaaaggtcatatattatatgattccattaatataatattcttgaaatggtaaaattatagaaatggcgaaccatttcagaatagcggttgctaggggtcaggacagaggagcagggaggcagtggaggtggctataaaagggcaacatgagtaatcaacatgagggtgatgggaatgctctgtaacatttgactgtatcaatgtccatatccaggttgtgatactgtactatagatttgtaagatgttaccattaggggacactaggtgaggggtacacaggatctctttatatcatttcttaaaactgcatgtgaatctacatttaattcaaaataaaacatttaattttgataaagtacattaaatcatgttgctctcctgcaaaccatctagtagcttcccataatatactaagaatccaaaactcctcaatgttgcctaataggacttgcaggagctggctcctgacgtcccttcccagctcatttcctactattctccctctggctgactttgctcctaaccacacttggcttcttttggtttctcaaatactccaaaggtgttcccaccttaggatcttggcgctggatgcctccagcctctgaaatatgtttctcccagatcatagtctagtttactccctcccttaatatagttgctctaacgtcacctccttaatctcactcccttaatgttatttgctaaaatatcacttcctgaaaaaggacttccctgaccagtttgtctaaaacagcacacatatttctgtattttctgatgagcaaaaataagtcggaaaagtattcatatctttatgagaacatttgtgtgtaaaatttaatgcacaaaaaaaatcattatatattgtttaatcctaccaggcaggtaagtggataaggcttttatgggggaatactgcattatgagtaagataagagataagtaatacctgatagccattagtgtttttgcagaaaatgtgagtgtgtgacctaagaaaaatgttttgcgtgcaaatttggtagcaacttctttcagttgcaatatagtttctatttatttaagtagtcctactgagaaatgagctgctatgtgcctgtccttatcagaaaacactacatcttgggctctaccaggaaacagaagactatttattagtaccaaagaaaggtactaatgatttcagattgaagtagtacaataaatggtccattaaatgctcttgaatttacgtgctttcattttattgctgttatttcattaactccttgatggacacttgttttggaaaaaatcatcttctcaatgcaaatcctgggactgcttctccttgaggtcattcaaactccgtgttactcattttctatcttcgtggtagcatcatagtgccttgcatgttaaaggtatcccatacatgtattttagaacaaagaaatgaataaacaaaggacatttaatcttattttacatatttaggaatagggatctttgataagcttattttctttgaaactcaatgaagtcatggaatactacacttctacaaatcctttaatgtaggagtcagtgggaaacgtgcatatctactgaggatcatgaaggccaatacactgcactaaaatattgagggacacaaagaacccttttattgcctgcactgcaaattcatctgtttctgcaatagatttctgtgaatagatgatgggctgtactatattttaattccttgcttctggcaggttccaacacacaggggtaagaggatgaaacaatagtagacagctataattatttggttagggattgcatagggtaatattcaatgtccctcaggaaattggcacaacacaatataattggctttattttattgtttgtaatgttcatgtttccccaagtcagctgtgctttatttgattgcactgagaccaaaaatatgtaaagtatttgttgacagagaaggtgaacaagctattactctgtatgagtggatagcttgaagtgttcacatctctagttttgccaagtgtttatattacagatatgttgaaaaccactgcgggggacaaggacagtctttctcaaatttgagcataaatgagaatcacttggagtatttgttaaaattcaagattcttaggccttatttccatagattctgattccagaggatcaaagcatgcaaaagatattgaatctctaacaagctcccaaacaatggtggttcacacaccacagtctttgtaacaccacactaggctgaccagttagtagagataggggctgctggtcacacatgtggatgaagttaggtggaaatcagctggaagcctgagctgcggtcagggcaggaaggcctgcatcttccccaggaagaaactgcgacttctctgaagacagatgatgaatgtgaagctaattatatgggagttgactcagaggataatggagatgatttatggaaagttgtgctacaaaactgggtggaaatatgaaaacagcagtgaggtgatgacgtgcgtgggacgtcagaccagagccaaaaatttcttttattgcatctgaacatttgagcgttttgtcctggggagacaaccaattgccattaatgttggaaaacaaaattatctgatgcttttagacagactatgtgaagtgtaaatgaatcatggtgatagttgtggcagactctccaagttgctttcccaatgtcttttcacccctttaccaacagaaccaccatatcatatcaattggaaacaaatgagaattggttttacgcactgatgacactaacaatgggggtaggccttactgagcttggcaatttgcccagttataaaatttgattcctcagcctcctttaaagctgcatagatctgcatgacagagttctagcaagtgagagataaccagagctctactaagcaggcttctgggaatctattgttttcctgacttaaggaaatgaaagggcagacttagctgcattgcaccctttgctatttcctctccctcctttcctggaatgtagttgtaaggcctgggtgtgtaggagccatcctgaaagcattaggacaaaagccaaatgaaaagatggagggagcctgggacttccatactagccccgggctgcctaccccagactcctgttgcctaggaagagtatattaatttgcttaagcagctgcttttgtgtgcctgttatatggagccatacaaaattcctaacagatgaaatggatatgatttgttaagaatttactacatgctagccacttttctaaaagttgtatatatattatatatcattgaattctgacagtggccccgtgagatatatcgttctattttaccaaaagctctaagaagaatcaatagcattttaaaatggacttttaataatgccagggtaaatttctgtgtgtaagtttaaattttatttactttaacctgacttaactcctctcctaagatagtctcttgacacttattttacacataatgtattttatggtgattatattctatgcctcttatatggacttgaaattattaatattcatcctccattgggctcaaaaacaggtgaagtttactaccaaaaacaaagaaacaaacaaaacccagttttgattcttgtaacttgggtgtaaactatggagagaatctgggttgagtagacttgacctcattgtagatgctgtaagtatgatatataacatagcttacccatgcatgtcctgaaattaatattatattctagtggtctggacagtttcattatttttgtattgcaattgcccatgttaaaaatctgtctgtgctgtcatgttccttcctttcctcttcagagaaaagtgattagaacattaagtggagcaaactgacctgaccctcagagataaataaaggaataaattagcttgcaaagaaatggttcacactatctagaatttatttgcagcttaaatatgagggtgggaggttagggtcttgggagacaaattgagaatctagctttaaattagatttaatatcagactgaaattctagtcaattatcctcaaaataactgaaaatttctgtggcactcagtgttccacaaaatcattattaaagcccaaccaatggttttcatgagtcccacagcctagtcccctatatggagatcacagagttttcaaatcctgtcttctgagtccacattaggtatatttgaggcataatcagggtcaaatcagagaatcaccaaaatttaaagacctcatagtatctagtttaaggtaataatttagaaatgaaaataatatagctgagaggtagaagtcacccctccacttaatgttctaatcatttttttttctagtacctaagccaaaaatagagttaggggctcctacgtcttaatttctagtcactcatggtctcccatgaaagattcctgccataatcagtttggctgctacaacaaaataccatagactgggtggcttacgcaacagacatttattgctcacagttctaggggcttggaagtccaagatcaaggtgccagctgattcagttcctggaaaggactctcttcctggcttacagttggagatggccatcttcttgctgcatacagaggaagagggagagagctatctcatgtctcttcttataagggcactaatcccatcatgagggctccacccccacaacctaattacctcctgaaggcctccaaatactattacattgagagtcagggctcaaaatatgaattttggggggacaaaatttagccatagcaatttccctagtatttttttcatattctaagtctcactagatgggtataattacaagcaatgagtaactttcaaatgtgtcctgtgtttttgctaaaaccaaatccctatcccaaatgtggtcacatatggtatcatttcccatcaagaaaaatgtagaaaatacccctgttgagatgcaacctcatgttcaaagagcctgctgcccaggtcacaccagaccacacccagagactaatacaacgtggaaaagagtgagcccagagggatgggctaagcttacatccaacccacttcccaacaacctccgtcagcctcaaattcaaggtaacactaacagtgatggtgtaaatcccagttccaaggtcagccagtggctccttagaggcagtagacagaaggcagtagtttaggtgtgcactagtgcagctgagatcacatgccggctccactagtaactcgtttttaaatttgttttgagaaagtcacttattgtctctgtgctttggattttttcatctgtaaaacagatctaacaatattaactccatagagttaaaaggatcaaatgaatgactcatgtaagtgtgatcccagcttgatactagcactgagtctgttagaatcctaaatgcaggcaagaccaaggctcaagacaaccaagaactcatcatccagttcccatcaaagatgaactcttcacatatcttttccttaaccaatgctttttccatggatggatttggtgacttctgaatagtttaatcttgtttcgctctcattcccgtttgttttgaagatctggagagtaggcaatactcagccattttcaccatctgcatgaatattttcttattgatgcacgtgtctataaatcattctgtgtgcctttctccatattctgagaattgcctgtatttgagggtggaggtcattgagtctttggggaatctgatagtagcagttcttattctctctcccaccaacactactaccacatacatatctgaacaattgacatacgatcttagaggcccagcacttcctgatgccttcatggaccctctggaaaagtctgtagtgataaagtcttctattctatgcctacatacgcttcttaaaataaagacggtctccaaaggatagtttttttttttaatttaagctttggctcatatataatttaagaaaaaaatttgtgaaagaacataagtgatttgtgctcaacatctaaagaaaagacacatttctcttcaactatcttttcctttttggtgattttggacttcctgggctatgctgaatgtgataatattctaagctagccaaatctctcttaaggacctgccaattttcaaagcaaagttatgtaattatgtatttccaacagaagaaaaagttaaggtgcatatgaaaacatgctgaaaagtgtggaaatgttatcaaagacaaattatacatttatcacttcaaaatccagacagtatagaactgcagtgcttatttgtttagactgtccgcccgaagtgtaactgttaaagtacattaagcagaggccttatgtctgctttggatgacagctgggacatttttatttcatagactgcataacagaacctggccaacttcaaggtcaaagtcagaaatcatgatctcatttccactattgactcagacttgcccttatttatgacttacagagctcactccatgtgccatatctagtcagtatgcaatgagatctgtgaaatcaaactcatgtcaaacccctggccatcatatgtttttcaggtaggcagttggagtaggggataactggattcttgtttctatttgggcaagtcacaacttctgtgggccccagtttatttttctgtaaagtggccagattgaattacttacctctcaggtcccaggtgatgctcttcctgatcttcctaatgatttatcatcatggctgatgattgattgcctgttgtttcttttcccaaagataataataattgtcaaaagcctgagatgtatcaataccaggcactgatcaaagcacgctatgtttttaaaaaaattctcacaacaaccttatgtcataggtgctctcattctccccccactttgaaatatgaaaaaaacctgcagatcaggaaagttcaataatgtgctcaaggtcatacagttggcaagaggcacagtgaggcttcaaaacgaaggctgtctcgttccagagccagcacaaataatgactctactgttgaagcaaagcaataattgtttctagttaggattcttacatcaacttgcgtattttccagtgtattttcttggatttgagacatttaaccaaaatttacacactttggactggaaccataaaaaaaaattgtgcccctaaaaatcacctgatataattaattcccctgtcaagcatatctgcttttaactaagtccttcccatgtctccatatcagctttctgttacagatacattgattgctggctgcatagggtttcaaaacaaaatataatttgaactggaaagtttcggttgttatttatgtgaccaaactttgaggttgcacttttcattcagcttttaggtgtgctgatagccaagatctttgcaagttcattttttataagaaataggctactagcaaaatacaagtttatttagaaatactgagaatatactgcttccaccaggagaaaggctaagatactaaactgaattaaaatacacgtaaacaatgacatgatacataagaaaagttctagaaaaaaaactttaattttaaataagaattacttatataccaatcaggtactcttcattcatcttttcagcttggcatattataaactaggggccatcatcccagaattttatagtaaatatacttttaagatgtctcactatagagctttcaagaggggttactaacgaaaacaaaacatactaaaagtagactgtttcaatgttttctggataatgggataaagtaaaaacagcatttggatgaggggtcaggagtatgatgtctctctttggaaggacccaagaactgcagaaacggcacactaagcaaggggcacaggtgatcccctggggttagacaaacacgggaaccactgccctgctccacagcactctctcctttagactctaagctcttcagcggggtcatggacctctaatgcagtggaatacacaacagtttagtcaacttcatacctgcactgttaacttgccaaactatttccttgaggctcacttatctcacctgtaaaatgaggagatgggactggatggttctcgaaggtcatatctatgtccagcattcccatcttcagtctaaaattatgtgaggaattaaactctgaaaggtgtctttgtcgtgtatcattctaattcatgcctcttattgaaggacttctggttggttggttgttttttccagctgtattgagatataattgacaaataaaagttgtatatattcaaggtatacatgataatgtgatatacataagccttatgaaatgattattcagcaataaaaaggaagaaaattctgccatttgtgacaacctagataacctttgtttttaccattagctctcttttaagtcagtgggtactctgagaaaacataacctacttagtttcgaataatgctctgtgggtcttctatcctgcatcagccacatttatatgctaggagaagaataaactatatataatggttgtcatttgttaaagtctaccccatttcagttattcagttgttcttgtctttacttttctctctaaggatattccaaaaatatatgttagtatttaattctggtaaacagatcagattcttggagttgggttttgttggggtgaggggaattggcagggcagagaggattactaaaataaaatacacactttcaaaagtgtttattgtgttctaggcattaggcaaggtgctctgcatgaagaaacctatttagtgagtagactagccttggaaaaacccacaacccttaaaacatgttctatgggttccctctgtcctgcccctgcatcattcagcaccacagattctttgagtaatttcagatattacagtaatttcactttaaggtattaaaaagtccaacctgatccaaaacaaaattttcatcagagacccaattcaaagtttcttccccatcaagcctggtccaatttggaaactgtagggggaaagtggggagcggtttctttcttcttctcaacgaactagttatacacacacacacacacacacacacacacacacacacacacatacaattttcaatcctcatttatgacaatctcttaaagtaggcttgactgttcccattttatagaaactacaactaaaaagacatcatacattttatagggtttgacccaaggattttaaagcagattgtttccactgccctcttttacctctcaaaatgtcagttacccacatggttgacgtgtgtggtgtgaatgtggtggttggatttgcttctcttaaattacgtttcccaatgaaaaaggatcaaatagtttagttatgttgaaatactttttgtgtatctgcatgtgtttgatgaggcacaaggctgtttcaccctgaacatgcctctcataactcagaggtatccaggattgatgcagaggatggctgtgactcctgcggtaaaatgtagatactttgtccagcaccagcacatgcacataagaaacatagagaaatatatgtcatatatagaaatcattttgtagatgacataaatcaatcaataattgttaaagtacatttagtggattaggaagcagcacaatgatagtacaggcaagttgcagaatagataagagtaagtttgggaggatacaaggtgttggcatttttcagaataaaatccgactcataaatatttgaaggactctagaaagggaatatagaaatggtatattgagatcagaattgaaagtgaggtaatttcatgtgtgtgatgtttattatttagtgagagcaatgagtatttgaatgttctatgtgaatcatccctgtgagtattacacaaagatttagacttcgaggcatcatttctctcactcttcaggaactagatttagagcttgagtcattgctttatatttttgaagtatatattaatatgttttttagtaaatccagtgattcctgggtttttaattgaaagctaagtattatggtgggatataaaccaaccaatttctaatggatgccacttggaaagtttttctttctcctacagaagagaaagcagtgggaaatggcatataatgccaagaaatcatgtttcctgcttaatccatgtgaaaagtatatggatgactgtcaaaaagatctgttcaactacaaatggagtacagatgaccatgtggtcaatacaatacaataatgcaatatttaatactgtaatacagtttccaatagtatgaagttgaaataggtgttgagatgctttaaattgaataatacagtgtattttaagtgcatagaggtctttcttacaaagaaagtgcacggaaaactttagaaggtaaagacacaaagtataagatgtatcttgtgttggtctttagaaatttgaattctctttcaagctaggacaagtcttgagatgaaacatacataaaaaaaaaaaaggtctttataaacctgaagtctaactcaatcctgagtcacatgatagacaaccaaaagcaccatgactttatgcacctccatttgtttccctgaagctcagaggatccctctgaatgcattcctcagacctcgtggtgaatccagcaccttgaggatcatattgaagtttttaaactgagcctaaaaactccattactacagcttaggcttttcttttcctaagtacttttctcatgctccccgcaggcaagatttgctgcaagcacaaacctgtctcaggctcaatatctacctttctgaaaaacattttttatgaaaatggctttgtgtccatctcgtatcctgttattttcagctcattgagacatggcattgaatatatctcttacatggcgttgcatatatctctaaaaagagaaacattttttctccacacctaattttcttcacctctatcaattcttccttggctatacctttacttaactcctatgtctgcaaggcttttgaagttcctttgcaaagatccattttaaactttctgtatattgtaatttaagttttctgtttctttctcccatctgctagtcaaattttcttctcagcagaaaacctcaccattgcttcatttccacacatggaaggcattcaagcatagcaactgggagtcacagttgtactgaaatgagaaggaaatgtgcttcccaacacagcgtcagcatctccaaccagaggccatttgtcttttttttttttttttttttttggcttttcagcaaatgactgctaaaggaaagtctctcaaaacccaaatcagtagcactccaacccttgttgcacaaagcattacattggatcatggaagggttaagatttctattaaaaatgtttctcatggtgaatctgagatgaatgtatcttctaagcttgctatgattcttccccagccttctcatttcctactcattgactcctctgttggcgtcagctttcccctctggtctcctgggtgggttcctttccattctgctcaagtctagctctttcagcaggccccagctggcccaccaaattccttgtgcagccttaccctgtggcactgtggaagggcagggctttcctggcacagcttggctctttgctgccccaggaagcttcctcccatcagccttttgcccttagactcatttcgaagaaaaagtccctgtatttccccaaatcccagaggacataagtcacgctttctgaggggttctctgaagcctcccttattcaaactctgtcaaggaccaaggaaattctgtaacattcagacaaccttctctctaaactctaaagaacctatagctgggtcgagcggcgtggctcacacctgtaatcccagaactttgggaggccgagggagtggatcacttgaggtcaggagttcgagaccagcctggccaacttggtgaaaccctgtctctactaaaaatgcaaaaattagccaggtgtggtggcaggcgcttgtaatcccagctatttgggaggctgaggcaggagaatcgcttgaacctgggaggcagaggttgcagtgagcccagatcatgccattgtgctccaatgtgggcaacagagcaagactctgttgccaaaaaaaataataaaaaagaacctattgccaccccaaattctcaacacatgctagactggactggcaagggttgagaattcagactggaggtgcggggtggtaggggaggtgggttggtcttggcagagttcagttttgatcacccccttagcatgtcctgcattgatgacctggcagcttcattagcatgtgaggatatttgacacctgttttcctcagctttgggacctcagctgaaatttcaaaacaggaagtttcattttgtttgttttgttttacattgttttgttttgttttcctttgtcatgcagactttttttaaaaaaagttttaggtactcaaaattatcaatgtattttctggcttctagattttatgtttgcttagaatggcctttcccactctattttagtttactggggttattgttaaaaagtaccatgaactgggtgacttaaacaacagaaatttattgcctcactcttctagaggccagaatctgaaattatggggttatcaggagcgtgctccctcttaagcctctagggaaggatctcttccaggcctgcctcctcgcttctgttattctgtggcttgaggcagcataactccagtcttcacgtggtgttctcccaatgtgcatgtctgtgtctaaatttcctttttttataaagacactagtcatattggattaaggacccatcctacttagatataacatcattctaacttaacaaattatattcataacgacctcacttcaaaatagggttatattctgaggcactggcaactaggatttgagcatataaatttcggggagtgggcacaagacaatctatacacactctactaaacacactgtcctggctttcttataagtcttttggatagctagctaactagatagataatttttgttgttttagtttgtttattttcctcatctgaagttcacctgaaatttacttggtctaaggaataagacagggggaagaatgcacatggatattttactgaatagttagtgctaattatagtgttttatccattatattattctctccagagcctagcaaaatgattgatacccaataaataaatataaaaatattgacaccaatgctcaataaatttctttaagattgaatcacatcacttaccaggtaactgaattgttaagtttataactagaagatagcttgtttatttgaactgatagcggctatctagaaatttgatcacaggtagtgaagatatcctagagaattgacaaagcctatagctgcagtgatctgaaaggatattgggttaaaaaaatactaacattttctgtttattgaaggaaatgaatacagttcctgtgacatatcttttgtaccagcacagaggacagggtaatgacctagaatcaaagaatgatttataaaacagagctcttcttttactggcaggtagtagctagattattttgtgtgtgtgtgtgtgtgtgtgtgtgcatgcgtgtgtgtgtgtgttcaaggtacatatgttggggaagtgggcaaggaaaataatcctaggaacagccatggaagctcatgaaaatatttagaagcaacattttagagcaataatagtaaatgattgtttggggtctattccaaattttaagttttagggaacaatctccttctttatgatgctaaattcctaagtatttttcatataagacaaaaaagatataaaaaatattgaaaactaagttttggtggctaggaatgaaacttatgtaggtccatgttcggtatttgataacacatagatatgtacttggatattatgctacaaatagctgaaatttttacatttaatttatatttatgttcagagtgattacagatagtaatttgtattttgatgggaacacatggagtctgcctgaccattggttagtgtcaagtgaagctatttcatgggacaagatggcaagataagtcactgacatcaggaaagtcattagaaaaaaatatatcaagagtttatctctcagcaaaacactatatattgtttatattttaacatagtcttccctgcatgtttcagagaaaagtattaatatgctagcttttagaaacaaacagtttttgaattactaataaatattttttccaactctgcctaagacatttattttaaactgaataaaaatttaaattcacccattctctattttctctacattttaacaataacccaactgcaagtcactccaattcccatataattgtaacttctttttgaaaagcttagaattatatgaatcatgctaagctcttttattattgactaaaagggcatattctaatcttttactatctttgctggatgtagggtataaatagaaaaaccctatttcaccagggaaaggctattacgtgtccaaaaagactttttgtttttccagcttagggaacattcacattttagatgctggctaatatatgtttcctgagctgatggactgtaagctggttgtatttggcccctgtcatcttcttccaccccaatgatgcaagccagaacagagacacagtgtcaagtcctatgaacaagaacacgatgtggtagtgtaaagcaaagagacagtgtggagtggaggaaaggaggaaacagtgaggaaaattttgaaggagaagcagcagggtgggggtatcaggaaggagagagattgagggttctgtgaatgtcatggtccaggacttgggacttggctcatttttttttggtagttctcagtagattccttgatctctatgagactcattgcacaatttgaactacatcttctctagagcccctttcatctctaggatgctaggcttctcttaagcttaattgtgaatactctgaaaggagaatctttgctttcactgaagacataatatttggagcgcttcaatctcaatttttttgaggtagacaattctgttatagtacaagcctgtgtctttatctagaacatggtaattctgtagatcaagggccttcaccttatggtttttccacatggaatgatacatttcagttctttatagtctcatagcatgctgtttatctgaccaaaggcagttttgttgttgttgttgtttaacatattttctgtagctttctccctgaaaatgatgtcttcatatatctttgctgtatttgaatgcttttaacctcaaattaagctagttaatacggttatttgattcaaaaatctgaatcagaatcagagaatccaaatgtgaattattcagcaaaatcatgcaggcttttctttgcacggtaaaataagcagaggcaatattttcttcagaatcagtgagcagtacacatatcctttaggcaatgtactgtttgattttcagtgcggaaatgtgtgctatgctctttcttttagaggttcagtttgtcagcagatttttgtgtcattctaatttttgcttgtttctttgggaatctaaaatttctccatctgtatattttaaatgattgggggccaaaatttataaactgaaataaacagggaaattaaccttgttaatgaatggtagtaagggaaatgtggcactaatttacaacaaataaaagaatcaaagaaagggaaggagttcatttttgagtgaggattcagaagtttcccttttaaaaaaaatgagataacccataaacaataccaacactttagctacttgttaattaggccattgaactttcctttgagatcctagaatctgaaaaaataattagctttgcaaggccattagtgaaggagaaaaacttatattgcctagaaaccagatcaagaatgatacagaaagctacacttcttgcatgtggcattattgaagtgaattgtaagaataaaatgacctggacacttgtatgttatatgaaacaaaaacaaaaaattgctcagcaacttattaggaaaaacatttagttatcctctgtattcattccctactagtataacaaatcaccacaaacttatggcataaaatacacaaatatattatcttatagttctgaagttagaagtccaaaatcagtcccactggaccaaagtcagggtgttggcagggcttctttccggctggaggatctagaagtggacaggtttccttgtgtttacccagcttgtagagattttctgcattcctaagctcatggccacttccttcctccatcagcacatctctttctcttctgaccttccggtatccttcttataaggatttgtgattactgtgggcccattcagataatccaagatactctcctcatctcaagacccttaatcacatcttctaaagacctcttgccctgtaagttaacacattcacagattcaggggatttggatttggacttcactaaagggctattattcagcccaccacatcccccttgcttcactcagctgtttaaacagcaagtacataaatcttaatggaataagggctaatttttaaatttatttaataaaattttttttaatttttgtgggaaaatgggtccatcaatagagaactgattatgttcatgaagaaaatatatgctgtttatgcaaatattgtttatatcaaggcttgtttctaatccttaaaacagattaaaagtatcagaaaagacatgaccaaagaaggaaatagtgaggcactgcttcccatgtttattttatttcattaaaaaatttaatcgacaaataaaagctgcatctattcaaggtgcaaaacatgataaatcaaggacttccacaatcattacagatgaatattgggatattgccaatgtgaagatctgccttatccttgaaaagaaggaaatgaaactggtactaaactagaatgtcattttggaaaattggacaggcaattacgccagaggaaaatttgtattgtgatgaagtactttttgttcccatgagagaaattaacatttaaatggctactattaagcaatctcacaaaaattaagatgaagtgtcatagaacacctgagtgaatactttttacttttgctgttctgttacctgcaggaataagtttatagttgtaagaacaaatctttagtatgaactgccttgagccacagtgaagagagaggaatcatttgtatttgggaatagtggctggagttgaggatacatacaagaaaaagctagagatggaacctgaagccatagcatgggacctataaatactagactagaaaagaattcttagttgaataggaaatggtagggtggtgactggggattttaagcaagattgggatattttaggaagattcatctgaccattcttttagaggcaggttgattaggaaaataagttaatgaaaaagtgagcaaattgtagctgagataatgctggaagaagggaaggaacagatttgaggctgtgcaaaggaaacacctttgtgatttatcagctgatttgctgtgggtcgaaggggtgaatcaaagaggaaaacaaggtttccaaagttcaagcttttgtaactgatgttggcattatcaagaagtgatatgtcatgaggagaaacatttgtatggttgaggtgaggcacgtgaagtttcagtttggaagtattgagtgtggggtgactacagacatgacaatggtgatgtcaagtgagctagacagaaagctcaggaagacaggtcaaggctagaaagaaaatatgagtcaactaacttagaggttatatgcttatgtgactgaacatgagagtggcagtaaggtcgactcttattcattttatcgtcaaatagcttttttgtacgtaggtcattttgccactgccactatgttaaaatagaatgaaaaagacattcttgaggcattattacttaaagacagtttttggctgggcgtggtggctcacacctgtaatctcagcactttgggaggctgaggcaggtggatcatggggtcaggagatcgagaccaccctggctaacatggtgaaaccctgtctctattaaaaatacaaaaaattagccgggcgtggtggcgggcgcctatagtcccagctactggagaggctgaggcgggagaatggcgtgaacccgggaggtggagcttgcagtgagccgggatcgtgccactgcactccagcctgggcaacagagtgagactccgtctcaaaaagaaaaaagaaaaaaaaaaaaaaagacagtttttaagatgatttcagaaatactgtatggtatataactattatgagggaagtgtaagagaaggaatttaaatgactgagagcatctgaaattattccaggatcacccttccatgaatccatatattttctcaagatttggggatttactcaacatgttcctgacagtttgcaagtttgcaaaattataacacaaaagactgtattatcaactagtactttccttagctctatagtgttctgtacatcattaaacatgcaacaaacgatgtttccttgcctgaagtgtatattttttctctttgcttttactgaattatcttttttgtaccttcagcctactttgagaaatgaggatttactggaggaatttctctctgttctcagggctaggaatatgtgattctcatgaacatggtttattattttatgacccaaatattgaatattatatagctttacaccatgtatatctctttgcattagctacagaaaagcctagagacaaatttatgcccacttttataagttttaaagcttgaaaatatgtgatttagataataatttaaatttgaattcctggcttcattcttcttatatacttttcctcctggtctgcaattcttttttgttatttttctgtttaaaaataaagttatctttttcatatactttgtaaaccacttagaattgtacatggaaccagttatgtacacgtctgcattttggttatatctgcatacaggcacatgaacactgggaatacaggaatgatgtattggtttcctattgcggctataaccgggtaccacaagcttaatggcttaaaaaaacacaaatgtatagttgttcccccttatccatggttgcactttctatagtttcagttacctgtggtccaccatggttaaaaaagtgtaaatggaaaattccagaaataaacaattcatacatttaaaattgcatcccattctgagtagtgtgatggaatctcacactgttccactccatcctgtctaggacatgagtcatccctttgtccatactatccacactgcatacactaccctcctgttagtaatatagtggctactgtggttatcagatcaactgtcccaatatcgcagtgcttgcatttgagtaactcttacttaacttaataatctaatggtaccaaagcacaagagtattgatgctgacatatttttataattgttctattttattattattgttcatctcttactacgctcaacttataaattaaaatttatcatcaatatgtacaggaaaaatatagtacagccagccctccatatttgtgcattccacatccatgactccaaccaaccatgaactgaaaatatccagaaaaacatgcatctgcactgaacatgtacagactttttaccgttatcattattctctaaacaataccgtataacaactatttacatagcatttacattgtattaggtattataagtaatctagagataatttaaagtatccaggaggatctgcgtaagttatatgcgaatactatgccattttataccagggacttgagcctgtacagatttcagtgtctgtacatcattaaacatgcaactctgtttcttcaggttttggaatcaacttaattttggaacaggacctgggattgacagaagcagtctttatcacttcttttgaggcagcctagagatccacaggcctcagttggaatgccaacttaggttatggggtgccacagttagtaggctatcaggccaagtaagtgagcagctctaggaagtgtatagtgtctttttttctggctgtggcttagctgaacattcttacctgacccccatatccacactggttcataggaaaaaggtaaaggatcttcttaatggaggccattttcaggcctgtttgaatttagcagctcatataggaggggagtattaattaatgaaagggcaatgtctgcaggaatagcactgccaaataaaaccgttatctggctttctgggggatcagaagtcatcatagcaagatatcattgttcaaattggtgaccaggagttgcaatcctacttttgcccttggctggctgcatgcattagggaagattttaccgccatgtgggctcctgggtcaaaaaagacagtgatgctatccacttgttttagaggcccagttctgcccactgggaaacatttgttacagattatcacaatgtgttactggtaatatattactgaatatattgcaatatgttactgataatatgttactgaagatattggtgtggcagtttttacttaaaaagagaaatccttaagcttatgtttaataagaaaatgtgatagaatctttattgaccctaactttcatgagacacatacagatacatgctaatccctcatagataccaaaggatgactgtctatatagggttttgtactatccatggtttcaggcatccactggggagtcttggaacatatttccctcagataagggacaactactgtattatcttatgttcttggggttagatgtctaaaatgaatctattaggctgcattcgttctggaggttccaggaagaatctcctgtcttgtgctttccagtgtccagaaactgcctgcatcctttggttcatggcctcttcctccatcttcaaacccagaatcttctctctttaactttctgtcgcccacttaaaaagacttatgtgattacattgagcccactcagaaaatccagaataactctccatctcaagatccttaactaaattatatctgcaaatttccttctcccaaataagaccacatattcataggttccaggaaataggatgtatacatccttggggtatttttcagcctgcaacagataataacttcttctctgagagaactggctcaagctgacattagttaagctaatacagttgatcattcattcatttagttggcatacttaccagactgttattgagtatctactatgagctaggcattcttctaggagctcagaaaatgggaataccatagtgaatacattcactaagttccgtgttctctaagggcttagattctatgtataaataaaaacccaggcacatggaaaaaacgtagatatagaaagtgttcacctttcagagatggacgcatagttcaatatggcagtagcatagaatacaaagaaatgaagttattgtgagctatgctagaaaggttatacttaatctgcaggaaataattttaaaagaaaagcaggtgacatgattagatatgtaatttatgaagatgcctgtgggtgaaatgtgaattagagggaaacaagactggaattagaaagaccaattaggagatgctgctttaatccaggtgataagtgatgacagtctgaattaggttaatagcactggatgctattggaggcaggaagtaccataattcaaggcagcacaaagaagttgaaaaatatcatcatgacatttgtagagtgacctatggagacaaagttgataggaaagagtgaaagacaaaagggatcaaagacaaatacccaaacaacacatagattggctcagcatttagatacactagtatcctttctagtcactactgtattatttcgtattcttcagtttatgaagctttagacttaggccattgaaaatttatgagctaagtccctgaatagacttgctaaagttttatttggtttattatctcactttattccagatttccttctctaggaatagattagcaatagttacttctaaatgtctcccattttaggtataattaataaaaatattaacaactggttttgctatgactgattatggcttgtgagtcctgttgctgtctgtactgccctttgttctatagctgtctctaattctgattctctttctatgtgtctctctctcacacacaaacacacacacatacacacacacacatacacacacacacacacacgcatgcagttaattcttagagccagctctcttaatcaaatggaagtaaaagggaggacagactcttatcaataactttaattttgaaataaatttataggtaacagggtatcctcttggcccatccagttgtccagcccattgaccactaacacagtcccttggaggagggtagaagcctttgcctatttaacaacatctctccagcaacgttaccaactttgatacaagcccagttaccctccaaatagagttgaaaaaaagaaaaactttccattttaaaacctcaaagtcatttcactcggtgacctagagctcaaggactttttcctttgctaagaactccaaccacccagctccccagtgaataatgaagacaatgtaatcatctttgtttcttttagtggttaattgggagcaggatcattttatccatcttcgtgagttgaagcccttctagaaatgattgtggtttgttttgcccacccacaagataccaaaataacctgctatcttcgcaaaatgtgcatctattccccaaatcatattttatgccaagttttaaaagagagggaaccatgccagaattcattttaaaccaagttttatttgctatttctagtgctagtgcatggtagacagctggaggatagttccatttaagttgatttcttccttgacactgtttcttttcagatatgaattagatagaatagggctaaaaatgaaggtaactaattgtggactaaaaacaacaacaacagaagtaattgcaagtaaagaaaacccagtaaacgtttcagtaataatttgcttggtgggggagtggacatttttttgcttgtgcttaggaactattaattatatgaatgttagcaaatcacacctaataaattttggcctatatgaatgtggcatcaattgagatacaaggcaaaaaataagaagacccaatccacctagagaggaggtagcttaatattggcataaattgcatttaatataatgagcctaatctaaacattagtgcagttcatcctacatgtaagatgcactcaagatatactaaagaaataatatgactcagcatttagatacactagtatcctttctagtcactactgtattattttgtattcttcagtttatgaaaccttggacttagaccatcaaaaatttgtgagctgagtccctgaatgtacttgctaaaattttatttggtttattcaacatttccttctctatcaacctccattaaccatcttagacactagatgaatatgatatttccaacatatgaactattttaattaattctggtaaatgctttagagaggccaaaatgtttgtttctatataataccaaaaatcattttacttggtgccaagaggtatggatgtttaataacctgtttattgttctaatggtttctccagagcacccataaagaaggaatctcgtaaagatgttgttgactgttgacttttccccactcacttcttttccatcttctacataggagatgctcctcatagctcaagcctggctggctgaaggtttttgacccaagagcatgttgtttatggcagccatgtgtaccatggcataaccttacctctccctgtcttactgtttaatataagtagtagcatttccaggacccagaataggtcaaagacaactctaaattgcatacttaaatttttgacaatgagttgacctccatcagatctgtagacaatcttctcttctgattctattcagggcatagtctatcccactttttgaaagccaactgttttatgccactaaattatgaagcctttacataaagtaacaatctgctcaaaaggtttagctcctcaactctcctaagaacatgtcaattctactgtcttctcaggccataggttctacagaaagaccaggaaagatttgtgttctttatcactttgcaatccattttaattactttgtgtgacttattgatatttctttggcctttgaatctgtgaataggagttgattacagattaaactccataaagatattgcgtatcttagattattaatactgacaccttaatactacttagaaaatcagtagaaatggtctcttgatggatccaatcgtgatttctgtgaagtcaaacatgtatttgatttgtttttgccttttttgtaatttttaccttaataatttgttaacacttggtagtgagttggatatacatcctccataatagggactagaaatagctgacatttgttgaccttttactctgtgccaggtattaggctaagcatctccaagtttattctcatttaatccccacagaagctctatgaagttgatgccatttttatttccatttttccaaatagaaagctgaagcctagagagatagaagtaacttttcacaggtagcatggctactatgagacgagaccagaattcgagtcagaaaatctgactccagaacctgaactcttaattattactatatactacctcttatgcgaagataatattgttttcttaatttagatttggtatggacaacttatcctgctccctggtgccaacacaatatttcacaacagacaataaaactaaaggtaattttcacaatgaattcctaacttttaactggcttaagtatgagatcctacagcaatttaaatatttcagttatgtagatgtctattttgtaaccagataatttagagggcatcccatgaagtaattctgctcaagataattttatttttatttttattttatttactgtagatgttttgttgaagaaaaaaaagtgtatggcccaggttaatttctggttgtgaccgttccaaaatttggattgtgggggtggttaaaatcagtgttgccatgcctgatggtgaagacaatgaggcttgactatccatttgtctagtgggagagcagatccaaaattatttcttaaagagaatcatggcctttcctccttccattcattcccttgacacaagttaagtggggtggaaatgtcctctgttcaggccgttattcctgacagcctcctcaacttctcctcaaagccctgagaggatgcaactcttctccttgttcagatgactattaaagtacactgcttagtgttaagtggtataatagacaaactgtactccagatcaaattcttgtctaatattctgtcactcaatatttagcaaaagcccaatgtgtgaagcaatacttaggggagatatctcgaagtttatatggctcactaattcctctaaactactttacaatttatacctagagttatgcatactggcatccatccaaactgcctcctcctataagaattactttttaaaatgtatacccttctctagaggcagaaataaggttattgagaagcaacaggaaaagctatatagacctgaatgacccagttcttggcattagaaataggtacttctagttaagaattctatagccatttgagatggtcttaatgttttctaattttaaaatattatttttaaaactgaaacaatggtaactgaattcattcctgtttcagttatttattagtgtgtaacaaactataccaaaactaagttttaggcttaaaatattttattacttctcatggtttcctatgtaaaaaaactggacaggacatggtgtggagaattcatctctctccacatgatgtctgctggagtgaaatgtgcaaaatggcttctgtactcacatgtctgatatctcaactggggtggcttagacagctagtgttggctgcaataacctaactggggttgtatgtttggggccacagatttctgtcagctggattctttaattttcctccatgcagtctctaggtctttctgtctctctgtatcttttcacatagtctctccaacagggcaatccagcttcttacgcagcagcttaggcctctggaaagtaaaaaacttgaaactgtcaggtctactttctgcttaggctgagaaatggcacaaggttctttgctgcctttgtagttaaagaaaaaaaaagcagactatagaaaggcatgaaagatgaaagcaggatgtatagttaggtggagatcattaatatttcttattactatagttctattagtttataatatggtgatataactaataagatttgtaataactaataaatccagttaccacatttaaaaagtatagcaattgatcataagataagaggctatcattgatgatagcttacagaagattttcatgtttcgtgataagttgctcttaagccacttttgtatgtgcttattactaagaactgtatatttaagtcaccaaaaacacatacattatgatagttcacacaatttccagtaaaaaaaaaaaatggataaattgctttatttctttcaagccactagttcatttttagaatgaggtccacagtgcacctacatcagaatttcccatagggctactaaaagtacagattcccacacccactcttgtcttactgaatctagtctttaggctgtgggggaatgtataatgaagtttcttctgcatttgttcataagtgggctgagttttctttctccaaatggagaagagattaacaaccggagagtgttggagacgtatagatggggtgtcttctggataaatattggtttaattaacaggaaatgaaaagccaaggaaagaagcaagaaagggaagaagagatgtttctttcttagcattgacacagacgtaaggagaaaccagccaaaacacttttacatctttaaatccactaattaaaagatctgtgtggaaggagaaaatgtgggtaattaccaggcataatagactctctgagagacactgactgggactgagacggaacagtcttggtacaaaatgtcttttcagggaatatacataataatgtcatattactgaaagcttctggtactgtgcctgtacctagaacccagacatgcaatgaatacaagtgggtgtttgatctcaaaatgtatatttttttgcataatgcacttttggactagagtttatctattttctgctcacctgtgatgtcactgaaaaaacacaccagataaatcacatttataccatgattcgattagtgtgtggaactggtcttcttgttctttaatcataagtgaatcttccattcttcccttcacaaaatgtgattgtgttctgaagattcatggacccaagcatattttagaccaggggatcacagtctagacttcagctaaagcaataaagtgacgctttttcttcaaggtcagaacacccaaggatgagtaagcctgctgtacaatggttcttttctgatacatctggcatgaaaatagctccaaatggttggacacttaaaatctgaaagtatgtatagtcacagcaatgaaagaataaggttgtatatgcaatttaaatagatcttaaaatatagccacgtccatttttatctcagtgttttataaactcaaagtttagctaatggaatattcactgtttgttcaaacgtttcgataatgcatttgtttaaaaaacacaatgaattagtatactattagtcagaaatgcaaatacatatttgctaggaagaaaataatgttcagaaaaaaaagaatagactgacctcatatttataattgaataggaaggataggtaatgatatcttttgccagtagctgggattttattttgatgttaagcataaagtttagcctactaccaccaagataacattaaatttaagtgggaaaaacattatgacagttagaacgttacatattctcttgagttttggcccatatgcatcatttttactgtaaacattgaggtgataatagcacttcattcaaatagaagtaagcatcaatatccaccacccccacccccagatagttccctatccatgccctgtgtttgaggattcttcttgggccaacttttctggcattgcttttccatttctattcctttttcaattactgtctccaaaataaagtatttagacaatggttgtaagtccttggcacctataattttataatcctttagagattcaaaatataatttcttggctgggcacggtggctcacacctgtaatcccagcactttgggaggccgaggtgggtggatcacctgaggttgggagtttgagaccagcctgaccaacatggagaaaccccttctctactaaaaatacaaaattagccaggagtgttggtgcatgcctgtaatcccagctactcaggaggctgaggcaggagaatcgcttgaacccaggaggcagaggttgcagtgagcctagatcgtgctattgcactccagcctgggcaacaagagtgaaactccgtctcaaaatatgtatataaatataaaaatatatataaattatatttgtataattatataaattatataaatataattaagataagtttataattatataaatttaattatataaatatagttaagataaagttataattatataaatttaattatataaatataattaagataaagttataattatataaatttaattatataaataaaattaagaaattatatatatatgtgtatatatatatatatatatatatataaaatttcttaaaaccttgcaattcacctggactgggaatttgaattataatataacctgggaataaacatttttggtttcaaactatgagaggtaggtcataatatatcttgtttaatacaaaccatcaggtttccttctttttacccaaatgtaacaaaacactgcaatattttgtttactgttctttgattaaaatagatattaattcagccaagaggtagagctgagaaattgaaaagtgactccaagtgacttctattcagcaaaagctaccatagatggtccaacataaatcgccccacacattcctctattaaactctaagcccttgagtacagtaccttttcatatacatatgtctctgtaaacccactgcctaacccagtgaccagaacatgcagggctcaataaatgtttgcctgatggcatgccaattctagtctatgcagggagagcccctctgaatgaaaagccagagtcacaggcatctgggggctttcctggatatgcttgacaacccagtccatccaactatcccatacgttcccatctgttcaatttttttttaatttatattttttattatactttaagttctagggtacatgtgcacaacatgcaggtttgatacgtaggtatacatgtgccatggtggtttgcagcacccattaactcattattgacattaggtatttctcctaatgctatcgctcccccagcccctccacccccacaacaggccctggtgtgtgatgttccctgccctgtgtccaagtgatctcattgttcaattcccacctatgaatgagaacatgcagtctttggtttcctgtccttgtgatagtttgctgagaatgatggtttccagtttcatccatgtccctgcaaaggacatgaactcatcctttttacggctgcatagtattccatggtgtatatgtgccacattttcttaatctagtctatcattgatggacatttgggttggtttcaagtctttgctattgtgaatagtgccgcaataaacatacatgtgcatgtgtctttatagtagcatgatttataatcctttgggtatatacccagtaatgggattgctgggtcaaatggtaattctagttctagatccttgaggaatcaccacactgtcttccacgatggttgaactaatttacactcccagcaacagtgcaaaagtgttcctatttctccacatcctctccagcatctgttgtttcctgactttttagtgattgccattctaactggcgtgagatgctatctcattgtggttttgatttgcatttttctgatgaccagtgatgatgagcattttttcatgtgtctgttggctgcatagatgtcttcttttgagaagtgtctgttcatatcctttgcccactttttgatggggctgtttgtttttttcttgtaaatttgagttctttgtagattctggatattagccctttgtcagatgggtagattgcaaaaattttctcccattctgtaggttgcctgttcactctgatggtagtttcttttgccgtgcagaggctctttagtttaattagatcccatttgtctgttttggcttttgtcgccgttgctttcggtgttttagtcatgaagtctttgcccatgtttatgtcctgaatggtattgcctaggttttcttctggggtttttatggttttaggtctaacatttaagtctttaatccatcttgaactaatttttatatgaggtgtagggaagggatccagcttcagctttctacatatggctagccagttttcccagcaccatttattcaatagggaatccatttcttgtttttgtcagatttgtcaaagatcagatggttgtagatgtgtggtgttatttctgaggcctctgttctgttccattgggctatatctctgttttggtaccataccatgctgttttggtcactgtagctttgtagtataatttgaagtcaggtagcgtgatgcctccagctttgttctttttgcttaggattgttttggcaatgcaggctctttgttggttccatatgaactttaaagtaggtttttccaattctgtgaagaaagtcattggtagcttgatggggatggcattgagtctataaattactttgggcaatatggccattttcacaatactgattctttctatccatgagcacagaatattcttccatttgtttgtgtcctcttttatttcgttgagcagtggtttgtaattctccttgaagaggtccttcacatcccttgtaagttggattcctaggtattttattctctttgtagcaattgtgaatgggaattcattcatgatttggctctctgtttgtctgttattggtgtataggaatgcttgtgttttttgcacattgattttgtatcctgagactttgctgaagttgcttatcagcttaaggagatttgggctgagacgatggggttttctaaatatataatcatgtcatctgcaaaaagggacaattttacttcctcatttcctaattgaataccctttatttggttctcttgcctgattgccctggccagaatttccaacactatgttgaataggagtggtgagagagggcatccttgtcttgtgctggttttcaaagagaatgcttccagtttttgtccattcagtatgatattggctgtggatttgtcataaataactcatattattttgagatacgttccatcaatacttagtttattaagaatttttagcaggaagagctgttgaattttgttgaaggcctcttctgcatctattgagatactcatgtggtttttatctttggttctgtttatgtgatgaattacgtttattgattagcatatgttgaaccagccttgcattccagggatgaagccaacttgatcgtggtggataagctttttgatgtgctgctggattcggtttgccagtattttattgaggatttttccatcgatatttatcagggatattggtctaaaattctctttttttgttgtatctctgccagaccttggtatcaggatgatgttggtctcataaaatgagttagggaggattccctctttttctattgattggaagtttcagaaggaatagtaccagctcttctttgtacctctggtagaattcagctgtgaatccgtctggtcctggactctttttgtttggtaggctattaattattgcttcaatttcagagcctgttattggtctattcagagattaaacttcttcctggtttaatcttgggagtgtgtatgtgttcaggaatttatccatttcttctagattttctagtttatttgtgtagagatgtttatagtattctctgatggtagtttgtatttctatgggattgctggtgatatcccctttatcattttttattgcatctatttgattcttctctctttccttctttattagtctttctagcagtctaccaattttgttgatcttttcaaaaaaccagctcctggattcattgattttttgaagggtttttttgtgtctctatctctttcagttctgctctgatcttatttatttcttgccttctgctagcttttgaatgtgtttgctcttacttctctagttcttttaattgtgatgttagggtgtcgattttacatctttcctgctgtctcttgtgggcatttagtgctataaatttccctctacacactgctttaaacgtgtcccagaggttctggtacgttgtgtctttgttctcattggtttcaaagaacatctttatttctaccttcatttcgttatttacccagtagtcattcaggagcaggttgttccgtttccatgtagttgtgcagttttgagtgagtttcttaatcctgagttttagtttgattgcactgttgtgtgagagacagtttgttgtgatttccagtcttttacaattgctgaggagtgctttacttccaattatgtggtcaattttagaataagtgtgatgtggtgctgagaagaatgtatattctgttgatttggggtggagagttttgtagatgtctattaggtctgctcgttgcagagctgagttcaggtcctggatatccttgttaagcttctgtctcgttgatctgcctaatattggcagtagggtgttaaagtctcccattattattgtgtgggagtctaagtttctttgtacatctctaaggacttgctttatgaatctgggtgctcctgtattgggtgcatatatatttaggatagttagctcttcttgttgaattgatccctttaccattatgtaacggtcttctttgtctcttctgatgtttgttggtttaaagtctgttttatccgagactaggattgcaacccctgcttttttttgttttctatttgcttggtagatcttcctctatccctttattttgagcctatgtgcgtctttgcacatgagatgggtcttccgaataagcacactgatgggtcttgactctatacaatttgccagtctatgtcttttaattggggcatttagcccatttacatttaaggttaatattgttatatgtgaatttgatcgtgtcattatgatgttagctggttattttgtccgttaattgatgcagtttcttcatagcatcgatggtctttacaatttgggatgtttttgcagtggctggtaccagttgtttccttccatgtttagtgcttccttccttcaggagctcttgtaagtcaggcctgttggtgacaaaatctctgagcatttgcttgtctgtaaaggattttatttctccttcacttgtgaaggtaattttggctggatatgaaattctgggttgaaaattcttttctttaagaatgttgaatatcggcccccactctcttctggcttgtagggtttctgccgagagatcagctgttagtatgatgggcttccctttgagggtaacctgacctttctctctggctgcacttaacactttttccttcatttcaaccttggtgaatctgaaaattttgtgtcttggggttgctcttctcgaggagtatctttgtggtgttcactgtatttcctgaatttgaatgttggctttgcttgctaggttggggaagttctcctggataatgccctgaagtgtgttttccaacttggttccattttccccatcactttcaggtccacaatcaaacgtagatttggtcttttcacatagtcccatatttcttggaggctttgttgatttctttttactcttttttctctaaacttctcttttcactttatttcattaatttgatcttcaatcactgataccctttcttccacttgatcaagttggctattgaagcttgtgcatgcatcacgaagttctcatgccatggttttcagctccatcaggtcatttaaggtcttctctacactgtttattctagttagccattcgcctaatcttttttcaatgtgtttaacttccttgtgatgggttcgagcatcctcctttagctcggagaagtttgttattaccaaccttctgaagcctacttctctcagctcgtcaaagtcattctccatccagctttattccgttgctcacaaggagctgcgatcctttggaggagaagaggcgctccgatttttagtattttcagcttttctgctctggtttttccccatctttgtggttttatctatctttggtctttgatgttggtgacctacacatggggttttggtgtagatgacctttttgttgatgtcgatgctattcctttctgtttgttagttttccttataacagtcaggttcctcagctgcaggtctgttggagtttgctggagttccactccagaccctgtttgcctgggtagcatcagcagaggctgcagaacagcaaatattgcagaacagcaaatattgcagaacagcaaatattgctgcctgatccttcctctggaagcttcgtcccagaggagcagccacctatatgaggtttctgtcaacccctactgggaggtgtcctccagttaggctacatgggggtcagggacccacttgaggaagcagtctgtctattcttaacgctcaaacgccatgctgggagagccactgctctcttcagagctgtcagacagggaagtttatgtctgcagaagttgtctgctgccttttgttcacctatgccctgcccatacaggtgttgtctggaggcagtaggccttgttgagctaaggtgggctccacccagttagagcttccctgctgctttgtttacctactcaagcctcagctatggcagacacccctcccccaaccaggctgctgccttgccgttcagtctcagattgctgtgctagcagtgagcaaggccccatgggcatgggacccaccaagccagtcacgggagagaatcaccttgtctgccggtttctaagatcttgggaaaagcgcagtatttaggcaggagtgtcccatttttccaagtagtttgtcactgcttcccttggctaggaaagggaaatcccctgaccccgtgtgcttcctgggtgaggcgatgccatgccctgctttggctcaccctctgtgggctgcacccactctccagccagtcccaatgagatgaaccaggcacctcagttggaaatgcagaaatcacccatcttctctgtagatcatgctgggagctgcagaccagagctgttcctattcagttatcttggaacgcccccaatctgttcagtttttgaattaaattgaaaggtagaccccatctatacaatttttaaatgagtcagcatggtgcatgacacgtggtagtaagtgctcaggaaatgttttatgaatattatcttacaagttaattaaatactttaaaagacaaaagcagtgctttacatgtgtttcatatgatttagttttatgaaacttccaggtaatattaaaatccaaagcatcctgattctctacatgttcacgttctgtgatgagggggatggcgagaagcaaagaatgcattttgtgtgtgtgcatgatattaattccatgaactaagtttgaattctattcaaatactgaataggtaacatccagtttaagacttttatttctgtttagaaacacaattaacttatggatctaatggataagcttgagaatgtcctcccaactcagagccctaaggtgtttatctgcaaagcaaaaataacattcattgtgtgttcccttgcaaagtttgtctaagatcaagtgaggtgataatgtgattgtagtttatgaaccactttgcaaaacatcatcattatttccctgtgaagttttttaatatgattatttgatgcataggtgtgtatataaaatatgtaacatgtatttaaaaatagatattcctgtctgttccagttggctaggaaatcgactcgaggtcttgaaccatttcacaatcatgctactgaggaaaaaaattgagagcacttggtttggtgagcctggcaagaaaaaatgctatggtaacattgtcattaattcctcctttatggatagacctccaaatagttgaaaggaggtagcttttgaggtactccagcttaaaaatcttttatttatttatttatttatttatttatttatttatttatttgagatggactctcaccctgtcacccaggctggagtgcagtggtgtgatctgggctcactgcaagctccgcctcccaagttcacaacattctcccgcctcagcccccagagtagctgggactgcaggcacccgccaccatgcccagctaattttttgattttgtattttcagtagagatggggtttcaccatgttagccaggatggtctcgatctcctgacctcatgatccacccgccttggcctcccaaggtgctggaattacaggcgtgagctactgcgcccggcctagttcattttttaatcacattctaaattctgttattcttcaggtgttatcaattttacctttgaaatgccttcagaatctttctcattctgaagatgagtttcctttccaattatagtttagtttacttatctctcccaggatattgcaattgcctctctttatttttaagcttctagcttcctggtagcaaatccattcccattgaacatgtatttgtttcctactactgtaacaaattaccaaaaatttagtggcttgaaaccacaaaaatgtattatcttacagttctggaagtcagaagtccaaaatgggtcttcagggctgtgttccttctgcaaactgtaggggagaatccacttccttgccttctccggcattcagaggccacctgcattcctgggctcatggccccttcctctaccttcatagccaacaagatagcacctcatcaaatctctttctcaccttttcttttgttttcacctcttctctgactctcctgcctcctcctttcccttataaaaacctttgtgattacattgagcccacccagaaattataggataatcccctcattgtgagatcattaatttaatcatacctatgaaattcctttggccatgtaaagtaatattcacaggtttggagattggaaagtagaccccttggagagccatcattcagaactcaagtgatgtcttttagtaagatgcaaatctggtcctgccattttcctgcatggagcactcatgacttcccaggcctcggcaacagcttcaaatttttctgatctcaacctacaattaaaaatatatattttacatcattatctaatttacacacacactcacacacatgaaaatcttcacaaaatttggcacttactcttatgtgtaattcactttcataatttctgttatagcctattaatttgtaaaatgctgtccgtgacccatttcacagagtttctggcctgttagtgggtttcaaaccacagtttaaacatcatataggctgtgtgtgcttcatccatgcaaactacttttagatcccaaacaggctgttttctttcatgcctcatgcactttaggctattcttgccctacaaagcttacatgccatttctgctgacaggctcaacacaaaacattactttctttagaaagactccattgatttcctccaggcacctgcacacctacgtcttgccagcctcccgtattgtctctgttatagcacttgccaggtagtctctcattctcctttctctctctctctttctttttctttctctctctcctgcacacacacatccttctctttctcctcctcttccatctccttcttctgccttcctccttcctttcctgttttcctccctttctccttttctttttatttcattctaaaagaaagataataagagatacaatagcctttgtagaaaaatttgaaaatacagaagaataaacagaaagctaaacctacctctaaacaaaccctccagagagaactaataatatttacacattttcagttaatctttttgatatctaaatctacacactttactgaacagaaataggttcatgctgtaaaattttggaacctgttgggatggacttgacgttaacctggatagtgagtataagttataaccagcaatttttgacggaaaaatacaaggcaacctatatattggtttaatgaatattcaggatatatagtaattaaagatgacttccatgaaaagaaatgtaaataacgtttaataaaataagtaaggaattcttccaaaattatacgtggcaaccaaaattatatttggcagccaaatttggactctcctgatgaataagatcttgtttattctttttttttgtttgttttgtttttgagacggaatttcgttcttgttgcccaggctggagtgcaatggtgtgatctcggctcaccgcaaactctgcctcctggattcaagcgattttcctgcttcagcctcgcaagtagctgggattacaggcatgtgccaccacagccacctaattttgtattttttgtagagatggggtttctccgtgttagtgaggctggtcttgaactcccgacctcagctgatccgcctgccttggcctcccaaagcgctggaattacaggcatgagccaccgcgtctggccatgtttattcttttgtaatcatatttctgatgaaaaacaagtttttatttggaattattattgtgccttaataccctattaagacagtttaccagggacgaaaccagaatttggagaaattgttttacttttttcaagctactagtccattctcaaagtgaggtccaccgtgcaactacatgagaatcactttgagggctactaaaagctcagattcccatgcttaccctgtcctactgaatatgtctttaatcatggagcccaggaatgtcccccttttaacaaattttgatgcgtaataaaatttgagcatcactacactaaacttataaaactgtaaaaatcaatgttctaaacagctatttgggagcactaatagtttgtgttaatgtaaattctccctagaaatcagttcctttaaaaaggcttaacctcaggagtctttagaaccaaacgagaccttaaaatatgtaatttaatcacatctttgtgcaaatgaggaaactaaaaagatgaaatgacctctcacaagtcactgagcaggtttgtagaagaattgaaccttttacccagaaagaatctctgattccaagtcctaagccctcttccctattccagactggagcaaactttactatatctgctggcttacctattttaagccactatttcatcacagtaaatgccactttaatctttgcttatttactttctaatgacaaatcctgaaatcaatttctttataaaaacgcattttggtgtgtgaagagaaacattcctggctttaatgtaattatgaaaactacagagccatgaaatctcctttgctaactgcatactgcttggagtttgcatgtaatttgtggttcataatgctcaagtttgcctgctggtgtactcagataagaggaagcagctagacttccaaattaaaggactctgatagaataaactgcatcaatatctctatttcctgaaaaggaaaaaattctgcttgtttagtgaggtgaaaagtaatctaaatagctgaatataatcgcaaacagaattcttgaaagtactgagaattttttagtaaagatacacaaaagaaatgctatacaaatgatctgtgctgaatgtatctggggttgagattctattccatttcagaacaacagtcattaaaaggtcataaaaaacatgataagcaggtaaaatgacttttcctttatctgaattattttggttgccatattttcagaagtttaaaggggtgctagctttttctttctttcttttttaaaaaatttctgtatcttttattcattctctgtttgaacatttagttccagtttgagttaggggtggtgatcttatagctaaacaccagaaaggctgattcttgttcaccattagttagcacaataagaaactcaagttatcaaatcagagagcactttcagcattaactattaataattgtatgagtttccttttactttaaaatttatgaatggtagattcaaagtgagtgataatgcaatgttatattcagagacaatttcactgaagcaaacaggataataatttattatttttaaatatcactatgataatttttttcctggatctttgataatttttttaaccatctggttatttatgacatcacattatatgtaacactaaaggaaggtagaaagatacttcttcagtgaatctctgctttcaacatacttttagaataaacaactagtagaataactatacatctggtattttttaagttcgtatttataagtaggcaaagcaacctttaccttcaggaagaaaacagcttctcacaagcgaattccattgcaccaattggaaagaagtgcccagtccaaatgtgaactagattcttctgtcttatggtcaggagttttgcaatactgttattaagtgacattattgaaaatctacaaataattggctttcttttatgaattcttaaaaaattttgatgacaaattttgcattatggtatttggatttgctatttattaggaaaggagttaagaggtacttgaattcagaatccaagataaacatgtgtttcagtaaatattaataaggttaaagagaaattttcttttgagggagaatataagtctcttgcaactgtgtttatggaatagaagtagatgatgcccacatttttttattgaaaggactccttggttacaatgacttgttcccaagcacttttgtcttccccctacccacttgcactctctctccctctcttcatccctccctctgtctttctttagaaaggagccctttgcttcctaaccttatttaacttgtttctggaaatgaagcaaattaaattttactcattaatgtgcttatgcctggagtatccatcttcttatgatgggagataaggctgcacttgatcctgtgttgcccagtccaccaccccttactttcatattgctcctagtacccttgcagttcatttaatcttaggagatactggatattacatttttggtacatccagttgatgtttttctgatggtttgaaagttacttgagatgaatttttaaaaatgcaaataaaaataatcaagtacaaacaaccactgggtgatctaggagttagtgtaaaggagatggcaagtacagaaacttttgttgttgttgcttaggaatagtttatggtggccatgttgaatgataagctttactatcccactaattgagaactgagatccatcagttacagctacaagttgtaggacagtagcatcggaagtcagagtttgagcacctctggataagcatttttttcggtggccaccttgggcattcgtctcaaattcatatctttatttagaaataagtggctagtctccctcatggacacactgaaatttataggataggaaaagcagaaaagcagtaacaacagacttattggaagaaaaggtagagttgtaatataatgagaatatatccatttatacattgttggttttagaatatctctccttagaagttttcatctaggattaaaataaagtatctctaacattcgagcttcttatctttccacagacttgcagtaacttatctacttatttgtattgattaataatgttagccttccaatacctcatttttgcaaccttgataccatctgcaacttgtctcttgtgttcttgtggttgtgtaatctaacctcttacagaatgcacaactctcttctacaacatccttaatgttgttcattcttaacattcttatgttcaaacatctcctgtgataaagtactcaccaatttctaatgcagcccatttttattagtttctatcttgagtcaaaatctatacatatccaatcatttttaccgttgagacaaagggttttcatcccgttgccaaagccagtttggagaaaagcccagacaacattttagtcatcctttgcctgcttttctttccatgacagtttccagtttttatttacttgtctcaatttgttgttcgattgccttggacattccatattgaagtgggtcctctggcagaagttttaaagctcattgttttttgcttgtcaactttaagcaaattggaaggccatagcagtaatcttatttccatttctggaaaaaagatgatatttgagcaaagaatgacaacctgtatcttcactccttgtaaaatacaattttattcaaataagagagattaacagtagtttgtaatcacaccttttttaaaaaggacatccaaaaattagatatcatacataacatttggataattctatagagatataataaacccaaatcatgaacatgaaatatgttgatgtataaaacattgcacatgaaaaagaaacttagaaataaagaaagagcagctaggagttataacagctgacaggtgttgcatgcttcctgtgtctgaggtcctattctaaccaagttacctgtgttagctcatttgattttcatagcaaccttaggtttccagagaaactcattttacagttgagaaaactggggtacagaaaggttgattgatttgcccaacatcacacagccagtaaggagtggagccagaatgtgaacacaggtcatccagccctagaattcctgctcttaacaattatcccacgttgatcagactgccagcatcagaatgaccaagggtgcttggagaaggtacacattcccagactcagctgccaaatctactaagggagaacttctgagaggagcactatgttaaattgccaaatgtaatttataaataaattcattagaaggaataggtctcctaaaacttccctgaaaatgaatgatagggaaactcttcactctatttttccccccagccagctctgtgctttactaggattcattgcttggttccaaaagagaagaaaccctgccccgcctgggcatgttctacagcagcttgcaaccatctttgggtactaagaatcatcccttatctttctttccttttttttttttttctttttgagacagggtctctctgtgttgcccaggctggaatgcagtggtacaatcacagctcactgtagcctcaaactcctgggtttaagcgatcctcccaccttagcctcccaagttgctgagaccataggtgcacacccccacacctggctaatttgtttacattttgtagagaaaggtcttgcgatgttgcccaggctggtctcaaactcctgggctcaagtgatcctctagcctcgggctcccaaagtgctaggattacaggcataagccaccatgcctggcccattccttcatccttctatgaacgatgatggatctgggcaaatctagcattacacccttgcccatctgcctgctctcacatttgtgaaataattcaccaggctgagcatgtagctgggctgcttggagcagagggaagaacacacagggatcagaccctgaccttattagcacggcatgatcatcatgcctggcataatccagacagagtggcacccagctggagaagtttctgtctttcctgtaggagaaggatcagtagaggccagtgcatctgctccctgactctgctaccaagcaattcaagcagtagagtctgtttacagggtaagaaaaatacatttgtctggcacacaatccctgaaagaactttttgcattgaaataggaatttgaattatagtcagactactaattccctttcaggtttctcatgccaacagtcatgttgtcagtgaaatttaaatgtgggaaaaatgcttttatggactgccagattgtttggcaaatgatttaggtctacttggtttatttgtgaagcagtgatttttgttaactgcaaaataatatgaaaataaagaattaaattttgctgtatacatgggttttatttctccaacaataacattcttagtcctacctcgtctttcttcttaaatttaaaatgtcaatgtacagatgtatgctatatagcatatacttgcttgtctgctttctttttcacacataaatcaatataggtcctttctcatttgtggctttttactcttattttctgttgatctggaaataatatggttggttcatgtgtaataacttctggaaatttgttttctctgccttagcagagaaattaacccctaaagagaattcatattgaatacattctgtagatgttattctatatttaaattgtgtcaagttgtaataagagtttggccttaattttacatgttgttgtcttttggcatttcagtcaaattttatcattttcaaaagcagcacccaaagtgacagtgttaaagtggccctgggtgcccatgggactcaccctctgtacaccacccaggcccttctaccttccagaggggtagcacctcctccacagaggcgagtccacaattcacagtccagtcctcaaactgagatgtctgcctttctagcttcttaatccttgcagctaatgatcaggccgcagttctccccaataaattccagttctgttttgaatgaagatgtataaaatgaaaaaagccatttcccatgctgtatgctctatcagaaagacttctatcctcagaattggtaggaagtcactcttcagacttctgaggtttatcaagcctggcccgtaattgttgttgaattgttttccataggtgcatctctcaatcctttcgtcttctttgtagctggcctctgacccacgcctctgatttcatgtcctccaattatggatccgagcgccagtctcattggtgtctgatcagaactgaacggaaaagaattactttaacagcaattgaagccatttctggatgatttcaacatatccaaaaaacaagtcattgaaaagccagggtttctctctaattagctgtgtgatggtgaagcctcatttgctgttatcattgatcttaggaggccgtgggtaactttgtgccttgtaaagtttgatattgtataatctcatacagaaatgtgaggtcactaaattcacacatgaaagtacactaggctgtctgaggccttggtctgagtgtcatcatttcccaaatgccagacaaataggcttaatattttttaccaagttaaccacttgtgagacagtactggcccactcaaaattgcttttgatgtttagatactccatttgaatgtactatcatcccactatggttttagaattatttaagatgaaatattattttaaaagcaactaataagtaaattggacccacttataaagagaaatgtatatcattattaatagtagtactatttcaggtcaaatcaagaagcttttccaggccgggcgtggtggctcacacctataatcccagcacttcgggaggccaaggtgggaggatcatttgaggtcaggagttcgagaccagcctggccaacattgcgaaaccccatttctactaaaaatacaaaaattagcccagcatggtggcacacgcctgtaatctcagctactcaagaggctgaggcaggagaattgcctgagtctgggaggcggaggttgcagtgagccgagatcacgccactgcactctagcctgggcaaaagagcaagactctgtctcaaaataaataaataaataaataaataaataaataaataaataaatagaaattttaaaaaagagaagcttttccaacgttgacaccctttctctggtatcttctccctggctttcccctgctcttccgagaggcagccattttatcctcctgtttcatatctgttgcacagccagctatgtgctcgctctctctatggcgtacatgatgagatgctgcagcagcttctagttctctagcatctgatttctacattttcatttccctttttctttctatctattttagggagttcatcaccagacataatacttactgattcttgtcactcaaagtaatgtgagatgcgggaatctgctttaatcttggaacactcatataattcactaggccctttgtttccatgaggatcaaagcaatcataaaaataagaatgtgcagaagaccttaaagaaatcagcaagcataatcagatgatagtcatgaaaagaatttaattgcgtatttcatctttgcattctgttctccttttatgtaaggaggcatggagagcgaaaaggagagcatgtgaattctggctgatcctgaaggacaaatatctttattttctcttctcccctgggagtgggatgagcaagaaacaatgttccactgtgcaatccagttttgtcttaacagacactttctactgggatctgacaggctcgcttcgattttttactcattaacatgatcaataatgatgatgctgcctctagcatattacactttacagagaacttttctcatttatggcttgcagttcaactcactattaggtattgatttcattttggaaatcaggaaacatgcacagagaggttagatgatatttctgaagataccctgcttgtgagtcttagagccagggtaggaacccaggtgttctaactccaaagccctttctttgtgccacacattgctattactgaataaaaaagcagagggagtctcatttattgagcacctagtatgcacaagaagcattacatacgttaattctcacagtaatcttgagaagatagatgatatcatcattattttagctagaaagcaagaactcaaaggggtttaattacttgcccagggtcatataactgataccatgtcaaatattacattttctttcctccattacagattgtggatcctcctctggaatacacaagaatttgttcttggtaccttccctccaaccccaccatcccctcggatactatagttttaaagatagggagggtgtgatcatcatactgtgcatgtgcagtgcctggtgaatttttcaatgccaaacagaagcctctgcaatacctgaatattgtttcagttcttacaatgtaaaaatggtagaaaatgcacaaaagatgaacatcagtgtcagcctttttgccatgattgtgattttcgtgtggtaacaaacacccctcagcccatcaaaatctacccatcactggaaacctgcaccaaccgtccccgttcctggagcttacttcagcttacattgatttgttttttctctgatttctctagtacttacgtcatactataaacacttcacacacaaccaggctctcagattgctttgtgtgcttcattttgccagtttatgggaaatagaaattttctgatttctaggttgtatctcgtagatgtttactttgtatttttctcagtaccccacacaatgctaggtatatagatatttaatgtttggttggttttcattaagaagttaggttaagaatattgattaaataacataatttttgctttgtatcaattttgagtccaaacatcaatttcacctaggcactaaattgtttgggataagttaataactagttttattcttggtttaaaactgtctacaaaaaaaagaatagccatttgatagatttttttttctcgagacagagtctggctctatcacccaggctggagttcagtggagcgatcttggctcacttcaacctctgcctcccgggttcaagcgattctcctacctcagcctcccaagtagctgggattacaggcatgtgccatgatgcccggctaatttttgtatttttagtagagacagggtttcaccatgttagctaggctgatctcgaacttctaacctccagtgatccacccatctcagcctcccaaagtgctgggattataggcataagccaccatgcctgacctagaatatttttgtttttatttttatttttgaagatatatgtggattctcttgaacatgaaaacacaaggtcaaatgggtgagaggagtgtagtcaatgaagaagacaaagataagaaaacataggtacaggctgggaaacatggccaaattctgacatgaagggatcaaaaacaaaagaataaacacacatactaagtataaatgtaaatataaaattggatagggatcttggagccaaataaaaagtagcctaagaaatttggactttattctatggccagtaggaagacatagactgtttttgaacaggagtgagtggtggtacagatggtgatggaggtagtggggtcatctctaaacttcaatacctcaggggccagtcaacaacataaagacagccagataagagtacaaaagtggcagctgctactagttgtagtcctccatggccacacagcaatgcaggaaccatttttaccatcttttgaaatttttcaaaacaaattagaaatctgggcttttgtgtaaaaaatttacattttaaaatgttagcttaaggaattttaaacacgacgttaatcaaacaggccacttctgtgaggcagataccagcctgtgatcttgacctacatgagtgacacaatcacttttcaaaatagttaactagagaaagctggtcagaatcagggcaagaactgcacatggcagagaaatattcttattttagaggcagactcactggttttattttaaaatgaacatgtttacagtgtgtaaatcagctgagctttagaacttttgcaaacattcaactctttagaattgacaatggtaatataacaagaatctttaaaatacatcagaaattaagaacttgctttataaaccctcacctgactttaaacataaattaaacaggtgctagaggacttttgagacaataattaaccaagtattcattgataaaacacaggcataaaccaggacattcttgggcaaactaggacgtatggttaccctatctacttacatatagttggaattctaaaataaacacatttttaaaatgaggttaaagtagcttgaagggttaataactgaaattttcttctagaattgttataagataataatcctcaaaattgggaagcacagttattcccccagcagcacatgtaaaaagaatgtaaatgtagccacatcacagtgaaactacagaataccaaagatgaaaagaagctcctaaaagtagcttcagagtaatgatagttcatatgttggggacaaatggaaaagagcctaagaaacttggactttatttcctagccaataggaagacatagcatggttttgaacaagaggtgaatggtagtatggatggtgatggaagtcatgaggtctttatcacaataaagatagtgattaaaatggaacaataattagatttacagcagacttttcaatggtatcaactaaagcctgaagacaatggaatgatgtggtaaagtgaagatagactataactagaattatatacccagctaaacattattcataagtaagggttaaacaaaaatatatttggacatacaaaagaagtatttattaccggcagaccttccccaatgggatttctaaaaaaatgcacttcaaaaacatgaaaggaggatttgagatacaagaaaaacttgtgagcagagaaactggaaaacatgtggataaatacaaataaataatgtctgtgttaaaaagtgtctgacttagggagtaaaaaatcaaggtagtttaaaatataaaacattgtacaacattatgatttatgataggaatggatgactgaaaaattgaattttggagaatgaagttaaagatattgcttgttttttttaaatataaatttctacattttcataatcactttattataggcataacttccaaattaataaagagatgaatgagattagacaaaatagaaaattttcaaccaaagagaaagcaggatatgaaaaaaagaaacataacataatcagaccaaatgtcatagaacaagatagtaaatatacaaataaatatagtggttattatagaaaatattagtgggccaatttcttgataaaaggattctgatccactgtatcaaaaatactatgagaaagaaaaatatattttaattcagagctgaaaaggacttagaaaatgtagtttctcatttataaatgagaaaatcaaagcctagagagtcgagtgagataaccaaagtcacttttctaacaagtaccagagattcaaccagaatctaagtttcctggcttctaatactatatgatctattaaattatacttttgtcttcttttccacaaaaacgtatttaattccacaggctgagtttcctgtgcatcttttttttttcttcttgaagatactactagccttttctccaggactaaaagtattttttttttcctagagggtagacaaagttgtgactgctgatgagaataaaaatattgcaataaagaaaaatcttaggtgattttttttcttttgctttgactgacctaagcttaaggaaagataatttcttgtctaattgtatctttaaaagtacggaagggaattaatgaaggaagaagaagaagaatcttgaataggtggaacattttcagcttgttaaaatttgtgagttttgatgttgtgattaaagattttaagtgccggtgacacagtagattttggagaatttcattgactttagttttttgcacaagttaaattcgagatatctgtgtgtcccatgatgaaaatatggttctggaatacagaagtgtagtcaaggtttcctagtaagcggactattatatttatagattacatttcaaattgtgaagaaagtgtagtatctggtagcatcatacaagacgatgagagagaatgaagatcagaagcctgtacagcaccatgaagaggtgagcagaaagggaagcttgccaatcaggaagaggagctcgccacatgaagaagaaaacttagagagactaaagaatcaggagagcgtcatgccctggaagagtgaatttaaagaaataaggggttagttacatatgtatacatgtgccatgctggtgcactgcacccactaactcacatatgtaactaacctgcacaatgtgcacatgtaccctataacttaaagtacaataaaaaaaaaagaaaaggaaaaaaaataataaataaataaatacataaaagtctttcagcaggaaaaaaaaaaaagaaataaggggttatcatctataccatgtgttttagaatagacaagtaagatgagaaccaaaagttaaactgctggatatggtagtgatgaggtcattgattattttagcatgaacaatttcagtagagtcttagcactggacacagctacaattggttgaaaaatgaatggggtttgaaataacgaagctgaaaaagatctaaagcacatacatgaacaaaggttcaaaagcgagatgataacatcaaacagaaagccaaagtaaaaaaaactataacctaacttcttcactattcaacctaatattcagaaagaggactagactttggatatttgagaaaagctgatctttggtatgacctgtgtcacctcccagcactgtgacttagaactggcacctaacctctttatttctcagtttcatcatctaaaaaatggtctactgcttcagaataaataaatggcatgatacatatgaatgtgcatatatgtaacaccctgtttaagtctacattcttgatgttgtttttataatattttattggtagtttgctcggtaaaaagcctaaacttgtggtatactttgatgttttatctaaaccctgtttttgatcgtgctctgcccagtcacctgtacccatccccaaaccatgactcgaatagatctcatagtatttccagtcattgttctcttattaaaaaaaaaaaaaaaaacaactcaggcagaacacaggggacttttagggcagtgaaactactccatatgatactataattgtgaattcatgtcattacaaatttctgcaaaaccacaggatgtaaagcaccatgagggaaccctaatgtaaactatggactttgggtgataatgatgtgttactgtaggttcatcagttgtgacaaatgcaccactcgggtgggggatgttgatagtggaggaggctatgcatgtgtggggctagggtgtttatgagatatctccgtattttgttcagttttgcgtgaacctaaaactgctttttaaaaagttgattattaagacagaaacaaatctcagtactgttgagcccagtttaaaaaggcaaaattgtcatatccagtttaacaataatattcttcccttaccataaatctgactatattctcagcgactggtagtacaatcaaaagagcagtttgatcctccctttctgtcccttctttttgtagctcttgctgtttcaaaatcagggatgaagaagagctgggagatgaagggagggcagatgactgtacgtaacctgatgtgcaattacaattctttcttggcttcttcagtgaagcctgtcctgccacccacaggacaagcttctgtgtgacagacatctgaatgctggtcatctgaatgctggttcccttatggaggaccttcagggagcctgttagggctctctcgctgcatagtgccatgacatggaagatttgctcagattccttctcttttaaaatttcttcagctcccttctgcccctgttaatatacatcatagctttccacacctcatccaggagacagctctcttggagatggcttaatggcaaaacgtctcaagtgcagctacctgctgtagtgtttacagatccatgggaaactcacataatctagccatgctagcctgtgggaaatcaggcttctccactgcctccccttcctcaaccctgctgtctctctccaggtatcaagtactcttgcacaaaagccgatcaaaatttcattgtttaagcagatactattcaatgagcccaatcggcacatggctttgtgtgcatgaaagtgcccatccctttacaaagagtctggtttgagtcttagttgcctattttagggcaatagtaaaagtcccattcaaaagcctgttatcctttaaaacgcaatgcatttgatctaatgcaagcatttcttattgtgttctgtgaagaaaaacaattctcaaccttgactaaaagctgtaagctgcctgcatttatgtatttatcctgcaggttttgaaaaaattgagtgtaatcaaaatcccactgggaaaaagtatgtcaaaaagattaattagaaggaaagcaaaaatgatgtcttctcctgcctttgtgttaaacattcttagaaaacaagcactgaaataaaataagtaaagatgcctctatatactttcggctgtaaattttattaaggtcttgaagagagttcctctgagtgtttaaatagcatttactgaaaaccatctccaactttcatgagcagaaacatgcaattgttagatctgtcagggtattactgaaaatggagtcaaaggccccttataaaaaagctatctatggcttttcctctcttccaggaaagatgaattgccatggtaacactgccatgaaataataggtcaggttttatccttctgcctcaggcttattctattaggttttacttagaagtggatgccattgtaaaatgaaggtttttggtatttcaaaactaaacatcatgacaagaaaaatctgatcaataaaatctgctggtatgaaaaggttggataaaggacaacaggtagggagttaaactgattggagaactatttagaggctggtttattagtactcttctaaaatgtgggcttgtttcacagatgcttgtataactgaatatgcataaatgaagccaggctgactgcacaagatcagttgggaaaagtggtttgtaaattttattttaatggaggattaactgctctagggaaaaagtttccatttcattccgaatgaaacaagaaagcataaaatatttaagcttcctatttttcttactatttttaaaagacaaattcaatactgttttgtgcctatttatggaaatttctaaaaatgcaacttgggagaagtattaatgacattacacaaacaacatggtgtgtaataattgaaattctgttgtttctgttgtttgggggagttgtgtctcagtatatgcgtcatgactttacatttttctggaacagtatctcaatcattttgggatgaaattccaacagaaactaatatatattttttgtcatatcaagcaacattgctctgtccttctaataggacatacattagaataagagagaaatagatatctagtttttaaagtaacaagatatatcaaaccaacttttttgaagagtttcatttaatttaaatgtaagttaaatgtagaacatggtagtggattttagcataacatctttcctgaattcacacagtgagactatgtctgacttctccatagaccaccttgaattttctgtagttttttcttctgtaaagtactaacagtgtgtgtgggtagctctgagatttatattgccttcagtctgatcatgaagattgcaaagtggggtcagtgactgtgctagtttcctagggctgctataacaaagaggcacaaactgggtggcttaacacagcagaaatttattgtctcacagttccagaggctggaagttctaaattaaggtgttagcagtgccatgctgtcactgaaggctctaggggagaatccaattcttggcagtccttgtcttatagattcatcaggccagtctctgcctctgcctttacatggctttctcctctgagtgttatatctctaaagtgttatgtatataaagattagggcccattttaatccaaagtgacctacctactgggtacagggtatactgcttgggtgatgggtacaccaaaatctcagaaataaccactaaacaacttaattcatgtaaccaaacaccacctgttccccaaaaacttattgaaataatttaaaaaaggaagacctcatttaatttggttacatctgcaatgaccctttttctaaataaagtcaccttcataggttctggggtgaggaattcagtgtatatttctgggggacacaatacaacccacagcagaaactgaattgagggacttcgacactaaataaattatctctattacaattttaaattgctatgctgtctagttctttagggaaataaatggtgatattacttgagttatgtttcattactaatggttactctcattttccctttcccttcaactttaaatttttgtagatatatagagaatatggtattcctaattaagtgctctcaatgtgtagaattttaaaatgtacaaatatggttagaataggtaaaataaattgaatatatacctatcacagttcctaacttgtaataggtgttccactaaatgtttattgaatgaatcaatcagtgttaacattaaaatatactgagcataatttaatctgtctttaatgattcaaaacattttctttgggcaaaaggtaactaggtatgaattaagagatccccacttgcctgagtgctcaatgactaagtatttattctatttcacttctttatgtccatttggaaactcattaggttttttgtcttggattacactgttcccagcccccatttcttttgactttcccctttgggttatcacatattcttttctatagcttaattaaactacttctgttgaacaattaacatcaatgtgttctgatttggtttctccacctataaaattgtctactttatcatgtatcaggattgtctgtcctttgatctatttttctctgtctaggtatccaataaatgtattttgatcgtggttatattatttgagttgtatttctttactaacggttactcccattttccctttaattgaatacaaggagaagtaaccactaaaacaaaaaacaaattacattacaactcctaccttacaaatgactgctatttcctcagttttaaaactgaatgttatttctgcatgaccttagaaggttttaagaattcagtacatacagttttaaaaaagaaagatttcattagaaaaacattctaaggcagaaacagagtgccaaaattcaaaccaaaaaagttttaagctactacttatcaagctgtgaatgttttctattttatagttttttcttgacagatattcaagtatttgttaatcaaacttgccattaatgccaaaattcccctaaaaacatgattaggaaatcaaaatatttaagctaactgaaataatttttttttcaaaaaaaaaaaaaaaagaggaaaatgaaagctgtatcactcatggaagaaagtttttattttttaatcacatttttatccctcattttctctctgatatttccagttgtttttttcagtcacgagaagcctacatttatggaaaatcagcaagtataaccagctattagcatcagctagggagaggaacaacacaaagccaggattttgagccagcttcctgggcaaattgggaaaagataccattttagttagttacctgagactgttcaagtttaattacattagtggcacttgacattataaaatgtttttttctttcagatataaccttcttccatcattagtaaacgtcaattataatgaagtgtttttcccacttccttttcttcctgatataacggaagaaaatgctaatgagtttataatcctgaaattgttttcaaagccaaaacaaagtcagcttggtgtctgtttattagcttaattttattctttatatttggagaacaaattttctcattttgtttcttactatattttccctacttagtgcaatttcttattctccctgagagcttttaaatgataaatattaccaattagattgtatttctgggttcaaatcagaatgatgttgaagatcctgccccttgctgtgacttacgtactatctgaaagcttctattttttttttcttaaaagctggtttttccctctctcttttttgattttgatacataatggctattcaatccatgggttctaacagtttcctgtaacatttcaatcagaatataatggtgacttgatttcttctctctcaaagattaaatatgtccacatatgaaattgatgcattttataacaaagaacaagtttctttactgtcaaaatgaaattaacatcttatgaaaatgggacaccatcactggaagaggtcaagaaggaagagagagataaagtcagttttccaatacaacattattcagtgtctgtgctgaaaacatgcttgacagaaaaggtctgggtcaccttttagcagtgtcttggtatactgtttgttttcccctactgagaaattagggggaagctgtctattgtagtgcagagaaggcagcaggcatggggtcccaacctgtaagaatgctgtgtaatcaatgccaaaaaaaaaaaagtgtgaccaagagaaaaagaaagccatttaaagttactttacaataggcaaaataaaaatggtaaattacatttatagataatatgttctggaaaatacgaacccaagccaaatgtgggaaaattttaaaatagactgactagttataaggggttatgctccccagaaagcttacacatatcacaaaagctttgcttatgcttttcattttaaacagtcttttgaagtttggtcctggcattttatccatattgtctacctttcttctttgtttcacagctggatatactgctaactgaattaaatccaatgaatatacaagaatatccaaataagttcaagagttgcttctttctgcctaatttgtatatttgtcccaatgagatacactttacgacatctatgtttatccctagcatctacatttttattttaaaatatttataaaatagtaagcaaagtataataaaatattcaaatagtggccaagtaatttctatcatatagtcatgcaattatgcaacattgcattgttatggctgggattcaactcttaaattcattaaccatttatttaccttttcaataatttttactattagaatatttaacttttttagtgatttcttagcaccgttttacatattaaatatattaacctttggtctctctggtctaatgcaaatatacttcccagtttatcatttgatgttctatcattttaattctactttttttatattcaagggattgacagattttcatgtggtgaaatctttactttcttttttgttttctgccattgatagtatgttctgaaagatcttcctcacctgttctacattatttctgctattttgagtgctataatctgttttcatcttacttttgaaactttcttttctgtaaaattaccaaataaataccttgtaatcaggccagccttacccctgctccaagagtagaatataattgttggcttcacaaaaaatcacactcttagctaattttcagttccattttatagcctacattcttccagaataattcactgattcccagcctccttggatcactcttctctaaactttcaggagccgaataggatataacacacaaattgggaaagagttgtaggcaatctttagtttcacactgctgttcatggtggggtgtaagcatctaagcaggtacacacctatgggtgaagaacagcaaattcaacatgagcccttcccaatagtgaccttatgagacgttaatttcattttgatggtaaagggagctgtttctgtgtgcaacatgttagttttgcctccaaggcctgttaaatcttaggggtagctgggatgcactctgcatccaaaggaggcatctctgggataagagagtccagattgatgtcagaaagaagataatatttctgtccaaactgctaagcatctaaagagtactaggaaagagaagttagatgccaatctccagggaaagtggcgaagagagaaactgaagagcatttgaattataagtgatgccccaggtcctgaggagggagtttgagttgaggaacaattactctaattacactataaggtatatgtgatgtatacaggtccattttggtaatgtatctgcctctgattcccaaattgaactgttatatgccatctctcttttgcaaatgtcaaacttctgtacttgtaagctgctgtctttatcttgtattagccttgctgtcccacatctaagtaataaaagctagtacttgccatttattgaccaatttttgtgtgctgctctctgtgggaagcactttacatgaattacttcatggaaccctaacaagcatgctaaatgttagagggatttggtttacagaggttcagtaacttggccacattcctcggctatctaatgggagagaaggacctcaaatctggatctgtctgactcaaacatacatacaaagcaggtttttttattcccattttacaattaaataaactgagactgaattgcaagcttcttaaaagcagggacctttttataaacttccttttttccccccacagtggcttgtacttggtagatagacaaatgcatagtggtggagctaatatactcctctgatcttaaactgcaataaaaagctcagattttaaataaatatgatctatctttttattttgttttctatagtcagatgctgcttaatgaaagtaaacatatgtagaaggtactttgagcgggttctttaccaaaaaaagaatttttcagaatattgcagaactgcaatataaaaatcattaggacataaaagtggtttaaaagaggtagcaacttatcctagatcacaaagaaaagaacagaaacaaagaaacaaatgaaaaaaaaaaccctctgcactttaactccatcctcccacattctgactttgtgttattacaatttacatatatttatattgcctttctcttaacaggttgctgtaactactgttgttttcatagatttgtcttttgggcttcatactagagttatgaggggattgccaccacaattgtacagtattgtcggtttgtctatgcgcttaattttaccagtgggttttatacctttaagtgtcttctttttgcatattaatggagtttgttttcaaattgaagaactccctttagcatttgtagatgggtctggtggtggtgaattttctcagcttttgtttgcctgagaaagacttcatctccttcatagataaaggatatttttgctggctacagtattcttggatggcaggtttcttcagcactttgaaaatgcagtcccactctctcctggcctttatggttttcattgagaagcctgttgtcagacaaattggagctcctttatatgttatttgcttctttgtacttgctgcttttaggattctccagttgtccttgacctttgagagtttgactattataagtcttggggtagtcttatttgggtcaaatctgtttggtattccctgaccttgctacctctgattatttatctctttctcaagctttggaaagttttctcttattatttctttaaataagctttctatcccttgctcctgctcaactcttttgaatgccaataatttttagatttggtcatttgaagtacaaatatagagtttggtagaagaaataagatgtagtgtttgataactcagtagggtgactataatttacaataatcgattgtatattttaaagtagctaggaatgaataatttgaatgtttctgcataaagacaaatatttaaagtgttgtatatcttaattatactgatttgatctttacaaattatataaatctattaaattattacatgtaccctgaaaatatctacatctattatgtatcagtaaaaaaatcatttttaaaaatcattaggggaaacaagaccaaaaaagatagacagctatacacaacaagtacattttagactctattgtgactctttttggaattattaatcacttcccaaaaatgtattgccttatttctgagagattatcattttttttttattctttaggacacagcaggccaggaaagatacaggactatcaccacagcctattatcgtggagccatgggctttattttaatgtatgacattacaaatgaagaatccttcaatgcagtacaagattggtaagtcagagcaaatactcttattactgataatgatggttctccggtcaactctgtctttcttcccaaagcagtgaccataccgcaatgtaatatatgtgtttacattacactacaatcccgcttgtgcttcatttaaaaaaaaatgctgtttatgcacagaagcattattcagggattgataagaagtcattctgatgatttttctgcattttgttcattccagtgctttgcattttgtcatcatcgcttccatggaaactagtgcattgcttttgattttttaaaatataaataacgaatggtttggaagtttactgatctaaaatagggatctagaaactatggctcttgcgccaaatctggcccactgcttgtttagtaaatcaacttttattagaatacactcccctcactgttgtctttgactgccttaacaccaccacagcagagttaagtagttgcaacagaaaccatattgccggtaaagcctaaaatattttcgatctgtccatttatgaaaaaagtttatggaccccttatccaaaagatttgttaaataggttattcaaactgaaaaattttgaaggactgagataaaggataagataaaaccaaaactttttctgactcatagctgcatgaaactatctgaaaatacttctgaccctgatgagtgtttacggtggggggttattcctacggctacagtatccttcattctatcccaccagcaccttgagagcagacactgaaaagccagtgagatctggtcatgagctcaagcacagggctaaagaggacggtttttctgtggaaggagcgagaatctaggtagggctttgtgtgacattaggaaggaaatggagctcccaaaatggagttcccactggtggtggctaggactgactgaagaaataccgcactttaactgtaaatataatcacatattatcttatgtaaggaaaactttgacaatacataggcaaaacagacagcattctttttttgtttgttttctatgataatattatccaaaatgatttttacatatatatcagttcagtgagggtcagatactcttaaaaatatttccatttgcttttgcttttttctttccaattttaattgttcatctaggaagacttcttatttacacacacacacacacagttacaatgcaagaaataataccattggcaatagcaattcaaaagagaaatacagggttataaactaaaaaagacaagtttaagatgtatatgaaaacataagtatcttccactgaggaattcagaagaaagcttaagtaactattctttttagtaaactgaatgttgtaaatacaccagtatttctcaaactaatttataaactcaaggcaatcttaattaaatacagcagattttgtacaaaatgaaatgaaatagaaaatccagagataggcataaatctatatgaggatatagttgatgataaaagtagcattcaagttagtgacaaaaaggttggttcaattaagagtgttatgatatctagttaattgccacagatagcctgaaacacatattgctatgtaatatggtaattttaaccttgactacttcctgtcttaaaatgttgagatccaggaatcccaggccagaagtgctattataagttttccaaaagaacaagatcttaaaaacatggaagacctctgcccaaaattcctgcctcatcaatgcctgctgaattaattaaaacttcctcagcctgactttcagacataccacgtaatggtgccactatatcttcatgccttcatctcttactattctagaagcaaactaaaccattcattgtttctgaagcccagcttaaactttccaacatttgtgcttcttttcttctatcctttttttctctgctttgcatgtctctttcctcaatctgctactccatctgccccaaggcatatagatttgtcaaaaaccaacaaaagcctgttctagaaacaaacccttacctacttttttcatccaaaattagatgatcacttgatttattagggttttttaattcattcaacaagcacttattgagcacctaactttgacagccaatccatcagacatagcgtttagtacctatgccagcatttactatctcagttaatagatccaccatcacccagttatctgatgtagaaatatgagcactgtcttttatttcttcctcttttacaaatagaatctcattgaccaccaagtccaatcattttgactttctaaatgcctctccaatctattgctcttttttcttcctattgccaatgtgttaatccaaaccattcatttaggagtcttttatcttttctccttatcttcaggttccaccctctacaggtgatccatcttattgccatcagagctacataagtgaaccttagtacatctcgggccttaaaaataaaacttccagtaatatcttattatgtacagtagcgattctgggagcacatgttaatcacctgtagagctttgacaacatatacaagcccagactccactctggatctactaaatcaaatctcccgtgagatacacgggcatatgaatttttcaaggctccacaggtgattctgaagcccatttctggttaagaccattgatttataatgaaatccaaactcactaacatagtggacagtgcaacctccaggtatctatttcactgacatcatctcctatgactctcttccatacgctctatgtttcaactaaacagaaattttctcagcttacctgaactccatccttttactacctctgtttctctgcctgaaatacttcctctgtcatctttaaaaagtctatttacttttcaaggctatctcttttacaaagctttaaaagattaaaagatatctctaccccttttcctacctgctcccacctttattcataacagacaacactatccacaccctcatctctgcacccacactaccctggcactttctgcagatcacgtaagacctagcggactctgctattatttcattatattttcattaatcatttttccccattacagaatacagtacaatacaatacaatatatgcactcttatttttttctcatttctttatcgtggtaaaatatatataacataagatttactgtcttaaccattttttctgtatgtagttcagtagtattaaatacattcaaccatcaccaccatccagctccagaattcttatcatcttgcaaaacttatatttaaatggtaactccccatcactctctccctgcacccctcagcaaacaccaacctgctttctgtctctacgattttaactactttaagtagctcatataagtggaatcatgcagtatttgtcttttagtgactggcttattttacgtaacatactgtcctcaagtttcatccatattgtagcatgtcagaatgtccttccattttatattttattatatgtaataaaatatacattatatataacttatatgttacatataataaaatatacatacacacatacacacaatacgtgttacataatgtacattgtgtgtatgtgtatatataaacacaaaaaatattgtattttatatttatatttatatatatacacatatacatatactatatgtatatttatattatatatacacatatacatatactatatgtatatttatattatatatacacatatacatatactatatgtatatttatattatatatacacatatacatatactatatgtatatttatattatatatatacacatatacatatcctatattaatctaatatatattttgaatagatgatctaaagtactaaacagaattacatcctgatttcccagcaaaaaatacagaaattacttcaaactgacatagccaggaattaacggttgtattcttcctctcaacaatagatttaagattgtgtgtgtattgccgctatggcaccaattatatttatcttttcgtttttcttaagtgtatacttgtcttaagttcctactacattagaaactatttgtagggaaagactatcttatttatctgtatttcctttttgacataataactagcacaaaatggatattttaaaaattattattaatttcaaaagtaaaaaaaatcagaaatcttaagaaatgtttaaggaataggaatagaattgtataataaaagaaaaaagccctttggggaaaaccattccactgtagctactaaagcctactctacatgtacagtataattgaatggtggttgtgggtgaggaagcttgctgatattcagtgatggccttctacaacaggaaataaggtattctgaaagaaataagcacaaagaaacacattctttaaattactggtctccaagtgctgatcttaagtgtataaaaaatacagaaaaacatatctagcaaaaagaaaaattaattaaagctgagctgcagctaaagtttcagctactcttcccaacaaaatgcactttgattattcagaaagaaaaaaaagcttgctgactgtgatttctccaaaatcctaaaactgtcttactatataggaagaattaaagttcccttttcaaaaaacattttattacacaaaaattctggtctgttaaggagaagccaagtgtattagtctgttctcaaactgataataaagacagccaagactgggtaatttataaacgaaagaagtttaattgactcacagttccacatggccagggaggcctcacagtcatggcagaaggtgaaggaggagcaaaaacacattttacatggcagcaggcaagaaagcatgttcaggggagctgccatttataaaaccatcagatctcgtgagacttactatcataagaacaacatgggaaaaaaacccaccccatgattcagttacctcccactaggttcctcccatgacacgtgggaattattacaattcaaggtgagattcgggtggagacacagccaaaccatatcagcaagcatggagattcagagagagtagcaagcagcgagctaacagattattttgaggaaatggaagctatctcttttttgaaaacacattagactgtgctttgaattttccagtggaattttatttaaggagttaaattatcctctttggccaaattccccagttctgtaaaattaatacaaaattaagctcactgtaagcctatttagaatttatgtagaatctataaattttcaaaaagaatgtgagaaactcaacataaaaaaatgcatacactgtggttagtaaaatatgagcagaaagtaactcccaagaatcaggatgatggtttgtagctgtcattcctttgaaacagagaagaaaaagctttatgtgctaatagtttattgggacatacagggcctggaagcaagagtgaggagaaaagggagcatcagggaagagagagaacaaacatggagggtgttgggatttgcaaactgatctctacttggtagcaagtataactgaccattgatctcacaggaacgtcttcagaggtgctttatgaataatgcatctcaggacagactatctggtagaaggaaggaagaactgacccactagcttttctcttctattggtccaatgttcacttctgggactttaactcttccacacttcccagttacacatatatgggtgactcatggctcagcagcagcaggaaaactttggtgtgggaggcaaggggtctgtggcattggcctgagataagctgctttgggctgtgcccatgtcatgataacacaggtgatagtccagaagagcccttgcagaagtggttagcagaaggaatgaacaagtgaccaagagcccttcagacaggtgagtccaggaagatctgaggggttgcataaaaggtgtcttatagagaattttatttatttatttatttatttttttctgttttgttttttttttttaaattatactttaagttttagggtacatgtgcacattgtacaggttagttacatatgtatacatgtgccatgaattttaaagcttaagaaaatccaaagggtcaaacggttattgtgcttgaaatacaatttggttatgagattgctgaaaaccaaggtaataaccaaggccaaaaaaatttttttatattttatttattaaacatgatatattatatagctctcattataggaaaggagaaaaaacatatcaatcttacagggcaataagaaacttcaaaacagtttttgttgaatttggatggaaatgctttttatttggggcacattgggtttatgttaacaatagcttttataactagtactaaaaaggccatgactttagactcatttttttctttcttaaagaagacagaatatttgcgcaccttcagtgaaggcctctgtgagtggctgggcaaatataatccaagcacgtagagttcttgtggtctcaaatgatccaagaactgaatggtaaccactcaagggaatgaatggattacatgcttcctagactatcttctctaaatgtcgttttctgctttatgcctttgataggagctggataggcagtttgatatgtaaagttatgctctctgaggaagacctcaggtgcttatattccatccaatattttggaaaccagatgctgaccttatattaatatatttgctaaattctttctagtttctgaacttctttcagtcccttgaacttctcatacctctgggtctctcttcccctgggctctgcctttcataacaaaccatattccttcaaccttcacccagatcaagctaatttattgtcatcattcagattttagctagattctcatttcttctgagaaacttttcttaatcccagagtaggttagttgcttatgtagtgagctctagaaacaatactacccagtatatgttacaagttataaaactgcttatttggttatcttttttcctgctggattctaacttcctcgaagatagtctgtttatcttccccacttttacatcccagtgcctactgtagtgcctggcacttaatggctgctcaatattcatggaatgagtgagtaaaactacatagaaaacgcagaccatattcatggaatgagtgagtaaaattacatagaaaacgcagacctagtgaagttgtcttaattaattggagtgttttataaaaatcacagggatgttagatggctataaacaatcacactggaagctgcaatgatgtttacgatgtgcttcagacttgtccatgtggtaaaaatgtgtgtcatcatggtccttaactaggctaatttgccagatatctattggcttaaatctacagtttgttaaggagcatagagttgtagaggcaaaggcagcaatctagtggctccatggttttgggaaagtaaaggctacttcttttttaaaaacacagtattctgtgtctggatcccccagcagggtttgatttaagaaataaattaacgaatgatttgttaaagagataggtcctaaataggcttaagtaagtatagaaataccagatcaccgctgaaaacttcacttccttcgaagtgtttctcaaatgggttgtgaccagagagtttactgggtttcaattagaacatgacctcaagtacctggccaggctctttctagcactgtggctcagggtctgcacctattgcagtgcatttgaacttgatttaaaatcttctccatccccgattttaacatctttctgttctaagtatggcatggccacaggctgctgtatttcctgtagaagaatatcattggcttttctccccctctcttatttatttacattctgctttttatgatacaatgaggaactataaatatagaggttttttaagagcaggaactctggtaagcagattgatattttttaagaaatcagaggctgaggataaaagtctaacactctcttcctatcagttttaaataattcatttctgtgacattcagggtaccactgcagatatgctgaaactagaatgaaatttcaccttcaaatgttcccttctgcagtttttttttctttttctttcccctccaaaactacatagtggtcttaaattaaggttacttcatgttaaacatgaaagttagcctgccaataacaactaagatgtgaggagcaattgctaagcctctgttcagagctttctaatctagctcaaggctcctatcaactaaaaggtcagttctgtgtcacagctcagagggggcagtggtgggatgagagcacagaattctgcccccagactctcaccaccaccctacactggaccgcggggagtctcttctttctccctggatgttaatgatacatttcttattgctggtcggacccaaccatagaacattatttttgtgcagataacccaacttaaactcaaatttatatttagaaaatagagggctcctaatcctcagccccttcaaaaacaaaaactcaaaacaccctgtttcctccgttgtctttgcatctcaataaatgacatctctatctttctagcttatcaggctaaaatcttcggagttaatcttaacttctcattttctcagactgcacacccagttcttcaaaaaatactgttatatcttgggtctgatttcaaaacacaatctattctcattatccatggcagttatgccctataaagttgccacagacactgaattagcaaatactgaattattgtcccagaagggaattacaaggctgttgtcctgcaagcctccatcacattttgccaactaattgatacataactatgttttgtctgagtttctacagaaatataccttatttaatatatacagttgattcattaacattgaactcaggaccaactattctctgactcatgcctgaaaggtgcttgtctaacccacgtttattctatgcgaggcccatcacagttttcttatgctcaggaacagcagacagcacttcagcactctacttgagggctatttaaagcagcaaagtcacctgcaacgagcacaaaaatacgaaaagcatagcactaaatacactgtgaaagggcacttgtttacagtgtgagcagggccttgttcagccttagctggaacatgtgtgtcagacaattcagatttctcgctgctctgagcatgtctgcaactatccatgaaagcatcatgggtgttgattttgaggttacaaatcaattttagcaagcaggtgaatctgcaaatttggaatatgtgagtaacgaggacaaactgtagaattataattcccaccatttttcaccacgtctactgcatattagtttgctagggttgttgtagcaaaataccagaaactgggtagactcaacagcagaaatatactatgtcacagttctgaaggctagaagtccccaaagtgtccacaagattgattctttctgagggttctgagggaaaatctgttctgggactctcttctagcttctggtagcctcaagcagtccttggcttgttgaatgcattcttcttttgtctttgagggaggataagtaagattaggaggccctactgacttgcccccttgggaagcccggtgggcccctttctcagcaggctccacacctcttgcacccttgtgtgtcagcacctaactcttttgcaaggtaagcagtcctagaggatcccagcagactgccagattgttatacattcctaatacccagtacagcaaagagaacaaaagccccttattcctgatagagctttcccaatctccagccaatcagcactgaaagcccaggaaactattagctacaaattcctgccttgtgagagccaggggcttctctggggtcctgcatgtacacctaggctcttcaacaatttttgaagtttcatatttctataggaatttaccatttttagctaagttttcaaatgtgttagcacatagccctttgtaatctgcgccctgtccctcctgctttcctgcagctcctgcagcattgcaccattcctagccacaaccttaacagcatgcagggccccatggtctaggccccatcttgctgccttcctatctggtctccaggtttagctcatagtaacctttccctaattttaatagtaaaaagcacacccctaggtggagattttatatgctaatgatacatgcaatgtgtgttcaagcatgtagatattgagcgcattctccaactgcaggtccacctttgcatacttgacctcaccagtattttatgaatatgtccatacagctcccataaaacgaattcctcctaaggcactgctgtctctccctctgagcagcccgctctgcctcagagtatacttcggctttgcaataaacctcttcacctactcttactttggacttgctctcaaattcttttgtgtggcgaagtcaagaacatgaaccagtgcagcccattgaaaacatcttcacattatcttttctatattaaaggctctctctgtgtccaaatttcttctttttataaggacatagtcatattggattggggcctaccctaataacctcgtcttaacttcatctgcaaagactatttccaaataaggtcacgttcaccggtcctggggttataacgtcaacatcttttgggaggacacaactcaacccataatacactgctgccacctggttatgccaccatcatctcatctacattgttggaacagcttaactggtcttcctgcgtttactactggtccagtccccagaatcttcccaggacagcagctggagtgagcttttaaaactgtaagtcagatcttgtcacccctctgctccaaaacttcacagcatcccacatctcctggattaatgccaaagccattacaatagcctaccagaccccgtacaatttgcccactgcttctctaccctcgtcttctgctgcttatcttctccacatgccaccaagtttagccacaccggcttctttgctattcctagaacattcaagacatgcctgtacctaagaacatttgcatctgctatcccactacctggaagttttttccctcagatacccttatggtagcccacatacctccttcatgtcttcgctgtaatgtcaccttctcaggaaggcctttttttcttcccccaccctatttcatattgcaaccttctgcagtcctttctattccctttctctgttttatgtctttttcacagcatttatcaccctatgaaatatatatatatatatatatatatatatatatatatatatatatatatatatataatttacttgtttactgtgtttattggctgtctacctaacaagaatgcaggcttcttgggataagaatctctgtcccttctatgcagtattatattctctgtgcctagaatagtccctggcatgtactaggtattccataaatatttcttgaatgaatgactgtatgaatgacagaatgagaattatataagactggatcttattcacattgtatctccatagtctagcataggcccaggcacatatcaattatatgttttctacaacaacaacaaaaaaatgatgactgagagctggaatagtatcagatcattatgatgaaaacaaaccaatgctctcaattcaaatcacatatggaggcactgcctgttttaccagagctttgcttatatgagactcttcttcccagtaaggtggagagaatatctgggtaggactgataaagagaaaagaaaaaaaaaatgtcttatcttacatagtgagcaatgtgacttaaagttatctgattagttactgtagcacattctttccctaaaacagcattttattttttggatgggggtatatttgcagtaagttagtgccaatgaagtacagcacaaatgtcagacatctgaaaagaacgaaagatgccatgtaacctgatgggaaatgtctgctcatttctcacggcctccgttcaaagtttctcttactgttttagtttccagtcagggttctcttgtttttttcccactcataccttcatttgctgcacttggttctggcttgtctcaataaattccccaggctgaacactgagagagaaaatagctctttaaagaatgaagatatgtgaaaaaaaaatgtaaagccttgaattaaagatgtcttagttaagcattttgctaagtttctgttcagaccaaacagacaaagctgggcttatattctggtttcagaaaagtgtgtgtgtgtgcatgtgcatgtgtgtgtgcatgcgtgtaactcaggaaatagcaaatagttcgaaacacatgttagcagttaatgtgctgattatgtgtacagaaggagctaagagaatagagagagacacttgtcctctatgactttgtgttttggtcaactcaactgtactttggcctcactggactttggaagtggtaatatttccataaatattgacactacagggaaggctagaagctaaattatgtagatgcagccttacccaagtcaggctatatagggaatttgaagattaaataaaagacttagactcttgaataaaaggtattatgtaaatatgattgctatttgtactgtttcacttgcactctgaaaatatactccctcgcaactcttaatatgcagttatgtgttacaatatttattgcaaatactagcattttctagcatttttcttggtctccctctattgcaatatgcatatcctcttttctttgaaattagttacttgcctttgagggtagatttgtcttaaaggacaataattacacctgtcacataactcctcagaagaagttttgataagagcctattttccagtcctagatattcagctgggttttggtgggcattataatgattgctttaaagcaaatattgttgattattctgtttagaaaacagagttctgggctttaaaaaataacagttgcatttgtgacttacttgaaccttacagttattttcaggaccatcgtgaatacactgtccatcaagtctgcttcctaacctcagccaatgtgttcagtacctcatgatacatgttattgaccctcattttctatttgcccagtcagcaagaaatatgcactcaatcactgcattgtgaatgagtagaaaggccaaatcttctgagtctaaattgatacgaccccagtctactctctatgtattttcaagtctttgatattgtttgctaagtgtgggattcctttctatagctggagaattctggagtccttatctagaatttatctttgcagtgcagttaattaagataattatcctagttatcaattacgaaccaacctcgcctatgtaccccttcttaaaaacaaaaaaataaagagacattaaaggaaactattaaaaaaaaattagaaaaaacagcacaacattagacatgggaggtcaccagagaagataggtcatggtatatgatgtctgattctgttcatgttagacagagcccatattaagtattctcacatactgttccctttctagaccatcaattttcaaagcaaggataaaaattatagtgtaagtacaagaacttacaagcagcccaagcatatgtcacagtttctgtggcctcaatcttatggtctctacttacagaataacagttggttcacatttaaagcctattgtatcctacaacctaatttttatttataaacaccaaatgattcttttttgtacttttcctttctacagcatattgaaagcaatcattagtggatggtaggagaggaaagagatgtaacaaggcctgaatgtatttttagttggtttccaaactttgttttaagcaaatacccttagtaattaagacttttttgggctttaaggccctttgccctctggtttttgttgcctcctggtttagggagcatctcacacttgttagtatctggttgttgggccagccatgcctcctcaagatcaggagccaggccaggcaggggccatgtgtgggcatgggagagcacaaagcagttcaggagcccagagtcagctattacaggatttttgctaagttttgggctgttggcagcatcctggacctcacgcctgggcctgaatgaggccctttcttaagagtctttgcaagttcgtgttttatttatggagtgacttatcccttccattcagagcagccccacccagccatcccagcctctgggctcttacgtcttcaaagcagacccacctggttggtctccatcctgtgttgggagctcagccaccatgttcatgggtaattttcctcataaagtttatatccagttatttatataactgttatgtcaacttgtttgtattgactattttgattataaaataaaatatcttggccaggcgtggtggctcacgcctgtaatcccagcactttgggaggctgaggtgggtggatcacgaggtcaagagataaagatcagcctggccagcatgatgaaaccccgtctctactaaaaatacaaaaattagctggatgtggtggcacgcacccatagtcccagctactcaggaggctgaggcaggaaaatcgcttgaacccaggaggtggatattgcagtgagctgagatcatgccactgcactccagcctgggcaacagagtgagactccatctcagaaaaatatatatcttaacagaaaaaaaaaatcatcaaatatgtgtctactcaaagttaactaaactcaaggttaaggacacagctctccacaagattggctcaattctgacaccagctgcaaatttgggagtcctcagggccaccctcacttctgaccagctgtctacaaatttggggttttctgtgaccccttttaggtttgataatccactagaatgactcacagaactcaagaaagcactacagttatgattacagttttgctataaaaaacatatacaaattagaaccagccggaaagatagataggcagggcaagatctggcagtgttccagagcagaagcttctgatgtcctcagagacattaccctaatggcacatggctgcatgacaatatgcatagtattgacaacgagggaagtttccccaagctctagtgtccagagaggttttattggaggttcattacataggcatgactgatcgaatccttgcccaaatggttgaactcaatttccaatgcatcttctctccttggaagtggaactgatgccacctggctcaaagtcccaaccatctcatcatgtctttggtcttcctaacatggccggcttccatcctgagtcatcacattagcataaaccatcaaatatgctctatggggcccaccttgaagaacaaagacactccaatcacttgggaaactccatgggttgaaagattacctctcaagaaccagaaacaaaggtcagccaaattctttatcacacaatgtttattacacaataataaacaaattattatttatctatgaatagtaatcacataccactatgtccgtctacagtgcacattagaaaacactcacagaaaactagatgttaaaaaaaggataagttggccaggtgtggtggctcacacctgtaatcctagcattttgagaggccgaggcaggtggatcacctgaggtcaggagttcgagaccagccaggccaacatggagaaaccccgtctctactaaaaatacaaaaattagcatggtgtggtagcaggtgcctgtaatcccagctactcaggaggctgagtcagaagaattgcttgaactgggaggcagaggttgcagtgagctgagaaagcaccactgcactccatcctggacaacacagcgagactccgtctaaaaaaaaaaaaaaaggataagttaaagatagagtttttaatattgttttccagcacccttgtataaaaccagtggaaaattctccagataccccgtaaagctgacaaaaaatggtgcacaccaactgaagccatgcctacctgtctcccctggccctctcaatacttttattggcatctcactttccccttgacattccttccttcttttgcccttattggctccccaaattttgcttttcaaatcagtggcttcattgccactgaagttaaacgtagtgctaaggccagtatgacagggtcgtttttatatagccctcatcaaaacacccatgtcaaaatgttctttttttattagtaagaaatagagcaacaaatattttgacctcctattctgtccataaccttatctctgatcaaattcctctggtcagctttaggccctctctgaatttcacagtatttgatcctaatcatgacgtttttgatagatttgctgcctggtattcaaggagttaagtataataaaaactagctgtgctctccaccccaaacccagcacttcctaattgcatatcaaatatctaagcaacttgaaaacatagatgctttgttatcatttaaattatttccttatcattctgttttttataaactgtgaattttaaatatgtatatcaatatggtaatttatgtaaatctttgccttcatattttctactgtggaaatgagtgctttctgaattgacagagcagagttttacatcctatgaccctataaaatgcatcaaaaagtaccaaatatgatttcatttatgtagcagataagacagcttcttgtaggaaaaatttccttaagctgggaggaaaatttctttttttaattttttttaattccctcaatttaaagccaacaaagatagggatacgggagggaatgaaaaaggcagaaagaaaggagtgcatgttacagcagagttcttaattaaagctccattttgagaaggaaaagtggcaccaggctggggactctgagtctgatgaggagagctgagaatgctttgcctcaaagttagagaaatctgtcagacccaaatactgtgcaaccttggaaatttgacagtacttaacttttctcagccttaattgaccatcttaaaaatgagaaaagaattcctaacttacaaggtggccatgaggaaaagaggagaaaaatctaatgtacctggcatcatggggtaggcactgttttttgtttttgtttttgttttaagatactagttctcaatccagaccatatattagagtctcctggagatcttttaaaggcatatttatcttctatgccaattcagtcacaatctctgccattgtgaccccagcatcaggattttttttttattattatcatactttaagttctgggatacatgtgcagaatgtgcaggtttgttacataggtatacatgtgctatggtggtttgctgcacccatcaacccatcatctaggttttaagccctcatgcttatggtatttgtcctaatgctctccctcccccttggcccccagctcccgacaggccccagtgtgtgatgttcccctccctgtgtccgtgtgttctcatcattcaactcccacttgtgagtgagaacatgcagtatttgattgtctgttcctgtgttcatttgctgagaatgatagtttctagcttcatccatgtccctgcaaaggacacagcatcaggatttttaaaaaatctctccaagtggattgcaatgtgaggtcacattgaaaaatgagaacttttcccaaagtaattttttggtcacatattattggaattgaactttcatgtcgagtgttaataaaacattcttggaaaatacacaaatagatcttatatagcttcctaacctttcatatagctgtattttcagaactattttcttatgcccttacctctatggccaatacattaaaatttggactggatcttaatgttaattgtttaccagtgtgttttcagaaattttgtgactcagatagacacatggcatagagtctgtgtatggatcaggaattcaaactgaagtgtttgggccaaaaggattcatataacaagtcctggtcatgtacaaggacaagatctgcagtggaaccagctgctttctgaggcaggggtttgttgtagacattgtctcaagatgagaaagacagacgtcaactcatgggttgaatcaagtagtgtcccctggaagaaataacaaatgcaatgatgagaagttgtttctatcaaagatttctcatcagtgctgcctctgcaaaggttcctgggaccccttgactatcttattaatggaagtagacaaggaaggactgatagggagaaggcttctgcatgcctggggtaaatatatctgcaaacatgcagtcatcgtcacacgattcatcggcagtgtatgacatctccagctaattcagtctaggacaccttctcatgagcatgaacagcaactggagaggtcttttgaaaagaaaccgcagtgcatatgtgccccactgctggcttcatttttctctctgatgacataactgcgtagaaaagaggcaaggccatagtttctgaactttgaaagcttctgaattggcacaggggaatggtcatgtttgtggtttttcaaatattatgttttttaaaaaacatggatatgaagtccacagtatgttgaagatagcatacaaggttctgttatgtttctctggagaacaacaacaacaacaacaaaagattctattcaaccaacaagggatttgtttatttgtttgcttgcaattgaagggtttttccacggcaatcactgtgaaagacgtcaaaatgaattatatcctattctctccgatttcagtttttttcaggggaaataagacacgtagtgccctggtcaccaggccattattggggaatcaacctttgtccctaggattgcctttttggcctatctctcagtccttgcctttcctctctgccttccttgttgccaggactttcatgtcaccctctgatttttaaagcccccattccccgagaccaactgttcagaaagtagatgggggccgggcgcggtggctcacgcctgtaatccaagcactttgggaggccaagacgggtggatcacaaggtcaggagatcgagaccatcctggctaacacggtgaaaccccatctctactaaaaatacaaaaaaattagccgggcatagtggcgggtgcctgtggtcccagctacttgggaggctgaggcaggagaatggtgtgaacccgggaggcagagcttgcattgagccgattgcaccactgcactccagcctgggctgagcgagactctgcttcaaaaaaaaaaaaaaaaaaaaaaaaaaagaaagtagatggggtataataagcccaagtacctttcttcattctgacccaccagaccacaagctgttattcaaatgcatggtgctccctgatacttccattcttccatcagaacaaagggctcctttccttactgccggtctctatagtcctccttgtcccctaaagctcacctcagacacatctccttgataatgagagtaaagtcctggcggaggccagccacgaggcaggtatttattaaatgttagttatctttccttctttctgatctcctggccaggatcaattgcctcttcagggctccctcagcactgtcccttatatatcttacaagcacttattatattctaccttgtattaccaatgtttactttttcctttattgtactttgctgtaaagttcttgatagttgaatatgaaataaatttatcctcatatttcccaaggatatttcaaagaaccttatacttaggcacttaattaatattcagttgacaaatgaatgaatgaatgaggaaaatgcccaagcccaatcttatcctacataaatacccctcctacagggttttcttcttatctaaacagtcccttttagctgactgctttgatactttccagagactaatcaaattaagacaattcacagaatgtgtaagttgataatttatttgataaagtagatgggaacatttgctctttcaaaggagttttatatcctcaaagtaatctccaatttctgtaggattgatgatgaatataaacagaagggtctttttgttcctttgctgaagcaaaggaaactacctctcactccaggcaaaatcaagagcctccctgtaactagtctgtgagggagccaacattgtcctgtgcattatcaggcagtctacactttttatcacctttccaaagagctctaccagtacttggggcttcaggacaacaaagaacatcactcaggggagagagaatgggtgatatgctgaataatttgactgagaatgaggcagcagctaacggagagggtcttgcacatatatgcacacacacgtagccatccttataatattctagagaactacatgtgggagcttgagcttaacattaaggactttgatttatgacttctcattaacagccactacacatcgatgtgattcggctccatcttgcataataattaactcatccataaagtgcatgtttgacagctagactggaaagcagtatttatttcatgctactgctgcagctgcagagagaattcacatgatttttctaaaatcaatctcatgtgtatctttctgaaataggaaacagtttcacaaagttgttttgcaaatcaaatgtggtgacatattctgaaaatgtttaaagctgaaacaccttgcaaatgtaaagatatttattattttaataactactgttgatattttattgattcatatttctagataagaaaattgtttgattggttccttgagcttgatagctaagttgtccatcaggagacacatcccaaagctagctagaaggctgtggaaactaggactgaagcaacagacttttaacattcttaattattttgccagaaacttttaagttctctcattcctctcaggaattaaaacataccctgaatacagacagcttttactgatccagaaccaacaacaaaatcttctggttttttttctaacattatttctgaccaaatctctttttaatacagtttttaaacaacaataaacatagattatgataatatttgaaggatctttaatagatcttttagtaaggttgctagatatagcaaataaaactataaactgtccagttaaatgttaatttcagatgaatgatgaataaatttttggtataagtttcccatgctatatgtgggacatatactaaaaattatttatatttcatctaaaattcagatgtaatactgagtgtcctctattttatttggttatcctactttttaggatgtacgcaaccggagaatagtagaacatttgtgaaagcactcacattctaacatttctccgttaaacttccctttcacttctttctaccatctgcctctttccttttctgcaggtcacagatggtaaccaaaaacatgctattatttagtcaaaatatttattatttctggcaaaagcaagtgagcttccaaaggctgtggtgagaaactcttacaaagaaaattgcacaatatggattcattgctatctataccagggcgccaaaccacctatattattattattctttctgtctctctctctggagatatgattttatatatatatgttatatatatgtaatatattgtaaatattcagtcaatatttattttccataacagcaaggattacaattaagaccttaaaataaggggaaaaatacctggggtttaaatgattctaaacgagattttatattgcctttgcccaatccccttccttattaaataaacactttgattcttttaggcatttaaatagtacatttagagtcgtctttggggaaaagaaaaaagagtctatgctgttgctgcaggtggccatgaagagatctgctgtatgaatggcagaatgtaataataataacaaaatgtgtgtctgggaggtggagaacctttctgctatcttttttattcccatcctcaatacttgttgttcatatagtggaaatgaaagaattcttaaaaggcacataagccattccacattacccagaaagaatttcaaggggggggaaatgatctatcaatctagagaaaatacaggcaaaacacaagaacaagagagataacttaccctttaaagcttaaaactgtgcgtattttctcattgtgtttatccttgatattttaattatgtacctgcctttgtgtctttctttccactaggctgaaaattctcatgaggtcataagaaccttggctcatttttgtttgttgctattgtctagcatattccctgattcattgtgcatgcagtaattatctcaaaaagtctgagaaccattgctgtaaaatagaatataattgaattgggagataaaactactcaactctttaatctggggaagaatcatacctctaatttcattggcttgcttgtagctccaaccttatatttcttgaagtcccatgggtgtgtgtgtgtgtgtgcatgcatgtatgtacatgcgtatctcccttccagaaatgaaatatatacatatgaaataatatgtcctagatattcctttaggaagaatttagaacaaagtataggaaatcattatgaggtagagatgtctaactgtccatcaagtttatgctccttcttctataacatagttactgggaagtggttgcagtcagtggctacatttctcagcttctcttgcacataggtaggccatgggattagttctcaccaacaatgccagccaaagtaagtatgccattatttccagaccatggcagttaagaagtgaatttgctttctccatccctgttttcctctttaatgagcttggtgcagaatgaggccatatagtaaagacagtagagccagaaaattgaaaaaaaccttgagttctagaatcacccctgaaaagagagcctcccccaatgccatcaaacataaacattaatttgggacactatgtacacaaggagtaaacttctatcatgcccttactcctaatatattttatgagtagaattgtactttgcacctattcccttttcttctattgtctaatctccagaagcagtagtttagactatgtattcttatagtctgcccttcaccatctttctttcatagtgtttagaaaagtcctaatattaagaaattgtgatttttaaaaaaatttcaatgtggttggttctgtgtgaattttattttcacttaacatttatctaatatccattatgtggagcacacattctgctaggccttgggaatgaaaattgattagctgatgaattcacaaaagaaaaagacatataaaggataaattacaagagaatgcaataaaaatgttaacaatatgaatatgtctgtaggagcaaggagagaatattgttgtctttacttgaagcagaagataaagccttcacagggaaggtgacattgagttaggtcttacaggataaatatggggtttgtcaaaggatatgaataactgtttacaatttttaaatatttgtacaaagaagatagaatattacttttaatataaatgtaatggtttgtcatattaaaatttgtcatattcatcaaaataactttccattgtttcagccttttgctgaataaagttttcagttattaactttgttattaatttttttgtttcaataaccatgctttagccttgcagctattttagtaaaacaaacaacaacaacaaaacatgatctaaatcacatcctaatttttattaagtttgagaatgtttttgaaaaatcattctttagtctatccagaatttatggttgtatgtgattacaaataaaccagtatttatttagagcatgagatgtcattcattattaatttatgtgttagccatttcttttttatctattattctatttcatactgtattataatttattaaatgtatagtatatttgttttcatcattctagtcttctatttttaacctgtatcaaacaattttgaaactagtgttttataatatattttgctatattacagggcaatctccttagtcttagtcttccctctgactcttctcaactaatacagtgttcactttggcaagggaccaattctcaacagccagaagtttaaaaacaaataaaataaacaagaaggatttgagaggttttaaaaataagacaatagtaagatatatggttggtacttcttatttgctattgtgagtgcttcaagggcagctatctcatttttcttcttaattctctttaagattttggaaaataaatgcatgatatatgtgttgaattgaatcattgcctggccttggcccatttctttgagtggcagtaactctgcttaagaatcagctgaggaagagttgcattcagccactgtttaaaatagatatagaaactctaagaaatagtcattagaaaacattgaaactcttagattgataaggttttgaaatagaagaaaagaaattaggtctctgactctcttgaaaactattgagtataagatttcactctagattctttctatatatgtagaaatgattcccctagtcaatagagttgtattaatcagattgcaaatgtttcactttttaccttatgttgtttattgtaattcatttcttcattttaaaagaaggatgtgccatcatgtattttctttccttccttccttccttgcttccttccttcctccctccctcatttccttccttccttccttttattcattttgagatggagccttgctctgttagccaggctggaatgcagtggcgtgatcttgggtctctgcaacctccacctcccgggttcaagagattctcatgccgcagcctccagagtagctgggactacaggtgcccgtcaccacacccagctaatttttgtattttagtggagacggagtttcaccacgttggccaggctggtctcgaactccaggcctcaagtgatccactcggctcagcctcccaaagtgctgggattacaggcatgagccaccgtgcccggacccgtcatatattattcttgaccatttactctgtttttacatctgctactacaaccatgcataaccaagaaaaaataaagatttgaatcatagttatcgcagttgagacagaaatccaaaggtagaattgagaagtattgtttttgttcactgccatgtctccagtaccagagcagtgcttgatgacacatagtaggcacttagtaaacatttgtcaagtgatcgaagttgagtcaagcatgagtcacagccagcagagcagctcactgaggagcaatcatgggtctaagtcagggaggctgagaggaagtcagaaagcagattatagatagattagggtcaaaggcttggacggaagccatgaacatgatatgtgaaggagagggagatagactccttggctttataaagactggcaggataacatctgcacattggatacaaagaatatttgtgatttctattgtcatatggctaaagtccattttttgaaagtacattgacatcataaaataactgtttagtggtaacgacttctagtcatgttagtcatattacttgaatgaagagtatattttgactgagctgactttttatttgataaaatatttcactgtttttcagaatgctgaattaaatctgctgtttcagtagttttaaataaagttgtgaattaatgacttaaatgtaggtcagagaattgttgattttccttcatttgaagcctctcaaacactgcctttaaagctatacataaaaaagcaagggcagagttcagcccaatacagaatgcaagtggatacagaaatcaacttttcagactcagtaggatttttttctgacttggggagataaatgaatatagaattccagacttgcctaaactgttaacaaaattattacagagatgcaaaaaaaaattattctttaacttatactatggcacataagctaaattcaagataactacatactgaaatcacttcttgaaactatttagtaattttcaatttcctgaactctgtaactatttggcaacaaatctgttgactaagcagtatcccctaccagaagaaatattggccctaattcacaaaatactacttctataatttaatgatagaactgcaattcagtgcttggaaaagaccaagctatcagcccctaattatatataagggatttaggaatacagccaaccatgaaaactcccagcaagactgtgtcccaaaggaacatccttgaaaacaaattctaggattgctttgggcagaatagattaagaactacagtacggaaagcttattgagtcaatgacagaaaaaaaaaaaaatctgcaaagagaaagacatattccgtgttaaacatttgaataagttcatcttgaactctttagggttcaaggttttgtggtgtattatcagtgatttgagtcaatggaaattcttaatagttggcctttttgcttgattaaaaatgacaatctgattgctgatggactttctccagctattaagtgaagtaccaaataaatagatattgcaactttgggggaattatagagatctgaatttcctttactttgctcaattttattacttttcatctactacctaaaatgcagattttttcatcagtttaaaatagagtatgctatttgaataatgtaatcatatgctagcttgcctaaaggattaaattatggaaattcactcccaatctcaaaatagttattgatgatctaactacttgtaatgaattaggcttatgactgctttatgacagttggaatgagagccattctttcaggatcccaggcagggtcaattttagcagagaccttaaagaatgaaaaggaattattaaaaaaaaaaatctacattgctatcagaaaaatggttaataggatgttttgagcctgtttaaacttcctccaagattcataaatattcattgaatcaattagttatttgaagcttaatgttttgctgctgaatgaaaataattatctgctaaggtgggtgtcctgtctggagcctgcatttatttttaaatgtgtcgaggaaattaatggggattatcagcttgatctttctctatgtagaggcattatttagctgaattaactttctctgaccccccaaaaccaagagatctcaatgagatatatgctgtttccttattcccaaatcatagatcttaagaagcagttatttcttaaaagtaaattttaagaaatgccaagtaaatccccctcatttataaatacataagtaacccctcagttatccagaatctggacttctaaaacttccagtttccctgaacttgatcgagaagtaatcctgcaccataatctacctccctcaattatagtagtctttcgagtcaaaaagaaactccggagcatctggaaaggtcagcgttaaggaggaggagaggccaactggaaagaaatgcttgcagttagttgcacagctgtcttcacaggaagaggagggaaaggagagcccccacctaccagccctgtccatgaaagatacaaaggcaagtagcatgggagaagttacaagagacaagaacagaaccaagggaatggcagacaagcagcagttctataggctggtggtgtctgggatgaaatggctgtctcagggcagacgggacagttgtatacaaggagacctggaggcaagaaccatttaggctgcagtgggacccttgccttctaatgtctccaaacagtagccctttaaatattgcaacttgtaaaggtttaattttctgtgttgaggggaagggaagaataattgcttgccaacattagtgggccaagacgtgtcagatgctgctttcagcttggggtcggggggttggaagtcggagacagcaataggtggaagtgggagattcttctatttgagaggggagagaagtgtacatacattttagaaagctttccatcacaaaagggttaaattttggcacttacagggttagccctcatttctgttatgtgaagtgaactgtataattcactgtctctctccctggttgagacttgtgctttacaacacaattattatactgcctatgtcattaacaaaggtcttgtggaaactgtcactaaataatgtatgtaaccaaaacaatataatgattgtggtctggatatcattgtcggaagggcacgctccttactttgggggctgagtcttgtttttgtttctagttcagcctttcctaacccaggtagcttgcatatattaggcattaggtaaatgcttgccaaaatgaaaagaggtcaaggtcagcgtcatactcagcgtgaatatggatacagcccagggccagtttagtaaggaggacaggaagagaggtaacttttgcctttgggaggcaacatccactccccaacacactgaaagtgcgaattacccagttacccagttaccgcagaccaagtatagacaggacaaaaactcatacaactataccagccacaaagaaccacagcaccaaagaggaaccacaaacaaatgtttatatcgtgcgcaatctcttcatactttatgctttcttgaaataaagaaaactgaggcacaaaaaagagtaacaaattgtatttgcacacagcatcctatctaccatttattaactgcaaacgcccttgtgaccacctccacggcttcagcatcgtccagagagctacatctaaatctccttattctccttttttttttcttctgcacaaatcaataaagccttttctgtcagccccaggtaaattccaattccaagcaacttgggcaaggaaacaaacaagtgaaaaaaaaaatcacattggctttaagatgctaaatttaagacatgcagttggagctgacagctgacaggttatcaaccagaaatcattctctgatcacttattcaacaactccaaaagaattgcagccacatgaggcttgtaacgaagagggctgtatttccaaggaggataacagaagggcacatgtggaatgtggataatttccagaagatactgagagacagtgctggtttctgacttcttattctagggcaatgccttttgatgtcctgattcaatgccgttgtaagcctgaactaatctgatgtaataaaagcttaattgtctacttgcaattatcatttccctttaatctggtgatctgtttttatttgacatagattgctgttctttagagtgggatacactttgtgtaatgtgtattgtgaaatggtgttcatattttgggtaccattataaactgtaagtcacgcctgataatctcatgtctgaatactgaagtgagtgtacctccataggctactgcaagagagtactaggggctagacaagactacacatcaggactcggggcaggcaggaccaggcaagggtggctgatggcatctgcaagactgcagcactggaggaggggaatggctgctgccagggcttgtactgcggaaagaaacctgtttctccttaatgatggtgttgtccaggcaggggcaggtcagagtctctctcattctaaaaatgcccactgggcagcattttggatcccaaagaactggtaagtgtggggactgctgagtactaggcaatagtttgcaaacttttacattatcactgactttattctactctcacctttgaatttaaaccaatttttaagtatgcaaaagaagacagtttaaaaaaatttccatgcaaattaacatcacattcttaaacagatgaaatattaaaactcatacaagtatttttaatgaaataatttttatttgctgtgattatacatattgacatttgcacactttttaaaactttttatttggaaaaaatttaaattttatagataagttgcaaatataaaaagagtgtaaagaatacccatacacccttttcccagaaagacttattgttagcatttcacacaattggctttttggtttatttctttccccacccacctcaccccatggttctctctctccatacatgttacatacacataattatatacttaatttttttcttaataaattgaaggtgtcacatacatgatggccctttacgccaaacatcagtgcatatttcctaagaatgtagatattctcttacttagccccagtagttatatatatatatatataacatatatatgttatatatatatataacatatatatataactactatataacatatatatatatatatatgtatgttaattttactttaagttctggggtacatgtgcagaacgtgcaggtttgttgcatagctatacgtgtgccatgatggtttgctccacctattaacccatcaactaagttccctcccctggccccccaccccccaacaggcactggtgtgttgttcccctccctgtgtccatgtgttctcattgttcaactcccacttatgagtgagaacatcatattttgggtaccattataaactgtaagtcacgcctgataatctcatgtctgaatacccaaatatgtgatgtttggttttctgttcctgtgttagcttgctgaggatgatggcttccagcttctccatgttcctgcaaaggacatgatctcattcctttttatggctgcacagtattccatggtgtatatttgcaacattttctttatccagtttatcattgatgggcatttgggttggctccatgtctttgctattgtaaatagtcctgcaataaacatatgtgtgcatgtgtctttatagtagagtgatttgtaatcctttgggtatatacccagtaatgggattgctgggtcagatggtatttctgattctagatccttgaggaatcaccacactgtcttcagcaatggttgaactaatttacactcccaccaacagtgtaaaagtgttcctgtttctccaccacctcaccagcatctattgtttcttgactttttaataatcgccattctgactggcatgaaatggtatctcattgtggttttgatttgcatttctccaacttcaatatatttaacattgatagaatacttttttcttatctacctttcatacatcagtattgtcatttgatccagtaatgttctttatagcattttcctctgtggtacaggatccagtctgtcatcaggtatagcatttaagtgccatgtctctttacccactttcaatagggaatacttctacaacctttctttttattttctgacattgacttttttttctgacattgacattttggaagaatggattactgccacacccgcccccaacttttttttaatgaaacatttcccgtttggggttttttagatagcctttcgtgatcactttcaagttatgcattcttctttggaatgttgcataggagatgttgtgtccttctcaggctatcacatctgaaagcacatcacgtccatctgtccttcattggtgatgttaactttaatcagccatacaagtgttttctgatttccctactaggtaattattgtataatttttttcccctgcaactaataaatagtctgaaagagacagtttaaaacatgctagtatctagtttctcatcaagatttccctctagatttagcatccattgatgaatcttgcctgatctgatctttaataaaacagttgcaatattatgatgttccagtgtcagcactctcttcacatctgccatcagctctcagaattctacttcaagcaaaagctcccctacttatttgtttttgttgttgttgttgttttgttttgttttgttttgtttttgagacggagtctcgctctgtcgcccaggctggagtgcagtggtgcgatctcagctcactgcaagctccacctcccgggttcacgccattctcctgcctcagcctcccaagtagctgggactacaggtgcccaccaccacgcccggctaattttttgtattttttttagtagagatggggtttcactgtgttagtcaggatggtcttgatctcctgaccttgtgatccgcctgcctcagcctcccgaagtgctgggattacagacgtgagccacggtgcccggcctttatttgtttattattgatatagacctataaattttttccaatagtttataattggaaataaaattttaattaaatggtttatttactcatttatttagtgaatatttattgaatacttacaatatgccacatactctattctggtgatacaactgtgggcaaaacagatgtaacctgtttttcctcatatatatagacatattgtttatgtgttatgtacagagatttgaggactagagtctaaaagaatattttttaatacgcatgttaaacccttaattcatttcttcaatagatctgtcaaacactggtgtgttgagaaccgttctggaaactgagagcacaaacagggtccctatccttagggaatttgcaatcaaatggggaagataataaagaaataaatacactatcagaagaattgcaggttttgaaaggtgttttaaaaggaaaaaagtaaacataaacaccagagctaagataaaggatgacgaccaaagtaacatagaggccagtgattactaaagtaaaatgaaatctggaaggatcacttcatcgtgatctctcatgaatgtttgagtggtgcttcactgggtaaatgttccttggacttttttttttttggatacttttccatggtccttgaccagttggtttccagcagcctcataactaggcacatgtctgctgttgccacctgcatggatccagcctttagatttgacatttccaaaccagtgaccacctatcagtaacttctgcaccaggatacaaatgataacatagccaaatcaaaccgctttatactaaatattacctccctccaacattcaacaaatatttcataaaaatgcactgtgtcccaggacactggaatacctgtcattggaatgtacatttcagtgaaggatacaaacaagtaattaggcaagatactgtagtcagtgtaatcacagtggttagtacagggtcctgagggagattatagaaggagtttctaacccagatgtggtggggttggggcaagtggacagaaagcctttctggagttgcagctgatacttaaagagaaatgtaagttagccagagaccccaagctgttccctgcatccaggtgcatgcaataggtgcaacgtcacaaggaagttaggcacatatacctggatcccctagttcaccactgtctgcctccccagtgtctggcacataatttacactcagtgaatattttggaacaagtgagtaggtacatgccaaagagacattttgtcctcggaagagaagataaccatgataaaatttaatatcaaattctttataacatgtaatgtatgagattatttctgtcctatcaagtttgcattcatactgtagctttaattacatattagaaaggaggatggagtggttttcgaatctgctagtattaaaacatttttgctgatgcctttaactagatgagttgtaaagcacattatttatacctggaagaactggcttctcttacccatttaatttttccaattaactgaaagccaggttgacttggctttggttcactctgtggtcaaaatttagcatcatgggtattgattaattagtgatgagtcatttggcctataagagcataaactacctgatggcaaatttacaggacgaaaattaggccacagagtaagtgttgttcttcgttactaaaaatgaaactaaaaatgtcactgccgaagtggaactaacaggagcaacagagagaatcaagccaagtgttctttccttcctctcctgtctccctgacctagataagaaaccttacccaatcctaactcctagttccgtccacccttatttgagaccctcccactaagggaccattgccattcactagatcatgatgggtatgacccagtgaatggcaacataatgcataggataaatgtgcaatggattttttttttgtccatcagatttgggtgtttgtttgtatgaaaaatttagcctcttacttgttgtctaccatgaccatatagaaaagtcatgaaagttttggaatatgagctcccggatggaatgtgagaatatgagttctgaagttagatgcctgcattcatttcccaacaccactacttaatgatttggatgcatcagattcttcactgtaaaatgggaagtttaaaagtgcctacaccataggattgttgtgagaattaagcaagcccatctatgtaaaggacttagcatggcggctcactgtaagcctcatttaggcatcatgatgctcaaaaaagggatcaccaaaacacttaactgaatatcaccccaaaatcaagtgccaattcatgtaagcagttggtattaaacaactagtctgttctttcttcttgtctgatgtttaggacctagaatatcttatatgatcagctaatgtactctgataaaaatgaaaaatactgattattgagaaagtgtttttgagagcccatgatggtcagatctctgtgctaaatgctatggtgcacttgaaaacaacttcatttctgcctccaaggaacttacagtctagttaatggagacatgtcaggaacacgtgtgtctaaaaacatcagtcatcagtacaggaggtcaaatgattagcactgtaggcagtggagtctatttgctgatggcaagacttccagttaaatagataacgagcatcacttaaacattttaatttcccaaaggaagacaatatttgtgcattttaaatgcagtttatagaacatgagttatatatgatcacattccttctctctctctctctctccctctctctctctctcacacacacacacacacacacacacagcacaaaccatttagaagaccatataccacattgtttactgtggatatctctgacaaaagcattggaactgcaaatggaaggctacttttcacattttattcttcagtcttttgtattgattgaatttttttacaattaaatcagaaaaaacaatggaattatttattttagtaaaatatattgaagataattccctgagaaagctaaattcatcttctattaatgactttttacctgatagttatataatgtgttctttctttacaaataaaaattatacaattaataaaagtaagcatttgctatcccacaaatattttttaaatttaatttgggggtaacaaacattttaaatacattatgttactggttctgaaaaatctaggtcaacttctaggatcttgtttgatgtaagaatttgaactgtttccaaggtaaccaatcatatctctagaaagcttagctaagcttgtatctcttcattttgaatgctcagctctttttatgtcctcctggaaaccctgaactttgacatacacacacatacccacacacatgtacacactcactccagactttgcttgccttccatcagggacacaaggtacaacaaaaccaaataaatgctcattgatttttaagttgtttaatgcagctgtttcattatcttttctgtctttatatactgtaagtgatgacagtcaaatgttgtgtgactattcataaaagaaagcatattaattttgtatgaattcccaggtacctgctcttcaatttatgatcattcttttctctttattttatttttctctagcatagatatgaagcccaagaatatgtcaataatgtttagtaaaataatattaaattttttcacttaatttgctagtatggcattgactaatagaaacatcatctgagccacatatgttatttttggttccctagcagccacttttagaagcaaaaaaaaaaaaaataggtaaaattaaatgtattttatttaactcagtttatctaaaaagctatcatttcaacatataatcaatataaaaattaatgagctacttttttgtactaagtcttcaatatctggtgtgtactttatatgtgcagcacattgcaatttggacaaatcatggtgcaaacccttaggagccatgagtggctgaaggtgaccatattggacagtgaagatctagacaatggttgttacttcctgttagtatcatctcgtcagtgggatatttaaagacgtagtgtattattttgcaggattttcttttcttcctgaaatttaattaataacatattaaattgggcctggtgctgtggctcacacctgtaatcccagcattctgggaggccgaggcaagtggatcacctgaggtcaggagttcaaaactagcctggccaacatggagaaaccccatctctactaaaaatacaaaaattagctgggcgtcgtggctggtgcctgtaatcccagctacttgggaagctgaggcagaagaatcctttgaacctgggaggcagaggttacagtgagctgacagcgccattgccctccagcctgggcgacaagagtgaaactccgtctcaaaaatataaataaataacttattaaattgacttgcttaattgaaaatattttattttcacttttcataggtgtccatttatcctttttacagagttttcctactaataactagccatctgaggaaactacaatatgttttttactcaatatttcctaaaagataattttcggaaaaaggtaaaatcatgactctcatacaaatataaaatgaatatatgttacagaattttctttactcgtgatatgagagaactaggtagctgttataaccggttcaaaagaaaagtcaaaacagtataaatttacatggagtagagcaatgttgagatgaattccaaatgggaacaaaacttttttctacaagagggaaaaagtaaattaaattacaaccaggtaaggcagaacttacagagctaccagttacctacaacttacaatgaattacaaaatagctcaaaaacagtgagtagagctagaatcctataatccaaaagggtatactatatatgatgcatggttttccattggaacacaaaatattttgtacataatctgataatcaatttagagccatataagcatctagtttaagctttgtcccagaattttagagtaatcatgggcaggtcagagagattatgcttcatgtctgctgataaaccaaggagtggtattacatgttctctaagcttctttccagtaatatgactttttaaaaggaagatctccaaaaatgctttttatctgaacacttttccccatggatatacagagagtaagcagagaaggtcccattcagaaatcagtctccctacactgagtgagtagatctggttcttctgaggcagtctcctcacctgctgatgatgtcatcaaatgcacattataaaagtttgcatgttgtcaaaaggaaacaggatgaccaagttctcacacatcctagtgcttaccactctttccactcccagaaaagaagcagttcccccttccctggtttgcaagatagatatataataaaatttgccttccccacaacttagaaaagaaaagcatggtgatttagagtaagaaagttatttactttcactctagcaaagcagaaaaggtaatagagtgatatggatattataacacagagagaatggctgatggcatcataataggatgcactggactattgagaaattccttgcaggagagggtgatatatagaagggcaatggattagaagtcaggatctcagggtctgcacccacttctgggaagcctttcaacttgtcctaaatgaaggttatcatgttcttctcattgaataaggtttacttttaattattttctttaaaaaatagaagaaaaacattcaggtagcataaaacaagcctaatttggtatcatatatcaaattttgatatctttttgtggaactcaacacacgaatctgtgctgtaaggatgcagaagtacagtatcaaacttcagagagggggacaatttcagttactcttttatcctgaggtctacatgcgtcacctttgtgtaaatttaaaaagactaacctgagcatgtttcttaatctagcctccattccttgtgcccacggctatggcctttaaatcctaatgcatgacgatgtactcagctgggccaagacatttagaaagcagtatgaacagtgctttgttctagaggcaaggaacccacatgatcacttgtgcaattcccagtcctctgtttgggaggtaactactggaagccacctgaggactttctttcttcagaatgagtggttctgactcactgagagacacttcactgccagtccacaagccattttcaattaagcaaataatgtagtatccagaatactctctaacatttaatgttgaagattcacttagactaggaaaatcttcagttaaaaggcagaaacttctcactttaaatgagcataaaatttagtttgtcaattttgatagcactcactataaaatagcagttctattggactgctctcttggttaaaaaaaaatctgccgataataacttggcacatttgagctatttttgcttccacacctgaggcgagtagcttatatctgaagccatcaatttgtatactttcacgaagaactgaactattttcatgaactggttacatcaatgatctttattctcataataccacctcctgttatctattatgatctttcttataacagaaggaaacattaaggagaatactggccttaagacttttttttgcatgcatatgatagttattattttcaggcacttgcttttttaaaagactgatgtatttgtgaaatatatcttaatattctattgtctttcttcaaaactgtcaagaaaatcaactagaaagcaggaaacttcttacaaaaaattaaaaatagaaacagaatcagatcgaacaactgaggatcatgcattgcttgggaaaagtaaggttaataattaatatacccctaactttctagccagcacctcctgctcccaaggtgaggacaggcccagagtcccattgtgcctttggtagtctaaatcaattaaaaattgagctatgactggcccagttttttccattttcacctccctcagcttacattttcttttgacttgctttatgacagataagagaagaaacagtcatgtaatgagtccttaccacaagacttatctttcttttctctatttaattctgttgcctatttatgaaaataaaactcgctcattttagaaatgtaacaaacgcatcatgtgtaaagaggaaagtccaaatactcctaatctaaccaccatcaatatttgctgtgcaaccttccactcctctttttataagtaaatatataatcacatgtgaatggaatcatattaagcatattgttttgtaaccttatattgttatgaaagttatatcatggaaatgtttccatgtcaatatagtcatacatcatccttttaatggacataaaatattccactgtgtggatgcatcatccatcatttatctaatccgtcacattgatatatgatatcaagacataatatggtgatatggtttggatttgtgtccccgcccaaatttcatgtcaaattataatccccagagttacaggaggggcctggtgggaggtgattggatcatgggggcagatttcctcttgctgttctcatgagagcgagtgagttctcgtgagatctggttgtttaaaagtgtgtagcacctccccctgcccactcttcttcctcctgctccggccacgtaagatgtgcctccttccttttcaccttctgccataattatgcatttcctccgcatgatgctccccagccatgcttgctgtatggcttgtggaactgtgagtcaattaaacctctttacaaattacccagtttcaggtaattcttttttttttttttttgagatgtagtctcgctctgtcacccaggctggagtgcagtggcacgatctcacctcactgcaacctccacctcccagctttaagcaattctctgcctcagcctccagagtagctgggattacaggcgtgtgccaccacattcagctaattttttgtatttttagtagagatggggtttcaccatcttggccaagctgttcttgaactcctgacctcgtgatccacccacctcggccccccaaagtgctgggattacaggcatgagccaccgcacctagccgagtagttctttgtagcaatgtgagaacagattaatacatacggaaataaagtccagaaataaggctgtatgtccacgacagaagttcagagacaaagctgcctcgtagcacctgaaatttcttgaaatttgagaaagaataattaagccctttcaagtcagcaaatggccaaatgaggaggtgaaatcaccagaggtcctggtgtttctagaagatggggtgtattgccaccatgactatgttagtgaagctcaggtgtgaccagaggtcgctggtggggttcagagtctggtaggtagatagagctcagctaaaggtttaatcggagccttcgttagataaaggcatggtgcaggggcacaaaggcacaagaaatacctgttagggtttagagagtaacacaggctagcatgtagaatctgatataccaaagccaccccagccaggagacatctggcagaagctgattccaaacatacaggtgaggagtctaagtaccacgaagttagaggaaagaagtgagaaatagacttcaagagactgagaacagcatctctgaatctaaagcacaagtgtatacccacatagtcatatagccagcgggggggactcagacaggggctgtcaaacctctgccgtgaaaatcatcaccctgtggacagatcagtgccagtacatgtggtctggcacccagggaaagcaaaattctgctggtgctgttaatttcagacaaaaactgagttatctgtggagtcttcacagtttctacaacaggccaacactttgtaaagagggtaagcagttttctagtgagttgaagtgatgcaggcagccaaacctcagaaatttggccaaagtaattcacttgataattctcagctctgaaaggtgggctgaaaacaggcactctagttttcttccattatgcatttctggcagccacccagccaccagattcttagctttattctacacactcatttcattcattcattctttgaataaatatttattgagcacctgctctgtgtcagatactctgctgtgtactgcagagggttaaataaatcacagtccttgctgaattcaaaaagaagagaaataatactgtaccataaatgcaagaaaaagaggctgcagaggtatttggggtaaaagataaacatttcctctttttttggcaaagattcacctcattttacaaatcagttgaagacttggtgaggagagataagcattcttctgatattgctactagcattcgttaggtactcagtggattggaagcactaagctagacaacggtcatattcatattcaccaaatatttactaatcacctactattatgtcacgcattgttctaggctcaggggataaaatagagaacacgagagacatggaggcttatagcctactagtaggaaaagagaataggcaagaaaaatatgggtgataagagctatgcagaaaattaaaatgataatgatgtgatagagtgtccaagaggcagctgtagattaagtggtcatgatggcctctctgacatctaaactgaactctaaagggtgagaaaaagccagcccctgacacagtggagtccagctcacatttgtataagacttccaaggctaggccatatgtagtgaacctccagaacagcaagaagaggaatggggctggagtagaagggtggaagaagacaggtcagagtggaaggcagagacctgtcttgaacatgctgactttgaaatgcctacaggatcatgcagcaccaagctagagaatgggcagggagcatcctcaatcacctaggtgctcaaaacaaaagaagtgactcttgatcccagcactgctttcccccatagcaatcacaatggcaccactgagaaaagttaaaatcctgctttgaagcttattttataaatttctttgccatatttcttatgtagttgagtggatcagttaatcactcatttaacaaatattgttgagtgcctaatacgtaccagccacaaacaggtgtagctgggaggcagacaacaaataagaagggtacaaacaacagataaaatatgcagtatcagatggtgatatgtgctttgaagaaaataaggctgaataaaggagtacagcccaaggactattttagatcagggatctgggaagtgacacttgagcagagacctgaatgatgagaaggagggtgccatatgaaagaggggatcatatgaagattatgggagatgggaggagcatctcaggtgaagggaacagcaagaactgccccagaagcttgctgagtccaagcagcagcaaaaaggccagagtggctggaacacagtaagtaagggtgtaaatgtcagaggtaaccagggctagatcatggggtccctttgagccacggctattctgtgtgtgatgggaagctcaaggagtgtcatattttaatacttgcatttcaataaattcactcccactgctatgtggagattagatggggaatctaagaaagaaaagctggaaaccaactaagaggctgcgacttgaacctacacaagatgtggtgatggtagctggcccaaagcagcagccttggaagaagggagaagtggtcagaatcaggctacatattgaaagtaaactgggcagggtttgatgacaggggagaccaagaagaaccgaggatggccgttagttttgggccctgagcttctcggtagatgatggcagcagtaactgagggaggagcagctttggatggcaggaagagtccaggggtgaaggtagagatagcagtgtgcagggtatatcctggacagctcacatttgaaatttccattggatgtccaagcagatatttgagttggcagttagatatttgagtatgtagttcaggaaagagagagagttaaagataggatgcaaggagtcattggcattaaagtattaaagtatgtgtacattggtgcttccttcttagcatagacttgggtaatggggcagtgtgcactgaacatgtgtttgttctttccttatgttatgtccttctctgggacagtagatgatactgggaacgttacatctgcttgaaaaaataaagagaatcctgacaaccatatctttaacaaaagaatagaagcactgacagagtttgacttgatctgaggaaagttctgaaattctgacagtcttttagtgtataattttattagatttggacttttcatgtctttctgattttatgaacctgctattcaactgcatcctcatatataactgctaccaggaggtgaaatagtttatgcatgtttctttaagagaaatgtaatcatctgcaagattcttcaagatataaatttacatttaatattctacaccagggaatattggcaatatacagtattttgatcagattctttctgataaaatatgaagctctgaagagtgttactgaaaaacagtaactaagtcacatgcgaaaacgttcctaaaccttaaaatcacattccatgggaataaatctagttgcatctggtttagaaaagtgtagtccagacaatggtgctgcaatccattccatcatgatcattgtaattatctttgctgggttgtttctatgtaatttaattattcacttcaatacagaatagtattattaaagaataaggagggtaattattaatatgttctgccccagggtgagagtaggatgcttaattaatgaaccaccctctttcttactttatgaatggctcagtgatgttgcagtacagcaggttgttaggtattctctcctgctaatgggttatccacatcattttctcaactagagtagaaaaggagttactatctataacccagaaatgatattggcagagaaactgaataatcactgaaacagcttgaaatagtgttcattctggacgactgacaaaatgcaacggggaaatatggtttttcaggcttgatgcaagcctgagtccagttcgggttttccttgagatggcctacctcttcccctcagatgcttcttatctttgagagtttctaaaagataaacttccaagaacctgttataagaaaatgtctctaatgtctagcatcttgttatagtttggtctaatttttcccctctatgtttcttatttttgagagtttctaaaatataaacttccctgaacttgttataagaaaatatgtttaataaatggcatcttgttatactttgccttctttaaaaaccttgggatctctttaaacctaaaacaggaagtgaaatttgaagggctaacatgaattttaccaaacaacacagtctgggccaataattaatattaattatcataattagtcataatcttttttactttacatgtgttattttataccttcttatttacataaaattcacaggaaacaggacaaaactcaataggaagagattggattctgaaacacacactcatatatactcacacacgtaaaaacatgtacattacagaatacttaataaatttacacttttgaattaaataagaatggtttaaaaatatttaaagaatacttcaagtgtttcagaaaagactaagaatgcttcactatatttgtaatttggcccatagagcaataaatgtttccctattatatctgaacatatagaggccaaacgcccaactttagcatcaccagctcctgctctaccaagatcaattagacaatgaacaaatgtctttagaagtaggaaaaccatgagtaagctacctaaaattttacttagcaattgcttgttggagaagggacaatgctagataccagatgaataattatgatgaagaatatgaataaataatttatataaatatgggtatacatatgtaagaagtcctgctttaaaagagattctgttttgtcaaggaataagtatttagctaaatactagtaatttaaatgagattaaaaaaacctctttaaactcttagttaacataaagaatccatcaaaatcatgggcttattgtactttaatgcatgaaaggaaaaatggaaaattcaagaagcttgttttctaggttgcttaaaaaactcacatatatttataaattttgtattatttagcaacaaattaataggcaagagaagcaattagacatttaaagtttcagaagttaaaagttaaaatttttaggacatagcaataattttcagagtctaggtattgtcaataacttttttgtaacagttgcaaggacaagttttaaagtagcagaaatcagaaaagaatggttatagttacacaagtctccagagttaagatctagactgttgtgaatgtctcaagttcaaaatttttctttacaaaataaaatctgaatatctgtttttgcagaagtgaaaacatctttttttttctttcttttttctttttctttttctttttttttttttgagattctttttcctggcagaggttaatggcaaagtccacctctcaaggctaagcactacaatctcatttgttagcaccaagagataagagaaggcttggtaaactcaaagtgtataaaatggaaatagaaaagagcaacgttgaaatactactgagtaaagcagaaatatgctaggtggttgcactggtaactcccaataaaagcacacctctaggtatccatacacttctatagtcctctcaagctgactctgggcttggctatatgaaatgcatgggctaatgcgacatggatgtgagcagaggcttgataagtgcagtcttgaatggcagaaccaggagaattgactgtacttggttaacaatagggaactagtgaaggtttttcagcaagggactgacaggaccaatgtagtgcttcaagactatgaacctgatgatggtattaaaataaagtcacatgggatggggtgtttggagatcctggtagggtgaacatttgtgagattattgttctttaagtgagtctctccattagaatagaagggcagaaaatcaatactggaaatagtctgtgtgttaagaaaggacttcagggaagaaagactaatgcaccacagtgatgcagcagctctctcagaccactatggacagaggtggacagccttagccaagtccctggagaatgttctccaaggttgaataaatcttttcattgtcatgagaacaaagaagacgagagagaaggctcatcgtgcttgtcttttgatttttatcttatttctgggcatcccatgaaagcacacttcaacttatttccttgaattctaaatttctaactattccagatgactgcatttcagcataataatctaaatctttgcattcttctaattttcagcattcatatgccaaaaatcttaaattgcttaaagattatatatcaggtaaggaaattataggtctattgtatagagaatcataagagtggagaagtaaaatctttttcagtaacaaagaaaaatcatgttgcattcacaggaccatgaagccaagggtgaaagtgtcaggttttaggtaggaaggaagaacaacccaaaagaagcaggcattttatgcttttcatgcatcgtctgaccaacctgacctagaagcctacatagattctcccaggagagcaatagacacacactatgtatctgggaaagtagtcataaagatttcagataaagtcctaagagggctaggccaacagtgggataagccaacctagctcagcttagtggcattttgtaaaccagtcacatgaagagataaaggcaagttataagcctagggccaggggactaaccactatagatgtggcttagaatggagtacatactgctcctacttagtattcattgttaaggcagcagagactcatacacagaaagaggtgcaaggaagaacccctattagtaaaagcatgtttctgagaacccaaataagggactgtcctaaatgaacttggaatagcattcaagtcactccccatcataggactgcaactacctgtttcagaaggaaaataagtaagaattcaccaaggagtgggccagaaatgtctaacggatagcaaagagtcagctttcaaggtgtgtttgtgtggaaagtaggtggctactccccttgaataatttgtgaggagtcagaagagctctaatgagtaaataccaacattttggttattcagagtttgtgcagcagttcacactgggtaccttgattgaggctggtactgattcaagagctctgggggaaaggaggcacagctgtcaatcagtggcattcctcaaaatcaagtgaacagcatcaagatgaagacgcagtgaaccattaggtttaggggctgatcagttgatcccatcactccctagtccccctacaacatcctcttctagcaattcccaggaccaatttattccaaccatctgctttttttctgcttctgctcccaagttgcaaatgctgctggagaaaatcggatacctctgccagctggcaccaggacaacctcagctgggctctccatgctgctcagcagtcttttcacgtgtcctaactaccttccattaacagtgcccagagcagctgttccaaactctacactcttcacatgcttcctggagctctcctccctttgcattctcagctactggccttgctctgacatcactgagaaaatagagggcatcaactctgtacccctactccctagtgtagcacctgagacatagtatgttgaaatggatcaatgaatgaataaattaattcactcatgaatgtaactggtaagcaccagtttctctttctctcttacctggtatcagatctatccttgcttcctgtacacatacctgggagggagggagaattctctgcctttccaaggccagtgcttccacctaagctcttgattctattaatatctgctcccctctcctctgggatcatttatataccctttcttctgtacctctctttccatcttctaccttttagcccacaaacatgcttaagtctctgtctctgtctcctacaactagtatgtcctgagcaacttttatgtgccaggcactgtttctagcactacagagatattagtggggaaaaacatatagaacatctgccctttaatggaggtgggtggatgcagataataaggtaatgagggatacaaataaatgaatttaaaatagatgtttataaatttcttagaaaaaatacaaacagggaatgggggcagagtctactagggagggagagggagtagggatgctactttaaataaagcagctagatataggtgacattcaagccatgatatgaaggaggtaaagaagccaagtgaagactctgcattcaaagcagaggaaacagccatgtgaacgtcctgtgtcagggcagagtgtccttagcacaaatcaagaagcaaaggagactgtgtggcaggagctgagcgagaggtggaactttagtaggatacaggtcaggggaccagatcttgagggccttgtgaagcatcgtgactaaggactttggcttttgctctggggaaaatgggaagctggtgggaaggttttgagtagaggagtggcatggtccaatatatttaagaggatccctccagcttctgtgttatgaattgagtagagtggggtggaggaagaagtgggaaccctggttaggaagtgattgcaatcatctgagagagaagtgctgtgcacgattgcatcctcatttgccaccacatttgtcaaaaggactgtttcactcatcgcctccatactttctgtcctcatctagtcccatctggttcatgcccccagtgctcttctgaaaatactcttggctgagatcacaaatgacctaagtaccaaatgtcaaacccaggggcttctcttcagtatctgaggctcctttataaaacctcagggccaaagcaagcccaactgtgtcttgacctataaaagtaacaccacgtaagaagatcccacctggcaggtttaatgaaatcatgacagccacagagacttgaatttccctttctaatttccttcaagcagggtttgcagactgaaatctgacaaaggctgacaggtaatgggcgtgagtgaaggtggatggaaatgggatgacccctctaaggtggtaaatgcttctcacttacacatgatacgtaccaggtgaaaaagtggctcagggtagccaggctttggaatttttcaaaagaatcctgaaatctgaagttttagtgaagtttctccatttgtaaaaattgataactaaatttttttttaaaatacctatagaccaaatagaacctgtctgtgagtcatataaaactgcagaccaccagttttcaaatcctcacagaggaattgctaagtgcagtggtgaagcctccgggcttcggtctggtgctctgtaaatgctgtggatatgctgatggtaagtgttactcatcatttccccaattctcagccttacactcctgcaggcaactctaggttttgacattctattgctcacattttctttttgagttcctgttgcctgtcccacaaacttgcattttcaatcacatactgaccttttggcccatcactccctggctgtgaatctaccacacttttcttctgctcactccacctctcaccagacataccagattccttcctggttctctctgcaggaactcactctctcagccactgtttaggtcatttctagtttcctggagcagataggtccagattcaaatccctgctgacttgcttaatagacattctaagcttaaggatgtcatacaacttcctcatgcctcaattttctagatcataaattggatttttcctccacccacctttccctccccgctacccccacataccactcttttccaaactcttttgatgaaacttcttctttctacaccttaaatattggtgtttcccccagagttctgcctttatgttctcatctgagcctatgcatcaagggtggttcttttacttttttaacttcaaataatatctccattccgaggtcttacaacaaagctagtcttagcctgtttgttaagcttcaaactcctttttctaatgatctcttgaccacctgggtgcccctgttttacctcaaattcaacatagataaaactaagcctattattttcttcttaatcttccatcttatttataccactccccttttttctctgcgatattgctcacagtagtaacccgcgctgcttaaacagataaaccacaaatcttaatggcttagcacaataaaacctgactgcttgctcccactccactggatatcacagtccattgcagtcccacaggggttggggaggttccgctctatacacattttagggtcaaattccttccatcctgtgatgtggccattgtcaataccttacccggaagtttagtgcagatggggaagagagaatgaatagggccagaagcagtatgtatataacttctgcccacattctattgagcaaaactcagatacataatcccaactaattgcaaaagtttgggaaatcaagtttagctctatgttcagaaagaaaagaagaaataagaatattggacactactaggattctcagctatgctactgagtcttccaaaatagaaacctgaggataacctcaactttaggtttgggtcttagtagttctacctcagaaaagttcagcatattctctttgcaatccctatccttgtcacttctcactggcacttttgacacagctttcctctcttcactggattcctactgcttgcatccaggagaaagtccaagtttgcccaagccagctctggccttttcagttctctccttcaatccctcctgcaactcactgtatgctatgcaccaaacttccttctttcttcaaacaatttgcttccaagctctgtgtgtatgccagggtgttctgtgttctagaacgcctagtcctgccttggtcacttcaaaaaccttctttgagcatcaagatccacctcaaatattactttttttaagaagctttaccaaatcccttaggattaatgtccatagcagttcatatagcactataacatcttggcacatttagttatagataattttatatgtctatatctcccataagactgggaatttcttgaaaggaaagaccatgtttttttttttttttttgtactttaagttatagggtacatgtgcacaacgtgcaggtttgttacatatgtatacatgagccatgttggtgtgctgtacccattaactcgttatttacattaggtatatctccgaatgctatccttctcccctccccccaccccatgacaagccctggtgtgtgatgttccccttcctgtgtccaaggttctcattgttcaattcccacctctaagtgagaacatgtggtgtttggttttttgtccttgcgatagttttctgagaatgatgatttccagcttcatccatgtccctgcaaaggacatgaactcatccctttttatggctgcatagtattccaaagaacatgttttgtatacagttctactgaccagatttgtaatccctgagtcctgttcaaagcttgtacattgtgggtgctcatttgatgtttgatgaatacatgtatcactataatggaaattagaacactatatttttatttttggaaaaaaacttaacccatcatttttctgtacttcagagttttatcatttgtcctataggagtttttagctctaaatatcattggatttaggaggaaacattatcaaaagcagcactcttcattagccaagttagcagatttttctctgaagattatatagaatcttacaataaatcctcagctacatttcaacaagaggcagggttttctaggattttaacctcttggtctaatcagttttacaaattgtcaatcttaaaatcctttagagcctcctaaaagagaggaaccattttgttggttatctgggagctggttgtttcttccacttcatcttatgtagagtcatgcccatgcccaataagaaagggaacaaaggcagggaaaagctgtgaatctcaactaatccagtgctgcatgagttgaaacagtggataaaggatagaatgggttctggcactgcctagtaatttcagacttccttgcttttcttgtcctacttatcatgaagcattaggaatgagcccatcattgaattagatatgccaagaacactattttgcttaccagcttctctacctctcatacccaaatggagtgtgaaggtagtgaattaaaattatttatgccatggcctcatctatcatgcctatgtaaatgagtcccacatatatgtcttaagtttagactcctcttccatgtgcactgtatctgactgactcttgccatttccactcagatgacccacaagaatctctaattcagcatgtcaaaaactgaatcaccttcacttctaagcctactgcaacttctctctttccttgctcaattaataatagcgtcattctccaagtgggacaggattaaaaacacaaagtcatctttgacagcttatatatcccatcaacaatcacttagtaagccacgttcattctgtctctgctaactcacttatggtaagattcatgttactctttttagagaaacctcttcaactaccggcagcccagagctgaacactcataatgtcagcctcaaaaaggagagtccagtctagtgccaacaagacagaatcacagcaacaaactgatcccatccaagttctcactctggcttttcacccctgactgtcttaactgtcagctctaagtatctgtaacaactccaaaaaaggaacttgtagacttttcaagaatgaactcattatagatggttggaaatatatacatatataatttatatatatataaaatatgatttatatatatatatgattttatgtatatatatatgatttttttcaggcagtggctcactctgttgcccaggcaggagtgcagtggcacagtcatggctcactataacttcaaactctagggctcaagggatcctcctgtcacagtcttccaagtagctaggactacaggcactcaccacaacactcagcttattttttaaaatttcgttgtagagatggggccttatcatgttgcctaggctggtcttgaactcctggcttcaggatatcctcccatcttggcctcccaaactgctaggattacagacatgaaccactcttcccagcctttacgatataagattttaaagggatattagaggagccagaactgaacactggtagatggtctttgtgtactgggctatccagcttcctaattatacaatgtgtttgggagaattgaagggttataaaacatttgggaaacactaaaaaaggtacttagccacatttcttgagatatatagtgccagcaagcaatgtggacaaaaacttgagcctaatccacagttagggtcaaatatctaaagaggctcacctgggagcattttgcacagaggaagggagatgctgtggaaaaatggaaaggactgtgttagttggcccaaaagcttcgggcacagggaccccatcttcatgatggtcatgaacatcagaaaggtatttcctactggtctaaaactgaaaagcattggagggcagaggaataaaagaggttagcagtgtcgtgggcatgctattggcagcaaattgtgggtggcacagcaacagtggtcaaatagcaaggcctgtattggtaaggcctgtagactccaaaaagatgagactgcagaagtggaagtatgagctccaattaaatgagacatcccctctcctggagggagaatgaatttttagagtgaataatttttacaaagcttctaaatttggtttcctgaaaatcaaagcattgtgcctcgcaacgctgaaagataataggagtggcccggggcttaatagtttatgtatttaagtataacaaattattaaaagcactccttggttaccaatatctcttctggttctcctttctaaagaaaaatattggtctggatccttctttctaacttacatgcagtctttgtccccaaatcatctaagtctagatatcttgtttcttactccagggaccttagtacctaagttttgtcatttgcttatgcactggctccaggtattaccttatgaactgagtgcttacaatgcattcagcaaaattcagactgtggctgtgtgatgctgccactctgtctccctagacagggtgagcctatgtctgtttcacgaccctttgtggccaacttgttgctggcataatcagtgttctggaatatcctgagatcttaggtggaggttttcaaaccctcctttgaaggaagtatggcttcttccttaatgatggggctaataaaaaatattaaatatatcatagtagtcacaatttctttctccattgtaaagaacttgtgactactatgatatatttagtattttattattaattacctatcttgtagtctgtaactatgtaccagctataatttcattcagatcctctttgcttctgtctaggattccatatgtgttttgtttttcctgaattagactctagccctatctctgaatagtaactagaactgcatcatttctcaaggcaagaagaaacccctctaaaaatgaatgaataaatgggaaatcagtcaaataaaaaaaaagttaagacctccagcaaaaatactcatagatgctcatcagtgtcccacctgactccacacagtatggccctctaggatttcatgtttgcatataacctttgggtgagagaatgatctgctgctaggtagatatgattggttaaaattaatacttgtatatgtatttccctactattactttagtttcttttattaaaacttgtaaaagtcttctaatttggcttctgtatttctgagcatttcctttcttaaccagagttcttcatctgaatatgacttaagtaactattttcttagttctcctaagcatggttcctaactacagtagcaccattctagatgcacagggaacaagttaatttattatgtaaaatatatactttgaaagcattaaggcttaattcttagttgaaaaaaaaaagtagggttgggatggaaactctatgttaatcttcttagattactcttttgttcatgtttcacatcatcagcctgcgcagaatctaccagtggctccctggtacctatacaattaggtttaaacccttagcatgtagagctccctataatctggactcaacctacactgtatctcttctctctctttatctgggccactgggcttcactctagttctccatcccaccctgaaccaaaccagaatgtactcttccaacttcctcctccctctccactaccccagtccctgactttcatctctgtatgtctcattttactcatttttcaaggtcaagcttagattttatattctacataaatttttttttgattctcccttctaccgaatctctaccacattttactttttaaaaatttttgtaatacttttcactatcttttgagtgcatatcttatcaactgctccagcctgaaagtcctctgagtaaaactgtgttttacgtgtatttgcatcctcttttaccccttatccccatgactaaaagatgtaaggtcaataaagctttggagagagaaagaatgaatgaatgaatgggaagcggaatacattggcacttgtctactggtataccacaggttcagacttcaacaggttaagcaggcgaggcttggaagagaaagcatccttgacataagtgagctttctctctctacatgcttgtgtgttacatgacatggtatgatgccttaaactcccgtcaaaaatctacatgcccccctacttcctctaagagccttaaaccaaatcttttctcttaggttgtcctccagaatttctcaccgcatgctttaacaccttgtacacagtatttaagtagtatctccaaatgtgaatactcattatgcccaccattatatatataattactcatctttgacagtaaatgttaaatatttattcctatacttaaacataatgcacaggattcctttttagtgactgctaatgagttacttttttctaaatcagccgaaacatgaaaattaagcatttttttctgctcagaaataatttcaatgataatagtgttaaaactttgcatttctaaagtacactgtatttgagaattctacagaattgttggaacataagtcatgcaaaggtatgaatcagtcagcacttcagtaggaatattagctttatacccagaaagcacttaacagcctttgccacctgaaaaaaagataggataagaataatttctcaagagccaggatctaggaccacatttacctttcagatttaaaatatgaaggcttttcattttcacagcctttgattgtactatgtcccataatgttattttttttttaattgcttctattctttcctggtaggagactaccatgtaaccccttttgatttccgagagatgtggaatgcagatctgtaacactgcattttcataactcttcctttttgctttggatatatttttgtcattaatatagtactggcaggtctgaatgtgttttcctaaccttattccatcctccctttgctaggagttaatttagtgagagctcaacccacataaatatacgcttataaagcacaaatgctccccaatcataaagaaaatgccccatgagatactgatcaagggacatttttttagattaaaggctaaaagatatctttacatcaagctcagctgagtaaaacgtttattttcttattcatgtatggtgagaaaatttaaattgacatttcaatcattcaaaataatgaatatctgaagtgcaggaataaagacaacatgtgtgtatcatttagaacagaaagcttttcctctgtaactggtaaaccaaaaatagattgtattttcttccaaagaattataatcttttattaggatatattctaggtaagtaatttgtgtttctgctgaaggggacatgacacagaaaaccattatttgtattttaagtagttgtctcactttgcaccgagggagcaaagaccaagtattttccatatagtacttgctctggatcaaatacttttaaagtaaatgcactaataagcttggatcccatgaaggtgcttatcctacaggcagttttgggcacatggccagtcgtgacctgagaatgcactgaggtattaaacatcaaacattctcccttcttctttccttcccctttatccacaaacaacattgtttttaagatttcctaagcaaaccaggaaccttgagaagttattgtttttgacttaaatgttggctgacttaaattgtttcatggtaaacaagcattttcctgcccctataaccatataaaagtccgttgggagacccagaagttgaaatggtaactatattctgttgtgagccaggaatctgtgggtgagcatatgggaaggcacttttattagcagccctggtatattgtgcctggttctcatcctgagataagggatgaaggatgcatagaatccagagtgatattcttgattggttgaaggcccaccttcccctctcctgtttgaaaacatggcttaaaaataaatgggtcagaaagcctcacccaatgaaaagtgaggaatataatatatagtcctccacattttcattttggagaccctgggtgtattagtctgttctcatgctgctaatacatacctgagactgggtaatttataaaggaaagaggtttaattgactcacagttccacatggctgggaaggcctcacaatcatggcggaagacgaatgagaagcaaagtcagaactcccctttgtaaaaccatcagatcttgtgagacatattcattatcacaagaacaacatgggaaagatccacgcccatggatctttacctcctatgggtccctcctatgacacgtggaaattgtggaagctacaaatcaagatgagatttgggaacacagccaagccatatcactcggtttacatgtattgctgctttttcattaaagaaaaaaatgtgttacaagccaactaataaccaataaatgatcttgctcttattaccaaatatgtttcctaagtagggaatgctggaagggagggaggagtcaaaaagactaaagggtaagtgtaaagaaagagaaatcatctacctttgctcttcttcccacgacctcatcaccatgcttgaaaagagtcaatgagcttttcaggatcattagcatacttccataggctgtgtgagatgcaggtctaagagcagacctcagatctaaaggaaagcacggcattatctatctcacccacacagtcaaagcattgtctccttatggcttatccatgtgtctggtgtgtatcccacaggaaagcagtggagaaggtaaggatgaaaagctaaactcaacatcatgcagcagttgtggtaggctggattttacacctgggaacaagggtgcctaactgtcccagtttgcacaggactgagggaaatttctaagacacagcattttatagttttaaaaccagaacattcctgaccaaacccagacaattggtcattctgaaaacctaggatttaggttctcttcatcattgaagtcttctagaacccatactttcaaaattatctgcacgatggaaacgtctacggcattttaaaagcaactgatgtgggtgtcccaccccccataaaatctgacttcattggtctgggatgcagcctggcccttgggagttcttaaagctcctcaagatccccagctaattataatgtgcaggacagattggcaacccctgcactaagtgattttgctaaattatttaacctctctgagcctatttttcttttggtaaaaatttgccctacttctttgcatattacctctgtacaaatattcaagcttctactatttggaatgttctgaatcagtgcataggaatcaatcacctaaggatcttgttcagtgaagatgctgattcagtaggtatgagaggtggctagagaactcacatttctaacaagatcccaagtgatgctgttgctgttggtccagtgtgtaattgagtttgtggtaggcaaaataatgcctccacacaaggtgttcacatcctaatctctaggacctgtgaatgtgttatgttatttgaaaagggggattaaggttgcagatggaattacagttgctaatcagctgacttcaaaatagatcaactgacttcaaaatagattaccctggattattcaggtaaatctaatatgatcacaagggtccgtgaagcaggggaaatgatgtagaataatcagtttcagagtgctgcaatacgaggaagccagccattgctggctttgaagatagaagggaacccagaggtaagaaatttgtgaagcttctagatgctggaaattgcaaagaaacagattttctcctagagcctccagaaaggaacttggccctgctaaggacacactgatgtttgcccagtgaagcttctgtcagacttttagacctacagaactgtaagataatagacttgcaacatttcaaggtctttattgttatttggaacagcagcaataggaaagtaatacaagtatgatattaatccacaactcaggagagcagtaaacacagtttcattgttcattaagccagtttctcactctgagtcattctcccagacctgaacctcagcccttcctggggttttgaaactccaccacccctaccttcaaatttggctatagttcttgagtccagcgtttagggatgcattggaggcagctggctggtccatcatccttttccccagtggcacacttataggtgcaatcttggtggggggctgcctgtggtggaacaggcgactccagacagacaggagggacgcacagttccctcccactctctttccttggcctctcctccccgccccttcagcacagcccaggagaatgtggcttgtctcagctcttctcctgccctggttcttccatgctctgtgtatatctctatgaattctctaaattatcccaaatgtttgagctttggaaaacaaagttcaggaaaatgtgcaggttatttttattttctttcggaccgcacggcttgcctgagacactgagcccagctggctccaccgcaaagtaggggaaaaagggaacagacccaatctaggaagtaaagaacatgattcagtttgtcaaaaaaaaaaatctacttatgtgtgagaagtgagcacaattaagtttcttttatacgccccctcaccccccgccagccccccgcataggaaagttcctactgcggtacatgtgccgcatctgcccagcgcgtccagaagtagaaaggcatcgggcttcctaaggatatccgcggccagttgaaaggagcacaagaggctccgagataagacgaccagggccagaaagttcaatgcatcatttcaagattcgatgtcttggaaactagactccttctcagatcttaaaggtgaaatgagtggccactactggcagccccacaacagcacgcattgggcaacaggcctgagccccacacatctccggatgatacacacctgccccatgggaagccccgggagctcagagctgaaaatagttttgcgtggagctgccgctaggctggcttcctttctgaacctgaccacggagttccttacgatttccacggcaaagaaatactctctatgtaaattgtaagcattttctctgtagatttcagttgtcgatgactacctcataagttgtaataaaatccagttttattaagagattgagactcaagaaatctcttgagaagaacatacagaaaaatgttaagggattaatttgggagtagaattgtgggtaatttttttctttatgtttttctgtattttctcactttctagaagaatgtgttttgtctatatactttgaaaaataagtttttaattacttaagaagaattatggagagtttacgctctttggcttgaattggagagggtaacagtttggagaaggctatttcccctacatacagaccttagagagatatatctgccagcctcactgggctgggactagaatcacctttagataccatgaataataagcacagtaaaagtaacactaatgacaccagatgatgtctgtgttctttggtgtgcacggtcccatttgcatctaaggactgtggagagctctgtgcctaggtcggcgggaatgacaccctcattcttcaggttctgacgttcaagtcagtgctgttagattctcagctgtcctaactccttttcctgggtgcggaacactcccctccctccactgttgttggctagggattccaaactaaacagacatcaagacttttctttttttcaagaataggtgctgcagataaagcccaaaatacagagaaaaccttaccacagaaatgcaggttggaggaacagagagcgagagggcaggtgcagttcttgcctgccttctgccaggcccatgtcaccagttcactgtttatttcttcaccaagcctgctattagcagtaggtctgaaagctttgaacttaactgatgtacgtaaagcaagctgttcatttaatctgcacacttaattcagctctctctgcatgctgcttcagtctggcttctttccatataaggagttcaccgtatctttctgcagcacccctacctctgtcttgaaaaacagccaaagatggctttgtgtttaatgcacttgctgtaggctgaaagccccagctgcactgccaccaccttgccccctactcctgccaggtaagtcctgtgtggtccatttccatctcatcctcaaatgagaacctgctgaattctattattttgagacttttttatgtaaatgaagggaaagaaagtcagttttaattttgcctgtctgatagattatatcagaaacaaatgcatttatgtgtgtataatttcctgttcatgaaaatgttgctggaccctgctttagtgcaccttaaggcagatttggtgaaagctttaggcacacttctgagtaaaatatgcatttcaaatgcactaataaagtgtgtagaattgaacagtgggtgggagagaaaggagggacattttctcacttgtgtataatgttcttttctaagtaaatactggtaaagtctatgtataatcacaattttattgaaaggttaagtaggtggctccattttgttgttatcataaataagcaatatttgctacagaaatctcacattttggataatggtatgtaaatatatcatattccttctttcctaagtggtttccatggcttaatgcctgtcaaggttttgtgaaatatctgcaaaaccagatgataccactcagacgaagggaagagtgaggagatttaaaaatagaggctagctttaggagtctatgctaaggaacatgggcacgtgaatctgggaatgggggtgcatgcgtgcatgcagccaggggaaagaaatagtcattaaaagccatgagagaaggaaaatgcattataaatacaaaattgggaaaataaaatttagatgctaagccaggccttggtggggagaaaaatggaaccactcttatttggttatgccttatcaccgctgttctgcttggggtaccagctgcctcatttagagcccgttcttctcacaacattaaccaaggtgaaaatattattaaaccctgacagtgaatgacagaagcttgagatatagtgcgtatatctactcaggcatggctgtagaccccaaaccagatacccttaagcctattatccgcagaataacagacatttgctcctatcattatacatgtgaactgtgtaccttatttcaacagttattatcagtatattaaacagctacaaaatagctggccctgtgttttctgttttattggaagtatctcatttatctagagtcttctgaaagtcaatactattcccatttttacaaataagaaaaatgttagggctcaaggaagttaagtatctcagccagggccacacagttaatgagtggaggagacaggatttgaactcagatccatatacctgggaaagtttatgttctttccacttttaagcagcctctttatttaattggaaaaattcatagaattataagataggaataagtgagaaaaggaacatacaaataaaaccattttcttgggaatattggaaccacagcttaagtaaataattctatcctgaagtgttttgatttgttggctgaattttccagtagttgaaacattagccagacacaccagggcattatttctctatgttggttgcacattttaccaacctgaagagctttaaaaaatagttacgtctaatctccactcccagagcttctgattaaattggtctgagatgtggcttggacattatgggttttaaaagctccccaggtgatcctaatatgtagccaaataagtattttccccttaacggcctctcctaaagtctagacccattaattcagctaactcttagctatctctgctttaatatcccataggcatctcaaactcagcatgtccaaaatagggctttacatcttttcacttaaacctgaccctcatcttcctatatgatattttttaatgccaaacactatcactagacttattattctaagttagtcatatttttatctgagttctgaaattaaaataggcatgcctgaccactagatggctgctatataaattcataaatatttgcatctgtgggatttcaaaagagtagcaaattcaaaccctgattagttttagaaatgttgtaatagctccctcctgaatgccaaaggaagacaatgctcaaattaaatgctctacatcaggaagttaatttaaatgagcatgtgagccttattgtccataagaaagtgagtgtggagcatttaaacccgcaaggaatgccaggttccacagggaaacaaggaccactagccctgatatgcaggctctacaataaaaatcaaatctaatatattatgcgggaaaaaaacaaacaaggaccactagagcctactctctgcttccccgttgatgcaagggtattgcactttttcagaggttcacactctacatggcaaagaatggtacatggcctaagagaagaaaaaatgatgtctctatagtaactgtgatcatttctattataattatttgataaaaacccaactcaattttcctgaaggaaaaaaaatcaagaagccattggcccacataactgaagggttcagaggtgatctagcatcaggcataaataaatccagaaggcccgtggtgacaacacaggtctgtctcgctggatcagtttcccccttccattctcttgttcctcctttctcactctgtctggtcctgctctgcctcaaatttggctttattttgatttcagagctgagatcaaagttatgagtaataagtctggctacatataatttttgacattaaaaaaaaaaacatatatgaagaagaagcttactctcagtcaagccctttacccatggcagcttccacaaatctcgatttctgtccctccagttcttagtccaccaaagtcattttctttcttacagcagtctcacaaaaagccttgtgattgaggcttactggacccaggcttgaactaagttcagtagccagggggatttccttgactaggcctttaccatgggcccttccaaggaatcaagagagagttggcgtgctcaaaccacctgggactcacaatgggagaagggtgaatacacaggagaaatgtgggctccgttacaacatgaagagttagatgttgggctggacaaagtaaggaatccccagtgcaaactctgcaggtgcagagagaaagagatctcatccatctggggatataagaggattttcaagaaggtatgattagggatgagtcttggaggattggctagttaagaggagatataaaataaatttaattttgttgaaacataattcatgtcctccaggacctcctccatagttatgaatctaagaagctacttaatctatttggtgcttaaataaaaatgttttgatttcataaataaagattttgtttataataaaagagactgtatcattcagatactcagataagcaggtctctaccatcaggtataatgatatcttttaaagtgagagcctcccaaactttagtaattatttcctcacatgagcattccagtattttcatgaaactctaaaaagtgagaatttatgatacttagaagcagtttgatgttgggaaaatatttatttttggcactggccttccatgtaactgtaggcaagtcatttaagtggtttacttatttctaaaatggagatgatattggccagtaataacaatgactgataataaagttgttgtaaatggcaaaggaaataatgcaaatgaaatagcaagtactatacaaataagtgtgagatggtgtcattgtacagttttcaaagtaatatcttatatgaggaaattagttgataatgggagggtttgtttctttgcatggcaagccatctccattttatcttcattaaattcaccaccagagcttattataataatttagcattatgggtaaaattgtgttagtgtttactttggaaatatataaacctggtggcttctatatctggaatacttccaggaattaaggaaaaggtgaagggagcagcttccaggcacctaacaataacagccctatggctatgggggcaaaaccttttcctcatgcagtaatggggattactcataggctagcagaaatggtccaaaccaaccatctgaagaaggaaccaagtgcacggaaaaaagcaagaaattttacaaaggaaaggggaaagtggaaacaaaagagaggagagcaacagatgcaaatgcaagggactagtacagtgcagtggaaattagagccagaggcggaagctgtgaaccacacatggaaacattgattttggtgagggaggggggagatgaaggggagtgatagtatacctactagattcgactccagagcagaatgtttcccaacaacccttcctatagatggccaagctattttcgttaataattgtgatgtggaatgaataataatagcctgaaacaaacacagtaaaaatcttcttttactgaactttgtgtgtgtgtgtgtatgtgtatatataaaaccttgtgtatatatacacacacacaaagtttaataaaagatttatatatatataatcattatatatgtaattaattgttagtaattgttagaatttacactaagaaaagattttttgagggcaggagtattttatcattgacattgttttgattctcatgtttgctagcacatggcaataatagaaaaatatttagagtgttatattattgttctaaaattctgtatgtccaatgcacattcttattgcttgtacctgagggagaaccctgtcacaaatggaggggagtcagcagcccaaacagaaaaatatttggttcactctgcagagaagggacacacagcctcaaacctctcagtgggccctaagggctttgctgaactgtacagcctgtggatacaataccaaaagagaaatttcttcagaattccctcagaggaaaagcttctcttatgtttcctactttaagaattcctggccgggcgcggtggctcgtgcctgtaatcccagcactttggggggccgaggcaggcagatcacgaggtcaagagatcgagactatcctggccaacatggtgaaaccctgtctctactaaaaatacaaaaattagctgggcgtggtggcacacgcctgtagtcccagctactcaggaggctgaggcaggagaatcgcttgaatccaggaggcggaggttgcagtgagccaagatcgtgccgctgcactccacctcaaaaaaaaaaaaaaaaaaattcctaagtgttacagacttcattttgccactttttttttttttgctttggcagagtacagaataagtaaatgtacacacacatatacacatgcacacatacatatagtttgtagtcccagtgtggggagcttttaaaagtctgatttctgaaccttatctctggagagactcactaagtctgggatgaggaccaagaatctacattttaaaagcatctgtgtatttctgatggtcatctaggtggaggaatcattggtgatgaatttgcatttttctagctctatgcttgtaatattccacttcaattaaatatctatggtcctgattatacatttctattgtgtgagtttattgtctatcttcttattttatcttggagatcaccttaatatagaattggaatttaattgttaggagaataaaatcctctttctcctttcctgaaaccatgatttctcccaagtataaatgcagaatgtgaagcctccggtttgagaggtcataaatcagcagcaagtttctcagcagggtgtatattaaaatggaaggccttctattcttacagcaggtcactaaagttataccagcaaatgcaatgaaaattcacagtgctttttacaccctcatatattactagattctcccttagaagtgtataaaactgttttctctacttaaataatgccccccatttttttctttttcttttctttccttttttttttgtggttcttcagacagaatttacaatttaaaagaaaacagaggaagaaaagtagaaaaaaagctggcatgacacaaaacaaaacacagaagcttgtgggaaccatgataacttactgatttttctggctgcaagattgtatgaaacaaaaaatagcaatatataacacttccagtttccccccgaagcaggcatgaccaagctcgttgtggtccagattgtctaaccagttatgctttaaaaaaaaaaaacattcttctgttgtctgtgtctttactaaacctcaaatgccagtcggtgtgaatattcaccaatctattcagtttcatcatgtaagaatcactgtttttaattatttattaaaaaaacatttattaagtgttaagtattatagacaaaggactaaatgatgctttaattctcgtaacgtctctatgaaagtggttttccccccattttacagatggagaaagtgaggcgcagaggagttcagttactttctcaaatgattcagctaatgtatttcttgtattttgatgtatggatgtatcaccactgggaacttatttaaaatgctgattactcctagggattccccttcagtaggttctgtggagcccaggaatctgcattgctaacaagcaccaggtgaacctgatgcagatagttcatttagaaaaagattattgatatggtttggctgtgtccccgccctaatctcatcttgaatcgtagttcccataactcccatgtgttgtgggagacacccggtgggaggtatttgaaccatgggggcgggtttttcccatgctattctcaggatagtgagtaagtctcctgagatctgatggttttgtaaaggggagttcccctacacatgctctctttgcctgtcaccatgtaagatgtgattttgctcctcctttgccttttgccatgattgtggggcctccccagccatgtggaactgttagtcaattaaacctctttcctttataaattacccagtttcgggtatgtctttattagcagtataagaacggactaatatacttatagaatactatgggtttcccactctgaaagacagctcagagttcaggacatgaaggaagtcctcaccctgttccatttccattctatcacctggcatttgtcccctcagaactcaggccataggaagccacactccagcctacccatcctggcctgctgtgtaactttcaaccaaaagttttcttaactatagttgtgtaacttaaaaagtggttactgaaactgcatgttgtacttcattctgggtgaagggccaagagttgtgaaaattattgacagagtgggagctgacagaagaggctcaggagaaaagaagacaggtataactttatctgtctcactgggcctcccaacccataggccttccattcccttctaatggtgatttccattaaacagcagcacactcactcactgggagctgatgcaaagaaattctacagtggtggtagaaagaaagataggaggtagggcagaagtgtgggcataagatatagagaaagagaaaaaagcaggaaaaaagaagtgaaaaaaaggcagtggctgtgtagatggggggatcttgttaatagagtgaaacatggttaaggttaacagcacattgttcagaccaccaaaggtttgactgtattctctataattcctaggacaactgcaaattactagctccaggaaaattactcctctcagatctgcatctcctccaatcaggttcactgatatcatagcttttcccaacagatgacctttccctgtgattttgagataaagtgattggaaggtgggaaataaaaatctaacagggtctggggttctccaaagccttttagtgttagattttatggtgtttgctccaagtggtataaatacctttaggaatctcctcacctatgaaattagaaacttcttggaccatctttgaagaaagtgttacacaggttacagaaacacggtatgtagaaacactatatgtagcattagagaaatgctaagttgggctttaacacccatggcagatacatgacacttggcatgtcatgtaatttttctgtccttcagtttacccagctataacatggaggttataatccaccacccagagtggtggagaagactaagtgaataattatttaatacagaacctgacagatagaaggtatatcaggatgtaacagggtcctggcaggaaacagaagccatcccacatgagtcaatggaagagaattgtaaagagattatttacaaaagtgttggcaggaatataaaaatgggatggcgaggcacctggagactgtcatgcaggaaaccattactactcatagctgaaggcaaagaagatagaaagagtatctatctccggtgagtgcaggagctgtggaggagaagcctgtaagagctatagcctggagaaacccagctactgccagagaagcaggagcaagagaccttttcctcttcccagcgtatgagctgctgctggaggttcctatggccaaactcaactggaaggcacatgagaaagaagcctagatggtagagttcatagcagtcatcttccctgggcacagagataggcatggaatggatgggaaggaggaggtgcagaggggttattcaataaagtcatttctacctttcatttctgacccactacacacacacacagacacacacacacacacctaccttccctcatatttccaaacaaaactgcatatgtagtattgtgagaagcaggtggtatttaactaataattccactaatgtttatttgctaagtccagtaatgaattcaagctaaatattgtttcttctcccaaagttcagggccattagtggctatgtgtacttggcaagacatattaactcttggactcaaatccagttttttggatacataaatatcctctagctcactgagagagttaatgtgcttccctaaagaccttactaactgactggcagtgagtgaattcagcaccaaggatatcagactccctggaagacaaaaaaaaaaaaaaatatgtatatatataatatatatatatatatatatatatatatacacagagagagagagagaaatttaaaaattagcaaggagctcagtgtgtagtgctgctgcctccacttcccactcactgttcttccccaggactccttctttaggtaatggcttctcagcaactggagctgcctcccgttggaaaagataaacgtcctccttccctccatagagatagagaagagtcagattggtggagatgtctggaccttgtgagcctatagcagggaccagcaaagaagctattcatgctgtgggtcttgagatggaagcagaggcataactggaaaacaagcgctgtgaatcatttggtcagtcttgaagtatcatttagagctccaagaaagagggaaatcttttaaccacaggcctacaggacatctggaaattctatggtcaaggtatccccattatggtttctcccataggcaagataagatttggcgactaatttgtgctcgactacaacaacattaaattgacattttaacttctggtgcacaggataaaataataattagcattataaataatagagagcacttgtcaaatgcctggtgtagtccaggcatgtgtcaagagtttttttgtcctaattctcacaagtcttatggcagatactattaggttattatattagactattagattataacacattaaacttaaagagtaatcattcagaacatacttggcgggggggcctcctctttacagaagaatgccagctaatatagggaaaatgacacatagaaaatcacaatttttcaaccatgattgtagtcattgattcaggcagaggtcatcaatggatgctaaaacatcctggttaaaagttgctagaggatagactataagaggtacagtctcaaagcgtcatgccacaggttagtttttaattacaaagggaaaaaaagatacttttacaatagaaaaatctagctgatgatatactaaccaagtgagcagagttaacctcagcagtaatgagacaaactgacctgatatgcctcgtgatggtttgtcatgggaagtgctcaacatcatcatatatacaggttgagcatccctaaaccaaaaatccaagattcaaaatgctctgaaatccaaaagaggaccaacatgacatcacaggtagaaaattccacacctgacctcatttgattggtcataatcaaaactgattcaaactttgtttcatgaacaaaaagtatttaaaatattgtataaaattaccttcaggctatgtgtataagttgagtatgaaacgtaaatgaatttcatgtttacacttgggtcccatcctgaaagtatctcattatagttatgcaaatatttcaaaatctggaaaaacatttgaaatcataaacacttcttgtccccagcagtttagataaggtatactaaacctgtagtattcttattgaaatgtttaacctgaatccagttgtgaggaaacagacaaattcagatttggggacattctacaacttgccacaactagcttggactatccaaaaatattaacataataaaaaatgaaaaagttcgggaggagtctaaactgaaagactgctgagacaatagctaaatgtaataatgtgtgctccttaactggatcctggggggaagaaacattaggtatgaagacattactgggataattggggaaatttgaatatggggtacatattcatgttacagtattcagagtcagagtttcctggttgatttagtgcaactgaagttatggaggagatggttttctattcttaggagatgtctgtgaagtgtttaagggtcatcaagtctgcaacttactttgaaatagatcaacaaccactgcgaagtgttatatgaaaagagacaaagcaaatgtggcaaaatgtccacagctgaggaactgaagtgaaaactagatgtatggcaacttctacttgtctacaggctttaatttttttttttaatgaagagttggggaagaaagggtagtattattggtcctactttttcaaaatgtaaaccaagcttgaggtgtcccagctagtacatgctagagctgatattcaagtccaggtctttctgactctactaaccccttcaatacattttggccttagaataatcaatgtgaacacaatcaacgtgaaatggtctttaaaatgtacgccattcatttctctaagtccctcatgactgaaacaaacaaggaattgggtttggtttgcagttgtgctgtgctcccctccacacccccacactctcagtctcctcactcagggaaggagaaaggcacttccctcttatatgaatattactgaattcattccatgtcaatcattaaggcctaatgtaaactcttgtagcatgctgggatctaaatgaatcctgacttttcatcatctcagaacacaaaacctaggagataagagaagacaactttaaagatagctttaatagaagtcaatgtaatatacagttgtagttacactgataacacctgaacaaaaaaagagtgagaaaaagggcatttcttcaaatcagttgactccctttcttcaaagacattatcagctatttatgcaaacaatgatttattttacctggtatatatgaagtgattaatcatataaccttacagtatccatcttaggtaatacgtgctccacgtccatgaatttcaactaagctgcctagacttcccagtgagtggtgtttggaagtttaaatttttacaccttatgttgctacctaatacaattctttggcatttgagccagattcttatttaaatgtcttcagtcaatataactagtcataaagcaaactcattctttggtggttatgagaagcagcctcacttctctctttgtttgcaccctacatttagtttttgaattttataaattgctgacaacagccagatctttttttggaaagtgatttaggcaggcaggagggaaacgctcacagtaagctagtggtgtcattagcaattttgttctttatagaacaggaaactataatcagtgtttttaagctattaattctataggctagtacttccctcccactaggaaatgcttattttctccacccctgaagatgggtgttttttaatgtttaagcaaatccctgccatgcctttgtctctgtaagtataatagaaacgctgtgcttctgtgctgcctgtggcgcgcgcatcagggcatccaggtatagctttgtgctgcctgtcagctgccacacgtggagggtgaagggcagggaaaatcacattttgtgggggactgtcgacattcttctgaatggaattctttggcaaacttgaggaaaaggaaaaaaataatgtgggagactggacagagtcagggtccccagggtgccaagtgtagctcagagtgaccattggtgaatcgcttcatctccatgtggaactaaatgcaactaagtgatttcttaggctttccccagtcattcttagtgaaaatatggacttcccacatcaattctgagtcactttcttcccacctggaatgattaccatttttctcatagtcagtgtatgcagcagcatataccctcatttgcctttgggtacattcctgagtcaagatacacaacaggatatcactggggctgcaaaagcccccgccccaaaagagacttggaaatattacgctcttcatgaggaatgtggctgtgcctctcttctccccagacctcttccttcttaccagctgggttgctttctttcttggactctagacagtttctagcaaagatacaagccattgaggaactgagataagaagcagaaaggctaggaccagaagtctcaagcagggttccaaggattacctctacagtcctgagcaaggccatgtttgcatgaaacgatgaacgatgggatgaggaaatgacaacatgcagtatttcatcatagtgtaatccatgaagctactgacacgtggcagggtgaagcatgaggcactagactacataggacctgtatgacatgagaactgatggaagcatatgagcatctggggcatctcagagccaaaggtaaaattaaaatccagccaatcactaaagactaggttcctatgcagactttgaatttttaaaatcctgaagttctttatcattggactacagcatggcatcatcccgtacccatggttatggataagtatgaaaattatgagatttgaaatttataatttaatcccagaaaggggatcttctattttctggccagaggccaactctctggagatgtaacaaagccaacagattatgagaccctcattggtttgcttgaagcagagctcttgaaatgttgcaatgtaaataacttgtaataccaggaccactttgtcagcaaccagcaaaggctgcttagggatatagtgaatctgctcctcaagtaaatcctgagaaatttaatgtcctccaagctttcagctttctagctatggctcctttagcaactgctactgacttcatgccacaacaacaagaacaaaaatatggagctgcattcttttccattctccataaaaccagcatccaaactgcgttaatatggatgtgtgaacatttagcactgacatacattgttcttactgaggaaagcattagacaaaatattttctcaatgaatcattagagtaatataactaagagaatattatatacatttagaagttttttttaatctaaagcatgagaaaatactgtatttgaaagttagaaaactgcatttagttatactaaatcaatctgactttcactcatcctcacaaaccccctttaccttcattttgaattagagagcttcttattgttatattatttataatggaactggtattcctggctggctaatgggcgagcacacattaattccaggttcaaaggaagacaaagaccctcttcagggttctttattgtttgtgcatctgagaaaatgcatttatagtgcagtgactctgtgtgcacactcccaaaggacagagaaatcatgcagaaacttcacatgcagagtttgcagaaagaaatgtcaactcatacctaacggccacggctgctgacataagaatgacaataattagactggtacatattagaagttgcaaccgttcttagaagtaggtatttaattaatggcttgatttcatcatctactaagagatgggtctaaaaagtattttctagccttttttgatgggctaagaatctgtacggaggattgctctaggtgtgaaatatagcaataggtgagatcacataagggtatgtactgaattcacacaggtttagataagaatcctgaattaggtgatttaaagtctaagctacaataataaaaagaccctacaatacaaggctaaatgacacaagacattgccttctatttcacttcataggacaactggactaagctaggagattgtccacaagatcattcagggacacaagttctttccagcttgctactgaagtcttcactgggatattaacatcatctgcatggcgaaagctggcttgtagccttagctacaaggctagggcacagaggcagtccagggcaaacacttgcctttgagggtagtaagacaaaggtagtacccatctattctgctctcattccattgaccagagcttagtcatatagccatattgagctatgtagaggctgggaaatggtgtctggctggtgaccatgcccctaagaagaataaaactagtttggaagagacaaatagcagtctactgtcagacttggacttttcactattgagtcagtattattttcaactgggcttctgatgtcagaagcactaaactggcaagctccatttctgggaaaagctgttaatgaagtgagatagatttgctgcactaggctaaaattttaggtttgtggtttttactgatgagcttaaaaatgcttttttatttttatttcagagactgtcaaaagtgaaaggtagcttttgatatatgagaatcagttagacttccattgaggtattcaacaaacttacaactatacttatactgctcactaccagaaataaattaattttcttagaaaaccagctctatgtctgtaaaaataaaaataaattctgatttttctatgccagtccattttctcatgaacagcttgttctgcaaatcatccgggactttgttagtgtcatatctgctgcacagcttgaggtgggtgattgattgtgcagtcaggttgaaaaggaccaatccttgacagaagatggctaggggatcaggaagataaaggcatctggaacaatgaactttaaaagaactcagtctgttctctgggcttcttaaaaatatgaaattcttggccgggcacagtggctcatgcctgtaatcccaacactttgggaggctgaggcgggtggatcacaaggtcaggagttcgagaccagcctggccaacatagtgaaaccccgtctctactaaaaatacaaaaaattagccaggcttggtggcaggcacctataatcccagctactcgggaggctgaggcaggacagtcacttgaacctgggaggcggaggttgcagtgagccgagatcgtgccattgcactccagcccaggtgacagtgcgagactctatcttaaaaaaaaaaaaaatgaaattcttaaaaactatcaggatctttagctaattattctttctctaaatccctttatctgtaggtagatttattcaatagaaatcactggtggcatgtcttaagatcaccaactttcttttcctttcctttctaggatagctggcaataagtagtgaccagctatattttttaattgtctccacattcaaatgccaggagccccatggattttaatcaggttttagaagcaggctgttttctttcttgtgtgttgtgcattcctattgcctcccccaggcctctaatcttgcagagtccccagaaattgctccattcaggaatgaattgttccattcagatttcttccttcacaggcacactctcaacccagggagggacatgagcaagccactcaggactgagcattaaatcacaagttcacagttgctttcttacacccagagaggcttttgtcttatttagcaccattgctaacacatctttagcaccttatttgcaatacaggcaagtttaggaaagaatgttaatataaagctggtttggcctgaatgccagggagagaaagtcacagtacacagtggggtgcatatgtgtgtgtgtgtgtgtgtgtgtatgtatgtatgtatcattaaaataacagcagcttctctccagagcaatgttcatacacaccattaaactaacatcctttcttgcaaaaagaacacccacatataggaaccatgactcctctatgagaaacataaaataaaaataaatttaatcaatagtttgtgctagtaaatgcctaaagataatgtttttgtgtggtcactttccttatttttttaacacaacatccattgacctatactgaatgttccatgttgtttgtacatactagatattgcagtagtaaaaagatcaaaactggggagaggcaaaggtatttttaaatttatttaagctttaatttattcagatatgtaaattttatttcagagctagaatggttcattttcaccaaagtgtactcattcattcattcatttattcaattataaactaaatacttattaggcactgttaaatacttgagagactacaagcaagtctccctattttgaagaatctaactccataactcagaaatttaaaaaaatactcatatataatgcttttatagcaatacaaaataatattctttagaattaagagccaaatgggcagtatagataccaagaagatgggaaatagcacttgaacaaggtggaacttgagctgggagttgaaagatggacagattgtgaatttgtagaaaagaaagaaccagcctggccaacatgatgaaacctcatccctactaaaaatacaaaaattagccaggtgtggtagtgcgcgcctataatcccatctacacagggggctgaagcatgagaatctcttaaacctgggaggcagacgttgcagtgagctgagatcgcgccactgcactccactccagcctgggtgacaaagcaagactccatctgaaaaaaaaaaaaaaagagagagagagaaaaaaagaaaaggaaagaaagagatagtattcaaggcagagaacatagaaaaatgttcccagatgatgagttgggattgtatgaagaagtgtgattaacataaaaagcagaggagtagcatgaaatattcctaggaaggtagtgtgtgttcagcctgagttggcaaaggtgaggaggtataagtggtgtgctacaaagtatatcaccctgaaaactgactccaccatgaagaaagtataggagggaaggggtgtggggcagggagtatatatatgaagtctgtatacataaccaggtttctaacataattattttaatttctagtaaatgggtatctagcacccttctttttgtttttctgttcctttaagcattctgatgggtagacagattctttgtagccaagagaaattttgtaagggaaggtggaaaaaatatgtaaaagagaaagaggaggagaatctaattctctgaactgaacattagcctagaagtgaagggtgctgacattgaaaccagattccctaggtttgtgccccacacttccattcactggcttgcaagtttacacaagatgtttaaactttttgttccttattttactaaacagtaaaatgatgataacgttagtcccatctcatagggctgaatattgagaccaaatatgtaaaattcttagaaaagttcctagtacatagtaagtgctgctgaataaatggtagctattgttattctaatgaggaagaaggaactcaggcaaccaatacatcaattttagggtgagaggaggaagaagaaactgaataaaaatctgattttcttggatacatttagtattaaacagtgctcatcaaactgtactacttcataccaagatgaaccacaagctccctggatacgtgattatttaagaaaagaaaacccttggttctgttagaactgagtttctcaactgtgacactatggacgtttgttgggaaagaaaggcagatgtcctgtgcatggaaggatatttaatagcatctctggcctctatctatgacatgccagtagcctctccttccctcagtcatcacaaccaaaaatgtttccagacagttttgttccccagatgtcactggggaacaaaatcacccccactcaagaactactgtgttagaataatcagatggaaacccattgcttgagtttttcaaacacaagaatgtagccaaaatcaatactggtacctttagcctacacccactcaaataaaccagacagctttcatcacaatggacctcactgagcagaaaccacccatcccatatgccagtgtcaaaggaaggtaagtggtagaatgcagaggtaccaacagggaggaggaattggaaatgcgttggtgacttagcaagatttgaatagtggtattttctaagcaaccagaatcgcctgagtaatataatcacctctgtgcttctgtagaatgggaaaataaaaataacaaacaagaaagggttgctttaatctgtatctcatgtgaatccattagacacttgctgcttcttgcttttcctgggatgatttgctttttaaagcagcaggcagcatatcagacaaaaaaacatcatggcctggatggtctctgcagatgggaagcaagacctttctgactgaaggtgatctgtctctgcctagagagttaatatagccagagtttttcccatcataatgtatcaactttagaaagattaatttcagctaaatggatatatgttgtgagctctgagaacattgaaagccccatgctaagttgcagctactatgcagtaggtcttagtcatctcaggctgctgtaacaaaataccatagactgggtggcttaagcaacagacatttatttctctgagtttggagtctgggaagtccaagatcaaggtgcctgctgagtgagttcctggcacgagctgtcttcctggtttgcagagaaatgccttcttgcattctcacatggtagagagagagtaggagatttatgtctcttcttataaagggattaaaactacaatggtgggggggcaaaacatatgaccttgtctaaatctaattacatcccagagggttgacctccatataccatcacattgggtattattagggcttcaacatatgaatttgggggaagacacaaaattcagtccatagcacagtgggtactctccagtagaataaaaaaaaaaatttaagaagaaatatagtaaatgtagaaaaatacagactctgttcagcaaaaccaatgtattcaaaattctaaaactctagtgtttactgagatatttgaaataacttgccaggtgcggtggctcacacctgtaatcccagtgctttgggaggccaaggcaggtggatcacaaggtcaggagatcgagaccatcctgcctaacacagtgaaaccccatctctactaaaaatacaaaaaattagccaggcgtagtggtgggcgcctgtagtcccagttactcgagaggctgaggcaggagaatgtcgtgaacctgggaggcagagcttgcagtgagcagagatcgctccactgcactccagcctgggtgacagagcaagactccgtctcaaaaaaaaaaaaaaaaaagaaataactttagttggctataggcaaaacaaatgatttgtgaaatgacaaaacatgatacaggatttctggagaatttgacacagtacacagagaaaagttgcagaaagaataaatattctttcctgactccaaatgagaaaaggtactgctcagagataaaattaaagacaagaaaattggatatctgtttcaggaaataaaactaacattttaaatcagattattgaagtatcccccaaccttattattttaggttgatctgctaagtaaacccattgggcaaatcttatgcaggcaggtagctaaattaagtggcccaagaattcttttcaatttccaatttctttgacttataacacaattaagaaatttataatgaggtgaaaaatagaattacttagaagggatattatcatatctcatttgtatttgatttaaactgaaacctaatcactttgaaaagctttgtgctgactgagttattttctgctacgtggtggatgctctttcttatttgttcaccatggtctgcttttatttgaaatattatggtatttaataacatgtctagccataaccacagagtttcttacagcttttaatatcagcaacataactcttctactctcttgacttagcatttcaaaagtgaggttcataaaaatcctatttgtagagcaaacatctaactccaatttcatgtaccaaatttggtagccatggatttctttatctccagtgcatttgcattaacataagatgataatgttgctagcttctctaccaaataacattctagcataagccacagcaagggcaaaagcccagcaaaattcaaggatgtgacatacccagagaatgctaatattcagtgtagctgaaaaactatgtatgaatgaaaaggaatatcaaattctcgtgtaaaatacttattttgagtttgaaatacttaattgtgaccaaaaaattgtttcttttcatataaaaatagaaggacatcctggagaactgtggctgtctctggaaaaggtacttttgacttcaaaatgtcactgaagaatttgtgccagaagcctccttgaaggcacacttttgatgaaagaaaaaaggatttctggttttgaaagctctttttctcagaaaaaaaaaaaaaaaaaaccttagcagaggcacaaattgaaaaatgtacaatatatgatcattgaatctttttaaaagttagtgctaggcaagaaaagcaatggaagaatttcagacactacaggaaactcctcaaattcatatttccctcttactggccttgaaacttgaaaatgaatgcagatttatgtgtccccacccatcaagttcacacgttgaagccccagtacccaatgtgatggtatttggaggtcaagcctctgagaggtaattagttttaaacacggtcatgtgggtgcccccctgacacacaccactgtgggattagtgcccttgtaggaacagacacaagagaaatctctctgcaccagagagagatccctcaccaggaactgaatcagtcttactttgagcttggaattcccagactccaaactgagagaaataaacgtctgttgcttaagccacccagtctatagcattttgttatagcagcctgtgctaagacatactgcaaactagtagacagctaggaaagctgatagttatattaactttattatttactgttcttccgtttcacattgtttgtggcagatgaagcttgcagaacagttggagcaataaagcagcccaggtatttgtggtgttccttgacccacaggctggggcagccacccagcagaagtggaacaatagagctgttgcccctcctagagaagctgctgaaagccggggagaaacactcaaagcttcacccctcctccttcagtccagtctcctgccagtgtctcccatcagaaaccagctggcaaggcagccaggaaaacacagactgcaaggatcagcctcttagcatacaggacacagcacagggagggcaagaaacatattcaagagcaaacaaatgacaggcacaccttgaaaatagtggtcaagagacaaaagtgcttctactggtacaaaagtactctgtgtgctctctctctctctctctctctgtgtgtgtgtgtgtgtgtgtgtgtgtgtgttttcttagaagttactttgttttgttttgttttgagatatgatcattactatttaatatgatcttctcaagaagcccggtaatattggacacttccttctaaagcagtgatagaaggatactggtatacttcaagaatggatggtaatatatgcatgagatatatcttttagttcatgtattgctcttaggcatcagttgtagcttgcctcactgtgtcacccaggctggagtatagtggcatgatttccactcactgcaacccccacctccgaggttcaagcgattctcctgcctcagcctcctcagtaactgggactacaggcatgcatcaccatgcccagctattttttgtatgtttagtagagacggggtttcgccatgttggccaggctggtctcgaactcctgacttcaagtgatccacccgccttggcatcccaaagtgctgggattacaggcatgagccaccgtgcccagccccttattcactcattttaatggtgcacttctgaaatttgctcccaccaaaacggcacaaccatggccttgtcagcctccaaggaatgtggtgtgaacatggatcattctaaccatacggaggcacagtaagaccaggacttaatttgagcctctgaactgagcatagggtttaatgaaccacttctccactgtgataaagtatactagcaaaactgctatggtttgtatgcacagcctgcagctgaacccattacaggatgcattatttgataggaggtctgaaagactgaagagcaattactctctacaaccaagggcaaatggcaactgtggagcttggccttttctcatttcttggtttcctgaggtcagagttctctacaatgacaaaacctctttgctctggctcatttgaaaagcaatgtcattttaaaggttagattttgcgtgtgtgtgtatgtgtgtgtatgtgtgtgtgtgtctgtgtgtgtaagatagagagaggattttatagtgatttttatgacaatcaattaaaaaaatgctttggaaacatttattgagaggggtcacaaaggtaaatgtcgtgttgaaaggaaacagatagttctggctcttccaaatctgttttaccagaacccaaggcctaggaaagggacaacagtcctcgatgaagtccattactgggccctgagaataatctttccttaccttcctgcatatcattttcctttcctcctctctcccctcccctttccccaagatacagagctggctgggaggccagcttaaccatgtcccaccccctttctctcactttgccccaggacagtcagagctaaactcacaaaggtgaagcactgatacaggccccaggaccaatccccagacccaccctccctccactgcaccacaggttcccactgccattaccgagcatggtgccccctgaccagccttcactcctcagcccttctgaaagccccccagctcttcaccccagagaccccagccccattcaagtacccatggtcctctgcttcagtctaggcattttcctgacatggaggctcaagctcacttatgaatatttaaagactcatgatttttttaatccttgaaggctactgactttctgagcccaacatcatcaacaaatagtaagggagtcataaagaaaatgctttgctcacctttcatctttcttttgtggcaagtaagaaaaaagaaaaacaaacctacttctcacaaaacctggatgtgactgtgtgttcaggaaaaaagaaagagatgggggctggtggaggcaggagggcagatgacaaaggacacagcccaaggtcataaaagggggtggaaagagttgtataagccttcactcccacctctccacttcccagaggtccagtccctgctcctcattcctcccgatgccattcctggtgcttgttggaaaagcaggatctcaggccccaccccagacctcctgaatcagatgatctaggggtggagcacaggagtaggttttagcaaactttccaggtgattctaatgcctgctaaagttgaaaagcaacaccatatggtgcagacaccagtgtcttgtgcactgttgtttaataaacaaacacttgctaatttaagtatatttgcaaggtcttggtgtggcccagactgcaagctccctgagagcagagaccatatctttcttcatgcctgacaatgcatttgttgaagggaaatagaatcagatagtattttgcttttgtttttgttttccactttaaccttttctaattaaaagtttcaaaacagcaaggaaaatcacagtgagtgttgtttagagaatggttttgagataatatatcaataccatgtgaataattaataacatcagtttaccagtaatattaataccttccagtcatatagtggctctgtggttttgaaaactcttccatgaacatttttcatttgatcctcaagaaattttggcaggaaaatgtataggtttctttctttcctctcatagaagaggaagcagaagttcagaaaagctgagaaaatagtcttggttttcctaattaggtacaaaaactggaacccaggactttgagctcctactccattggaaaggtttgtattccagttctgttatatgttatcggattgtttctagtaacttacccttgtaagtctttattttgcagtttcttcatctgcaaaatgggaaaacaatggttcctattttaaaaggttgttgtaagaattaaatgaaatgataaaggtaaagcactcagcatagggctggcacaaagatttctttattgttatatgtctgaatttacatattattcatacaatcattatatatttatgattattgcaccacactgactcccactagagtgaccaatattccatacatggtttagcaaggctggggtcttcctcgtttcagaaggtgttccttgctaacttaacaggacatttaggcctccagtctgcctttcatgccaggagtgtttctcactgctgctccccaatggatctttatgcacgctgcaggttgggtatcttctgtggtcacagtgcttaccaccctttctcatagacaggttgcctagtcattccaagcacatgccttccttagccattgtattgttaagttgttatggttaatttatatttatatttatatatatatatatatatatatatatatatatatatatatacacacacacacacacatatacatatggtagaaccacagcttttatccaaatataaaataaacacatgtcaaagatattatttaattctggacttaaagaagggaccagtaagatgttgcataggctcaaggggatattcagtgaatgcacacatacaggcaatcaggaatgcagaaatgaatttaccaagttacaaaatgggttaacacccatggagcaagaatcagatgcatgccaccaaacacaatttattggcatttctttctatttgcaagaacttgtattattattggttttccaccacctacagagctataaaatagctcaaagatgacaaaagcagagataacctggaaagctgtgctgaacagggcccccagtcatcttttctgcccactttgaagtctttcgcaatctttcctgacagtgggatctcaaaagagtagtttagtgttggaggaagagaaggtatcactatatccagttccctgcctagaaaagaggcttcacagtcctggtcttcaaaaggcccgagcgagttttcttctttggttctcttcttctcttaataccctcttccccttttcctgaagatttcatctcaaagttctacaaaatccacaaactcaaagtcccactccttctccttggaaatcccaactctcccataggactcccttggtcctgtcttaatatctcacaaacctcggtgttcaggctttggctgaatgtctgtgaagcttcttttctcagccaccaggaatacaaagtgggaagagaaggttctggtacctaagtgagggcaagtaagtactgggttctaagtttagcttccccttcaacaagcctgattgccttcccactaacctaagaaggaagcatatcttgccaaagatcactaattcccccaggacaatataaatcttgtctaatttgagagaaggatatttatttctaacaacatgactttggccttgccctgtgaaagcataacccagtcattcttgagctgaggaacgtcttaccttttcctaggtcagactttcattcctctccctttgttgtccagaagggtggtccttgcttcatctagttactgttgtttttcttccttgcatagaagaaaagaaatgtccagttgtttctaccacacatgtggtttaaaaaatagaatttgacattttataaaattaggagatcagaagttgtaagacaggcatgatggaaataggtctaagtttagatttagactaagggagaattggatgtggtgcaaggtagttccaggactaggtggatcaagaacactgcttcttgagctctcgaaatatgttctcagtactggctctctgcaacagacttaccacagagaggtggatcaaacagatccttccagaacatccagttctgcttgcttccacatgcagctgaattgacactcctagatctatgcatattgaagcatttttggtttttccaggagatatattattttctactttaaaagataatcaagcatatgaatttcttaccaagttccacattcaacacaatgtaggcactttccctcctgtgcaagcagacagcacattgaagacaagcattcacaggagccttgggatatagacccacactggccacaaagtagttgagctatctcaggcactcacatttggagtttcagctttgtcatctccaaaatgaaggtgctggactggggttcttcaaagcagctcttccacaatgtcaaagtgctaagtaactcctaagatatcctcatcctatctgtctgtgctagatcagaaaggaaaatgtgacttctccagcctggggatgaatagccagtcacacagatgtcctttgcagactgtgatggggtgaacacttgccttcccttactgcagacagtgtcagggtataaaaggttctgtggaagaagctgccagcaacacaccctaaaagggatgcattggggcactggcatcacataagatggtaatttattttgtgcttatattctgagtcaggcatttttgccgtattcagtttgtcattcactcattcattcaatctctaattctacattactgtttgagtaccttctatgtgccatatattttgctgaattctggagacttaatgatgaacacacagttgaggtctctgtcctcatggtacctatagtcaaggggggatgtgaataagtgaaaaagttatagtgagtgatgtacaaggcatatgtgggcctgcatgagtggcaactaacccagaggaagatggaagagactaagagggcctgacacagaagccataaatgtgttttagacagatggtacatgtgatggctacaggtgatttcttgcaaaactaatgaagcttaagtttagtggtgtacccataaactggctctttgaaaaaaggatgaaattatttaataatcagtgcttttgagccatactgccagctccagaacacagctaaactttgggccccttactaagacaaatcccctcttagtgtcttagtaattcccctagagcaggctctgagacaggagtttgcgcataagtagtttatgtgggaagtgaaagaaatacccatagcaagagggtaagtgggctgtgaaaggcaagacagccaataaaaggtctgtgttcaagccacctaccattatgggttaccagagcttaatctttctttaaaattctgagaatcagtatggtaacaacctgaggagaaagggagctggggtatctatactccaacttctgtcagtcattggctcaggtctgctcctgagtgtgttattttcctttcatattttaccttccctgacagggggagtgaccttccgttgctttcacgaaagctgtaaagcaaagagatgcagatactgacagttggaagtcagccaacaagcacagaagtggtaaggcctgggggatatagacagtatctggtacagattatcccatacttaattatgtatttgtaatttgcgttttacttaaattgggccctcaaatttttatgaattttagacctcacaaaacctgaaaccacctatagtgacaggcctaacttgctgaaaatacagagtgtatgggaaaatcaaagaaatttaaaagcccgtatcagaattggaaggaagacggagggtagcaagagatgaaactagaagctagaaagttgaagctagaagctagaaaggtaagccaaggccctatgaagggtgctatgttaaactgggcttttctagatttggctgacatttgttggtgtctgcagaactcagctgggttccttggggcatctcatttctgggacaaactgacagagcaacccctttctgggatgggctcttcccaagatgaagaataagaacccaagagggctgatggaagctcaccatgcctctgatgtctgttaatcacagcagcacaggtcaaatctccttatattccattggccagatccaaagttagtagggcaaggtacacctgcagggaaggacataatgactaagtaagaactgtaatacagcctactactggattttcaccaaaatgttaatagtggagatagcgagatttctgatcatttttcctttagcttttcactattgttagaatttgtaataagaatgtagcaattgtaccaaaaaatatgaacctattcttctaaataataaaagattatatcaaatattgaagagcatttttaaggatatctttttaaatttttccttttttaatgtgttatttataaatgaattaatatacatataaaaggcctaccccctaaacttcctaaaactacctattagcatttatagcatgtgtaactaatcagactttattatgttcctgtttctggtttcttagtattactctcattaaatttttttattttgtatatgtctttgtaaatcacctggaagtactttgtgatgttagctaggaaataaagaaatagattatttagaaactagaaagaaaagtagttggagggaatcatcctaataatacgcagccctgatagcatatacaaatcacctggagatttctttttaatacctctgatggagactctagaggttctaatttaatgtttctgaattgggctaatttttaaaagctctctgaaggttgagaaaaattgaataaataaatgattaaattaagtgaaaaaaataacaaaagggccaattatatgtgaagagcaaaagcaggttgggaagtttctttacaaacttgaagtaggctgtgatactaaaaagccaaagctcccaaatattaaaaagaataagggaaatggatgcagtagagcaatattagcttccagaattagaaagggcctgctattaagatctgttcgagcttcgctgggtgaggaagagtgagtcatattctctctgatacctcatattcccacatacatcccaaatcagaccctaatcgacaattgtttttgtgggtcactgaggtgcattttgtggactgtttttcagaacattgtgattaagcaaaagtctgtcattctccatgagaagaggctgaactcataggcgattacttacacacccagaacaggagagaaggaatactagaaatattgtagaaatgtggtttgttcacttgtttatagctcttcagacttaaattattttattctgtgcagagttcagttgtttatgtgtgaaacatcataaaatatcaaaagctcttttatcttgatgtctcatcccagcttttttgagactcctctttaatatttgataagaaccaaaatagggataaattatgctttcctcctctttcttttttacgtttatacataaatgttgagagaaagcttgaggtatttgttttgttttgttttgttttagctaaatggcaagtaaataacaggctttttagtaactatgatctggcactggtaaggtctgagttaactgccatttgcagagtaaccatggtgaccagcatatggcttctgattccattaatcttgttgagattaacagtaaatcccaaaggatcttttgcagtgattcagaaataaatcatcttttcacatgtatactgtttggtgacagccactcgctttcagtgtgtgtctctacccaacaaagaaataagacagtctctctcatgagatgattggaaatgtgtccctcaaataagaaatttcacaaaatacatccaatggtgaaaaggtaaatacatataaataccatgtgaaaggaggatttattcaacaaacatttgtcatacccctgatagacacataaggggaaggtcatttactcccagttaaaaatttatttgtatagaacctcagcctggagatatggaatggaaacaaaatttgagactctttaatgaaaaaaatccaattattatttcaattataggaattagaaatgatgaattaagctggatttgggaagaggagcagctggctgcccaagaggagactaataatgtgttctatgtgtaacgagatgttgcaacttaaaaagtacagtgtggccctacctaaaaccatatttggcctacaacagccccagagcatgtaaaataatagcctcattttacagatgaagatactgaactaaacaattcagagtgacttccccatactcactaagtattagagctttctcaaactggcggaataaattgttgagtctgagttggaagggatgggaactgaattactatcccagcattcttctgatgctaattcctattacagtgtagacaaaatatgcataactgtgggtctttctcaactcatggagtttatacttcctcatctctaagttttccttggttaaaggaatactccgagctcttatttcaacctagaccttcctacataaaagaaatatcaagaacacaatagcattttacgaattctaagatgcacaatttttcttacttacccatctacggctgggcacggtggcttgcgcctgtaatcccaacactttgggaggccgaggcaggcagatcacttaaggtcaggagttcaagaccagcctagccaacatggtgaaatcctgtctctacttaaaaaaaataaaaaaattagcggggtgttgtggtgcatgcctgtaatcctacctactggggaggctgtggcgtgagaattgcttgaaactggaaggcgaaggttgcagtgagccactgtactccaacctgggcaacacagcaagactccacctcaaaaaaaactgtgacattgagatatgccttttcatcaatggcttcttatgatcactatgcagcaagaccaaatgtagatttcattgctcgtacatgcactaacttggtcatagctgcttatattgccaaagtcatacagttattggtacgtgcatagaaagttattgtgtatgcagaaagaggtataaatttcattttagtgacatgaatactcattttggagtaatgaccatcattttacattttcttgcaaagcaacaacatagtgttctacaggacctaagaagggaagatacaaacagatcttgtatgttaacctaccatgcactaagcactgaaacttaaaaaaaaaaaaaagctaaatctttcagaatgcatgaaaggaatttcaaagcaacaagaagctgacataatttaatttgctacatccttttgttcttggccattgtaaaatagttttgatcctatcatttatattaggttttatgataggtggtaattcacaaatcacccaacatggcattgatctcctcttgctgatggtgggactgtgcctaaagctcccttccctgctctgctggtgcagaacaacatcaggaagtccaagtagtcaaaaccaaagccaaacattgaacatttgcaaccccaatttcaatcataaaattaaccaactctaatggcaaatcagtcttttgttcatcgtagcacaaatgctctagaccacaatttttatttcattaaaaagaaaactggtctcctttggctctctaagatttcaaaataacgattctttgtaattccctagcaattgtagaaaatattcattttacattatttcccgacaatttagaacatttgaggttacattgaaatatttcttatataagagcaaatgaagaggatggatctcatataatcatggccaaataagtatattcttcttggtcatatatttttataaatcattgaggagcagggaatgttgtatgtgcataaatgtataacctattacagcagcctgagaccccatgggttattattatgtcagcagaactgagatactcggatgtgtttagtggtagaagcaagcattccattaatttggttaagggacatgaatcagctagtaggttgtgagttatgtaccttcctgaccttcacaaaaggacaccctgacttgggtttatacagtcaggggtgcagtaggatgtactggcccaggtcagaagagtgccaaatttcctcaaggactcatttgtcctcaggaaactcagaagctgggtcattaacaccctggccccaggtccttccttacacaactgtgacactctctggtgaaccccttgtcactaatctcactctgggtatctgatttctagctttactaccaggatgagaactttttctgttaacataagtgttctctacccagggcctttccaagcccctggcttacaagacctataggaacaagagatcatttcttttaattacatgaagaaatctgatcggatgtgagatcctttaaaagaaacttttgacttcgtttgtaaaaatatattagcatttgttacttaaagtgtttccaagagtggaatttattttacaccctaattcattatgaatgcatcatttttcatattctgtgtacataagattaagtgaggaaaaagaatagagtttagaagttctgtctttatttctccagtcctgccaaatctcactgttgctaagggaatatattattaacttaggtatcagaattagaaaggtcgtattgttctgataaaatatgctatgactctgagatgtccaggtggaatcaagaatatatttccccagataatttaatctcatttgaaaacttagatgtacttggttcaggggaatatgctgaaataaaaccctatctgcctcttcactctttcctttcttctcaggaaggagaaacagtgatcatagctcattgaaaactctcctgctgtagtttaaaaagctataatatttgctttttattccctcttcaagttgagaacagctcattgccactttctattcaatgatccttcacttgactattgtttgtaacaccattcccaagctttactttttgacatgttacaaatctgttttttttcaaactttaatcatttgtttacgtttcaacatttcaatatttctctcctgaccaccaccaggtaatatgtctttcccacctatcttagactgttcttaaataaaaatgtggctgatataaagggagaattaaaaaacatagcttcctctcagcttcctgtagataacaataaatgcactagaacttcagtttttgaacttttaatgagtatcatggaaatatgttttaaagcacaggcttgagagccatactgccagaacgtgactcccacatttgccactttactggctgagtgatcttgggcaattaaccactctatgcctcattttcctcaactgtaaaatgggcataataatattctccttaagttattctaaggattaaattaatgcaacagatattaagtgtttagaaaaatacctgcgctttttctctgcctggcattgctgggcctgcaggtctgtgtcaagccatggatgagggtctttgttctgcagaatggggtttgttaaagttgttaagaatgaggcctatttaagagataccaagtgaaatttaggaaatgacaagagggtagaactgattactatactcagaaacactctgtgatacaggataaaaataaatacaacacactcaaatacagggtgatagtctgtgtaacaaacagagatatgatttgtcagattacttatgcccatatagaaggggatacggtagtctgcgcagcatatgtacatggtacatgaactaccaaaataaggtgtgaaggttggcctgacaaattatgctgcagcacattatactggcctgccactggcccacgggcttctcggtaggtttggcatggacaggatctatgaaggccaagtggagatgactggagattaatgtgatgtggaaagcattgatggtcagcctggtgccttcacctgctatttggatgtaggccttgccagaaccatcactggcaataaagtttttggggccttgaagggagctgttgataaaggctgttctgtccctcacagtaccagatgattccctgcttgtgattctgaaagcaaggaatttaatgcagaagcgcatgggaaacacatcatgggtcagaatgatgcagattacatgcattacctaatggaagcagatgaagatgcttacaagaaacggttctttccgttcataaagaacagcgaaacttcagacctgatggaggagatatacaataaagctcatattggctgggcacggtggctcacagtcccagcactttgggaggctgaggtgggtggattgcttgagcccaggagttcgagaccagcctggacaacatggcaaaaccctgtttctgcaaaaacaatttataaaaattacccaggcatggtggtgtgcacctgttgttccagctactcagggggctgaggcgggacgattgcttgagcccaggaggtcgaggctgcagtgagccaagatcatgccactgcactccagcctgggtgacagagcgagaccttatctcaaataaataaataaataaaacaaaaaagctcatgttgctatacaagagaatccaaactatgagaagcccaagaaagaagttaaaaacagcaggtggaaacatcccaaaatgtcccatgcccagaagaaagatcaggtagctcaaaagaagggaagcttcctcagacctcaggagcaggctctgagagctaaaacaatgttctaggatgatttttcagacaaaaacaataaactttttttattttattattattacacttagttacatatgtatacatgtgccatgctggtgtgctgcacccattaactcgtcatttagcattaggtatatctcctaatgctatccctcccccaccccccaccccacaacagtccctagagtgtgatgttccccttcctgtgtccatgtgttctcattgttcaattcccacctgtgagtgagaacatgcggtgtttggttttttgtccttgcaatagtttactgagaatgatgatttccaatttcatccatgtccctacagaggacatgaactcatcattttttatggctgcatagtattccatggtgtatatgtgccacattttcttaatccagtctatcattgttggacatttgggttggttccaagtctttgctattgtgaatagtgtcgcaataaacatacgtgtgcgtgtgtctttatagcagcatgatttatagtcctttgggtatataccctgcaaaaacaataaacttattggctaagcaggtttaaaaaaaaaataccctgcagaagcaaattattacatttattatctaagttccaaaatcaaaagttggttaatttgtgtcatgaatcatactggaggcttattctaaattctaaatatcctgtttatagcaacttaaaatgccagctcattgtattataattttgacattaatcaacctgacatttttcttttataaaggtaaggcatgaacatattagctctcatgattctttttttaaaaaattattacttctcccagatttcctaagccccatttctttagctctttaagttgttactgtgataagggaaaatattgttttcgtgtgatgtgctgtaaataggttgggcagccatctcagtttgcctgaaacggaggggtttctcaggacatgggactgttactgcttaaactgggaaagtcttggggaaaccaggatggttggctatcctactgtaaagctattacataaggtggggtaaaagaggaaaggaagaatcagtagtggtattaatctcattaaatacaaaagaattattagtacaccactgttcccttgatttttgactcatgcaatctctgatgagtatctgaagggtaaaattgcactcaactaattaactctaaatgtcaggcatttggacatcgtgttttttttttccttttgctaccatcatcatctgtggaatgtatttcttctccttcattttatgctgttctgctttcctctgattgtgtcatgcttcttctttttcttttaggtcaactcaaatcaaaacatactcttgggacaatgcccaagttattctggttgggaacaagtgtgacatggaagacgagcgggtcatctcaactgagcgaggtcaacatttaggagaacagcttggtaagaaacaaattaataagttaaaaagaaagataatttgcttattatatgtaactctgtacagagtccgagctaattgtcagggtggagttaatgaaatgtttgtcaatctaagagtggaaagcaacataatcctccctaagtggacaatatattttctcccacttactatggcatcatgagagctcaagcgcaattacagaagcaaaaatgatactcagaattttggtcttagtacaaggtatttaaattcttattccatgagaaacacaggttatgccttgtccgttatttttggtttttttcccccatactctattttgcattcagtgagctctttattttattgtgtgattattgttctcaagtttccattggaggaggataatggcacagaataggtcacatcctagattctgattctagtgacatcactgataagccatgttactgttacaaatccttttgagacttagtcaccccatctctccagaatgagtatcatagcccgtgcctatttaaccaagtccttgtagataagatcaaatgagataatagatatgagaaagtttcagaaatggcaaagccatttcaaacacaaaacattgtatctaaagagaaaaatgctggagtgagaagggtagagatttaatacaaaggagggattgatgattgatgattgattgattgagccaagaaatttttactgggtactcgttgtatgctttatattatgccaaacatcatggggtatacaaaaaagtaattcacagtccctaggctcaagttgctcccaatcgagtggacactgaagactggagatatacataaggaagcagaaatacaagtcaacaaaaacaggtcaatgaggagataagctgcaaggcagatgccaacaggaaagcaacagggagagggaggcagacacaggaaggggaaaaacattgccggaaggagatgtaggagtggagtgtgatgggaggaagataaagagcaatgcagagagggcccccggggagatcaggtgtggaaatgaatacaccaagaggaagagatgagtgatgaggggagatggagatcatatgggtgaaatggcaagatacagcttgaatggtctctgaaggagagtagaatttgcaactacaaaggagatgaggcattatgagtaaagggcacagtcatgcatggacattgagatgagcataaggtgagaggacagtgaatagaaaagtgagaacctagcagaaagttgcagaactgagttgtggatttggggaacaactccagtcctagaggtgaaggagttggaattctttttgttttttgtttgtttttggtagaccactgagaatattgaggcattcttagcaaagaagagtttgacttttaacctttttggccaggacctgcagtaagaaatactttcaatttagcaacccaatacatacatatataaaacttctgtaaaacaaaagttttacaaaacacattttaactttacttgatgagattcactctgttttctgtcttacttttctttcttcttttttcttaaatggtggtcccaacccactaagttgatccccagaagcagtaatgtgtctcaatctataatttgaaaaacactgttataaaggggatgatttgggattaatctgctggtgttgtgcaacatgagtcagaaaagcaaagtccctctcattgggtcactcttcctcttgatcatctcataactaatctaaatacagttcactctgaaagtttgaccatttctcatgagcttaatgagttccttagactaaaatctatccctggatggccacaagaacccttccaccaaatattcttagagccacccaggagaaagttacctggctggtgtacggtctcctgtggcagcttttgaagttaccatctctgccacagggcctcttcccactctaccgattaaacaatatgaagagtctgaaaaaatgataattttttttcttaatcctcttaggacctcagaaagataagaatgggaaataatagatccccaaagaaagagagggaggaaacctgggagagggttggcaggttggcttcccaagatggtctcttccctgtcttcctgtgttttcttaactagctgggcacatgccaggatggggaagaaactgctacacagatgtaggctgtctctatgaataaaaatgaaaactgtttggttaaaaaatatatatatgtatctccaagccaagaattgtttaatgtcattgatacataggaggcaggcaactggctaaattttttaacactctaataaattacttggatattgagaagaccaggttgtgaaaagggatgttaggatgatggaaatgcatcaatagggtgactttcccactgctccatcgactggcacacacacaaaccctttccattcagtagacagatgtagcaaagttcctgaaattgtgaagcagaatgttttatgttcctgttcaagttcttccagtggtttctaattgattttttgctctctattcaataaaaacccagctgttgtcatagcaaccaacacatgtgcattcttggagagtcatttacctcgtttaatgtggcttgttctcctcatggctacacatgcttctacaaatgatcctgagggacaatttgtatttttaaaaaatgctctcacaatttaaatttaaagattttaaaggtctttgctttgttttttaattacttgtacattttattcttcagaataccatcacatacacacaaaagttgcacattgttttttaaaagtcattaccacatcttggcagatggctcgaaataactgctttatcgatctggtagcaattaattctccattgtggattgttttttctgtacaacatttgctcatcctaatgagggtccttgatggaaccaagttgtaatggagctctttaaaaattcttgtatggcagctgtcggtcgcaatccagtttagttcatcaagcatttattaagtgtttacaatatgccagttactgggaatgcaatgacaaataaccctaccttctaggagcaaacattgtaatgcctgagatagactacacagacaaagaatatttttctggctttccctttctcagccattttgtttcatttgatcctttgagcacccctccttactgaatgctgcttcgtcagcatttatgacgtggtgctctctgttcatctcctccctctccagacttgcatttagtttccttggtagactcctcctcctttatccatctcctgcactctggctttctatcctcagtccaccactcctctctctctacaccctcccttggatgtttccatccactccaaggttttaactgcacctccagactaatgactgccaaatcatgtcccaggcctgacctcacactggcgcttcaggcgccaacatccacctgccagctgtgcatattcagtacttctgatttagagtagtggtctaatcatctgcagctgaattggctggggttcattttcaaacgcacattcatcaacccaactcagacctgctgcatcagagtttttgaagttgaaggctagactctacatttttaacaagcatttttgtgacttttatacgactaaatttccagaacactggcttttgtgggaagcgagtgtttggagagggtagggaattattgctgccagagctgaacattaccctatagctggtgttattttaccatgctttttttttttttttttttttggatggagtctcgttctgtcacccaggctggagtgcagtggcgtgatctcagctcactgcaacccctgcctcctgggttcaagcgattctcctgcctcagcctcccaagtagctgggactactggcacgtgccaccacgcccggctacttttttgtatttttagtagagatgggctttcaccgtgttagccaggatggtctcaatctcctaaccccatgatctgcccacctctgcctcccaaagtgctgagattacaggtgtgagccatggcacccggcctccatgagtgttttaacagttagtctatatgtatgtacctataacaatatataagaatgtttttaaattctatattaaatttatagtatggtacttatatatgtacaatctcataatttaagttttaaatgtacaactactgttttaaatgagaaaaaaatttggagatacaattaaagatagattttcctaaaatagaataatttatctgggaataagaacaaagaaagaaatttatagaggaggatggatttgtattgccttgaaaccacaggtgaaagaatacttgaaccattattataagctcggaaagggcagaaaatgcagaaactcctgttttccaaaaatgtagtcagagaaccaaagactgcagagaaactataattgcttctgaggagaagtcattattaataatttgtaaggagccaattttaaagcgttttcaatttgcattaatatttcttcctaaaacaagtaacagataatattcccaattctctccactcaaacaattatcttaatagcctctgaacatacgtattaccaaattccagattcatcccctgtacccttccttcttgtccagcactgaaccccatgagaatttctgaaagtacaaaatattcttatattttgccattttaccaagctctataatttttcttcccttcttttcccatttaatggctcttttgattattcatctgacaaatatctataataatactgcggagtcataaaacgtgtatcttccctctcacggagcttaaagtgtggactgtgtttcagaaatagactcaaatattatgaacacgtaaacagggctgagtgtaactcagaggataaaggaagggcatgaagttctatgaatgggtagttacttctctttttggaaaatgaagaatgacaaaaagatacattctatgtctatatactccgaaacatattgatttgataaatactggcttaattaaacaatttcttcaaggaaatagtctcttgaagtagaaagagatacatttaagacaaatgaaaaaggatattctttcacctaacaaagaatatactaatggaaccaattatctctggaagtggaaggtagtgcaggcgggacatataattacttcccaaaaggtctagataaatcaatgcaggcagatctaccatggctaatggggggagtttgcattctgtgggatatttctgtgtcaccaagcataagagtttgggtgtattgaccatgctacatcatatgttgtggtaccactctcagagacaagatgactgaagtgactgaaacattataacctagccagaaaagtggattttaagaaccatgctcttgatttctactgagcctgaatgaccccagcatgcctgatttgggaactctaagattctctgattcactcctatgaacttttcagtttaaatcacccttgtctctcactgccaacccaggtaagggagagaaaggcattgactacactgtgaaatcatacggtggtggaagccctgaacttggatccatgtgctctggccataagcaaccaatttctatttatacaatttccaccaggaaaaattgtaatagcagcatcatcataccttccataaccaccaagctccacttcagtcatcatacccttgggacaatcttgagtcacgcaataggtcttttttttttagagatgggatcttgctctgttgcccaggctggagtgcaatagtagcatgatcatagctcactgcagccttgacctcttggactcaagcaatcttcccatccaagcctcccaagcaactggaactataggcatgcaccaccatgcctggctaattcttttttattttttgagagatagggtcttcactatgtcacccaggctgatctggaactcttgggttcaagcaatcctcccactctactttagcctcccatgactggggttacagtcatgagccactgtgcctagcccacaataggacttaactgaatttagttttctatcttaaagtccaggaggaaggtagggcatatgtagctggtaaacctatttaaactccgaccttggaccccacaatctttcagtgatccacacaatccaatggaagatgctagaaaataactagatgattacaaaggataaattatcctaaatcaaccatactcaaattcataatttctcttttcaaaatgtgctcacctttctggaacttccccaactaataaactgaaaaactccttagccaagtgtgctgtgatttataagaaacctctggaaattcttggtatctcactctatgtccaaattacactgagatgattaccactaaattgtacagcaatttttcagtacctttagagcaccactttagggaagctataatcagaactacttaaggcggttctcatctgaataactaaaaaccaaggtgttagagagtgtgctattttatttgcttgtttgttacattgagactgctgatattgggaatagcagggatatcaggagtcactgctaggcctcagcacattgaggggaccttgcttatttctcaaaaaaataataataataaaataaggaaaacccaaggcggggacaaggaaacaaatctagaaggaagactagatatagagaaaggttctcgatcttggctacacatttcagtaggttgggaagcttttaaaaatcctagtgaccaagctgcatcccaagccaactaaattggaatctctgggctgggacccagacaacagtatgttttttaagtcccaggttattccaatgtgtagacatgattgagaaccactgatttacagaaaaaacaaggggcagattagcccagagagccagcagaaggaagctgtaattggttccacccttcatggtggggctcgtgctgcccggccacagggagctggtcttccaggatggattcatgctgaagctttcatgcaccctagtctagtccccatgtggccaataggtgcatggattttacagaaggctattggggatcagaagaggagtatgaggttatacaacagaacgtaattattaggaccaatgtaaatttagcaaagtccacttgtaattgcataacaaccactgagctgaaataaatgagccaaagattcttttcttaaactacagtggggtcacactaggagtttatttcttttggggggcaggagatagacacttcaaaatagaactcatgaatatattacgggactttattcatttactaatgtattcatttattcagtattattgagcaccaactattggtcaaggcactaggagttaggaaacaataagaccaaatttctgtcaccccaaaggagagtctgagagacacataaagactttcaaaagacagcatataattgttgtaatagaggcatggactcagtgctagaggagcttaaaagattaagaatgtccctgtttggaggctctgagaaaggtcacactgtggagacaatgtctgaaccatgtcttgaagtatgaataggattttgatagttagacaaacaggtgatggtctccctaggcataataaatagtattctggagggatctaagcctggaaaagttgacatcatatatcatggagaaccttgtttgaaagaatcaaaaactcgggctttgtcctatacatgctgaggatcctaagttttaaacactggagtgacaagatcagatttcattttggaccaattacactggcaatattccagaaattagggtgtttaagatcagcaggagtacaaaaggaaaatattaatagctctatttattcgtacctcaatttttttttcagttattgggtatgttttataaggtactactggaatagtacattatataatttatgaaatattcatgtattagggcagtactgttttttgaaactaagaattataaaacaacatatgtttggagaccactggctaaaggatagactggagggtaaggacaggaagcagagattccaataagaagctgatgctattgggtaaattatggcgaggcctaaagcaggggttccccaccctggctgtacattcgaaccacctaggtagcattttaaaaaccatggcacggaccccatcacacacacacacacacacacacacacacacacacacatattaagtaaatcagaatatctgaagctgaggtacaaacatgagtgtttttagctccttaggtgattctaatgtacagccatggttgagaacccttgatttaggccctcaccatgtctcacccaattgtgttaaagttgaggaccacagacctaaaccaagcagtggcactggggatacaaacaaggaattagaggcataaaagatgatggaggtacctggcctgagtaacagattaaaatcattgtggagggagaatttcggagtaaaatcaacacactaacaggcagaagggaagacatccagaaaagtcagagagtagagagtcaggatagtggagatacttaggtggtcagtcatgaaggcaaatgggacaagatctagaaaatacattgaaagaactagtcttaaatctaagcaatgcaatccataattttaaatatgacagtaaattactatttaaatgctttgataagcattgatccacaaatgatccatgaggtgatacacataggaggacagtgggaatttggaggctctttaggaagaaaaagacaacattgcatattgcatagagaggtgaccacccctttctttttaatgaaatcgaaatagatttctaagagttgccttcattcaatgtctttttgataacacaagaaattagttcaaaaaagtaaataacatcattaagaactggccattgtagctacctatgtctgcattgttaaccttctttttagcaaaagaccatggctgatttaatggtttggtggttcacacacatttatagctaatttcatgtcatagatttcagcctatcgttacagtttcagtccagcttgccaaggatcatttagtaagctgggcaccaaagccagagaaacatggacagccctagtggtgggcatgcacccaccttggctatcttaaagcttttctgttgagctcagacctgcaatgttgcctccagccacttcactttaatgaaggatgatggttttttccttcagttttaatcctttccctcttacccctgcaaaaacaattatgtaataaagccaggttgtgcagccagaaactctaatgaggttaacattgccctaaagcctatttttaaaactcaaaccacctgttccaaatatgcattagctctgttcttcagcagcttttaaagatttatttaactctcaattgaagtatttctcaaagaatgaaaattgccaacctctgggttcagcagggaatcccagtgatgctactaaaatgttctaagtacctatctgcacacacctctgaggagaagcactgccaccctaccattatatccccaggctcactttctttttggctaagtattcccaggaggtataaactaaaccaacattgtacattttaatgtgtttgggttggtttaggtgtggtcatatccatgggctgggaagggaagggactgctgtttgtttgccctggttcttgtctcttttgtgcttcccagttcctgttaacctgatctttatttcataatcttatggatctccactctcccttctggcagctgaaattcactcctcagaaactgtctgttccttatgaataaagtgaccatgcatcccagtttgctcaggacagtcctgtttatgttcatttcccagtgtaagtattaatagcatcccctttcaatctcaaaagtgactcagtttggagaacaaatggtatggttatccaatccatgaaaccccacccatgcagcatctttgagtgataaactccacttcctctttgttttttatgctgcccttcttctaaacctctacttattttttctcacattccccagtgaataaactctcaagactctggcaaatccctattttactgagactctggcacatcgctattttactaattgccttccttaaccaactccactaatctaggtgttctttcctatactccttcttactaatccagatcttaccaacctttgacccctgagtttccccattctcatgattctgacagctccaagggacatcaatatgcaaagtgcccttcttcattatgaagagcttccaaagccccactgtctatctgttacttgtggatcaaagcttatcctctaacaaacgttatgtttacatgtctcctgtcccatctcgacagacaaaattgtctagccctcatttttctacctggatttggctcagaacttcacctttgctccttctcttagaatgatcttccaagctgtgcccttttctcattcacacaaacttgcaaacacatttggtgaaatgtttaaaaattaatccaggtccatgtaaccgaaatctgtataaactgccagcttcattttttatttgtttttcttttttaacaaaaaaaagcataaatagcagtattacttaccaaaattaaagtcagatataagaaatataaactgcagtatttggatttggatttaattaatctgctaagtgttgagagctgaaaaagattaaatcaaggatggctttctcacactaaattgtggaatctgtgcttggatgcagctggcagaaaccatctctgttcatcagctttgcacactggccagtgttatttcctttctcccagggtaaaattattagggcggggaacagtagagaaacaaatcacactaaccaaactcacaggggacagatttctaatttaaaatgccttttatcatgctctgcgaaatgtaaatgtcacacagttggtaatattcctgttagacaatcagtgtatccttttatcaatagaaaaaatacccttagaaaggctatcaatttattatggtttcttagtggttctagatcaaagaaaagggaatccaatgatgttcactcatatatttctttatttttaaaattaaattaattttttttacaaattatgatgtttcatattcatagaatacatagtgaatttttgatacatataatgtattgtggtcagatcagggtaattaacatacatttatcatttctgtgttgggaacgttcagtattctccttctcgctatttgaaactatacaatgtattattgttaactacagttatcctacagtggtacagaacactagaacttacatcccttatctggctgtaattttgtatcctttaacaaatacttccttgtgcctcccttcccccacacccttctcaatgtctagtatcttctgactactttttactactataagatcaactttttttagcttccccatgtgattgaaaatatgcactgcttaactttctgttcctggcttttttcacttaatataacgtccctccagttctacccatattgctgtgaatgacaggctttcatttttttatagttgggcatatttcattgtgtatatacaccacattttttaatctattcatctgtttttggacacttaggttgattccatatcttggcaattgtgagtatgctgcaataagcacgggggtgcagatgtctctttgatatactgattttcttttatttgaataaatgctaagtagtgagtttgttagagcctatggtagttctatttccagtttttttgagacaccttcatactgttctccatagtggttatactagtttacattcttaccaacagtgtataagagttttcttttctctgcatcctcaccaacatttgttattttttgtgttttgataatagccatcctaactacggtgagatagatgatacctcactgtggttttgattcacatttctctgatgattggtgatgttgaacattttttgatacattcactggccatttttatgtcttttttctttttttcttgaggcagagtcttactctgtcacccaggctggagtggagtgggtgtgatatcggctcactgcagcctctgcctcccaggttcaagcaattctccagcctcagtctcccaagtagctgggattacaggcgtgcaccatcactcctggctaatttttatatttttagtagagatggggttttgccatgtttgccaggctggtctcgaactcctgacctcaagtgacccgcccctcttggcctcccaaagtgctgggattacaggcatgagccaccgtgcccagccatttttatgtcttcttttgagaaatgcctgttattggtctgatcgagttttctatttcttcttgtttcagtctctctttttttttttttttttttgaaacaaggtcttactctgtcacccaggctggagtgcagtggcacaatgtaggatcactgcaacctccacctccaaggttcaagtgattcttctgccttagcctcccaagtagctggaagtacaggtgcccaccaccacacccagataatttttaagtatttagtagagatggggtatcaccatgctggccaggctgatctcgaactcctgaactcaagtgatccacccaccttggcttcccaaagtgctgggattacaggcatgagtgaccacacccagccttggttcaatctttgttggttgtatgtgtgcaggaattcattcatttcctctagttcttcaaatgtattggcatatagttgtccatagtagtctcttatgatcctttatatttctgtggtatacattttgatgtctcctttttgtctctgactttatttatttaggtcttatctcgttttttcttcgtctagctaatgatttgccaattttgcttattgtgttataaaaacaactttttggccaggtgcggtgggctcacgcctgtaatcccagtactttgggaggccaaggcaggcagatcacgaggtcagtagaccgagaccatcctggttaacacagtgaaaccccgtctctactaaaaatacaaaaaattagccaggcgtggtggcgggcgcctgtagtcccagctactcgggaggctgaggcaggagaatggcatgaacctgggaggcagagcttgcagtgagctgagattgcaccactgcactccagcctggggacagagtgagactccctctcaaaaaaaaaaaaaaactttttgtttcattcatcttttattaatcttttattcttaatttctttcttcacccacttgtcattcagtagcatattgtttaatttccatgtatttgtgttgtttcaaatgatcttcttgttattaatatctaattttgttttattgtggtcaggtaagatacttaatataattttagtttttaaaaatttgttaagacttgttttgtgttctaatatatggtcaatcctggagaatgttctacatgctgatgaaaaaaatatgtattctgcagctgttgtgtgagatgttctatcaatgtctgttaggtccatctggtttgtggcatagtttaaatctgatgtttctttgttaatttcctgtctggatgacccaatgctgatggtggattgttgaaattcccaactattatattattgaactattatatcactggggtctatctttccctttacatctaatacttgctttatgtatctgggtgctgtggtgtcaggtgcatatatatttataagtgttatattattttgctgactcaatctttttattattatattgtatcctctgtctctttttatagcttttgacttgaagcatttttttttaactgctgcaagtatagctatccctgcttacttttggtttctgcttgaatggaacatctttttccaatccttcactttttgtctatgtgtgtctttacaaatgaagtgagttttttgtaggtagcatataattgggccttgatttttttttaatctattcagcctgtctatgtcttttaaatggagaatttaagccatttacattcaaggttattatttcataggtgaggaattactcctgtcattttactgattgtttcctggttgttttatatatcttttgtttcttatttcctcttttattatttatttttgtggctgggtccctatctgtaatgataagtttttattttatttatttatttatttatttatttatttattttttgagacagagttttgctgttgttgcccaggctggagtgcaatggcacaatcttggctcaccacaacatccgcctcccaggttcaagatattctcctgcctcaaactcccaagtagctaggattacaggcatgcaccaccatgcccggctaattttgtatttttagtagagatggggtttctccatgttggttaggttggtcaagaactcccaacctcaggtgatccacccgcctcggcctcccaaactgctgggattacagacatgagccactgcacccagcctgattcctttctcttttttccttcatatattgcctctactagggagttttatagtttcacaagtttttattatgtcatttatcatctttttacttccaaatgtaagacttccttgaacacttcttgtaaggccagtctggtaatgatgaatttccttggtttttgcttttatgtgaaagattttatttctccatcatttctaaaggatggctttgctgggtataatatttgtggttgggaggtttttttttttcttttggtactttaaatatattattccattccctcctgtcctataggggttctgtgagaatttcactattaatctaatgagggttactttatatgtgacttgatgctttctctgtctgctatgattttattaattatgctatcctcatcttttcccttcttttctgcttcccaaaacactgaaaatataaatatttgttcacttagtagtgtcccataagtcctgtaggctttatttatttatcttttttctttttttttctgcttatattatttcaaaagccctgtcttcaacttcagaaattcttttttcttcttggtctagtctgttgttgaagctctcaatggtaatttttttattttagtcattggattcttcagctttaaggtttctgtcttgttctttttaatgatacccatctctttgtcgaatttctcattcaaatcatgaattgtctttctgaattcattgaattgcctatattctcttgtatctcagttttcttaagtttattgttttgaattctttttctgggatttcacacattttcttatcattgaggtctgttacttgagaattgctgtttttcattgacagtgtcttgtttccttgctttctcatgtttgatgtgtccctacactgatttctatgcacgtggtaaagtcacttcttccaattttatgaagtaggtttcatatgaatgagttttagggtattggtttggtagagtacattggctttgcttctaggtggatgcaacagtgtactctccatgtagtttcttcagctataatccatactagtagcataagcaagtttctcagtggtctaggctgagagagtctgtggcaccagtggtgtggctttgtaggattggggttgctgggctgtttctcaggttggaggcatatatatgcacacagtgtgctagctaacttggagtcactggggttggagctatggtactgttactcttgccacaggcacaagcatgcaattgcttgtctgacctagaattgtgcctgccaggagtggtccgtggaactatttctcaggtctacatgcaggtgcaaggctcttcagttggcctgggggtatgcccaccaggggcaacctgcaaggctgtttcttaggcactgatggagagtacaggaccattgggtaggccacagccatgtctgcagggggcagggggcaggggcactgcagggctatttctcaggtcctgagcacggtcacatagcgactttgctggccaggggcagatcagctgctcagagactcaggtcctctcccatttaggggagggcatgtagcagtttggctggctcaagagtagagttgccctgggcaagattgctatactcttcccccagctgaaagtgtagtgacaggagttgttttccctgctgtgcaggaccagagtcatagctgattctgggcccaggctctgcacagctggggttgtggcattcagctacctgtatcagcttgttggaaataaaatggagtcccagtgctggagaggtgcagtagatactggcccccagagaagggtggaccccagaggtagctctggtctcaagatggtgctatgctgcagaagcttggctcacaggggtgtgaggtatggggagtgcaaaccttgtgctcctgctacagggcaatacagctgcatgaattcctagcggctctccaaaatgggcttagggtttgcaagagctttgggattctcctcttataaggactgtaggtgtttgtggtggcagtgggggctggtggggatcattttacattttctcttcagtggaaagtccttcctaactccaggcagatctgatccagtttggatagacaagtctgcagagattgggtgcttctacacagccctatggtgatttcaaatcaccctatgtgtgtctgcagtctcttgctgcacttagcattctccctttgacaaatcgtagctgtctgttccttgccttggtccttttctactcatgtatttcttatcctattgagctctcactatgtgccaggcatgtgatgttaagggataccattgagtaagtacaatgctctttattgggatacagagcaagtaaacctgtatactcagccaactcaatgcaggcatcctctcatttccccattgaccatactgggcagtaaataatctcaatccttgactctttttttccttgacttcacacaaatcaactccattttcttttaatggttttaccttgaaatttttatcatttattagactactgataaaagagaagtcttaccctccatctgagaaatttggaagacactctagtcccttgatggattttgagaagtgtgctgttctcaccagaaaatcgtttgttcatcctatcttggagtgaattccttctgcagatggctaatctcatggactttgtggcacttacttaataactttattctcagtggatgactttttcttgtctcaatcccaaatcccaaagatatactctctttgatgcctgtaggcacctgctttcagctgtgtacagactgacccatgatatttcatccgtgtaagccattagaatagttttctccactaaatcttggtactatgccctattgtctctattttacccttaactttacttaactggcatttgcatggcttggctttatttgacaaggaagtagccatcctaagaaagattcatcatcatctcatcctctgccttgagagttcagtgaaaaagctagctgcttctggagagagttccttttccatattcaaacttcatcaagacaagggatgatttaattacgactttcagaatttgtcactatataaagtaaaatcatttgtatgaagcttcacatagtgttctgtgtctaggctgtgttactattgaaaggaggtagatatagacctcgagaagaatttcttgattttaagaattggcagatattagtacatattagaaaggataagaaatcccaagaacttgtaaatgaagccaacagctagtggaacactgccaaaatataagaagatggacattagggatgtacaaaggttaagagtgtggactttagagtcagattttagatcttgtcctggtttaccaagtgtgtgactcaaccattttcgcaactgtaaaatgagccttgtaaagtcatctacttcatggggctggttacaggattagaaaataaatgcaaaaaggcctagcgtagtatgtgcatatagtatgtacttaataaatgttagttacatttaagattccatatcctttgatatcacaatgaaatttcattcatttgggccctagtaattaaaaatgtattacactatttgctctatttcatatgtatcctccacagcaaaaataacttcctaattgataatgcatatgttattgtaacctgaaaatcctaaacagacagaagttatcaatgtttttgttgacaattcataaataggctgagctggaaattgtctcctttatcattgaaagcctattgaaatgttaagaagttacaaggttatatttaacccatttcagagaaaaaactcttttaaaacacttagcactctttgcatataagcagccactctgccaatcataaatgatccttatctctttattaaaaccaatatgacagaacattgacttctcagcactttaatagttcttagttcaggtgttgaagtgtaacgatcttgcatttcttcaaattttttcagaaatatgtctttccttgtgagtaaatagagctggtttaatttgttttatatcataaatttcccacagggcaaaaccaaaacgatattttgtgaaattccatgcttggtaaactccatctaaaaatgatatggctgacagaattgttcactggtttagtcacgtcataactaaaaacaaaggaaaagtgattctctttctctccatttccccattaaccccactacttctcccagccaattaacagaaatctattctttaattaaccctataaatatatacacctactatatacccacaaaaatttcaaaagttaaaaaaaaccttttaattagccaacatctactggacacctgctcatgctgggcactatgttactatctctagagatatggagaagcacagtggaatgtacattctaattgcggagcaaaacacacgtagtatggaggtggtcaaggaatgaggggtgtttgcttttggatgcaaagtttctttctggggggtgatgacaatgttctgaaattagatcatggtgattaacctttgtacatccctaatgtccatcttcttatattatggaccaggatttgttaaggccatagactgaccattgcatagtttcagaattctaacagaagtaggaaaatgctaccatctggtcatgcctggctaaagacacagactcaggggctgaaataccatttttttagtagcactagcctttggttgagctcctattcttgcttttctacagctttggtctgcaattttggcccttcttcaggcaaattgatcaaaagccttacctcccacttctcttcctaaagcctgtctctgggctggggcccagtagaggacgagctaatatgccagtttgtcctgctgctcagcaatccctacttctggctcaaatgtcacccacccggtagcagaatgacctttccttgcagttctggcccatccagttccacaggaaaggggagacaagacattgcaactgtaactagaatctggaaaaagaagattttctcatttaggagcttgggaatagaaacttaagaacaaatcacagatttttaacaattggagatgaaaataatttattgcagtgtgactttagtggctatttcctctctacagaaaaaaaaatatcacttgtgatttttctttcaaagtaaagtttaaaagatcagagtgccccaagcgatgtttccctggggttaaaaaaggagcaacagtgccgcagaacatctcataaaaacaaatggcatttcacaatatggtgtagctattgatgggtggaaatgaatcaagtgtttcctgtaagattgttgtaatgcactggagaaagcgggggaagaggtggttaagtgtgcaatactgtgattgtgattattaccattaacacaatgcagtcacatgtggaatggagtcccctagggtgctctgacgttccagtactcttcaagcgccagagtgacatcctggagcctgccacctcagtgagcagcacacttctggcctaaggccctgcttgctgccctgtgggtatcaatgtgaaaaggcctcagccttctctgaggcttcctttgctctaaggacctcctgggagcaaagtggacagaagagtgtcggcaaatcaggcctgcgccacagccaggaagtgtgggttcatgttcttcacgtgcaccggaaggtattagaatgccctccttgaaaagcagctgctctttcatctccattgagaccagagcaaaaaggattagatttaaacacctgtaagaagggttcttgttgagcatgggaaccattttgtggtaggggattctgccagtcaccagaatggtttccccaatcggccatggggtttctcagaaaaatctctaagggcaacgtacattctcattcatttaggacagtgattcttactatatatatatatatatatgtgtgtgtgtgtgtgtgtatatgtatatatacatatatatacatataggtatacatatatgtatatatgtgtatatatagttttatagaggtataattcatataccataaaattcacccatttgaagtgtacaattcagtggtttttagtatgttcacaggactgtgccaccttcatcacagtcaattttggaatattttcataaccccagaaagaagccccctgcccatcagcattcactctgccttttccctcactctctaccccagcctaggaagctactaatctgcttcctgtcttatagatttacctattctgggcattttttataaaatggtctcatatgagatatggtcctttatgtcaggcttttttcacttggaatactattttcactgttcatccatgttgtagcatgaatcagtatttgtctttttgtgactagcttattacacttagcataatgtcctcaaggttcattcatgttataacgtgtgaaaatttcctttcttttaaaattgaataatattccattgtttatgtataacacattttgtttatccattcataggttgataggcacttggattagttctaccttttggctatcgtgaataatgctgctctgaacatgggtgtacagaggagggtaaatcttaaccttaaatgtgcgtaagaaacctcccaaggagcctgttaaaaatgcatattctgaagccccatacacccctcttgattcccattgttcagtatgtgtagagtggagttcagaaacttttaagcacttcaggtgatttgctctgtcacccaggctggagtgcagtgacgtgaacactgctcactgcagccttgacctcccaggctcagtggtcctcccacctcagcctcccgagtagctgggattacaggattgtggcaccacactcagctaatctttgtatattttgtagaggtggcgtcttactatgtaggccaggttggtcttgaactcctgagctcaagcgatcctcccaccgtggcctcccaaagtgctgggattacaggtgtgagctatggcacccagcccataatttaggtgattctaatgagggtgaacctccaatcctatgaagtcagggtgtagaatcacagccgtttgtcactagagtgtagtctggcttacactgcctctctctgcttgctctttcagtgtccaccatgaagaggacacaggttggcttttgcttctgctcctctttcctcagcatagctaacatgttttatcaaacaaaacctttccaagcttttatttggtccctaacatcaggtgaacctgaagggattagtgtcccgctgtacctgtagtggtttttggaaagggtaggagtgaccctttcaggatcaggcatgaggaagcctacaacagagatgtgctggaccacagtgcaaagctcatgcatctcacgaacagtgccgcctgcctctgccaaagagattagaaaggctttgttaagggaaggatgagaaagaatgatcagagtttctacagttaagtgaaaggcttcactgatttgctgatgaagaaacctacatgagctgaaaatactaattctggatgatgtagtctgagagacaggtgttcaaggctgtaagctaaatcagtaacttatttatcaggaggtctttgtcagacttcacaatcggcttgctgtgtgactttgggctacttatttgatcttgctgaaccacactcttctacccagtagattggaagtgatcttcaaagttataagactctgtttctgaagtatcattgatccagcttcccactgacgttggtgtgtacgaatgggagattaaagatttctcagaacaagctcaaaatactgagaactgatctcaaaatacagagatactgggaggtaacagccataaaatctgagttagtgaaagaacaaaggctgtagtggttgcattagtggttataacttaggccatgagctttaagcacccatgggcacacacagttgagggcatgagcatcctcatacacaggtgattgaatgaaaagactgattcgcttggatagaaaatcaagccccacttgattttctaaacatccctgtaccccaaatctaaactactaaatgctaaaatactaatgatattgattttgatcctgaatatcttattttatgacaaacttatgacaagagatcccagcatatctggtcaatgagaagcactttaatttccagaacctttatttatttatttatttgagatggagtctcgctctgtcacccaggctggagtgccagtggtgcgatctcagctcactgcaacctccacatctcaggttcaagcgattctcctggctcagcctcctgagtagctgggactacaggcacatgccacaacgcctggctaatttttgtatttttagtagaggcagggtttcgccatgttggccaggctggtctcgaactcctgacctcggtgatccacctgcctcagcctccaaaagtgctgggattacaggcatgagccaccacacccagcctccataaatttttatatctataaatctagaattctgtatagaaatacagctgtcatgatgaccatcttgatgaatcttgagcagtgtaagatatcagagtacttttggaatcaccaagaaagattgtttcatttggtttactggcagtgttaaatctagttaattattttctgattatttaacttgatgaaagtttatggtatattgtgattgttaattaacataggacttacaatttagccaaaacaaaatggtagcttactttttcagtgtatctggagaagcaggagagtgtacaagttagtagttcatgttccagctttgccatttactagctgagcaacgaaatacttgagcaaattacggagccattttctgcctctatttcatcagtaaattggagaaaataatggtacctactaatggataaaatgagttaaaatgtataaaatgctctgaatagtacctattatatagtaatcattcaacaaatgttagtttattattgctattgttgttatcatagcattttctagtttgcttggcacttatgcctatcttttctcattttagcctcatgataaccctgtaagttaagtaaggcaaatgtcataaataaggaaattaaggattttttttaaagtgacttgttcatggtcccaaagctagaagtgttgctaagtggggctagatcccacatcttttgactgataatctatctctcaccatatcatgatgtctccttctcagcatgctgaataaataggtgccattatttctggcacattgtctctttaatagccacatattcttagggttccagttaaggttgagaagctgagatcatgttggcttctgagatcaaagataattttactgacctcaaattgtataccaatatgatgatagggtgttgagatgcccagggtaaaggagtcacatttgataaaaccttgtgtggattatcatcttttcataatggctaaatcttttatgataccgttcaagctcagtgacttcccaaatcatactaataagtacaagaagtgttagcaaaagagatgaaaaaattgaacttgtaaatgagacctttgtaccaaattcttggatgttttttcttcaaaggctcattcagggatcttgaattcttcagtgggttcttggtatcttatgacataaagcatcctcccattaggtctgggaaaatcaccacaagcatgccaatagttctgatatcttagcaacaaggatcttgcttagatccatgcttgcctttccccaaatctggattgaattactggaagttgaacgatctagctctaaagactgcacaaacattataaaagagagctctgttaacaccagatggccttatctgcagatttttaaaatgtagactataagagagccatataagcattgtccagagagacaaaaggaaagaaaaatacaagccacaatggtttgaaatatccagctctattttatagaaccttgactctactgatgttcttcaaccccaatcctgcagttattcatgtggattttaacgagagtagctagtgaaattcaagctcagatgtagtcattgaaccaaatagtataacgactaagttggagattttaactcacgacacttgccttttgttgtctagcttcaatactatttaagaaaataagtatttctaggttatttgagggattttgacatggatgcaaaatattaatctgttctttttcctttggccccaggagctgggatgaaatcacatgatttcatcattttgaatccatgcggctcctctgagatagggccagatgtaaccagaaggatttatagggtgtaaaattcagaatggattagaaaagcctttctatgttcagcccaacacatcctaaatcaacgtcccctgaatggaccagagcaatctctggctggcctagtggggaggttgtcatggcaactgactggcaagctcagccagtggaatgtgaatgcaaacaatagagtgataagactgtgtacagagcagcatactaaggctgcttctgcccaggtacagtggcacataggtgaaagtgtgaaactgttgctgcattttgtaacttcttaacaatctctggcagctcatttgaaatttaccaagtgccctttcccagatgttggtaaaaacattcctgctgatagataacagaagctatggaaaaatcagcacccagctgataggtgcagaggtatacaaagccctggagggctgttggaataacactactcaaaaattttctgaaggaggttgaagcaggtttaaggtaaatcttatgactcttcagtgccatcttgtgtccttttagatactgacaatttactagaagcccactctcagaccgatcattaggcagcagcagggcagacatggaaaagttagagctggattatattggagcttggtattcccttttacagcagaatatgcacaccaagccttctgagctttaaattgatttaaaaaattgaaattaaaaattttggtagaatctggaaataaaaacagaataagatgccaaataatgccatgaaaagattgcaagagtctacatggtgcgctaggggttgagggaagggatggaaaatctagatttagtgttgaagattcttacagatagatttggtattgaggattcttactgttgtcattactaactcttgcaatagaatatttttaatctattcagtcatgctgataatgcaaatgaatcaacagagaaaaataaaatgtgaacatcaccaattccactttataactcttttgttcatggttaatggagtaagagatggtagcatttgcttaaatggtacctcatgcccacctctaatctcttacctaccccaaacctaccacccactgatgtctcaccatcacctcatcactattgaaagccataatcaagtcccatttaatttcagaaatgcaaaataaccaagatgtgtttctgtgtgtttcttccagggtttgagttttttgaaacaagtgccaaggacaacattaatgtcaagcagacatttgagcgccttgtggatatcatctgcgacaaaatgtcagagagtttggagactgatcctgccatcactgctgcaaagcagaacacgagactcaaggaaactcctcctccaccgcagcccaactgtgcctgctagtgtccccgtgcacacaggcagctccagggggctctggttgccaacaaacagcatttgtaaatggtctattagccttcatttatactgcctaacaattatttgaaggaataaattgatgtcaatggctcgtacgcattcaattcttgggagctttcctgtttaatatgtggcaaatatgtgatcttaaatttataaggactatccatctataaacatctggtacctgcatgtgacttgttatttatttgtctgctaggctctttttgtttcaaatttgttctcagactacttctgggacatcagactataatctcactacaactggcttttgtcccattgattcaaattatgctattcacttgtaggaatgatgaccaaggaattgcttgtgtgtgtgtgtgtgtgtgtgtgtgtgcacgcatgcccgcatgcgtgcagaggaagaagtcacaagacttcatttgctttactcttagttgaaaatcaaatggaagtttttctcatgattagggacgctgtcacgagtctggtcagtttactgttgggaactgtgtctttatttcactgttattaataactgagatcattggcctataaagaaattgaaatgttgtttttaaggtccttgcaattttcctaagtcattaatattacctgactggggctatttaacaataatcttcgtttacacatttaaataagcaagtatctacccaggactgctttttccactgatccttcccaattctgtgaatattcaacatcattgaacagattgagacatatctactgaatgccagttatgcaacaagcattttaaccaagaagggtatgagtagctatggaattccaaggtccaagcccccttatttttcaatgacttgccttccccaacccccataatgcacaccaccaccaccatcactttctggaaccatcaccaactcttggactagagcttatgttgaagcttgttagggctcctctttccgtaggatgtagacttgcctccccaaacacggccatcttctcaaacctcagctaagttcttttacctgtttagatgctatttaaatcagatttcaaagggtccccagttgagaaaaaggaaaattttaatctttaatcatctttttaagtccagatgttcataaattctaaagcatattcctattacgtgaatgcttaagttacacaggaaacattctataactgtagtatttcaatttcagaaatatttaggatccatagcaatttaaaagagggaggaaaccactggagcattctaattttgtatcacaaacttcctaaaggacctatatgaataaagagaaaacaacaaatcctaccagctgtacagagagcaacagggaaatttggcctctgtatcactgtccagcattatttaaagctaggatttaggaaggaagcaggaattatttggcagatttggaaggatagtttcgttaagtgaactttctacttttttggtggttatgtcaaagaatttttttcctcttctcaaaaatagagaggcttcccatgaaagtattggatgcaaatgaaacaggcatacatctaaagatatctttggagaataaatccttacaagtcacagaactaggtcacacacattagtaagtcaaaagttggaaattaggggagagagcatttggaatgctttaagcatttccatgttatttctcaccttcctagttgaagatccactaatcagtagtacatttctactttggtgccctacaaagcaaaccttagcatagtaaagacaagaaaacattaatgttttattagtttttaatggggcaaccaacttcaaaatcacaggaattacagtgacgggagagaaagaagcaggaggcataaaaacagatttgtttgtagcagtagtctgtttgtacaatgttataatatttctgtaacttgggccagaatgtggccatgttaaatgatatagctattaagctcacttttacaatctaaaaggaactaataaagccaggaaacccttctcatcctccttcacagccctcatcccacacatagatgtaaaaagcttagaaagaatattctgatggctttttcagaaggaaggaccttgatgtgtgtattgtggtaaaatgaaaagcaaaatgagacagtatttaaaagtgaaagagcagagttttgctctgctgaaaaccccttccctgaagaactgattgctgttgaagttaattggcccttagatgggaagccctaagccaagctcccacttacacagtgtcaaacatcccgaagtggaaacattttatgccagtcaggggagagacaggcaacaatagcccaaatgtcattgccaagaaacatctgatactttctaatttctaaaccccaatggaagtgaggcctttttcattgattctcagttctgaaactcccaccctgttaggatttccattccaaataattcaatgagaggtttccagagaaacagtcacagagctcaagagaaagaacacttaaatgctcctgctgtaattgcatcaaaaaatccgggttttaacatcaaatttggcaaatggtgggaccaacccaaggttaactaagtgggctttcattggcattgagctatgttacttataaattataacactatagttccaaggtttttcagccttttggccaacacacacacacacacacacacacacacacacacacactataccatcatctatcaatagtctaaatacataaataaatgcaggtcatttttatcaatggcctaactaaatttatatttaaaagaacaagacttttaaaaagtacatactcctgttggtttgtaagttatacacatttatctcttgtctttgatttaattaaattagtgttttaagtatgaatttattttcctttgctactcattacctgaccactttcactcctctagatacccttaggaataaacctgaactgttccaaatcgattcttccaagagctttggtgttggtaccttcctttcttttcctaatgcaactgaaaaattagactgaaaattatttgacttaaatagccatcctcagagtgaatcagcatttcagtttttggagatggggatggaagtagaaggtgcacaaagcgtcctaagatggcagtttgaatgttagcatcgcatctacatgctcataagaggaattgcttcaggacaatgaatcagttcattgttgctgcccccagtgaacagctccaactgccttgatgaacttctaatgactgtgaaagctaggaggttcttctagttcctccttagggtcacttgaagttcagtatttttttgctgcctggtaactaagtgctaagatttttacttggaaagaaaactatgacaatgccttcagttgtagcagaaagttgtggcattgtgataataaacaaaatctacaaagttacaacccaaattatacaagacatcaaaacactcagtaaacaaatatatatatttcacctacttaaatcttattcatattaattataggccttttgtttagtacactggttattttttaaggaaccaatttaaactttcaattttaaatacatctatgctgacgatagactttcgggtatatacaaccttcttcttctcttttaaaagttaaatacattccactattaactgaacttccatgaagcaacattaattttagagcatggtagtccataatcagtggttcattgtgatgtgctttatccaacatgtatcttagtgcatggttgaggatgtactatgtgatattttagttaacagtgtggcatttgtgggactatattaaaagcatatccaaactaccaagctataccaagctgaggtaggtaacacctgcatgtgaaaaactgtgatatgaatcttatttataaaaaagtcataactaaaacccttctagaccaaaaagttactgtgtgtttgttaataatcttcatagtactactggaatgctcaatcagttatttttggtgtggcatacttcagagctggcctgtccgtctgaagaaccctttctctcacaattacagtttgcatgactagaacccggaactctgttcctttgcgtgtatagtcacttagtgtgctgtccgggtgccacatgagcaactacacccatgtggcctttctgtcactccctggaaaatgcaacctctacagctctgctcagctctgcctgtgtgcattgattaccttcgctttagtagtttgcctgtaaaatggtgaagtctttctgatatgctgaacctttgagccagcttttgggagttcttcatattttaggtgaatttttgaccaaagtcaattaaagacataaacctgttttatatcatggaatttactgggccaaattaagtaaaagatgaagtttatgaccagaataaaaaagcctttacccctgcacagcactgtatctaaagggctctaggttgtagaaatatagtaccccctaacagggaaaaaccaagttgggggatttatctaaaatgtatctacctattgttactggtatttcacaaataatttttttcttaaaaatatttacagaaatgcttgacactccggtcaaataatatttccctttgatagattgaaatatttgcttttagattacacatacagtgctgcccttctcaacagtcactcacacgctcactcgcctgtacaaaggtatcaggcaaacactgatacttttttttaagaaggcaaaattccatctatggtgctttctcagtgctagggaaaagggagcttttactatgttccagctataactcacatcttacttataaggtccataaaatcggttcttcacactgatttcgtttgattagtctgtgcatgtaattaatttcctccaaacagagagagtggaggggaaataaattttgcaagcattctagataacagaaatgagtcattttaaaacctcactcagagctcgagtgttaagatcagaccatctagctagtggacaaattgaactttctatttgcagttctcttttactttctgactttcttttaaattactgcagtttttcaaaacactatcctcatggaatgacaggaccaagaatagaaaatgagactcaaatttcaccatttacttcccatcagcaaccattactggtggagtttcaaacagtcattacttgctgaaatgaggtttgaggttacctgtgtatttcattcacctgtgttaatatttccttcatcgtggacaagtgagagttggctgtggctttatttcttgaggcaaattattttgcattcatgttatttggggctaggtattgcttaggttcgtgaatgctgttcttacagacacagatggtacctgagcccctcagacacctgccctttcagggacgtgagcatgacttacatctgtcaagtggttccatacttcttgtaaaagtaaagtttgggtattgtttgctgtatcaatatgatggctttccatgcattgtctcattatccctaggatacgtgctaaaggaaaactgtcctgtaattcctgttaatatattgttaatgtcagacgtgatgtgataccgttagactgtccaaatgtacaacaatttaatggtgtttgtagaactgatatgtcttaaatgttgcatgaaatatgttataaaaatagatttgttttctattttcaacacctcagaattgagggttcatgggccaataagtgcaatatttaatgactcactcagtgtatataaactagtatgaaagagtgaattataatgaatgtgtgagatgctttgatagctgtgtgacttattcaaatgattttcttgtagctgtatttgtctagtggtgcaatttatacagtaaatatcttattggtgtcatgtaaaacccctctgtgcctacttcaaaatacttttttcttataaaaccaaacatttagtatctggaaatatgtgtcaattttatctcttagaattgtggattttattgtcaagacagaatggctgttcatttattttataaaagcatctccttctataactcaaaattttctttaagtgtcatataaaagtgtacattttacttttaagcaactaatttagatacctaagaaaaactatgtgcattaggaaaagtcatgtttttcttctcagaaaggttgatcacatgacatgtctactaagaattttcacctctgtacttgtatgtatattttattgttactcaatcttgtattttatttacaaattcaacactgtcaaccctgggaattctaaaataccaatgtatttttaggttgtagctaatgttgtattcactttcaattctcagttgtccacactggtgatataagaggaacaaatcagaatcattaaatactttgtaatgccatcataaactcatatattcatcctcaaactcccttgtttaatgctaattggtggcctggaacttcactgagatgcaaaatcaagaactgaagcctagttgctagataacgaaaagctataaatgtttatgtatgtgaattttaaattagaataaccgtcttaaactcctacttgccatttctaaggcaaagcattcattttaatattgtactttgccttttcattcagttagtggagtaagtcatgaaacccttaggaagaaaaacaagttatgacttattcactaaaattgatgcaagacagttggttctagatgaccatggccatgtgttcatcatataaaaccttcagttctctctatggtgcttggctggagattgacatgtgaggatgtgccaatcatattaaatggatttggtctatgtgggtgatatgtggcctgaatgtaactgtgatagactgaaatttgttcttagctctcaaaatccactgaagaagtcaagtgaaggtgggtaaaatagggagattagtgacaactttgtgccaaattttttaaaaaatggaagcaggtagccaatattagaatgataatttaagggtgtggttgaattttagttagttgtcacatagttattgaacctcatatgctcagtgctgtgggaatcaaacatggaagaggtatggctcctgcccctaatgagaacaagggggaaaaatccagatataatctaaatgctaggttatgtcagggtataggaacacagagaatgggggacctgtaagaactggaagagtcagagagggctccattgaagaggtcaaacataattccggaaagaattaggtagtgaggagattgtgccaggaaaataagtgggaaaggccacagttatgtttcctttgaatggaagagagacaaagctatcagctatagatcattgttttcttaagacagccaaactggccctttgaaaccattcaaattaccccagtttagctccctaccttttagtctccgtgaggaagacaagctgttgcattatcatattcctctgtgctgagcagctcaagactcagccacaatatgcaaattgctttaatgccatattacggcagttgatttagacatttgccagtgcaccaaaccatgagagattgtccgacctaatgccacctggcagatgtgtacccagagatttttctgtagctccatgtttcccataaagggcattggaaatgcacagatgaagatcttcctttggaaccaggcacatttggccccttctcagtgactgcactgtggaactcttcttaagaaaatattgaaaacagcttaatgctttcatatagtgaccgacatttagttgaaaactactgctgcatagcaaatattgtgactcttcatgtgtccacaggagctcttgtgtgggtttaaagctatgaagtgtattcacattgtgaagttttaattatctttattgaaattaattgtgtaaaaatggtatgtgctctattaggtattcagtttgtatgtgaattctataaagaaagtggtttttgttctttgagtttgttttatttcttgaagattacaataaatatctaagagactatattcctgaatttcttagccttagtctgattaatgtttttcatctcctttcaattcatattatttttcatcctaggatgcttatttccatttcttctcccacttctataatcttaggtacaacactgagtttgaactgaagatgaagagtgaacacatttagggctttgagtatctcacacatgaatttggacttaggcacaggaatgaattctaatacttgtaatctttcaaggtcgataactttctaactgacccaactgactgggttccagagttacaaagcttagctgtaggatcaagaatagctgctaagggagataaaggtcttcaggtctgcaacttgaagaccatgtgtccctaaatgaaaagtctaaggtttgatgatcacttagcaccctactggcatagcccgaggcaagggcggtcaacagagaaaacatgtggatgggatgtgtgaatggaatgggtgtcatttaatgcacagtgcttggtgcagtgatgattaggatgccgtgcaggatctccttggccatgggcctcaaggcatggggaagcacccagctaccaatctatttgtatcacagcagacctactactaattttgcaatcttgtagcattctacttgtactaacagcactgattctatggaatttcttccaaatgttcctcagggcaatttccaggaaggagtctgcactgaaaatcagtcaagggggaaggtccctggaagagccacatgagtcccatgggtcaaattagcttcctgaactgaacttggtaatagaagggtaacctccctgggtagacaaagcaagtagcacttaagaaaccaaaaaaaaaaaaaaagaaaacaatgataataaattaagggatttccagttatattatcaacaaatacttacaaaatgccttctaatgctaatttatcagtatttatcagtatttatcagtatttcagtaatttatcagtatttatcagtatacatgaaaatacatactatagagtcctgaccctccatgaacttaaaccattgtgatagaggaaaatgtgtaagttaatatcaataaaaaactcatcattgataaactaaatattccttaatatatatgtctaataaatacttaaaatgaacattggaaatttgtttcatttcaaaagagctcacaaaaatttcctctttgaaatgttgtaaaatgcattttttggactgtagtcctttgcccccagataaatatataacaatcaataaaagtcagttcaaaacttaaaaaaaaaaattaagagcccagaaagacttcacatgtttcctgattattctgaggctcttgtggcagaaccagatccaactggttttagcaggaatctgcctgtaccctattccctcaagtaatatgcccttagcttttttaaaattaattttaaaacatgaagttactatgtggccacttactcaatagcattgagacagtaggcatgaaacagaaaacatctgtcaccctcagaaaatgctaagtcattctctcctcaacttcctaacagacttgaaaaggacaccttctatataaaaggccacaaagtctttgcacagttctcagggacactccacctcttggttcttggttctcctctttctcctctaacttctcaacccctcacccagtccaaagaagctttagtctgatagagactgcctgctcatcttttcttcctaatctattgttaatgacctgagtccttttgagctagaatttctcattgtttattaattctaaatctcaggaaattttatctaaaaattatgttctcttttttaagtattgcctctcccttaaagcaattctgctaagtggaagaaaggcaaagggtatagaaaatatatggaaagtgagtgttggatgaaaatctggattaatatttcaaaacaatattctaccaagcagacaattacaatataatttgattagtgtcaatatagaggttaaacacaagctactgtgaaagcacagagagaagcaattattaatccagattgaaagcaagggctgggatgttctgagaaggcctactagaggaaacaaggactgagctaaaacatacaggagatgtaggaattatgcagaggcagatgtgagagaagactgctccaagcatggggagcaaaccacggaagtttagcaaagcatggtgtatt

SEQ ID NO: 345 - DNA, 26133 bp, Homo sapiens
ccaacgactagaggacagtggaataaagccaacctgtttggtctctgtcagccagaaatggagaagaaaacctggttgagtcaacaagagaaagaaaattagtatctttcgtttcagttattccttgtatttatctgtaattttaatttcatatctttctctccttgccatacacagagcaaaggcccaaacatgccaaatgtgaaccaaaatgtatatggccttcaccatttttacttcctccagtatctttgggccatctgaattcttgctagcatgtctaaccaggaggcagctgaggaaggagtgaaggaggactgtaaaaatacctctcaataatgatcaaccttggggtaaagcgatgcccatagatagagagatagataaacagatatagatatatatgtggttaagatggaacattttgtgttacatcaattatatcaaaatttaaaaattaaacaaagaaaataataaaaggattccaaagtgggagggtggtggcagcaggtgtggaagggtgtatcacttaggaacaggtgtggaagtgagctgggtagacttctgagggaagaacagtccaggcccaggggagggtgatgcaaaggccctgaggcaggggaacaggccctgagaaccagcaaggatgccagggataggagatgaacgagcaaggacagagtcagggacagctgtgcagggctccctaggcctctgcagtggctttggttttactgagaggaaaagggtgcgtttggagggtggtatggtttggctgtgtccccacttaaatctcatcttcaattgtagctcccaagattctcacatgttgtgggagggacccagtgagagataattgaatcatgggggcagtttccctgatactgttctcatggtagtgaataagtctcatgagatctgatggttttataaggggaaacccctttcacttgattttcattctgtcttgcctgctgccatgtgggatgtgccttttgccttccatgatgattgtgaagcctccccagtcatgtggaactatgagtccattaaacctctttttctttataaattatccagtctcaggtatttctttatcagcagcatgaaaactaactaatacaataaattggtattgggagtggggcagtgctgtaaagatccctgaaaatgtggaaacgactttggaactgggtaacaggcagaggttggaacagtttggagggctcagaagaagacagaacaatgtgggaaagtttgaaactccctcgagacttgtcgaatggctttgatcaaaatgctgataatgatatggacaatgaagtccaggctgaggtggtctctaatggagatgaggaacttgttgggaattggagtaaaggtgattcttgctatgttttagcaaagagactagtggcagtttgcccctgccctagcgatttgtggaactttgaacttgagggagatgatttagggtatctagcagaagaaatttctaagcagcaaagcattcaagaggtgacttgggtgctgttaaaggcattcagtttcaaaaggaaaatgcacataaaagttcaaaaaatctggtgatgggataggaaagaaaaacccattttctggggagaaattcaagctggctgcataaatttgcataagtaacaaggatccaaatgttaatcgccaaaacaatggggaaaatgtctccagggcatgtcagagacatttgtaacagcccctcccatcacaggcccagaggcctaggaggaaaaaatggcctggctcacgaaaccacagaatgatttcctgggccaggcccagggtccccctgctgtgtgcagcctagggacttggtaccctatgtcccagctgctctacccattgctagaaagggccaaggtacggcttgggttgttgcttcagaaggtgcaagcccaaagctttgaccgcttccatgtggtgttgagcctacaggtgcacagaagtcaagaattgaggtttgggaacctcttcctagatttcagaggatgaatagaaaggcctggatgtccaggcagaagtttgccacaggagcgacaccctcatgaagaacctctgccagggcagtgtggaagggaaatatggggttggagccctcacacaaagtccccactgggacactgcctagtggagctgtgagaagagggtcactgtccttcagattctggaatggtagatccactgacagcttgcactgtgtgcctggaaaagccagagacactcaatgtcagtccttgaaagcagccaggagaggggctgaaccttgcaaagccacaggggcagagctgccgaagaccatgggagctcacctcttgcatcagcatgtcctggatgtgggacatggagtcaaaggagatcattttggaactttaggatttgactgccccactgggttttggacttgcatggggcctgtagtccccttgtttggccaatttctcccatttgcaacagctgtaattacccaatgtctgtacctccattgtatctaggaagtaactaacttgcttttgactttacaggctcataggcagaagggacttgccttgtctcagatgagactttggactatggaattttgagttaatgctaaaatgagttaagactttgggggactgttgggaaggtaggattggttttgaaatgtgaggacatgagatttgcgagggtccaagggcagaatgatattttggctctgtgtccccgcccactatgatctggatggggtaaggaggtgaaagcattgataagccaaagtgacagcctcttttgtagacatgatcctgcctaaatttctcatgccccacagaagagggcactgaactccccacttctccagagcttcatgcagtccttgaagcactctctggctgtctctgcaagtggctgaacagctcctcctggtctctatggggctgcagaggctccaggtccctatggctcaggggctgtcacgctcaccaggtcccaccaagggtgccccccaccgtgggtggtggaggagaccaggtgtagctgctcttgcccctacccctctcctgacctgccaatcttaataggaggaagcagtagggatgagtggagccatggaggttgttcccacctcctaggaccacttttcctttcctctttcttggtctgtttctggaaatctatcaaaactacctccaatgccagccctgagaccctcccctcccccaccctggggcatcacctcctcttctgccacagcgggagggtggggtgtgctgtcatcttgcttccctcagcagctgtgtgagctccctgaggacaggggacaccccctctccctaccccaaaacctgtcccaggggctaccccatagcgagggggaggggacaaaacctctgccttccaggatgacctggctcggcaggagctgaggaggcgtctcctcagatttggggcctggacaagggctgtcactcctgtgtttccctttcggcaccacccaccgtggccccaggcacagctcaacctaaagccatggccaccaccctcagctcctgaagcctcatcatcgtcctcctcttcttcattctacttggcatctgaggagagttccatgcagagggagaggaaactggtacaggcttcctgaaggacagggtaacagggctcaccaagagtcaaaaatatccacatctgaatgaagaatatgtattcatatgcgtttcaaatggcggcaaagactccctggaaagatgagaagaatccaatcaaatttcgtcccgggctgtggccaatgagagtggatgcaggcaggggccggggagcctttcacacatgacttttcatggtttcgatcctgaaacaggtgaaaatatggaggtgaaggagtaaggaagagtggggccgggagccccggggacggtcaccaagtatgctcgccagatctgttgtgggccatgagggtccggaaacgtggaacccgggcaggggcgcgcggggctgctgcagtgacgaggcactggttctagatatttacccaactgtgttgtcataaggatgatattacaggtgattgctgatttcaaccacagatgactttcggggaaagttggctcctgagggtttcagtttccacctagccgcgtgctctccgggttctgcgtgctcctcccagggcgcccgctgtgccccagttctggacctgggtcctacccagtggaaaccaacgagtgggtgccccgccgcccaccgcaagagttctttatatattcaggataccagtcccttaccagatacatcattttcaaatattttctctcattctgcaagtttttttttctttctaaatggaatcctttttgaagcacaaaagttttatatttgcatgaaatgaaattaaactaccttttattttgccatctgtgctattggcatacagtacttaagaagcctttgccaaatccagggtcacaaaaatttactgctctattttcttctgagactttcatagtttcatgtcttatgtggacatctgccattcatctagagctagtttttgtgtgtgctgtaaggaaggggcccgcctcattcttctgcatgcagcatccagttgtcccagcaccattcactgtagtgtacaatgcacctgcccaacctcctgtccctccctcctgcactcagcatcagaagtgcgtcctgctgaatggttctcccagggtttccaccaatgaattcccctcatgtgaatcccatataggcatctgcttctcagaggacctggaccgaggagtggattcactggaggaaattatatttcataagatagaacattctgagaatagtaacacttggcataccccttactacatcaaaagtaagaaattggcctggcacggtggctcatgcctgtaattccagcactttgggaggctgaggcggcagatcacgaggtcagtagatcaagaccatcctggctaacacggtgaaaccccttctctactaaaaatacaaaaaattagccgggtgtggtggcacgtgcctgtagtcctagctactgggaaggctgaggcaggagaattgcttgaatccgggaggcagagattgcactgagctgagatcgtgccactgcactccagcctgggtgacagagtgagactctgtctcaaaaaaaaaaaaaaaaaaggtaagaaattgcatgatttggtcatttgggttccacaattcttatgtcaacatagcttatcaatgtttatttattttttcttatttctgttgttgttgttgttttctttgagacaggctctcactctgcacccagtctggagtgcagtggcaccacctcaactgcctgcaacctcagactcccaggctcaagtgatcctcccaccttagcctcctgaggggctgggactacaggcacatgctactacacttggtcaattttcaaaattttctgaagagacagggtctcaccatgttgccatggcttatctccaactctgaaaataacaagttacttttcacatggttgtatgacattatgtagacttttaaaattctgtataaataatttagacaatactgtattagaaaatgttttctacagccacagcttcctaaaaatagaagtggtattaaaatgtgcatttgtcaaatcttgaagaagtttcaaatgtttagggtgattctgacctctcattttggttgacacaataatccataaaaacaagtaaagtgcccactctgatctggaaggggtaaggaggtgaaagcattgataagccaaagtgacagcctcttttgtagacatgatcctgcctaaatttctcatgccctacaaaagagggccctgaactccccgcttctccagagcttcatgcagtccttgaagcactctctggctgtctctgcaagtggctgaacagctcctcctggtctctatggggctgcagaggctccaggtccccatggctcaggggctgtcatgctcaccaggtcccaccaagggtgctccccaccgtgggtggtggaggagaccagatgtagctgctcctgcccctacccctctccttaccggccaatcttaacaggaggaatgagtagggatgagtggagccatggaggttggtgctggaaagaacagaaatgaagacctttgtccaattctcccaagttatggagatccttttctgagttctagtagccctggggtagtctgatgattggattcctcccacgtgtcttaaaccctatcatatggcagccactgtgctaggtgctgggtttacaggtggtgactgatgtgtccagtcctccaggaacttagagtccagggacagaaacaaacacccacatggctgctactgctgatgtgatgtccttgtggtggttggggctatcagaggacagaagagggggtgactcattctgcctggggatttgcatggaggcttcttgggaggtggcatttcagactgttcttgtaggaataggaagaatacagcgtggccaggtgggaggagaagatagggcacccagcagagggacaagcatgaagaggaggcctgggggtgcaaatatcatagaactttggggagctctgagaagtctgtagtaatgaaccctcagttactagggtagactctttccacagggaggaggaaatgtcaggagggaagacagggaaggaggggagggcaggaaccaccctggagtcccttctctctccacagcaaatcaaccaggaaatcaattcaccattcatacatgcatgttatcacacacacacagacacacagacatgcacgcacagtctctctcacacacactcacaccacacaggtgtttacacattcacacacacacacatacacaaatgcatgcagaaatacagacacagacacgcacatgcacacacaaagacacacataaacacatgggagaaactgggtgtcatctcaagagttgtcgtgttgggcccatcctgccccctcacttgtcacctcgggggctgtctcccagctcatgaaggattcctgaagccatcaagcaggatgtcactgtgtgatctgaaacactcagacacctcctcactctgaccttccttcctggtttccttggctctgggatgaaacagtgtcctgctagttttcactgcatcagaagagaaacctctcccgtggggcagaactgctgggccaccagagcgcaccgctctgctctttgccctcagggcatcttgatctgcatggtgggaggaacttccccaatcctcaaaaatgaactctttatggattcctcattcgacatgatgtcaacgtctcttttgtcttctctgtagcccttgactgtggatcccaagctgtgtgccaaggagctcatggtgcaaactcactgtgagcaaaccctctgggtttattgaaatatttgaaagatgagcagtgtcaggctaattttaccatttttagcagacacggtgttttaccatgttgatcaggctggtctcaaactcctgagctcatgatctgcccaccttggcctccgaaagagcattttttcatgtttgtcggccacttgcaggtcttcttttgaaaagtgtctgttcatattctttgcttattttttaactgggtttttttgttcttgcttgttgagttgtttaagttccttgtagattctggatattagagctttgccagatgcatagttttcagctatttctcccattctataggctgtttactgcgttgctagtttcctttgctctgcagaagctctttagtttaatgaagtcccatttggcaattttcagttttggttgcaattgctttgggtgtcttcatcatgaaatcttcgccaggccctatgtccagagtggtatttccaaggttatcttccaggatttttatagtattaggacttacatttaaatctttagtccatgtcgagttattttacttatatggtgaaaggcagggcttcagtttcattcttccacacatggctagccagttatcccagcactatttgttgattttgttgaaggttagacggctgtaggtgtgaaggattctttctgagttctctattgtgttccactgacctaagtgtctatttttgtaccagtaccattctgttttgatcactgtagccttatattatagtttgaagtctggcagtgagatgcccctggctttttttttttttttttttttttgcgtatgattgttttggctatttgggctctgttttaattccaaataacttttagattagatttttctaattttgtgaaaaatgatgttggttcgatagggatagtgttgcatctataaattgcttttggaagtatggccattttagctatattgtatcttctaacccatgagcataaattatttttccatgtatttgtattgtccctgatttttttcagccacgttttgtagattctgtttccacacaaaatctagcagaatcactcatttattactcacaccatggaggaaaaatgaaataacattaattctctactgggtaatacaagaaaattctaaactcagtaggtttttgggaaatagaactctttgtggaaatattagtacagagcaataaattactgaggaaatatcattaatataattttttcttattaaataaagaattatccttcaggacgcggaaagaaaccttggaggtctgaaatctaacatgattgttttactgactgtatcatttggaagaaagaggtcatcattcaaaaagtacttgatttttcaaacaaaagcagaagaaagaaaatgttgacatatcttttttagtcagccagaactttaattgcaggaattccatcaggtagcaccaataaaaaataacataagatgttaggaataaccgctggtaaaattattgacaaaaggaatcaaggcagtgaatgagctattgggtccatggtgtcatcatgatctgctggaggccactggacatacacagtaggtggtgggcaggtggccagacagaagggcgagtttgatcaagaccctgctcacaggggctttttggtatcatctttaactttcaaaaaggacacaaatgttggtttaagagatgaaggagaacctggatcacttttgcagggcaatctttccctaggcactccacgtctcagagcccactgcactaaaggacccgtttttcccttgagccccaaccctggcacctgcagcttggagcagcctctttcctcctttgtcaaatcacagtgtcagcccaggccctgcacctgaccaggggatggagtggaggggcctgcaagactgaagctggtagtgatgggcctgctccctcactcaaggccctctctaccatctgatgagaaggcctaaaacatggcaaggggtagggggagcccatccaaagagagggctctgtattcctgtgtccttggcattgggtgggcctgcaggcaaatattcctccttccccttcttcctcagcctctcctcacactgcaatcagcacccatagctctgaaggtgactgtccctgttccaccttattcattcctggtccagcccagtggtgcccatggacttaagcagcagctcaggtcccccgtgtctgagtccactctgctcctggcagggccatgagcgggctcaggatctggggtgtgcaggaaggtgatggcaagggagctgcctcaaggtctggactcgaaccccatgggtccatgggactgactttttaaaaatttttttcatgtgcagcctctactcttcgccttccaccttaattcctggaacccaagccactttctgtgggaaggcagccctgcgccccctccttttcaattaggtgtaccaaggctctcccagccccctccttctgggattacactcatagttgtagggaccagccctacagggcctgtgggtttttctcttcgtgtgcggagatgagagatcgtagaaataaagacacaagacaaagagacggaagaaaagacagctgggcccagggaaccatcaagatatggagacctgtagtggctccgaatacctggctgcgccgttatttattgtatacaaggcaagagggcagggtaaggagtgtgagtcgtctccaatgataggtaaagtcacgcgagtcacgtgtccaccagacaaggggcgcttcgctatttggtagctgaggcggagagagagaggacagcttacgtcattgtttcttctatgtatttctcggacttcaatactttcactaattctgctaccgctatctagaaggcggagccaggtgtacagggcggaacatgaaagtggaccaggagcgtgaccctgaagcacagcatcacagggagacgtttaggcctccggatggctgcgggcaggcttgactgatgtcaggccttccacaagaggtggtggagcagagtcttctctaactcccccggggaaagggaaactccttttcccggtctgctaagtaacaagtgccttcccaggcactggcgctactgctagactgaggagcccactactggccctgtctgggcatgacagagggctcacactcttgtcttctggtcacttctcaccgtgtcccttcagctcctgtctctgcatggcctggtttttcctgggttataattgtggaacagagattattataacattggaaaaaagagtaacactacagactaatgattgataatattcatagataatcatgtctgtattctacgtctaatacaactattcttattttaagtattttctttattatactggaacagcttgtgccttcagtctcttgccttggcacctgggtggcttgccgcccacacatatctctctcttagcctcagagatggaatcccccttcccttgtcatacctcatgtaaagctaccctgatgcacctaacccaattaagaggactgcccatgtctgaattcctgctgcctgcaggccacacacccttcctgaacagaaacctgctctgaatcaggcctgaacttgctaaaccctctcaagctcaacagaccctgagccttggtatggcaccactgcgcctttccctctggcctttgatggtgagaatccatcagaactcagggcagagctgcccaggtcatttccaacaagcaacacaaggtctcattcacctgtctcatgttaggatgagaaggtcccagccatagggagtgggactctgggaattctccatccctgtcctccctcctcacccacctgccctttgctccactcccaattctgcccccatacctgtcactccaaaggactctcctcagcagccaggtaggatgaagcaggggaggatgaggaggaggctgcagggactgagggtggtggccatggctttgggtcagactgtgcctggagcatatgaggagacacatgatgaggaggcagcaaaggatgagggtggtggccgtggccctgggttgggctgtgcctgaggacatggtgggtggtgctgaaatggaagcacaagagtgacaacccttgtccaggccccaaatctgaggagatgcctcctcagctcctgctgacccaggtcatcctggaaggcagaggttttgtcccctctgctatggggcagcccctgggagagttcctggggtaggaagggagagggggtgtcccttggcctcagggagctcacagagctgctgagggaagcaaggtgacagcaaagcccaccctcctgctgtggcggaagaggaggtgatgctccagggtgcgggaggggagggtcacgaggctggccttggaggaggttttgatggatttccagaaacagaccagaggaggaaaggaaaagtgattctcaagagggaacactaaggagaaaggcctgaaaatagtgacacctgcagtttcgaggctggtgagaaatccacagtgtggggaacagaagcaagtgcagtgaggaagaggagtcaggagggagaaggaagaggagggtgggagagcacaggcacgccagcacccccaggaggagcaccccacgaggaggtcattttaacataaacgtgtacactgggatgattgaagctgaactcaagaattagtttcttgagatccccatttctgatctcattggagatccccatttctttttctcctgttacctcctgcacttggctccagggtgctgtccatgcccatcaagaagtcctcaagccatcctgtgcagtctcccattgagatgtaatggaaggacatggtcatatccttgtcattctcccacttttctttcatctttctggctccaggatgaaccgttgtccacattctgttttctgagtcaaagaggaggaagatctgtccatcgaaactgagctgccaagatccactgccgtgtccttcggctttctgctcacaagacatcctggcctgcagggtgaggggttctgcccccatcaaagagagatcagctctggccttgacagatattgagcccccatcctcttccacttgcaatttcctggtcttacttgctctgccacatcctggccttgcctctagacgtcttgcggggtgagatgaccttcctatttgtatttttacatgaaaactataaatgcctctaacctaccactgtatctgctccctgctgtcctgggccatctgaaacttacccttgggtatgtaattctccagctgaatgtcaagcagttgctctgtaagtatgtccaccacctctctcagtactgggttctgtgctttccaggccgttgtgacatttagtttcttccccaggggactgacgggtgtgactgtcttgctgccacagtcatagtgaagaaaagtcttttcatccacctggccttgaaccgcacaccaccgtggtccaggtctgaacttagggatgacggtgatgtcatagcaaagagagtgagggtctgtggagaaaggcaggtgaggggtgggtggggaggaaaagacccctagatacccctcctccacactgtgacaataagaggaagcctctggagggctgggctggcccagcaaggagtgcctcctccagaactgtggtgtccacaagattaaggcgagtgctccccacttccatgagggcaaagaggaggaggaggtccctgcctgctgagaaaccacatgtccccagacatgtcccactgcccctctgtccacatcggtcaacacaggaccttgctagagaggtgccaggagtgctagaggaggaagggcctggatgacagaggatcttcagcagtagcccacgtggactgtgggaggtgggacagggtgtgggagctgcacctgaggatactggtgcatggtgggacggagtgaggatggaacccagttggataaagaagagttaattatcatggtcacaggatttaacacgttggcaaagcccctggtggtggtgctcatctactatgaggatgccttcctgaaaccttggacaaagggatggtccacacagcaagaaatagaaaaatctgaaaatctaaggcaggcagtagacggagggatcacaggctcagagaagtgcccaggctggaggggtctgagtgtgaaaatccagaacaatgtccatctgctgtgctcatgggaagcctggaggactcctgtttacctggcatataaagaaggccccatgagaaggcaccagaatgggatgaagctcagggatgcctattgctgaaggccagggttgggggtaggagatgctcttcctgaaatgggctcccagtagtaatgggatgaaaaatcccgaaataacagattccaggtggaggttgtcaactgtcaggaacaaggagggtgcaatgatggaaatgattagagaagtcacaatgccagctggagacctcagtcatacaaagctatgcccatggctcatagaacaaaggggtccaagatccagaagagatggaaacccaacctgaatagtgctggatttaaataattacaagaaacagagataaaacaaatgatggatgaccaggaggctgaaagtagccagtccttcaagaacaaggctgctttgcctaatttgcagaataaagccacttctcagaccgtgaacccatgactagaagaagacaccagtttccagtgaggaaggaccctttaaccccgcaacaagtgcaatgattctttgtgggcttctccaaacgtatttatggccactagagtttgctatgaagggcaattttgtaaacatgtaaaggtgtgcagggaatatattctccattgtaactactcagctctgctgttgaagcgcaaaggcagccacaggcaatccatgaatgagcgaggctggacctgccttaagtgcccaatgacccaagaccccctaagatcctagaggtgcatgtggttccaatgtctaattggagaatcacaacatagattccatgtgaatgttcagaggcaaggcaacgccactcacagcaaggaaatctcaacattaaaaagtgtctcctgtagagtactgggccttggcagagatggggcctttagccatggaagggccgtgaccatccagcctcagagctgcccattacgggtgggctcctcaccctctaggtcattaggaagagaggtctggcagtgagaagacacaggtggttctcctgggatgggcagaagtagggccacagggaaccgggaagctgcacaagcagttggccccgattcccaggacaccacgtggctgcacccccttaccctcagcttacacctcaggtttcagggaaggtcactgatggcccccgtggaccatagatgccactcagcagcaaaggaggggagagtagaccctgaaccatgggacccccactcccatcacatccacaccacccagaagccacaggcaaggtaggaccaccttctactctccaactgacacctgagacaccacttggagatgacaccataggggatggggtactatttgctggtacactgtaatcccctcatctagggtcagcaacctaggacagggtccaaatctggtcccccctatttgaaggttgccattgcctgctgttgctctgcaaagggacaggactggacactgagacggagaacccaaggcctgcaaagatcacagggcatccttcctccctttctagaaagggtttgctgacccctgtctacacactgactattctctatgatgctggcgccccagtaggaagaacaggcaggtctgggccccaagggcagaagtgggtgcctctactcaccagagttcccagggtcatcctggaggaaatggtgcttcccatcccccctgcacaggttctgtggggagcttggggtgtgtttgctggggtgtgtcctcaggcaagaggcagaaggtgtcacgtggtgtaagaggtcgcgagggccccttcatggatggggagacctctggggtgaccagctgggctgaggtggggagtaagaggatgttacctgggtggtggcagtggatggtgaggggagggtgggaagtgtctgctgagccgctgggtgcaggtgagtgtctacaggaaagtgcagggaaaaattcaagggcacgcagccctgggggtgctggaaggtttgtgtggttgagagcgggtgagaacagagcaggctggtggctggtgggagtgtctgtgattgtgtccctgtgcaaccccacttcacccctgtcctgaccccagctcggattctgggggctctggtttctccttcccgagggcgggtgggactgccgggctgcactagggatccccgctccacgtcgccctctgcagccctctggcccctccactctccgggggttcctttccagcctcctctctgaccagctcctcccctcggaggataagtagcctctgggaacggacccggcgggaaggagacgcggagggaaactgagcgggggcgcagtccggggtgatcgcacgggtccttccagaagcctcccctcctctgaagcccacagtccacagccccccacggttggcctccgccccgcttaggctccatccccgaactcaccggccagcccggtcctgcaccagctggacagcaggagcagaagcgggaggcgtagaaggaacgcggggctggcggccgctgccattggggagttggatcgcaggggacagcagaagcgaagcccagcccgtggatcacctggcggctcgcaggctgtctgaatgcagcccgtctgaatgcagccctaaactccagtaagccctaaactctagcactccttctgccccgcccctcggaggaaacacaccccctttgctgagccgctagccaatcaggtgtctctcagccaagttgctcatccaagtctaccccactttctactgcagcgctcgcgcacttccccctgcttcagccagtcagactttgctggctgcctgcccgggaccagtcctgccaaaggcttctttccatgaccccctcatgtaatcatcaccgcaattttttcattttgtattaatccaatgtggataccgatgcacagaaaggtgaagaaaatgcacagaagtgttcagccgcgacagggtctccctgtcctcgcctgtacctgcgacacccgccttccctctccctgcgttgcagagtgctcccaacccaccgtcctgtgcgcagatccaagcccagtcccatccccgcggcctcatcccaaatcccgagtggacgtggttatagcctgggctaggtttgtttgtttggttggttggtttttctttcttttcttttttttcttcgtgacagagtctcgctctgccgcccaggctggagtgcagcggcgcgatctgggttcgctgcaacctctgcctcgcgaattcaaacgattctcctgcttcagcctcccaagtagctgggaccacaggtgcgcgccaccaagcccggttaagttttgtatttcagtggggacggggtttcaccatgttgcccaggctggctttggactcctgggctcaagtgatcggcccgacacggcctctcaaagtgctgagatcacaagggtgagccaccacgcctggcccggggctagattttattacagaagcaccaggtcttcagaagcttcaaagaagatattgtacactaaacaattggttaagatagtaaattttatgttctacttttttaccaaaattaaacagctttaaaaattatcttaaaaatatgtgtcttgctgggatctgcccaattcggattggcaaaaagactctgctcattaaaatctttgcattttaatgcaaagcattgaaaaccttgtctctaaaatcacaacctgtgaggcaccttgctgatttagaaagcacatcagagagattgaccctgagctccccttagaacagtgccccaccaggtgtggggatggcccaggggactcagcagagcaggttcaaatgaaagctccccatagctactaactgccagcgcttgctttgggcctgttccccctgggcaaggaccagccatccttccaagccgcgcacaaataccccctcccatgtgtgtccctcatcttcccacatgaaggaacaccctcctgctccctgaggcctggatccacagtgatggagcgtatccggatctccctgtgtgacaaatgctcacacatttctttgcttctctactagaagcatgaggtctttgagactatactagatctgtgtacagcttttgagggaaaaaagccctagtggcctactgttgctcaattggaatgtgatcaattgtgtttcccatgggagcaggaggcaagggaggggtctgtgcgtgcgtggagctcactttgcagtacacccatctgtggccaaccattgatgcctggatccatggctgcacccacacctctgctcagtccctggacggtccctgcggccatcctcaaaaggaaaccccaattgtatccttgtcttaattatcatgagggcatctggaagtggtggcagaagccagagacaggtgagggtcccagtggttcctggcagctgtgaagggcttagcttagggtgaggactggacagagcccctgggtcccattctgcccccagccactcaggcaatatcctcttttccccttctctctcagcctcttctcaccctagggctgtacccaaagctctgaatgagactgtccctgccccgccccatccactcctggtccagctcagcagtgaccttggaactccaggagcagctcagtacccctgtctccgagtcagctctgctccaggcagggccagaatctggagtgtgcaggaggccggatggcaggggcattgccccaggactgagccgtattctgagggttcccagagacctgacctcctacttgtatacagtcttttcagtcagcgtctgccttaaaggctgtgacccaggcaccttccctgggaattaactccagcattgtcctctgggtcgacacagtccttggcagcctctccttcctggggttacacccagttcctctgctcttctccagtggatggaatctccttctccttgacacacagcatctggagccaccaatctgctgccccactcaaatgtgaggaccgcacatgcctgagctcctgctgtctgcacaccacgcaccgtgggggttccttatgaccagagacacagtctgaaacagacctgaatttgctaaaccctctagagctcgacaggacctaagccttgatatggttctgtgtgctcctcccagggcgcccgctgtccccgagctccgggcctgagtgctggctggcggagacccacagtgggtgccccgctcccggacgatgcccctgggcttccagatccagagcctcgggacgaaactgtttcaggaagacccggaaggactcgccggtcgcggcaagggacaggcggttcctgagacaggaggagccaggaaatgcggggcctggtggggtgaggagcacggggttcctccttcatcctcgcggggactttgccaccggctcagtgtggaggcctcaccgtcccgcccggatccgtggggctccgacagtgtggcccctgcgaggaccccccccatcctcctcgccctggggctgctgcgggagggcgcccgggcagcactaggtcctgagtgtccagggtccggcaggggcttcccgttgtcgcctccctgaccccgccgcttgcggtccagggctgctggtttctccgctggtctgggaggccctagcatggacgtcgtgaggcggagaaaaccttgggatgggtggaaaagaaggattggagggagggcggcagaaagggagaggaaggaaacagggccggagaacaatgagaaacccccaccacgaaaatggggagagggggacacgcgcacagcccccacactccaccgactctccgtctcctgctctctgcccagtaaggaacacaggccccaccccctccaccctcactgtgtttgggatcagccatttcagcggggtgaggcgtccccttgtgggtgcgattggcatttccctgagggctgtgaacactgaacaccttttcctgggctcactgcgatttgcattcttcttctgatgccagcgggcaaggggaggtccccaaacgccggtgggacctcgactccagccagtgtccagattcttgatattgccggggaaattaattcaaggaccagtaggaaatagagaaaggacggagatttattgtaaaaggcaaagtacacagtcaagtaaagggagtgcaggggaactcgagagagaagcaggtgcaagtttggggctgccacctttctgggtttctttaaccaaggagtggaatattcatgaaaattcctggaagaaggtagagatttctcagaactgtggtgccccgcatttttacactaaatataagtgttctcagaactgctcaggagctggctggtgtgtgtttagtatgttaatcagcatgtaatgaggtcctaggtgaaacctaggtcaaatgcagggccttgttgggtccagtcattcttagccagcttggtccacatgctgtttttcagcatcttatcagcccagagcctctgcacatatttcaacagattccttttgctagtcacctgaaactgctgcccaaaattttctattcttttgagaccaccgtgtagtatacctgtcttactttggagaaatgtctattcaaattccttgcatatatttaaattgggttatttcactttataatgttgagttgcaacattatatattatatataatatataattgcaattatattttgttgcaatattatatattcagaataccagtcccttacctgatatatgatttttattttattttttaaaatttatttatttatttattttttaatttttaaataatttttaaaaattatactttaagttctagggtacatgtgcacaacgtgcaggtttgttacgtaggtatacttgtgccatgttcggttgctgcacccatcaactcgtcatttacattaggtatttctcctaatgctatccctcccccagcccctcacctcccaatagggcccagtgtgtgatgttccccgccctgtgtccatgtgttctcattgttcaactcccacctatgagtgagaacatgtggtgtttggttttctgtccttgtgatagtttgcttagaatgatcgtttccagcttaatccatgtccctgcaaaggacatgaactcatccttttttatggctgcatagtagtctgtgttgtatatgtgccacattttcttaatccagtctatcattgatggacaactctttgctattgtgaatagtgccacaataaacatatatgtgcatgtgtctttacagtagcatgatttataatcctttgggtatatacccagtaatgggattgctgggtcaaatggtatttctaattctagatccttgaggaatcaccacactgtcttccacaatggtttaactaatttacactcccaccaacagtgtgaaagcgttcctctttctccacatcctctccagcatctgttgtttcctgactttttaatgattaccattctaactggtgtgagatggtatctcattgcggttttcatatgcatttctctgatggccagtgatgatgaccattttttcgtatgtctgttggcggcataaatgtcttcttttgagaagtgtctgttcatatcctttgcccactttttgatggggttgttttttttttcttgtaaatttgtttaagttctctgtagattctggatgttagccctttgtcagatgggtagattgcaaagattttctcctattctgtaggttgcctgttcactctgatgatagtttcttttgctgtgcagaagctcttcagtttaatcagatcccatttgtgtactttgccttttactgccattgcttttagtgttttagtcatgaagtctttgcccatgcctatgtcctgaatggtattgcctaggttttcttctagggtttttatggtgttaggtctaacatttaagtctttaatccatcttgagttaatttttgtataaggtataaggaagggatccagtttcagctttctacctatgaccagccagttttctcagcaccatttattaaatagggaatcctttccccattgcttgtttttgtcagatcaaagaccagatggttgtagttgtgtagtgttatttctgaggcccctgttctgttccattggtctatatatctgttttggtaccagtaccatgctgtttggttactgtagccttgtagtatagtttgaagtcaggtagagtgatgcctccagctttgttcttttggcttaggattgtcttggctctgcaggctttcttttggttccatatgaagtttaaagtagtttttccaattctgtgaagaaagtcagtggtagcttgatggggatagcattgaatctataaattaccttggggagtatggccattttcacaatttcctatctatgagtatggaatgttcttccatttgtttgtgtcctcttttatttagttgagcagtggttcatagttctccttgaagaggtccttcacatcccttgtaagttggattcctaggtattttattctgtttgtagcaattgtgaatgggagttcactcatgatttggctctctgtttgtctattattggtgtaaaggaatgcttgtgatttttgcatgtttattttgtatcctgagactttgctgaagttgcttgtcaactttccgccaacaaccacacagtctgctcccacacactctctaccacacaagccctccagcacccccagggttctctgcccttgatctttcccctgcactttgctgcagacactcacctgcacccaggggctcaccagacatttttcacccctctcctcaccattcactgccaccacccaagtcacatcctttagttccccatctcagcctggcacttttacccacacaaacctcactcacctctccatccatgaagggtcctcaccactttctccagcaaccagggggacccaggacccacttaccaggaatccagagtctttttcagacccacagaggatgattcttctgtgtagcactaggtgagcctgacataatttaagtggtggttggaggctgagggaacggctgaatgaatgagagttgtgggagtgaatgggctcagaagaaaaccccaggtgcagaaggggagctgcagtggatgctgtagcccccagaggcctgaaggtggcggtaccgtggttggagacctccaggctgggcagaatttggaaatatgtgtagtcacctgggtgcccacagagtttttccaaagaggagaaattttggcttacaacaggtatagagctccatcagcatagaatcttttaataaacttgttgatcacaggacaggaaattgctgtcttcagcccatttgattgagaccagagtgtactcaggacagaaaaatcctaaccagagccattggcaagtgaaggaaagaaaaggcgttcaaataggaaaagaaaaagtcaaacatgtctctttgccagtgatgtgattccatacatagtaaaccctaaagaccctgtcggaaggctcctggaactgacatatcaattcagtaaagtttcaggatacaaaatcaatgtacacaatcaagagcattcttatacaccaataatattctagctgagaatgaaagcaagaacacaatcgcatttacaaaaccaacaaagaaaagtaaatgcctaatagttaatctaaccaaagagatgaaagatctttccaagaaaactacaaaacgtggctgaaaaaaaatcagagacaacacaaataagtggaaaaaatatttcatgctcatgggttgggagaatcgatataggcaaaatggcaatacttccaaaagcaatttatagatccaacgctatccctatcaaaataccaatgtcatttttcacagaaaaatctaacctaaaaattattgggaatttaaaaagagcccaaatagccaaaacaatcataagcaaaaagaacaaagccagagacatcacattgcccgacttcaaactataatataaggctacagtgatcaaaacagaatggtactggtacaaaaatagacacttagatcagtggaacagaatagagaactcagaaagaaaccttcacacctacagccatctaaccttcaacaaaatcaacaaaaataagcaatggggaaagactccccattcaacaaatggtactgggatatccatgtgcagaagaatgaaactgaacctctacatttcaccatatatgtaaaataacttgatatggattaaagatttaaatgtaagtcctaaaactataaaaattctggaaaataacctaggaaataccactctggacgtagggcctggcgaagatttcatgatgaagacagccaaagcaattgcaaccaaaactgaaaattgccaaatgggacttcattaaactgaagagcttctgcacagcaaaagaaactaggaacacagtcaacagtctataaaatgggagaaatgtctgcaaactatgcatctgacaagcgtcgaatatgcacaatctacaaggaaattaaacaattaaacaagcaagaacaaaaaacccagttaaaaaataagcaaagaacgtgaacagacacttttcaaaagaagacctacaagtggccaagaaacatgaaataatgctcaatatgagcaatcatcagagaaatgcagatcaaaaccacagtgaggtaccatcccatacccatcaaaatggctatccttaaaatttcaaaaaaaccacagatattggtgaggctgagaagaaaagggaacacttagacacttttgctgaaaaggcaaagtagtactagttcagccactatggaaagcagtttggagatttctcaaagaaccaaaaatagaactaccatttgacccagcaattccactgctggggatatacttaaaggagaataatttattcagtccaataggcccgtatgttcattgcagtgctattctcactagcaaggacacagaatcaatctaagtgcccaggagcagtggactgaatgaagaaaacctggtacatatggaccatggaaatccatgcagccatgaaacacaacaaagtcaagttcttttcagcaacatggttggaattggaggccattatcctaggtgacctaacacaagaacaggcaactgcacaccgcaggttcccgtttataagtgggagctaaacattaaatacacatgaatgtaaagatgggaaccacagacactggagatcactagacaggggagtggggaggggcacgtgggctgaagaaccacccactgggtatgatgcttactgtctgggattattgggaccccaagccgcagcctcccacaattgacccatgtaacaaacctgcacgtgtactctttataataaaagttgaaaataaaaatgaataaatatgatggcgaggatgtggagaaataagagctcttctacactgttggtgggagtgtaaattagttcaaccattgtggaagacagtgtggtgattcgtcaagaatctagaacgagtaataccgtttgacacagcaatcccattactgggtgtatacccaaaggatcataaatcattctactataaaaacacatacacaggtatgtttattgcagcactatttacaatagcaaagacttggaaccaacctgaatggctatcaataatagaccagataaagaaaacgtggcacatatataccaggcaatagtatgcagccataaaaaagaatgaattcaggccgggcgcggtggctcacgcctgtactaccagcactttgggaggccaaggcgggcagatcacgaggtcaggagatcaagacaatcctggataacacggcaaaaccccgtctctactaaaaatacaaaaaatagacgggtttggtggcaggcacctatagtcccagttactcgggaggctgaggcaggagaatggcgtgaacctaggaggcagaacttgcagtgagccgagattgcgccactgcattccagcctgggtgacagagtggtgagactccatctcaaaaaaaaaaaaaaaaaaaaaaaaaagaatgagttcatgtcctttgcagggacatgaatgaagctggaaaccatcattctcagcaaactaacacaggaacagaaaaccgaatgttctcactcataagcgggagttgaccaatgagaacacatggacacagggaggagaacatcacacaccggggcctgtcagggggttgggggcaaggggagagagagcattaggacaaatacctaatgcatgtggggcttaaaacctaggtgatggattgataggtgcagtaaaccaccatggcagatgtatacctatgtaacaaacctgcgcattctgcacatgtatccaataacttaaagtaaaatttaaaaataaaaatgaataaacaaattgacacgaggcaaaaaaaagtgggtttaactgacacaggcaagagagaactctgcactataaactctaaccctgccctagaaaaataaactctagtcatttaaaataattataaggtgtatgatcataattttataaaaattgaagatgattctacta

SEQ ID NO: 346 - DNA, 285396 bp, Homo sapiens
tcctattattacctccacttctaacatcaaaactgaggcataaataagtaatttgtccaatataataaatgacaagagttagggctggagcacgtggcacatgctctcagctttaactcacacttccaggcaacacaggagaaacactctataataaagaggatgggtctccggtcagacaggcccgggttcaaatcctgcctctgagactcacaagctctaccatttgggaatgttacttaccttctctgaacctgtttttcttctataaaatgggcatgataataatacctgctttgtgaggtggatgtgacaatcaaatgtacataaatcaccaagtaaaggatttgtccccatttccaggcaggtgacttttaaaagatattacatatgtattttattttagaaattccaagatgccactgtacctctctccatctagatggcccacagttgccttcaagtcaaacccaaataccaactgttgtcagttctcttgctcaggccagatacctagagccatcttggcttcacctccatcctccatcttccgacctctatatctaatcagtagacaagactcgttgattcctccaatttggctggaaacatccaaatgtttcctccatcagcattgttaaaacttaccacgtgtcaggtactgtggaagtatttaaaaatacctccaggggtagatattactattacctgtatctccagttcagtgatgagaaagctgagcctgtaagagattaagtggtttgttcagtgtttcataatggatatgtaatagagcagggattggaattcacactgtctgattccagagcccatgatctcgtacaatctcggcagttcctatggttacactggacaacatgcagctttgagacgaactgagactagatcttgcaggtctttagttcaaatgtcccaggaaacagctcattttgatcgagccaaatcaggcacccactcccaggccaatcactgtgaccaggaaggtggggcctgtaaaaaggtggcagctccattttgaaccagacagtctgaagggcaggactgtggccagaaggggaaaaaggaaggggtgcaagacgatacaaggccactatgcttccctactcaaaaacctgtcgtgcccttttgactacttgtatataggaccttgcaggccaccgtgatctgacctctacctccatttatgccttcgtctctcatcataccccatcatactttcttctctcaaaccacgataaactcccacatttcctctaccctgtacttttctgttattggtctttcattctcatagcttccttagttaaaaatccttcattccccaaataggaacgcttttacactgttggtgggagtgtaaattagttcaaccattgtggaagacagtgtggcgattcctcaaggatctagaactagaattaccatttgacccagctatcccattactgggtatatacccaaaggattataaatcatgctactacaaagacacatgcacacgtatgttcactgcagcactgttcacaatagcaaagacttggaaccaatgcaaatgtccatcaatgacagactggattaagaaaatatggcacatatacaccatagaatactatgcagccataaaaaaggatgagttcatgtcctttgcagggacgtggatgaagctggaaaccatcattctcagcaaactatcacaaggacagaaaaccaaacgctgcatgttctcactcataggtgggaattgaacaatgagatcacttggacacaaggcagggaacatcacacattgggggccgttagggggtgggggcctgggggagggatagcattaggagaaatacctaatgtaaatgatgagttgatgggtgcagcaaaccaacatggcacatgtatacatatgtaacaaacctgcacattgtgcgcgtgtatcctagaacttaaagtattaaaaaaaaaaatccttcattctccagctctgcgtatttgccacttaaccaaccacccttcaggactcagaccaaatgctcccttgattgggaagtgggtcttcccagcagaaagtaatgtcccactctgtgctgcactggaccccatagtccttcagagatgcccgagtcggagttcccctgagggggttgtgcgttttatatccatatggccagtcatcagctctgggcttcctcagaaaggggagacacgatcttggcgaggtggctgtcttctgcggagaacaatcacagagagggctgactgccagtagaacttctagtagtagagcgtggaataatgaggtgaggagggtgaataagtgtctcattctgaaggaggagaccgtagcagcacttcacagtctccatcacactctagaatcacaaggagctctgagggaagctctaaattcctccagaggctgaacttggggagggggcggattgtaaaattccatgagaaaaagggataaaagaaagtcaaggagcaggttagaaagtataagggctggtccgggaaagtatttaaggttcaaatgtttgatgtggaaaagaagtttcttgaattggccaggcacagtggctcacgcctataatcccagcactttgagaggcagaggcaggcggatcacgaggtcaggagtttgataccagcctgaccaatgtggtgaagccctgtctgtactaaaaatacaaaaattatggcacacacctgtaatcccagctactcaggaggctgaggcaggagaatcacttgaacccaggaggtagaggttgtggtgagccaaggtcgtgccagtgcactccagcctgggcgacaggacaagactctctcaaaaaaaaaaaaaaaaaaaaggaagtttcttgaattgacagggtgtcattgttttctagcatttattcaacagatgatgttcatggagtcttactatgagtaatattcaggaatgttctaggtgctgaggatataacagtgagggagacagaagctatcaagcaattaagcgtacatactagaatgtcagggagcaacaggtgctacagaggaaaaggaggatagggtcacgcagaaaaagggatagggttttactccagtacaatgggaagatgtcggaaggtgttgagcagagaagaggcacgatagtgatttatgttttcaaggtactcattggctgctcaatggggaacaggcagtaggagagtaagagtgaatgcagggagacggctgggagattactccagtagtccaggtgagaagtggcgatgggctggatgggggtagcaatggggcttgtcagaaattgtttaatttactatatgctttgaaggtagagctgactggggtgagagaagattaaaagattcatagatgacttcaaatttttgacttaaggaaggatggggttgccatatactgagatgaggaagactatgggatgaacggttgtttttttgcagggaaattcagtcttgaacacgttgagtttgagatgcctactagatagtcaagaggagatgttgagtaggcagcacacaggtctgcatttcagaaaaggagaggggtggagagacttatttaaagccacggagtggataaaatgatgtagataaagaagagaagacgtcccaggagagggccccggggtgaaatactattcagaggctgcgaagaggagggggacagccatgagaaaatgaagacacagcaggagaatcaggaaggggctggagagtgtggtgtcccagaagctaagtgagaagactgtttcaagaaagagggagtgttcagctgtatcaaacgctgctgcgatgtcaatgtgcagactggaaactgaccaccgagcttggcattgtggggactgcaggtgaccgtgactgtggggattgtttcagtggggtggtggggatgaaaagactgaatgaagtagctcaggagaaaatggggagaaggaagtagacccagtgtgtagagagatgttataaagggcaagttttgctataaagggaagcaggggaatagaaaggggtttttgctaccactaaatcatgagtattttcttgggtctctaaaattctttgtatatcataacctatactttttgtggtgacactacagtataaaagtaatgcatgcataatttatactactgtatataatgtgaataattacattcgtgtagtcagaccttacatgttcagagcattgctgagaagccaaaaggaaatcatctctagcggtcaaaacaattcccgtgtattcctagctagattacacacttcactctctacaggactctccaagatcttctcatttttatgtttaataaagttatattttgtttcacaaagttcttaaaagcttcacagcctaagtcttcaagaaaccagaagatgacaattagaaggttaggatggagaaagggtgaaggatgcggttgggtttgtggaacagctatagaaactctaaaggcacagctgttcgtggccacccatggagaggcacacagcacaagctgttgtgttcagttgcacaggttggtcactgcacagggctccctgcacagagctgtagccatccagggggaggggcaccttttagtcacatgaaggtgtcatgtcatccactcatcaggatcatgttctcaaggctgtgtgcacctcaaggctctctctaattcatcctcccagagggtgtgcctttttctaatttgcataaaagagtagaggctagcaatagctgtggtctagctcctagacacattgtatttagaatagtgaccttaaatcaagaagatgctaacttttcttcactgtttagactgtagagatgtagagctcatttatcttcggtgtttgaaggacaagctttaggtatctcgaacattaagttagttgaaatatcataaggacaccagataaatggttttattagctctaagtagttcattctagtatttcgtaaataaggaattctttttggtcaaaataatactggaaacaaggaaggaataatccttttgggttttacctacttggggaagaacctggctttactaattaagtatcaagagatgatacagaatcacatatgtgccagaactggtagcactctatcctgtagaaacagtctgggattcttggtgagtctgcattattaaatatattattctccacatctacaagccatcaaaatgacaattccccaagtgatcttctgtcaggctaagaaaaggatcttggcaatactgtggctttgttacaggaaagcggtcccaatccagaccccaagaaaggattcttggatctctcacaagaaagaattcagggcgagtccgaagtgcaaagtgaaagcaagtttaagaaaataaaggaataaaagaatggctactccatagacggagcagtcccgagggctgctagttgcccatttttatggttattttttgatgacacgctaaacaaggggtggattatttatgcctcccctttttagaccacactgggtaacttcctgacattgccatggcatttgtaaactgtcatggtgctggtgggagcgtagcagtgaggacgaccaaagtcactctcgttgccattttggttttggtggctcctttactgcaagctgttttaccagcaaggtctttgtgacctgtattttgtgctgacctcctatctcatcccgtgacttagaatgccttaaccgtctgggaatgcagcccagtaggtttcagcctcattttacccggctcctatttaagatggagttgctttggttcaaatgcctctgacagctttgcttgacataatcttcctccaagaacccagtgcggatgcatttctgaattatagaaaccacagggaaaagtccttgcagaaactcatgcagcccatgtacattttactaacaaaacagagtttaggagaaagaaaaaaaaaattaaaacctaccttgtgcatctgaatactaaggcatgagttagggattttgaaaagctgtaggttaggttgtgcactccccactcccctaaacttcaaagctttagacaattcagataaaatttcccctcccacctttccttcctccctccttccgtcctttctttcctctttccctccttccctcccttccttccttttctcatcaaattatctgaataatgtctccctctctatttagtagagtttccaggtatgacagctcattgctatttttcccctcttaacttatctagaaaaggggaaagaggccacttgcactgtgatcatatgctttgttgcccataaaaaatttttttaaactggcccgctcaagaaagaatccacgcaatgcaagaaggaaaaacaatgaattcagagaagcttgttcccatccacttggaacgcagtctctttttggcaatctatttgatcagctgggggaaagcattcttatttacataaactcctgatcctttgtgtttcaggatggcaccattccagggatgtggtttccatatgaatggagactaaaggcccccaggtgcccatcagacacctaatagagatagcttctctaggctgtccaggaatgtctggttgttttcatctcttacaatcttgcagaatgatctaatatttgcaaatgcttatgccctctttaacaattcaatgaccaaataagaaattaatttagaaaataattgtctgaaaaacttgtatgcctactgcatataaactctcctactgggtgctacagggattacagagatagctcggcacttgagaaacagacaggtgagaagaagcacctaaacattaatcttcttcctggctgggtggtgtcgtacttacaatcccaggactttgggaggccaaggcaggagggttacttgagaccaggagtttgagaccagcctgggtaacatggtgagacctctgtctctacaaaaagtaaacaaaacctaaccaggtgtggtagtgcacacccatagtcttagctacgctggaggctgaggcaggaggattgctggagcccaggagtttgaggctgcagtgagctatgacttcagcctgggcaacagaggaagaacctctctctaaagaaaaaaagaaagaaagagagagagaaagagacagagagagagagagagagagagagagagagagagagggagggaggaagggaaagaaaagaagaaagaaagaaattctcttcctcttacactgagcacaccaggaacacaggcaatgctttttctctatatgctctacatcacctaaatatagtgttgaggacataaactagtgatcaataaatggttcttgcagtgaatttccataatcaaaacccacggtaatcaccagccaaattttgcaggaaacaagcactcctttctctcattgtccaggggcagagcagatggggtggcatataagggccacataaccttccgtggtaggaagtgatgtcagacaagaggttgtgaatatttcatgtggttcaaatgaaaagcacatttaaggagacagagatggtaactgagacattgcttattgaagaagagaatctttcacatctgaaaaaactcaagtgcgttagaaggtttgactactcatggcaaaatagtttttgtgctgatttcacactcttactggtttctactaaaaaaatggagcttatcaaccacacaggtgtctactcacttacggttctcacagctgggattggaccacagagaaagaaataaaaggcctcctgaggcaatcaccagctcctctgcatctagaatctggctccaaaatgttgcctgcatttacttactgtctctgtacttgtgtcttctctgaagaacaatgcaaacttccagctgggttaaacccaatttagcacagcactgtcctttagatatttttaaaaacgtaaagagaaatgaccactgttctcacgctgtaatttcaaaatggcaatttccctactatatacttgttaaaagtgaaaattttttaaaaaggtaaaaggaaaaaaaaaccccactcagctgctcagtgaggcagagttaaaatattctgcagaaacagcacttatgaaacaggcagaacccctggggctaccaattcatgaacacacaactggcagtacaagacaggtgtattgtcgtagactcatcacccagaaaagcattattatttacttttaacaataaacattttatgatggcactccgttttagtgataaatgactggggaaaataaaaaatgtgtatagcagaatcaaatataggccctccccgggggtttcactggctttctctcacagctgctggctacattatttcttttccacttacatttttacagcatggggttggggcgggggggtggctcttggttttctggttgtacctgtcagatttgttaatcaaatgaatccagtcctacaaacgatgagcctgtgacagctggcctttggggttggattctgccctgggcagcaaagtgtcccttatttgggtatttttttccaggttgaaaactcggcacttaaaatttagcatcttaccactgtgaaataacaggcattccgaaagaacttcggcatctgatgcctttccgggaacacttgggccactctccttaacctttaccggcagttttaaatactacaatgcaggtacaagcagaaaagccaaggatgcgggctatgcaaagccactctgtgactctacctactgccatgggaacgtacttatggatgtggcatgtgagtgtgtgtgtatgtgtgagtgggtttgtgaaagtgtgtggattcgtgcgaatacgtgtgtgagtgctttgtgtgtatttttggatgaatttgtgaatgtacatgtgtgttcatctgtgtgtgtgtttgattatctgcttatgagtctgtatgattgtgaacgtgtgagtatatgtgtgctgtttgtgtgactgtatgagtgtaatgtgtgtatgaatgtatgtttgaatgtgggtttgagtgaatgtgtgggttgtgtgtgaatgtgtgtgtaagtgagcatatcactgcgtgcatgtgtgtagctccttaagtgtgtatctgaatgtgggttttatttttgtgcgcgggaacgcacattgtgggtgtatttgtctatatgcatttgtgcgttgtgactgtgtgttgagtgtgagcgttgtgagaatgtgtatttgtgtgtcatgagtgtgtgcgcgtgtgtttttgtgcatatgtgcgcgcattgtgtttgtgtgcatttgtgagtgtatttttgtgcgtctgagtgtgtgcattgtggatctgggtgaatgtactggtctgcgtgtgtgtgggtgtgcgtgtgtgtgtgcgcgcgttgtgcgcgagtgtgcgagcgcgtgtgagcgggtgtgtggtgcggccgggcgcctccacctccctgatccgccccatcccggcgggcgcccgagcagaggcagcggcccgggccggggcgggcgagggagggacgcgagccggggcaagcgggctgcgccaccgccggcgccgcgccgactttgccctttaaatcggtctccaagccgattacagctgagctcccacgtgacgttttaccttctgtctcccggagcgcgttgcccgaggacagtccttccccggctgccgccccagcccgccgcgggggctcggctcccgcaactttgggcgaagcggcggccggctcgggcgccctcgcggggccgcgctccacgcgggcgttgggggcttggggggctccgggggctcggccgggagggtggtggttagggcggagagcgtgcctcggccccagcccgcgcccctgccaccgcgcgccgcggcctcccgaaagcgggcggggtgccctgcgcgcggcgtggggaaagggggcgcccttcgccggccgggacctgagcggtcgcgccctcgagggagccagctgggccatggccgcgaggcaggggtgagaccggcggccacccgtgagccctccgcacccgcaccatgcagaagagcgtgcgctacaacgaggggcacgccctgtacctggcctttctggcgcgcaaggagggcaccaagcgcggcttcctgagtaagaagacggccgaggcgagccgctggcacgagaagtggttcgccctctaccagaatgtgctcttctacttcgagggcgagcagagctgccgcccggcgggcatgtacctcctggagggctgcagctgcgaacgaacgcccgcgccacccagggccggcgccgggcagggaggcgtccgagacgcgctggacaagcaggtaccgcgcgccttctctccgcggtctcccagccttgatcgccgcactcccttgccgtcctaatccggggatcaggggtcgggggtcgtgaaagagtgcggggactatgctccgaaatccccccgcgtcaccagtggcgggacatctccacgctccttccgatcttcatccagggattctcccatctccatacccctccaccccactgccaagtgatcagtcagaatagtggcccgacttgctttcattaccctggtagaggtcgagtcgtttcagcttctctgccaaccatctattgcttctctagacctggctcgccagatttttgtctggtgacatgtattgacacctgttgggtgtagattggcaagacggaactaacttatttggaaaagtttgatttctgccatacccggctggcgcgtgtagatttctttgcctgcagatgtttgaccactggttgggctgggaacaagcggggctcccaagccggacagacactttctgttggtcattttcaatcagtctttgtgatttcggtcagttggccttgctaacatttgacctgctgggtgtaattatgaaggtaaatgtgtattcatattcctcaggattaatatttggtagccacattcttgctatgtttaaaaatgtgggcatttttaaagaacgcttctgtacttttaaatgaatgctttgaaaatgaatgcgaccttttaattctgggtcataattttattagttttgctgtgtgctcatggtcgcggggtgggggagaaaaaccctttaagtcttagtgatcccagcccctcattcctgcaaacacaaagtttgtatgtttccaatcaccgtttggttattaaagttaaagcagactaattttatgcccctaatgttctcatttagcttctcaatccccaccttgatatgaaaaaggctgattgtttttgctgttgcgtaaaaatattcgcagctgaattttccatgtgagttcagatcagacagcatctaccgcacaccacagaggctgtgggaggtgctagcaatggagtgatccgtaagatgcctacctaaccctttggggctcataaaacaatgtgtaaaattaagaggagttaaaactagaccgaccggaagtttgagttgttttcactataaatcattaacagacttaagtgattaaacttgttataacacttataaatctgaaagtttaaatatgctctttagtttctgagggcttgttcagagtcatttgaaaaactgatttccaactttatagatatagatactagaaatataaacataaatttcaagtcatgcattttagaatttaaattgggagaagagttttgaggaaacattttttttcaggaatatatataagtaacattctattggtgggattttttttaaggtatgtgttccaaggccccgcaggaaccaaaatgaataggtttctaaatgttattatgtctaaagtagaatagggtattttaaattactcaggatatatatcatttacttaatctcaaattatttgttttcttcatatttatattaatataagataaccacttttgattttttttttttcagttaggggtggggagttgttacctgttacaattcatatggctctctgacttgctaatgttatatggaaaccaacatttttctacttggaaaatatctggactgtaatcttcaagactgttttctttcttgcactttaataaggaaacataacttccaaatagtttgactttcatgccactttctaatggttgtcctaaataggccatctaatgaaaaaattgttttccctttttatgaccatgcaaatgatgagtatttctcagtcattttattcatcttcaagaggttagaaattagaatctttggtgtttgtagataaatctgagatgtagagaagcaagcattccagaatggattaggagttgggctgggaaaccttccacattttgtcttgcattagatgtgctgctgtgagttgggttagcttagcccactgatgcttttctctggcactgccaactgggtgtgtttgaataattaagaagaaactgtgaaaataagaaacaaggagaaacattctaccttaaatctacagtttatccagttggttacctctcagctaatttatgttgctgaggtgcttagatcatccagacactgagacacgaaggatctgtggaggatgtgaggagatgagcacatcccaaggtttgcttctttctccttatatgcttctggagctttccatatcaatatctccctcaacactatcaacacagttgaaggttagggcttgaaacaggacttagtgaggcagagtcatttttcttcaccaagtttccgtgttatttctttaagcacatctcttaatcttttctctttttttctgttaatgaaatctctgtttcctaatatgtaaaaattaagaatttggctaagttggtttccaattacctttcaataatggcatcttctatttctaaggttatgacagacagggtgagctttttgcagtgtggagaatgtgaaagaccatttcacaagattcagagattaccagtgtttgtaataaatactgcatctgaaaagccgaggacaagcaggtgattgaagtggacattctgataaattagttaggtcagcagatgtgcaaacctatagtaacatcattgcctgaggcagagacattcttattactcacattggagggcgacatatttattgtaatccccttgacagttacaatagttgatgtaattattgctataaactgcctctaagcattcttgggagcttaaagtccacatatccttcaatgatttttatgcttattagttgtgtttttaggtaagttacaagaagaaaacacccattggtttgcttcctgtaaataacaattcaaaataagttggttgacaacaacaaaaaaatccgttttttttttttttttacacttggacttaaattgtttccagttaagcagaaaaaagaaagtcactttccaaatatgcttagattgtaggaatatttgcattgctctatttttttcatagtgttctcagatttcactttgatgagtctttggaggattgcaaggctctcttatcagccttccatagtgactacttctttgggatagcaatggtgatataatcaaaatgagatcagttaaaaacaattttaagtggtttattttctccaaaagtgttgttccttttcttaaaaaggtgtccgatggcacttctttctagttaagctccatttgtggaaaatgaaaacctcccgttttgttccaggtgaaggagaaagggaagttgtatttagcaagtaccttctacatggtaggctctgtgctcttggtggctgttatcctctcttacctcatctaatttgaacttcagcttttggagatgatgagtattaacatcatcgttattattacctattgctaacactgaaactcaaagacttctggggagatgatcaaagtccagttgaagatataaagactaaattatgttgaagagttccttactaagactgtttttaaatccactgagcaaatctagatggatgggggcttggggtataggatgtgaatcactgttttgtttattcttatttccttttcaaaactatttaaatggcagttgtaattcttgagaaatacgattgcagaccattacatgttcaaagaaaaacgggatttatttttaaacaagcagttttacatgacattacttcaggaattcatttacttcaggaatggggtacctttaaaaatatttgcatttagggtgaaagtacacatcccagttagtctgctctgtttcagtggcagtatctgtcttgcctactagcaggagaagacacatagcaaaaaagccaccttgattcttatttttctggtggtggtaaatgttctcttcagcctgatttcacttgttttggggggtaaaatatctctttcgctctggaggtttaaagaagtagacatttgcatttgtgctgaattaaacatgttggtttaattttaaagggattaaaggctatgtgatttcctgtcacttcattactagtcattttagccttcctaaattgaccacaagcagaggattttaatcatcgaatgaattaggcagagctgcgtgcgaactctgaaatatttgtgggagatggagagtgtggatggtggattttcatactacttcacgttgtctaattataaccaactcaacttttgtttactgaacacaaagggaaaatggaataatgatatttgctaaatcttatacaatgttaaaaaatataatttagggaacaaaataatttattacttaaactttgtaattatccttctctttaaagttaaatgaaaaaaaaatctcatggattagcaaaattgagttattttaattttggctacactaagccttactatttagattgttgtgtaagaattcaacacagaaaagtccatccctgatgtgacagatgtattaatacataaaaatgcattattgttgtgaacaactatttttctgtgggtttcattaagtgacaactaagcgcattgtcgaggggtagaaaatacttgtagtgttataacaatttttcccttcttttgacaattaaaaaatagagaaatttttctcccactggatgatgacaagacctaaagcatgtgtgataaccaaatgtttctggttttagcaagcaaatgtcagtggttcattaaaacaattgctgatattgctgtctgtttaatgcagattatatttttaaatggatttttttctgcagttttcaatactacttaaatatgcatgccacagtcagtataattttaattttttggaatgaaattacttagtctttatgattattttgtaatgaaataagtcagattgaccaaccatatggatttgctcaagtcttaaattctacttttcacaggtttaaagtggctttctatttttatacctatttatttgttctacaagaaagggatatatgtttgtgtgtgtgtgtgtgtgtgtgtgtatgtgtgtgtgtggtgtttattcagtttgttacccttctactattttctaccgttgaatattaaacctttgttaggcggttatatattggagtttgcagattttgatttgtacattaacatttcaagacctgagttataaatcccatctatctataatttggggagctttatttttcaggactaaggatatggaatgattctgttaaattactcacaatataaattcctctctgaaattagtttaccttaaacaaagactgtaaatagtaaaattttattgatatttaaatgaaactagaaatgatatttgttaaatatcaacatagcactgtgataaatgtttgattattttataacatttggcctttattctaaaatctaaccattattctaaaattatccattacatttttattggtgcaacttttaaattttagctgattgagaagttataaatacatgaatttggttccgccaaagggaatatgttagcatttttgcccaaggagttaaaaatgtaattgtgtatatatttagaaaaaaacagtagcaggtttgttgttgttgttgttgttgcagaaaatattggcatcagtaggtggaacagagatgcaaaaagcacatggactcacagttttatttttttactggcacttgaaaaactaatgatttaatgaaaaataaggattcaaatcatttttcctaaaacttattacagtgactacaaaatgcttcaaatatacttttagggagaaagcaggaaaaaaataacaagtttgagttggtctgtgtttatttaactaatatactacagtgtttcttttctttgttaaaaaactgtaaagcaagaaatgagacagaaagttggggaggcctatataagaataatttacagctttagattaaataagttaatcagaattttaattctcataagatctgagaagataaagataaaatgatgtaaaaaaagcaatccttaaaaataaaatttgttggccgggtgtagtggctcacgcctataatcccagcactttgggaggtcgaggcaggtggatcacctgaggtcaggagttagagaccagcctgaccaacatggcgaaaccctgtctgtactaaaaatacaaaattagccaggcgtggtggagcatgcctgtaatcccagctactcaggaggctgaggcaggagaatcacttgaacctgggaggtggaggttgcagttagtcgagatcacgccattacactccagcctgggcaaaataaataaataaacacataacatctcttggtaaagaaataaataaaaataaaataaaatttattgatcctttagtgcttaattaaaaaaaaattcaggtcacaatatctgtttttagctcttatgatacttaccagtatgacattgtgaagacctgtggtgatggaaacagcagggatatgagtggtactttttattattttcagggtactgaagtgtttcattttgtcattgtctgatttaatttagacatgcctgattcatttcctggactgtatttataagcccatgccatttgtgtgactaatgtaaacagtggggtcagttctttcaaatagagggactgttgaaaagctaggaggtttcctgcatttagcaatgtggaaatagggaggtgataacttggtctaaggctcagtagataacattataactgatcacaaaagaagtcatgacgagataatgtcagtgattcataggaataggaggccactcatattaatatgaatttgctttcttttaagaatgtaagaatatcagtttctaggtgaagtgctggtgttgtgtatggttcagttcaggatttaaactgcataggattcagtcttggctctgctacttaccagacacatgatcttgagcaatttctctttctaagcctggctccctgcctggaatatggagatccggatagtacctgctccatcaggttgttgtgaggctcacaggccaagctcttggcataggcctggcacatggtgaatggtcagcacatttgccagctagcatttttattactctctttgatattcctctttttattttcattattaggatgacttagaaagtattttcctttcctttccctttcaaaaatactttaacacacacaaaatagaatatttcagggaatgccaacctactcatcctccagcttcaacatcttcatctttctgccattcttgttttatctgtctccatgtgtacatttttttttttgttagaccactttaaagcaagttccagacattgtattatttcacttgtaaataaggaacttttttcctttttggcatagcacttttttggcactggagattgcactggatatagctctgaaaaggactatcttggaaagagttcataatgagtttctgttaataatgtgtgctattataaaggtagccctcttttttgtttctttcatgttataataaaggaaaaaacttaagacaatagttgtgaagacataaaggagatggaattggcttttaaataagtcctagtatgttaaatcttaaagggaaggaagtttgaatcaattttaaaaattgagacggagtcttgctctgtcacctgggctggagtgaagtggcgcagtcatagcttactgaagccttgaactcctgagctctagcgatcctccttcctcagcctcccaagtagttgggactacaaatgtgtgccaccacacccagctaattatttatttttttttggagatggggtctccctgtgttgcccaggctcgtcttgaactcctggcctcaagcaattctcctaccttggcctcccaaagtgctgagattaccagcatgagccactctccctggccaaaatgaattgcataaccatgatcatggtgtaaagtgttttcatgatttgatcccactctaaggggcaattaaatcattggtgatcctcttactgagatcttctttccatttacccagctcctccagctgtgcaggactctttttttttttttttttttttttttaagttggagtctcgctctgtcacccaggctggagtgcagtggcgccatctcagctcacggcaatctctgcctcccaggttcaagtgattctcctgtgtaagcctcctgagtacctgggattacaggtgtgcaccaccacacccggctaacttttgcattctttttttagtagagacagggtttcaccatgttggtcaggctggtctcgaactcctgaccttgtgatctgccccccttggcctcccaaagtgttgggtttacaggcgtgagccaccacgactggccagcactcttttttcttttttcttttttttttttgagacagagtctcactctgtcacccacgctggagtgcagtggcgcgatcttggctcactgcaagctccgcctccagggttcacaccattctcctgcctcagcctcccaagtagctgggactacaggcacccgccaccacgcccggctaatttttttttgtatttttagtagagacggggtttcaccgtgttagccaggatgatctcgatctcctgacctcgtgatccgcccgtctcggcctcccaaagtgctgggattacaggcgtgagccactgcgcctggctaagcactcttatttagaatcaaggataagagtttcctacacagatgccaataatacttcttcttcttttttttttttttttttttttttttttgagacagagttttgctcttgttgcccaggctggagtgcaatggtgcgatcttggctcactgcaacctccgcgacctgggttcaagcgattctcctgcctcagcctctcgagtagctgggattacaggcatgcaccaccaccccgactaattttgtatttttagtagagacaggatttctccatgttggtcaggctggtcttgaactcctaacctcaggtgatctgcccgccttggcctcccaaagtgctgggattacaggcatgagccaccgcgccctttgcacagtttttcaacagtgagaatgtcatccatgagctaatgtctcatccaactttcacaatcaattctgagacccaacagctggtcaatattattttagggcagttactaaggcttcattaatcaagtgtgtagttggctttttctagtattgttaaacttttatctagggttagttggtttctgtcctatgactgattgttttaggcccttttgattgcaagggagaggtatgaactagagttgtcttgaataatgatcacctctgagtgttgaggggaacagtgggaatattacaagacaatatacaggtgagtagtgctctttatggggacttagctcttctttggatattgctgctggccaacctttcagtgtgtttatccccgtttgccttctcactgagtctttcctcataggtttttttcccctaacttcaggttgtcataaccctcatgatactaactcagtgttgtggtcccttttctcctgcttcagttttcactgcagcatctctcatatccagggtcatattcttgtgagatagaatctgattgtctcagttcaaatttgggggccagacaaaatcatcagtctctgaccagcccgtggcttaactgcgaaacagcaggggctatggacgagggtgtttcacagaacgtttaatgagcatgatagtaattattaacacatctagtgcattcatcaagctagttaagattacttttaccaaaccaatgttcattcactgtgataggccacattctcttccttcagtagcagttttacatcctcaccttatcaacaagatcttacaataatacaccatttctgtcctctggtcctgcgctgtcacctgtaccgcccagagtccatgttcaaaatttttctttacttttttatattttaaaaattatttacaattgttcttgtaacaataaattaaaaataaacctatttttcaaaatgtagcgtacatcagaaaagtacacacatcataggtgtgcaacttgatgagttttcacaaagtgaatatttttgtaatcagcacccatatcaagacattgacacgatcagccctccagagctaacctcatgcctattcctctccaccaccccaaccgtgggtagccaccatccttaatttgtgacaccatagaatgcttttgccagtttttgaacttcctattcacagactcatgaagtaagtactctttcatgttggatttctcttcctcaacatcatatttgtgagattcatccacgttgttgtttgttccttttcatttctttctttctctcttttttgagacagggtcttgctggagtgcaataatgtgatcatggctcactgcagcctcgacacctcctcaggcttaagtgatcctcccacctcagcctcctgactagctgggactacaggcacatgccaccacacctggtattttttttttttttttgagatagtttcttactctgtcatccaggctggaatgcagtggcatgatcatggctcactgcagccttgacgtcctgggctcaagtgattctcccatctcagccccccaagtagctgggactataggcatgcaccaccatgcctggctaattttttttttgtatttttttagagacaggctttcgccatattgcccaggctggtctcaaccgcctgggctcaagcaatctgctcccccttggcctcccaaagtgctgggattacaggcatgagccaccgcactccaccccagctaatttttattttattttattttattttttatttttttattttttagagacagtgtctccttatgttaccaaagctggcaaactgttgggcttaagtgatcctcccaccttggcctcccaaagtgctgggattacaggcatgagccactgtgcctggccccttttcatttataggtagtattcctctgaatgagtatacaaagatttctttattctgcatttgggctggttccaatttggagctgttataaataatcctgctttgaaaagtcttgtacaagccttttggtgtacatacatgtgcatatttctgttgggtatatatactcaggaatggagttgtttcaaagggcatgcatatattcagcttcaataatttttgctaaatagttttccaagatagttctatcaatttatacttccaccagcaatgtttaagaattccagttactttccaaccttgccaacccttggtcttatcaggattttagttgtaagcattctaataggtgtgtagtaacatgtcattttgatttggattttcatttctctgataaaaatgaggttgagcaccttttcaagtacttatcaatcatttgattggtctctgtttttttcttctgagccagagtcttgctctgtcacccaggctggagtgcagtggtatgagctcagctcactgcagtctttgcctcctgggttcaagcagttctcccacctcagccttccgagtagctgggattataggtgtgtgccaccacacccagctaatttttatgtttttagtaaagacagggtttcatcatgttggccaggctggtcttgaactcctgacttcaagtgatccgcccacctcggcctcccaaagtgctgggattacaggcgtgagccaccgcaccagcctgttctctgtttcgaagtgcttgttcaacctttacccatcttttattgaattgtctaattgatttgtaggacttagaaatattaagttaaactatatgacctaccatttctgtacatcaaaaatggttaaatatcataatttcatattgtttatcctaatatatatgatgagtcctttgtcagttatatgtattgcaagtattttctcctgctgtggtttgcctttctactctcttaacggtgtctttaatgaacagaagttctaaactttatgtagtataagttatctctttttctttatggcatttatctgtccatgaaatgaatggagatgaggacaacatctgaagttgttttatgtagaaagtgcaggaactgggcctctcccctgctgctctgatagatcaaattgtggttaaatcaagcagacagatcacagaagacccaaccataggtggaatagaatgtgcttacagtaggttgcggttgccaccccaggatgtcttccttttagaggaagtctccaaggacaattctgaaagacaaaagtcatgatgttcttccctccctcatcctcctgtgatctgaggtcttccctcctcgggtgctgggttgttgctcttcctgcgcctccacgtattctgggtatctcattccagtagcactaacttcatgttttcccaataattccttagtcacacctagatgttttgtctggaagggacaagggcacttaataaaacttatgcagaattaagtttgaatcctggaggtccctttaagctttgctgctacttggagggcgagccaaccaggctggcctgggggtgctatgagggaaagaaaaatgcatcatgggcagcaatggtcaggacggtatcctgaattttcaaaacaggtctctatgatactccataatcacctcgctcccattttgtcctgaccattatccaggaagtggccaagaagtgatgatccctttttggggatagtacattcaatgatcaaagtaccttactaaagtgtatggaccaggaggagatgagggagagagggagctggacagccagttcattgttgagtatatagattcgttcaagagctacaatggtgtggctggaaacagctgaccagtaataatccgaaaaggtatcaacagtggtaaggcagcattgatagccctgagaggggtttgaaggcctgatgtagccaatctgccaggagcagtagtgggtaatgctccttgcaatatgacctttctcattgcaagactaatgggtcagcttttggcaggagtcacaagtctgtcattcattggtagcctctgcatcagaaacagccagacttgatgaatggtgggttccatcagaaaaccagtccttatttgagagtatctatgcaattgttccagacagttcgatcagcagccatgatttgtttccagattcacatccacaaagaagggtatctttaatctgccagtctgtagttttccaagtggtagcacaaacagctatgctgttggcaacaaccgaaaagtcagttctacccccgaatgaagcaagaacatctgtctgcaagaacatctatctgcttttgcttcagcacagctgacactgaagctgagtagctacagcgccctagtgaacaccactgggtttcagcttagccaaaccatcggtgaactaggcccaggcatttaggaaatctgtgccagggcctcattgagccagtgtctttggttcagatattagagttggggataaattttcccccagagggacactagctacttttttaataatgtaaagctaagatacagctgaggccgccagaccagctctattcttcagtatgccatttccattcgacaagcaaggaggtgtcccttcccaccttgtgagttcttgatctgacttcatctatcttcagatgggaatttaggccggagagtcacaaagtctttatgaatcggttttgacaaagactctgtggcagcaaactaatagttgcctgtatgccttgtaattttgatgaatgctggacattgggtgtgaaaaatcgtagtggtaatttgaggccctgttatttttttttcagagaggatttacttttgctttcttgcaggcattagtgtgggggcacattctattaatccattttgggattgagctggtcagctaggtttcaggttttctgagagcttgtctacttccagtttgccctaatttctaaagtatagccttcccagagtcttctctggaattttgggatatttacacaactcttcctcttttggctcctcagtcccatgagattgtcaggaactcagtgctggtctcctgccttttagctgctgctttctgcttggtttcttagcctcctggctctgcacgccaataaagtggcaaacgcctctttatcgaaaagcttccctgagtgtcagactcactgccagtgaacctccctcctctcaggcatccttgctgctcatgtcttggctgtcttgtttgcttaatgatgagttcaaacagatttttttttttctttttggcattgtgtccagctttgaaaattcttcttagtgcgtgtgtcgttgaggggtgggtctgcaacaagctacttggccattactacttagccaggagttttaatcttgagtttaaaagcatatgaaactctttttaaaacagtggaaaagttaacccccttattttctggaaacttacctgttaattacttctagctcaataatgataagctagtaattagtcaaattacaactaatccttattttatcaatttaattctgaacattgctgaacattgtacatttgaacaaaagaaaagaaaaatatcattttgtagtcataagacattttacagctatttatccttatttactaatgagtggtgaggtatatattttgagggtaccaagctgtgagtcccatttattccttacatagtgggtttagtttaaacttggcttttaggtattttctcatacctgatatctgtctgttgatctattgtatattttagttgatgaacatttaatttaaagcaatcatctttttttttttttttttgagacggagttttgttctcattgcccaggctggagtgcaatggcacgatctccaacctccgcctcccaggttcaagcgattctcctgcctcagctttctgagtagctgggattacaggcatgtgccaccacacccgactaattttgtatttttagtagagatggggtttctccatgttggtcaggctggtctcaaactcctgacctcaggtgatccacccgccttggcctcccaaagtgctgggattacaggtgtaaccaccacgcccggctaaagcaatcatctttctgtaggcctgtagtatactaacttgttaatttttatgaacattgttttgtgttatacgactgtaagagccactctttgtttaatgctaatttggggttaacactgaggcatgcactttccatatattatcccatttaatcctcacaaccaccttgagatatcagtatcttgttttgcaggaggcttagaacggtttagtaattcacttggggcaaacctttacgaaatggcaaacctggttaatagaaccaaaattaataacagcatttggtgagcatggcccttagctaggagctggaagtatataactaggaaggaaatgtttttgtcttcagtctcattctcctccatcggaactagtatacataacctctataatctctatgtgctgggttctgtgctgagggcctgagaacttagacatgatagaaagtcgggtgttggggaacagcagtctgtgtctgaagaacccactgtcttcctcctgaacctcttgacttgcagctcaggcttccttcttggtgtctgcccagctccacaaggtgcctggcactgaggatgtagaaaacacagctctttgccgtttcagaccttgcctatggtacagctcttgactccgtgaggacatttcttacattttaaggtgggtccacatcctctgtgccttgatttatgctaccactttctggccactagaaagttctaagtttcaatctccccaggcccagagcagtgaataccatgttgccacacattggcaaactgcaacctgtgccattcactgtgtgcgtaattaaatgagaaggggtccttagatgtacatggtctttctgttttggtccatagcgtcctcttgtatttgttttgttggcaaggttcacctatttggaattgtgacatcaaatggctgaatagtagcatcctgtgattgtagagccccaactgtcgtttcctcccatgaacatgagtatagaaatttattttcagcatggtggtttgagcagagtccatcctccttcctgtttacctggcctgtcctttgttatagcacggaaggagccatggcattccatttggatgaatggtaccaaacgtccagtatattgaggccaaattcccaagttcaagttctagatccatctttgacaaactctggatcctcaagcttactcatgtcttcatctggaaaataggcatgataatttctacctaataaagaaagtggaatattaaattaactgagataatcttatgtgaaaggtgtttgtaaactataaaatgctaccaaaattttatttatttatttatttatttatttattgagatggaattttgctcttgtcccccaggctggagtgcaatgacacaatctcagctcactgcgacctccatctcctgggttcaagcgattctccagcctctagagtagctgggattacaggaacccaccaccacacccggctaatttttctatttttagtagagatggggtttcgccgtgttggtgaggctggtctcgaactactgacctcaggtgatccgcctgcttcggcctcccaaagtgctgggattataggcgtaagccactgcacctggcccaaaatgttattttaaattcttcacaattacattttttcatttaagtgagggcaatttaaagagcaaatcatttgaaagtttggatgctacagatgtgtattctgttcattttatggtccattttgagaaccagatagcttatcagcctagtttgtaagcatgtttatgagtctggggtttttaagctcttcagagaatgtttagtggatggtaaattccttaagaaatagttgggtgattacttttactaactgcaggaaactattcccttagaggataggtgagtgaaagagtttctttgtcatgtgatttctttctggtacgtaaatccttctgactgtgataattatattaaatatattaaagtaaaaataatagggttttcttcagaggaaatacatagctaaattgatatttatgctttaaaaatgcagttttttaaaaagagagtgtctaaaatgtatactaaaaggaaaataatgcaagtccacagcttactcttttttcttccttttagtataaagtaccgtgttaatagaacatttttaaaaagcagttttttatttataaaagtaatgtctatcatgtaaaatttggaaatcacagagaactatatgagaaaactaaaatattctgaaatcccattcttaccagaaaactatgtattcaattgttggagaattttcttcaaggacttttttctatgtctgtatataataaatagacattttaaagggggacaaggccaggcacagtggctcatgcctataatcaattcctgcactttgggaggctgaggtgggcagatcacctgaggtcaggtgttcgtgaccagcctggccaacatagtgaaaccctgtttctactgaaaatataaaaattagctgggcgcgatggcgggtgcctgtaatcccagctactcaggaggctgaggtgggagaatcacgtgaacccaggaggcggaggctgcagtgagccaagatcgtgccattgcactccagcctgggtgacaagagtgaaactccatctcaaaaaaagaaaaaaaaagggggggaaacaaaactgggatcatattgtatatagactttaggattctgatactttactgaatattacattgtgaacattttgcttgccagtaattattttttgaaaacattatttttaaggactgtacagcattctatcacacagatgtacaataaacattcccctactgttggatatttagcctgttttaatattgaaaagctttgttttgctattgtgattctgtagtgaacatcaggatggcatttgtgaataaatttgcagggtcggtggagcacatgcaaagaaatgaagaaacaaaaaagtgggaagtgagagtctccttttagctactatgattagggtagttcccaatttctccaccttactcaagaactattttatttaataaacactctacttgcatttcaaggtagctttgtaactaattgaaaaaattcaacataagatgtaaatttctggaatgaaagtacaatctgtgaattaaaatatagaaatgaaagaccaaatatagtagtctaatttcttgaaataaaactaagtttaagtgcattttggtgatattgggggtgatattcattgtaattaaagtgcctagggttgttattaatgagctccatatgaaggcacaaagtaggaatgcctcaaattaccctatttaattggttctaagaataccttcattttaatattttgcattttctgaaattaagttgtgttttcaattattgtgtacgtatgattgatgtactaattatttccctaaaatcttcactaacttatgttgcactttacaacaccatcttagaaacaaaggaatgtggcagtttccagatgagagatacttggcatttatttgtgtttcaaagatctttgctgcatgtgtatttggaacagcatacaggtactgtataaaggatgtctatattgcatcctgtactgtaagctttggccttttataataattaaatttaaggctagagaatatcatggctatgtgagaaagaggaaaatttggtgcttggcgtttgaggagtatgctctgaaaacctgcttggaaagatggccgatgttagtaccagctaacctttaccctggttgatttttatctttttttgtaaccccataggaccacaagatctttgctcactaaaaatcaagatgctgttgctgattctttatacagctacagcattacctactcatttggcagtgggttttcattttttcatattcttccatttggcttagagaatggcttatttgacagtttggtaattttagcccatcgttaaatctgatttgttacctttgtgatttgaaaaaaccaaaacaaaaccattcagcactcatggataaggaaactcattctttcctactttactttactgttggtaagggctgtcttgcctcctcggactgactgttatcctttgcaccaagaacattgtgtccccagggcccaccagcccttctccatcatggctttccatgtggcttttggaaatgagggtgattttggccccagacagtactcttgaaagaatactggctgggtgcagtggttcatgcctgtaatcccagcattttgggaggctgaggtgggtggatcacttgaggtcaggagtttgaggccagcctggccaacacggtgaaaccccattgctactaaaagaatatgaaaattagccaggcatggtggtgcacgcctataatcccagctactcgggaggctgaagcaagagaatagcttgaatccaggaagcaaaggttgcagtgaaccgagatcgtgccactgcactctagcctgggcgactgagccagactccatctcaaaaaataaagagaaagaaaaagaaaaaagaggataccactgatttcttagtcccctctcccttaccattttaaaacttacaccctttgtgaattgtaataaatgagtgttctaactgtgatgtttagatgaaacattttatttgaaaattatttgggggtcttagaaggcaggtttgtagggagcgtctctgtaattttgaggaggggaagacagcctgttggctttttacctggtagccttgttggctagagaaatgggattcttccagagcccacttaccacacccctgcctgccggttctcagactctttagggttcctgccaataacatcatggtaaaatccaggcaggcaagcaagcattttctagatacttcgtaatgtcttctccacatttgtctaaaagccacttaaagttttagagctgcgtatgtattgattatgttactatactcccaatacagcaatactacttgtttatagtcactgttaagaagtgaaaaccttccatttcattaagacttttgttgttgttcttgttaatatgatttggcttttcattgcctaattgataccacagcacgggttccaagttttccaggacactcttgattggaaatattctacctctacaattccataaatgcttttgggttttcaggtcatggtatcatggttttgctttaaaaattgtggtacctgtactttctgatagcttaaaaaaagtttacaaatccgtggttagaaccttaaagagtgttctcagtggtccatgtgctacaactgagaggcaatgaggctttcttacgacaaggattgccatttgttgttgctgagctctgagcacactggcgtgtacttgtgtgagtacgtgtgtgtgtgtgtatgtgcgtgtttgtgtgtgtatgtttgtagcagtgctctagagagtgctttttttgagacagagtctcactctgtcgcccaggtcggagtgcagtggcatgatcttggctcactgcgacctctgcctcccaggttcaagtgattctcatgcctcagccccctcagtagctgggattacaggcctgcaccatcacacgtggctaatttttgtacttttagtagaaaagggatttcgccatgttggccaggctgattgcaaactcctggcctcgagtgatccacctgcctcggcctccaaagtattctttaggaggtgtcccagacatttcctttctcatactaaaaattgctttttaaaaagcaaagcatctagtttcaatggaaaaattacagtgtcatatttacctttaaagaaaaattttgtaaaggataaattatattataaagggaaatacagttttaacaatgaattaattcactagcagtggagcactagagtgatatggcttatgccctaaaatgatagatcaggacaggcattagtggggcttttctgcctgtgaaggtctggaggtatattctcaactctggtggctcttaggagcctttgtcagagtctcaggacttcattccttcatttactcactaagcaggttttgagcacttgctgagtattgagggctctactcaggcctatgaaagaagtttaaggtctcatctctgccgtcctgaaagcccgtatctatggaggagatgagacggtgtatttgaaggcattctctgatgacttgggcgggggttagtaaaggctatacatattcttggaaggggaagacctttctggctttgtggtcagggagggttacaggaacatctgaaatcacccttgatgaaagagccatgtttaacctgtaggaagaaggaagaactaggctcattttggcttaagttgaaagtgtttaggttcaagttggtaataatggttgggcaagactggaaaggaagatagagctgtgtggctgggggctggaagtgggatagaaatttggttctattattattattattattattattattattattatttgagacagagtctcgctctgttgcccaggctggagtgcagtggcacaatcttggctcactgcaagctctgcctcccgggttcatgccattctcctgcctcagtctcccgagtagctgggactacaagtgcctgccaccacccccggctcattttttgtatttttagtagagacggggtttcaccgtgttagccaggatggtctcgatctcctgacctcatgatctgcccgcctgggcctcccaaagtgctgggattacaggtgtgagccaccgcgcccagccaggaatttggttctattattaatcaagtttactgtggggaatttttcttgatgtcaaataggtctccacaaaaatttgcagtagcttggagccatgtctctcaatgttagccatgaggaatatccacttgtatgcttcggtaccactttttgaaacgggttaggacaggatttccagaacttttactttgcaaatgtctttgttaatcctcccttacttgataacctgttctctaagcagcgtctgccctctgaatgtcgacggactggcgtcagcaatgacagagaccaagctgggggcatcccctttgcccctgtttcctctgctcccagcatctgctcaagtcaataccaacatgttgggatctctgctgtggcaactgcaggacactgaatggtggactctccatctgggagtctcagttgctaggtctcgtcccttgcagccacctgctctcattgcgatgacttgggctctctgcatggttgtggggctcactgggatctggtgaaactgatggcagcagccctgcccaccctaagggcagctgctcttcatcctgaggatgtctctatctgagggcatttgggtgcaaagccacaaccctgggcagcccgccctaggcaaacagtgctatttaagtacctacagaatatctttgattttgcctctgggtctgcagggcctaaaatatttactatcttgccctttacggaaaacatttgccaacctctgctttacatctgcactgttcattatggtagccactagccacgtgtggcttttgagcacttgaaatgtgactagtccaaaatgagatgtgctttgtgtatacttacacatgctggaattcgaaggcttggtaccaaaaacccataaaagagctcaataaattttttatttgattacatgttgaatgaatattttggatatactgggtgaaataaaatgtattattaaagttaattttacttatttctctttacttctttttcatgtggccactagcaaattcaaaattacgtgcatggcttacatttgtggtgcgtattatatttctgttgtccagtgctgatctataatatagcatccaagtttattgtctacagacttctgttttcatggagcctcttgaataaactgagctcgtttttccttcttcttcatcttttttgtttttaaacagagtcttgtgctgttgggcaggctggagtgtagtggcgtgaccttggctcactgcaacctctgcctcccagattcaagtgattctcctgcctcagtctcccgagtagctgggattacaggcaccacaccaggctaatttttgtatttttagtagagatggggttttgccatgttggctcagctggtcacgagctcctggcctcaagtgatccacccgcctcggcctcccaggtgctgggattataggcatgagccactgcacctggcctcgtgtttcttgtggtacaagtttagcaaacatgactgatccccaacatgttttaggttagggtttgtgttttgttgacacctaagctataatttaattgatgtaaactcttacttttaaataaagattatactttcctttgtgttttctagatccagatgtttattatgctctgttttattttaaatcaggtattcctttgttattcttctatcatatgtgttcttaaaaatctatgaggtatacattttctgtgatgtaaaaattatgatcttatcatgtctaatctttgatccagcaactctacttctaggattatgacctaaggaaacacttgtattaatgtgccaaggtgtgtgtataataagtaggctcattagaatgttgtcattaataatgaaaaattgaatacaacctcaatgcccgactataaagattgagtacttaaactatggattatccacataattgtattttcaatgtaaatgatggtaatgagttattagagagtctctatagaggatcaatattttaaagataaatgtatgaatttgtacttttaagagttctgaaagaggcctgtgtagtggcttatgcctgtaattccagcactttgggaggcgaaggcgagtggatcacttgagttctggagttcgagaccagcctgggcaacatagtgagaccccatctctacaaaaaatatgaaaatattagccagatgtggtggcaagtgcttgtagtcccagctacttgggaggctgaggtgagaggataacttgagcctgggatgcggagattgcagtgagcagagattgtgccactgcactccagcctgggcaacagagtgagaccctgtctcaaaaacaataacaacaacaaaaacaacaacaacagaagttctgaatgaaacagattctgaccgttcatactgattctctttgatggggaagattggggttaattttcttcatgcttatttatatggtctatttttctgtagtagacttgtgtatcttatataatcaaaataattatttagccatttagtaattgatatacgatgtagctacataacaagttcaaaattctaagtgaaaatatttttgtggcatgagaatttataaaagtctattttattgtcacataatgaaggatgttagataaagagcattagccccagagattagtcacgtgttgcaaacaaattgttttggtagtaaagtaaggagtaaagaaatgtgtactctctaaaaaataaagttcttatttaagcaccttctgaggtctaccctggattctctgttttgctacaattgtgatcgccagtgactttcccactaaaataatttcctgaatatttaagtgtttcatggctagttatttttaagtgacccagcacaggaaggatgtggagggggtggagtattatgggaactcctgccagtttgtggaaaaattgaaagtgaactaaggccaccaaaaggagtctgaagagagtgttaggtatgaagcaaagatttttgttgtggaagataaatatagagtgtgtgcttgactccaataggtctttaggtgtgtgtgtgtgtgtgtgtatgtgtgtgtaagcgttttatttgtttccatggtgaaattcaatacaaagagtcagtttaacagttgaaacttcaaaaggtaagaaactggtttttattatagtagttaacaggtgagccctagctagcaagcagagctctactattgggatttacctttcacattcacaatattaaataaaactttatagatgccatcacatagtctatatctgaaattatatgttttgggaaatttaggtatagcttcagctaagttaatgggaaatgtcactggcaatatgcacatcatttaaaaaattggtcataaatcttttagatcattaagacattcatggagttaaatgctaccttctcagtcccaaccaagcactctggaagtctcctttgcacacccactgccccatacacagctcttatagcactgggatattgttggttattatctgtgtatctgtctgtcttttattcaactctgaactccttagaactgtatcttatttgcttttgcatttctaactaccagtacaggtatgtagttagtttcacatagtcaatgtttactgaaagaaggaaagtaggagaggggcattctgtatggtaaaatttttagtctccatattcaaaaggcagtagtctgaatagtctgaattgctccatagtggatgccttggggacataaggaaacgcaacagtctctaacttggagtttaagctacgtgttgcaaggagaaatctaccatttgtatctgttaaggttcatcttttcatcttgctcatcactgcttgatttcaaacctttatattacctcagttgaaccgctaggtgacctccacacctcctttccaattcattctccacattgccatggcacctgtttctctaaattggtcagatcatgttattttcctgcttaatatttgctgttggctcattgtaactgctagataatccaccctctttccagaaccttgaagccctcggaggtctggcccctttactcacactgcccccatatctgggccccagtcacaccatacaaagctagtcatcactgcttaacaggctgtgtgcattgctgttttctttgcttgaaatgctctccagctttctccttctgccagatgagctccttttctacagaagaccaactctctgaccctctgggaagtttgccacaccttgccagtggtctctgcatagtacttactaactctttgatttacagtgaccttatgggtctgtcctttgcttctggactttttctttaaattcccattgttcagctacagtgctcaagaggtaggagctcccatttgttgagcactgactgtgtgccaggcattgtgagagacttggttctcactggattaaaaagtccttgcgggcaggaaccacagtttaccctaggctaagcattcggtcgagtgagagctctttaaataaaacacattggttgaatgtagacctccccatcatcgttttaaaatagacaagtagttcagtcgtttgaattcaacactaattttatttcagcttcatgaaaagacaatttttggaaataagtgctgggtgatttgtagtgacgtcacttatttactctgctagtttgtttttgagcacatgatgcatgcttgtgggagagcagacaagggagggagcacagggagctggcttccacttaatactcagaaggttgctctggaacactggggaaagaggggataaagtcagaatagtgatgagcatacaatgtagattcttcgttaaagaaaaccactgtgaaatagctcatcacagtttcatataacttgaaatacttcatgacatacattctattctccagctgccacctccatctctcctgttcctttttgcctctgtttttgatcacggtgtgaaattctcttctcccatcactttctaatccaagcattattttcttagaaagctacttagagatcacctccacaacacttcctgttatatctgtcatctttctctgtgtttcatttgtaccacattatcatctctactcatgtgtagttttgaaataaatgtgcgtgtgtgtgtgtgtgtgtgtgtgtgtgtgtgtgtgtgtgtgtgtagtcttcttcttctttaagacagagtcttgctgtcacacccaggctggagtgcagtggcatgatcttggctcattgcaacctccacctcctgggctcaatcaatcttccaacctcagtctcccaagcagttgggactgcaggctcatgccaccacagccggctgatttttgtattttttgtagagacgaggtttcaccatgttgcctaggctggtctcaaactcctgggctgaagtgatccccatgcctcggcctcccaaagtgctgggattacagtgatgagccaccacacccggcctatcatctctttaattagtctgcaaagtccttttagccaaggaccatgtcttatttttcttataagttacctagagttcttagtaccattctatgaaggttgttaataaatgttagagtcttgctgaattaagtcattgttatgtgtttaaagtcttaattgatgtatatagtccaggccctggtggatactttctgcacttctctgtcaattgctacttaatagcaattgagagagccactgtctgctttcagatgctgactttgccaggtattagcagtctaacctttctgtgcttctgctttcatctcttaatgaggcagaagtaacatctcctcatagagttgagtcagggataatgtaagaaggcatttgtaaatatggcttaacaaacattccttaaaaatgttgtaatgttgcttaataacgtctggcacataacgaatgcttgataaataatagccattatgtatagtttgtacatacaaacaaaaataaagcataacaaaataggcatagtttggacatacataatttgccctaatgattgtaaattttactttttaaattgcagacattaaaaaattaaggtgacatccattgagcatcagaaagttgagcatcataattgattttttttttttttagacagagtctcgctctgtcgcccaggttggtgtgcagtggtgcaatcttggctcactgcaacctccacctccgggattcaaatgattctcatgcctcagcctcctgagtagctggaattacaggcatcacgcctggctaatttttatatttttagtagagatggggtttctccatgttggccaggctggtctcgaactcctggcctcaagtgatccccccgcgtctgtctcccaaagtgctgggattacaggcatgagccactgtgcctggccatataattggtatttttttttaaaagaaagaactcctttactttgtgttgatattcaaaatcagattaagttactctaaatcagatgaagtcagttgtataaagccttacctaagggtaccagatgttaaaagaattgatccaaacatacttatggaaatgttactgatgattttgctcatttctgtttggctattgttttttgtttagacattctactgtaatgggggatgcttaaagactcctttgtgtggaattctgtattggagcaacctttatcatcagaacaactaataatgttgttgcagactttggcgctactactgtagagtgaaaaaatgttttcataaagtgccacatcgtgttagtaaatgagatctggaagatggagatggactgtgaacagagagggagctagcctgctctcctcacgtgctgaaataaaaggttccattttgaagcctgggcttcactatattcttggattttgaaacatatactatgatggtcattgtaacacagtgtagttatactgtagttaatcatgctaccagtcaacttgttaaacttagtataattatttggtggtaaaatacaattacaataagagttataatgaggtgagagggatggtgagcccttggagagctatttcctcacttcagaccactattgtttgtctggattgcttattggactcgagaattcctctgctcatgtactctgtgttccccttctccccaccacctaccttagaggctgccaaggtggagagggcagatggctttgtgtataaaggctgcatacatgtttttgctggggacaagcgggagctgtgtcccctggagaaagtagggtcattttcttagaacacaggtgccttctatttgcttagcccagtgctctgtcgcctaaaggaaagacctcttactaatttgactgccagatgttttttttttttttattttctttttctgctcactggagcatcattgattaaactgcacaaaggcaccaatgtgttgtttagtggtggcttgatttccacgttctgtaggaggtaggtgagcttccctcgtgcccaatttcatgtccaacccagagccaatacttggaatcctgagaattttccaaatactcttgtcatcctcttgccagtgaaaggagtcgggagggggctccaggaagaagtcgtctagacccccattgctaagccaaaaaatttctgctgttagggcttcctatctgccgggggcattttcccttctctagctggcttctgttaggagctctttgtggcaggagccctgttatgttgagcagggctgtcggtccacacctttgctgcctcaccccagtgccccactgggctcctgtttggtgttgtccttttgtacttccaggctaggtttttccttcccatgggttgaattgctggctggctggcgtctttcacattcttgtggtttctaaactccagtgggaattccttggtgtaaatctgggaatgagcacaggtaaggacagtgacttcaaatgtccattgtacactagaagtgctgactgttctagtacatgaaggttcacaaaaggtgagctgcatagctcaggttagtgatagtgcttttgtgggtcataggagtttgtcagtttgtaggtcataggagtttgtcaattagactagagcaggaaagttatttaccttgagaaatggcataatctcatttttcatatcactgtagatgtctgggacccattatttttgtcagcacttcttaattttataagttcactgacagaatatctgaacttcaggtaccttagagccaggcctctcaaaccttacaaagatctgcaaatcccctggaggccttgtaaaatgcaaacttggggccaggtgtggtgactcatgtctgtaatcccagcactttgtaatgccagcaatttgggaggccaaggcaggcagattgcttaagcccaggaggttgagaccagcctgggcaacatggtgaaactgcatctctacagaaaagtgtgtgtgtgtgttggggggcctgaggtgggaggatcatttgagcccaggcggtggatgttgcagtgagctgagatggtgccactgcactccaacctaagtgacagatgagaccttgtctttcaataaataaataaatagcagaatctcaggcaggacctgagagtctgcattgctaacaaggtccaggaagaccttatcagccttttctcactcaacaggactttgacctttttcacctttttccagttttaccccaaagtcccaccttacatatccatttttattttgttttattttattactagagccatctctagtgtgcctgtttgctttaatatcaatgagatgtatattgatgtacatttttaaaaaaccttctgaactattgaatgcatttccaagataatatatacaaaaaagtagttgctcttatttttaaaatatttttctctttaagttatgtagccatgttcaaattgtacagaaatgcttttttgagcacctgtagcttacgtaaaccctttgccagggacagtggcttttaacctgactaacaacacatgtgaattctggaggcaaaaggcccttaggtaagaaagtgctgccatggcaggtgaatttaaaatgtagggagactgcatggacaagggaataatgactctttggatgagatgtcctgggaagaaattcccattaggaaggtcataatgcatacgggcttcatatcgatgcctgctgtgtctgttcccaccctctcctggcaccatgatgtctccacctcctcccctatcctggaccagagaaggcccagtgccccagctgaatttccttttaacatgcagaatatcactcttctttctgttacatgcacacacagatacacacacacacacagagacaagagagaggagagagactctaagagaccaagactctcagtaaagccagtactgtccttggtaggtccctgcctcttaaggtctgaatgcttcccttagtgttgagactgcaggagaaaattgtctccccaatcccactcaggggcatcagtggccttcacatccccatgcctgtagggaattgacttttttgagggtttctgcaagtttactcaatgtagtgtagtatttgctccacctttatttctggttaataaagtgaaaaatgagtgttctaatttgcagaagagaataggagggagatacaatcaggttcttacttgtgaaagagggaagaaactctctgacaaacagaaaacagttggttccaggataagcctcagggtaagttataaaagttctcattccaatttgagcttgtttattgttttaatggagtaaatatagattaagcttcatgaggaaagatacatgtcactattttcagtcttttttgaaagttcattctgaatttatccctgcctcatttcaaatggatttgatacagcccacaaagatacacctacaaagattaaaaaataaaacaaaatacacaaggagatgaggtggaaagaaaagaagcagggagtatggtcagcacatgaaacattttctagaagatgctatttacttgttagaagtgaggtacaaatttggccaagagcttccaggctccttgagtcagtgattgatagattcataatgttgaaaagattaaggtaaaaccattttttcctgggctgagactcgaaagaaacacctcataaaaggaatcctgtgtgtgttttgaactgtgttctcagcaacattactgaaataaatagcatagtgttttgtggggccatttttcaatctgtcctttgctagaggttgatggcataatgtctatgcataatttagtgaaggcttttctataggggcccaaatgacagagtctaagcctgcacctccctggctgcctccagggatgaaatgacagtgtctggaaatggatggacaccatatccatgatacattcttccgtgaatattattttgctcaaccaaaccatatttttagaatatgttaagttaaatggaaatattttaaattaatcagtggaacatttgtgcctaaagcttttgatagtagaaagtcaacaactttaatttcagggcaagtatatacaaaatagagtaaatccagtggtttctactcatcactccgtttcctaatttatgtagtgagagcatttaaatgtttcatcaaggtcctttttgtctcaaagccctctgtagtagccaggatcttggcaagaaagagctgacattctcaaactgggcaattgaggcacattcaataaagagatgatttaccaagggagggcagggctttgggaaccaataaggcctagtgcagtgcccagggctggctagagcagggaaccattctcacctgtaggcctgaaggcaagagggaagggagtggttatagaaattagagattagctttagggaattatttgacaaaagccatagagggttgcaaccaatcgtggtagggagttgagctggagagatggctacctcagtttcacccctttcccctctcatctcttgatggtggccgctgtgggtcaaacccagcaggaagccagagggtttccatgtaccttggcctccaggggcacagatggggtgaagaaggttggagagggtggaggggcaagtggaagacccctagcactttccataacttcatatttctaaacaaatgctttgagtctttcctcaaggtaaggaaattctgccttcctgtcagcttcaggagggcccttatctctgtggttaccaatgtggctccagggccccctgcgaagtacactttaagaaggggtagtctgggaggccagggcgggcggatcacgaggtcaggagatcgagaccatcctggctaacacggtgaaaccccgtctctaataaaaatacaaaaaaattagccaggcgtggtggtaggcgcctgtagtcccagctactcaggaggctgaggcaggagaatggcgtgaacctggggggccgagcttgcagtgagccgagattgcaccactgcactccagcctgggcgacagagcgacactctgtctcaaaaaaaaaaaaaaaaaagaggtagtaggtcaaagcaacgatcgaactctacaatgctgaagaaatcaaacagaaatgacgagctgatggctttgtcagatttcttcaagtctttgttgtcctagtcctaatctgtaagaagatagttttcaggctggagggtaaaaataaaaccttcataaaatttcatttgctgctttctagtgttggagaaagatccccattttctgatccatacatctcacagatacgtgataatatggtattgtggactctcctgtgtgactgcctctcctgtgaagaaccccctctgagcttgtattcactgatgtgagagcttgaaacaacattgcctatgccacaaaagcattatgatttgaaatcaagcatgggtatgtactctcgagggaattacagtggattttccccaggcttttcaaaccattagtgcaattttcaaaaagtttggttggggtatagattatagacaagaaaatttatccattttaagtgctcatctccctgaatttgggcacacatatacagttgtgtaattaccaccacgattaacatatggaatatttttttcacctccaaaagtttacttagggccgggcatggtggctcacacctgtaatcccagcactttgggaggctgaggtggatggatcacgaggtcaggagatcgagaccatcctgcctaacacggtgaaaccccgtctctactgaaaatacaaaaaatcacccaggcgcagtggcgggtgcctgtagtcccagctacttaggaggctgaggcaggagaatggcgtaaacctgggaggcggagtttgcagtgagccgagatcgcgccactgccctccagcctgggcgatagagccagactccgtctcaaaaaaaaaaaaaaaaaagtttacttaggcccctttgtggtcattccttccctaactccagctctaagcaacctctgatctgacttttgtcactttagttagaatttcatataaatggaatttcatatatatatatatatatatacacacacacacacacacaggcaggcacacatatatgagatacatgatattcatattttagaaccagcttttatacgtggtaacaatatttattcaaatatatacacatggtaaaaatgacctgggtagtataagagggtttaaaataaaaagatgagtctgccataccccactctttctcatttctaatcccacttctcagagccaacagcatgtagctgtctctgctttagttcctctggaggttttaattaatatacaaatcattgtttctttcctttccttccccccccctttttttttttttttttgagatggagtctccgtctgtcgcccaggctggagtgcagtggggtgatctcatgtcactgcaacctgcgcctcccgggttcaagcgattctcccacctcagcttcctgagtagctgtgatgacaggcatgtaccatcaagcctggctaatttttgtatttttactagagatggtgtttcatcgtgttggccaggctggtctcgaactcctgacctcaggtgatctgcccgccctggccttgcaaagtgctgggattacaggtgtgagacactgcacccagccccaaaccattgtttcttgacagtaactagtgatgattttgctcattgcattaccccctccactcttccaccttatctcttcctcctcctcctcctccctatagttattagttaaatcactattttttattgcctcttttgcttacctttgaaccttaaatgtttattcttgattttacaacttaaacttgcactttgaggaggaaagtaattacaatttttgcactttgtagaatattctttatgtaaaataaccacataaactgtaaaattcaggagtggagatcaggcatgaccagttaagttattttgctattctctctctctctctgtgtgtgtgataatttatacgactcacttttgtttccgttctgtatacatattacaaaatagctcaaatagacctctgatattaatttttgtaaacataacaaagaaaattcagaagaaactgcaggatacttggaaaatgtgtaaagtttcttcttcttcttcttcttcttcttcttcttcctcctcctcctcctccccctcctcctcctccccctcctcctcctccccctcctcctcctccccctcctcctcctccccctcctctttctttttttttttttgacactgtcaaaaaagtctcactttgtcctgtcgcccaggctgaagtgcagtggcgcaatcttggctcactgcaatctccacctcctgggttcaagtgattctcatgcctcaggctcccaagtagctgggaccacaggcacgtgccaccacacctggctaatttttgtctttttagtggagatggggtttcaccatgttggccaggctggtctcaaactcctggcctcaagtgatccacctgcctcagcctctcaaagttgttttacttctttggtgtatgtatttataggcttagtaaagcaaagtcaggaaatttcctttttccagcaaaaacatgaaatttaaaagcttgaggcacatgataaaaattagctggcaataaagattttataactaaagtctccttatttggcaattaactgagtcaacattttcagccaatattacaaaaacaaaactttcagaggactatttatgaacttgaggctactttcttcacatttttataaacaatcatcttttagatgactgtggttttccctctaggtaaggagttgcaggtgcaaacaggatgtcttagcaatttaccttcttgaaatcttggaagttgtaggatttgacttcatcatctagcatctggcttccagtttgcaggtccaccttctccatggatgctgcaaattagaatgtcttcactaagcagagggtctctttggtgctcaaagatactactaactgatttgccaatgcttgaggacctcacttaaggtgagtacaaggagacttcttaatacagaaacagacccctcttacagcaaccacagttaaaagaaatttgtttaattcaatctaacaacaacaaagtgtgatcttaatgaagcccaaacaactatttgtctttcttggtgtatttatccaggcaagttggctaaaatgggaattcactgaaacagcaatagcttcacagttcacatcaggaaacttactgttttgtcacaaaatgaaatagtttcagtagttcatataaaagtgagatgtaaaacatggaagaaaatcagtgaatatttatttttaaagttgttgccgggcgtggtggctcaagcctgtaatcccagcactttgggaggccgaggcagacggatcacaaggtcaggagatcgagaccatcctggctaacacggtgaaaccccgtctctactaaacatacaaaaaattagccgggcgtggtggcgggcgcctgtagtcccagctgctcggaaggctgaggcaagagaatggtgtgaacctgggacgtggagcttgcagtgagccgagatcgcgccactgcactccagcctgggagacagagcaagactccgtctcaaaaaaaaaaaaaaaaaaattaaagttgttaagactttgagctctctccattggcaacagctgcatctttaaaataggaagatgagtgacattaggaacacagggtaggaactggtgccaaaggagggctttgagtgaccagaacctgaggacattgtgtttgctgaacacacttccttccagaagcggaaatgcctgggtgttcacatgttgtgtgcatagggctggagtaaccttctcccattggttaccatcttcccaattttataacttttaataatactggtaaatttctatttcctgtttcatctactttcaacagtaccttttgattctctactttctgccctacctcttcctttcttcctcccacctttactgtgaggctattatgtttgataccgtacattctgagatttaaatgatcatctgggctttacatgtaggttgattcttgaaagacaaaagccgaaaataggttttgttgcagcatataggggtatactctgattgatttctttctctgtgattccaacaccacagcttctttatctttaagaaatgagtttaaatacattctctttccagtgtgctcactgcatcatgccacattttagcaggcttcctatttgcactgtgactttcttttacattttccccttcctggagtttcttactgactttcatttttctcattggaagacacataagtgccttctgctgtgcgttctacacccacgctccaccctttttcaccctgctctgcctgtataagttgcatcagcagacagccaggcttgggggcttctggcctggttcagccaacaagcagcccagtaggcgaagagcaggagtggggagagtgagcttgaggttcattctgctgtgagattgcctccgtttggctgtgtacatctgctgaaaatcacttcccctctcaagataactttttttcttttggtaacggactcttggccttttccacttgggtaaaatactctcttggtccctggggcttagaggagtgacagttccacttttgctagcccctcgttattgtactatctctttttctttttctcacattttggcaaatagaccccaaattatcctaatctgagggtgccactggcttcctgttgggattttgactgatgcaatggggttggaggaggaagcaaggtatattcagagatcagagtttgttcacccattcctatttaagatggaagaaccaagagggctgacaggtctctctgtgtacctggctgggaggatcttcactttatggggataagatggggagccctgtatcaggcactacatctcacccccagagccacctctctccttaaccattttttattttattttattttttgtttttagagacagggtcttgctctgttgcccaggttggttggagtgcagtgctgcgatcatagctcactgtagcctcaacctcctgggctcaggcgatccttccacttcagcctcctgagtagctaggactacaggtgcgtgccaccatgcctggaatatttatttttatttatttatttatttatgttgtagagatggggttttgctgtgttgctgaggctggtcttgaacttctgggctcgagcaatcctcctgcctgggtctcccagagtgttgggattacaggtgtaagccaaccataccaggccaaaatgataacagtcttcattctgggcgtgggtggaagtgggtgtgggttttatatccatgacatctgcctcagttctccttagttcgatttctttaatgaagagctttctgcgttttttattttgttttgttttttgtttgagcctgctgataaactgcttaagctttgtgccctgaggtgggaaaagcagagaggagttggtttcataacaaactaacccacctcccccacggcattttagcagtttaaaacatcaatcactttattatgttcacagattctgtgggttaggaattcagaaagggcatgatggggaggtctcttctgtgttccacgatatctgggacctctgctggggctggagtggctggggctggagtagctcgactgggaatggccaggattgcaacagctgaggctggaggaaccacttccaaggtggcttcttggttcacattctggtacctgggctggggtggctgaaggaaggacttgcatatggagccctgagactgtgtaagcagcccacctgccctgcagatgccaggctggagagaccacatatccatgctttcctttaagttccaacctcagtctgcaacagggtttcgctcttgtcacctaggctggagtgcaatggtgcgatcttggctcacttcaacctccacctcctgggttcaagcgattcttctgcctcagcctcctgagtagttaggattacaggtgcctaccaccatgcctggctaatttttatattttttagtagagacggggtttcaccatgttggccaggcaggtctcaaactcctgacctcaggtgatccacccacctcggcttcccaaagtaatgggattacaggtgagagccactatctcctgcttttgaacttatttaaaaacaataatgttagtaaatgaggctctcgtactaagtcattaacaataatttatgtttttttttccttagtaaaagttaatgtgtcaagagcatatccgactttacccaatgctggtgtttgtcaaagcataagactgctctgatggcatgggactggtgtttgaatacagcgagtttcacagggtgcattgccttggttttgtcctatgcatctctacacgtcagccactttagcaaagaaaggctctgttcaatctggatttcttcagcatgatactcaaaatacagaacaacgtgcgtaactggacatagcagctagctgctgaatctagcctccgtcactctgaagacatgttcttaaaaaataagaatctattaggaggatgatgaattgttgcattgccaagttatgcaccagtgaatgcagtctcaaatgattaatatatttcctcatttactgtttagatagattgggcatgtctaccagaccctaggatgcatgcagtcttagttaagaagttaagaagtactgttctaaaaagatgaagctgatatttggatcctacagagatttgttttctgttgttctttgtgtcttcactcctgggaaatacaattacttcccagacaatagccttccagcagcagtcttttttattagatttacgaatgaagctagacttgattagatgggtcttctctaagataattttaatcaaggataaggtactaggagctaatgaggcttttgagcggtgagttgcctttgttaggcttctttgctgtctgagtttgagttcacaacaggcctgtgttcctgaaggaccccacagacttcaggtgcactatttggtatcctcacacaatgcttctctgcattcttggtgtgctttatcctttttacatgtaagtatgtctgttttcactgccattctgggcctcagatcttgttatttttcccttgggaacatgaagatgcttcttgacactcttgagagtcaagtgttgcccccattttgagcatggaccctattcctgggctattgaaaggatataatgtgaatgcttgatgcccaaagagccttcccacagtcatctacacatactgttctcctcttgtgaaaacccagagcaaccttttcgagacaattgtaccctgacttgtatttatttacttgttttcttgcctctgttctgctgtgggattgtaacctccttgagggctgcaaggaggaatttctcatcttaatagacaaacagtgcccagcagagattctgcaatatggtagacacttggaaatctatgttaaatagaagggaattctgggtttctcctcatcgactggtttgaacaaggtctttgtcttctatgtcctattgaggggtaacagaattggtagcttctaggggaactgtttataatttggtcagtttatctacgaagagacatgtatgtgtgataatttggttatcactgtagttttttagcaaatggctttgcagcagtggtccagttggtgaaatactgtatatattcagtggtaaatctatttttgaaaaggatatcaaccaactttttttcctcctagttttgctttgctggaggaagtaaagatagcatatttagcatttaacatccattcccatttatagagggagtagttatctaagctgtcaactttcttttcagggcttttttcttgtctgtaatacatccaattatttagttgcattttccctcctgcagttgtatgctgggtattggatttagtgctttgttttgatcgaagtatttactagagtaagtagatgatgattaagatgccattcatttgctatctgttttaaacgaataatgatgagggatgaaaacaaaactataactgagggatagccaaggaacatctggacaataatttgtggcaacctgtccatttttaatattttctgtgactcagaaaacatgatattatcattgtaaacaagggaagggcctttaattactactgggtaaatgcatctttggaagaagtaaaaaagaaaaagccatttttgctgtgcctttagtaatgatctagatttttaaatgtttgtatttattgaatatcaagactgtataaataagatgatctgtcgtgccgatctggaaattttgtaattaagccataatctttcaggatattgcaaggtattatcttactaggcggaatgaaatagaatatttgataatagggttattttccctgacaataaattattggcatcatattacatttattatgacagggttggcagctagaatggcagaactcactttgttcatcgagctgcttatggggaaaaaatgccttttggatatcttcaaaccacatggaagctgtcagtgagggttccttgaactcttttgttcagttgacatgaatttggtcaaagtaattaattatttgccagaagagggtagctatgaagtctcaatattttttaatatcacaaagagactattttttttgagagagagagaaagtctcgctctgttgcctaggctagagtgcagtgggtgatctcagctcactgcaacctccacctaccaggttgaagtgattcttgtgcctcagcctcccgagtagcgggattatggatgcatgccaccacacctggcttttttttttttttttttttttgagacggagtctcactctgtcgcccaggctggagtgcaatggcgcgatctcggctcactgcaagctccgcctcccgggttcacgccattgtcctgcctcagcctcctgagtagctgggactacaggtgcccaccaccacgcccacctaatttttttgtatttttagtagagacagggtttcaccaggttagccaggatggtctcgatctactgacctcgtgatctgcccgccttggcctcccaaagtgctgggattacaggcgtgagccactgcgcccggcatgctaatttttgtatttttagtagagatggagttttgccatgttggccaggctggtcttgaactcctggcctcaagtgatcctcctgccttggcctcctaaaatgctgagattacaggcatgagccatgatgcctggccgagacaattttttaaataatggaaaaataagttggcttggattttaaggtttattcataaaaatattaataaaatgtttacttgcaggtatcaaaatagaaatctgtgtaacacagggccagtgctgaggctgaactacagacctaaagaaatagaatgtctgctttttctgcattttaggaaatagaagcctgtatgttttgccccaaaccatggtgagctgagccttctgaaatgtttacagttgtgttagatctttggcgagagtcctggagatcacaattaggagactttaactagagaggggatcatttaactttacatcagtggtgctaacaagggtgctagtcagttgcacatggtcccaccctccagtttaaaaatttcctcttgaaagcagggtccctgccccagagctgttgttgatacgtgaactgggagttgacttctgtgccttgtgtttgtgttaatgttggcaggcacctctgatcacagcctaagagcatgtaaggttctctggaaggatttgaggcctgtagtcagaataaagttcccacttgctgctaaacggtaagcacaatgagcagtttcctgtcatttaacaggggagacaattatgctcagctactgtttttgatgtatttggattataggtctcctcctttatctgaaatgtaataggatgtggcacgttatttgttgcagccctttttgtatctgggcagtggctgacctactgatcacagagtggtatttacttatcaatgagttcacggacttcgtgggagagaagtgggcttgcaaagaggctgtgttgggtgtggcaggccatgaggctgcatgtccaatagcagcattccaacattccaccaatttggcttgtgagagaatcaccagacacataattacttggtcaaaccatttgaagcagattcatttcttgcatcttaataatgtacttttccttaaagcacgtggctgtcttggccaagcctggcttgttccttgaggtggtatacacagcaatttaaggtggtcattccatcagttgaaatggctctggagaatttatcattttggcagatagaggcaagaatccaaacttaggtaacacaaccaaatgcagtgcagcaaatatggaaaaggtacagatgccctgattgaaatgataatctatgtagctgattgttctttcctcaatgtgacgttatcagtattgttctttgcttggaacagagtgcagtacacgttgatattagcatttgttttcagctgcacctgtcaccatactgaatttccaaacattttcattacctcaaaaaagaaacccctcagcccttagccatcatctcctaattttccaaacctacccccagtcctaggcaacccctaacgtacttgttctgtatagatttgcctattctggacatttcatgtaagtggaatcatacattataccgtcctttgtgtctggtttcatttaacattagtgtattattctattcccacgctgctaataaagacatacctgagactgggcaatttagaagggaaagaggtttagttgactcacagttcaccatggctggggaggcctcaggaaaccgacaatcatggcggaaggggaagcaaacatgtccttcttcatgctggcaggaagaagaaatgcgagcgaaggtggggaaaagccccttataaaaccgtcggatctcgtgagaacgcactcactatcacgaggacagcttgagggtaatggctcccatgattccattacctcccaccaggttctacccacaacacatggggattatgggaactgcaattcaagatacgatttgggtggggggcacagccaaaccatatcagtcagtgtttttaagatttattcatattgtagcatatttgtatttcactccttttcatggagaaaaaaaatcccattgtatggatataccacattttgtttatccattcctcagctgatggacttttgggtagtttctgctatttgacttctatgaatagtgctgctgtgaacattcgtgtagacatttttgagtagacatatattttatttcttttgggtacatactgaagagtggagagacatattttgcagtactttttttcctttctatctggaagattgaaggggagtattccttggtgaggtgggctctgtctgtgatagagagggcattaagtcagaggtaggaattgctgattagagttccaggtcagcgcctgactggccatgtgtttggaagttcactctgtttcctcagctgtagaatgaagtagttttatcggacaatctttaaggtcgcttccaagttcaaatgttccaagttcaaacgttttcctgagtgagattgaaaggctttcaagatatgaagggaaatatttcaaacaacttggactttaatatttatttatttaattaagttttgtgtttttaataaaaataaatctttaaaaattgtatggctatagaaccaaccttactcaaatttgtattacccaaggacatctactttaatatttcggtgtatttcctgtcgaatttgcccctttaggttgtttagttgtttattgggctgtagtcatgctcaatgcacagttttctatggggatcctgttttgattgcccttcagactggtcttgatttcacttaatatgcttctaactttggttgaaggacctttgaaagtgaaaagtcttttgagttaagtggttttggtaaagccatgatagttttgaaagtgcaaaggtgtttctgaaagtatgttaccttctagaatagtcagtagaaagcttcatatgtagtaggcagagataaggctgtaagtgtgtcagaatctaatagttccataccccagagcagctaacccacttcttcctcctgtgttttggtgatttagaagccatcaaaatgcttattccctttgctggggttcagaagctgatgccccgaactatggtgctttgacatgctgaaccgaggaaggagccttgagacctctcggatccccctttccccacttctccgtctgccccaaagcacaggataaaattgttctctgaagttcccttatctgcctaaagtccagacctgctgaagaagaaaacaattacttctggtcactttcctgagttttcattaactgaacacatgtctcagaaagaaagattccaagtccatcaacacacttttatagacttgtcacaaaccattgtctgttctgcgggcccacgagacattgtcccaggccattgtatgttcctcgagtccatggcattctcctaaaaatggtttactaaccccctaaaataagcctcacttccccatctccctttctcctcagaagggtatataaccattaaccatctgtacctcattgcgtggtggagtaatcactgtgtgatccgcctgcctccgtacacatttataaatgtgtatatgcctcttctcctgttaaccttccttttgttagatgtggcttctcattcgggagggggtgtagctttcaggaaacctgcagaaggtgaaggggaggagttttcccttggcctctacactttcataatgctcaaaaagtttctgattgtggtttcaaattatttcctgtgttggaggaaggttgaacttgtttttctttttgcctactttctggttttcaagctcagcaacttcattaacttttctagctcctgagagaccactctgtgcagtgaagcaggctcttctgccctgaggaaggggttcattctttcccagggaccctctccctggagctgccttgaggccagaacacctccacactggcaccaagtgtttagagagccctattgtcagctgccccgggatgtcattttttccttcatggtgagggttagttggccatatactccctcgctttcttttttccattaagaaaaattcacgccaacaaactcaactttctcagggtggtccttgcatttatggtaaatattgaaggctgatttaggacgaggaaagtgaactattcagatcagctgcccctccacgataactgcttgacttgctcacctaatcgcaggtgcaactgagacagaaggataaccatgtattgttcttcaaaggagtgacctcatccatggaggagtcacctagtaaatgcaaaatgctgagcaagcagatccgatgcagcttctcatttgggagggggtgaactgaagagagagacgtgaacaggaaaagcaatggaagcatcctcatcccttggccatggcagttatggaagggttccaataccctcagcttcccaggaccatccagcaatagtatttattgtcttcatctatggtaaacactttctgataggccaaaattgcactgtctcgtctgatttacagaaccagctatctcaaatgtgtagtaattggaaaaagtggatgatgatggtttcagttttctttttctttctttctttcctttttttttttttttttttttttttttttgagacagagtctcgcttcttcgcccaggctggagtgcagtggcacaatctcggctcactgcaacctcctcctcccgggttcaagcaattctcctgcctcagcctccccagtagctgggattacaggcatgtgtcaccacgcccggctaatttttgtatttttaatagagacgaggtttcaccctgttggtcaggctggtctcaaactcgtgacctccagtgatccacctgcttcagcctcccaaagtgctgggattacaggcatgagccaccgtgcctggctggtttcagttttcatacagcttattttagcactttgacacatcttgcactgttacttaatcttataatgttatttaattgctttatgagtgcctaatttagcttttcagctaaactgtaatcttcttaagatcagtatatgtgtgtctataaaatacataccagcatgacactttcaaaaataagatggttgataaaataatggataaaatggattcctcccctcttccttctcttcttccctccctccttcctctcccttttgtagcacctcctgtctcttaggctgctgatttaatattagaaatgagaacagaaatggctagggtggcatctagaaccattataaaattcaagggcagaatagaattttgtagacttgatgattttttggaaatttattttctggacatacttcttatctatacaggctccagcccatctatttcttcctttccgtgtgatccatccttttgtggttgattgtctcagcaagtagaacttcaagtcagagtcctgggttttggactcatgatctggttggctttgccacatagatagctttcacaacagagactcacaacagagtgtggcagaccagtgggagtccactactacccctgggcctgcagctgagagcacatgccctgatgggttgtgggtgattgtcctgcctctttcagcctgtttcctcatctgtaaaaggggaataaattatgggctcatgacgagaactcgatgagaaaatgcaggatggatctcagaacaatgcctgccatatattaagcactgagtggatatgtaaccattttcatgcctagataggcagttaatgaatatcatcatatactgcccaggttagtgaacttcccttataccctgagagcagatgtaagcttctagagggtaggagccatcaactgcctagaatgtccagatatagcatcacatatggggccactcagtcgctaaaattgtgatgtgagtgttgttcagtagcttattatcatgtctgtcagatggagcatcacatcagacttggcaaacatgaggagcaaatatccctaaagcaagtctaaaaacaaacttccataaaccaagttattcatgtctttcatctgttcttgagaatctccaccaatggagtaacccaaaagtcaaataaaaaattgtatataccaagatttataaggaataattaaaaaccttccaaatgttaaaataggcaaatgtaatttaagtaaatatttaagtagtatatcatttctgtgtaacattatgtacactttataaacgtttactacagttttaagtaatatggaaaaattcttaagttatcatgtgacctgaaaactatgctggaatagcattgcatatgcagcatgagcatgactgtattaaaatggttttagaaaatagattggagaggccgggtgcggtggctcacacctgtaatcccagcactttgggaggcagaggcgggcggatcacaaggtcaggagttcgagagcagcctggccaatatggtgaaacctcgtttctatgaaaatgcaaaaattagccgggcatggggttgggtgcctgtagttccagctactcgggaagctgaggcaggagaattgcttgaatcctggaggtaggttgcagtgagctgagatcgtgccactgtactccagcctgagtgacagagtgagatttcatctcaaaaaaaaaaaaagaaaaagaaaatagatttgagagctatacatcaagatttaacagtggttgtctttggatgatggtaggattatgaatgaattttcctctctaattttgcctctctgtattttccgtatttatatatgtgtattattttcacggacgaaaaactcaaactttttcttaagagggaaataatgtgcatagatggtggacagaagccatggtatttggcttgtatttttacaatgaaaaaaggccaaatgtgtaaggcacagaactgaattatttgttatgtatgagaagagtgtggtgtgagctcaatgaaaaacgcattactctggagagttcgagagaagttttgctttttgaagatttttggagaagcagcaaaaatgtaaagttctaggtagtgcacatgagcaagtgccaattttcttttccagcaccgaagtttggtattcttagccattctgattttgggtgatttgagactgtcattttcttctaaaagtctgacagctgtaagctttcagctatcagcaaatgaggtgaaaatgtatttttaatattaaaagtcttcttagggaaagaggcccagcaaaaccatcattagtagtcacattcaggcaacatggtaagtgcccttcctaatcctgcgcctgtggtttttaatagccagacatgtccaccagatgtgcttcatgttcttttatttacataaatgtttccagtaactcattgtatatttttctacttctaaataaatgcataccaaatagctctctttttcacattgctatgttgcagcattgcgtttgtatgttttaaagcaggaaaatgttcagtaagccctgaatatttttcacatctttactgcacataggactgttgacatatttaagatgtatgtggtatactcattatggctaatttgaaaaatgcacaaaatatatggataagaagataaaagttactcagaggtaaccactaaattcattttggtatatttacttccagttacttttatgaatactttttcataaatgttactgattctgtattttttctctagcttactatttttttttattgcctgtcctatttatgttggtacatgtagatctaactcattctttgaaactatttattcatgatatgactgtgttatagtttatttagctatcgctttattggtacacatttaggttgttgcttctttttttaccattaaaccaacattacagtgaatattcctgtatgtgccctttgagcatctgagtgagtgtttcactagaaaatagttacttggggcccggcacggtggctcatgcctgtaatcccagcactttgggaggctgaggcaggtggatcacctgaagttgggagtttgagactagcctgactaacatggagaaaccccgtctctactaaaaatacaaaattagcctggcatggtggcacatgcctgtaatcccagctactcgggagactgaggcaggagaattgcttgaacctgggaggcggaggttgccatgagctgagatcgagccattgcactccagcctgggcaacaagagcgaaactccatctcaacaaacaaacaaaaaaaaaaaaaggaaaagaaaatagttacttggaattggcatttacataacttacattttcctcatttagcatgtgctttcagtatttttctttatccatttgcaaacatacacattatatatacatagacattatatatatttctttttcttttagagtaaagggtcagttcaaaattgctcaaaatcttgctttttgtcacctattgacataaatgcagaagctctacaacgttgctggtggcctgaacttttatagcagatccatgatgcctggagctatgaccgtgaacttgtcttcgagcatcccagcttttaaaagctttacattttgttattatttcaaacatcaggaaaactgcaagagtagtacaaagaacttgttacgtccttaatccagatttcctagttatgagcattttaccccatttgcctttatactctctgtctgtataaacttgtaatttttttcttgaccttatttacttgggtatgatgctatctgccagagctctccatgataaagtgatttttttttctgtggaattaatagtaatttatggggagattcattcatgttgttgtacgtatcagtagttatttttcttgctgaacagttttccagtgcattaacataccacatatcatttatttacctgatgatagatacttgggattttgctagacacggagacatttacatccagcagatctctgcctcagagaaggagttgctccccagccgtagcgtgtggtcagtagacggaatctagacggcgtctgtcggcgccttcagagtcactacagctgtagagagctaccttgtccaaggttatgcccttcctgaggcagcccacattcagtgcctgagtgaggggtgatgtaaaggtccagccacttcagactgaggtgggacaactccgacgcagtttttactattcacctccatagcatccaccactgttagaacagcacccctttctcagcgaacacttattgctgtctaggggatcctgtacaagcagaggaggcacaaggaaaaagcccaagcttgggttatggatggctcagctcaatatggccttgaaagactgtgtgtgacaaggtcgtgcacctggtcatccactttgggtgggaagaaaagctgcctgatgttcaagtacatacagaagcaaggcagtggtgaatagcctggctggaatcaggggattggaaggaaagggactcaaagtttggagacaacagatttgggaagaagcatatgaatggacatataggagcaggccccaaatacggtaatggctgcaacacccccacagagttttaagacactctatattctgttattttcctctgaagagtgttcattttaactctagcaggcagtttacttggctgactcagtctccaaactctgtctttcctatagtaggtagcagctgaaatctttgatcagtttttcagtcttccagctcttgctttctactgggttccttggaacttcccttcacaattcagggtccagccaaagatttgagcaaagtttctaaggcagattttaggacatcctctctgcgattcccacctttttccatactttctcccttaatttctgttactcggacatatctcagttctgtcctcagttattcctcagaccagtgaaactgtggctttctgcttgacttgtggctgtgccacaccacctgggctgtggtgtgccctcatgcgaaaagctatatagacacggagctcatgcacaattcccttctttcaacaatcaaatcctctcttgaattttgttgtcaaatagttatatatgttgtcccaaatatatttgttatatatatatatatatgttatgctatgtattatgttgtgtatgtgtatatatatatgttattctaaatatatgtatgttgtatgtattatcccagatttctaattgttttctactagagagttagtgaaagctactattactggaactagaaacttatttaaaattctaatagatattatcaaatgactctctgcagttggtgttatcagtgttctcttaccagtgttgtatcggtgttcccatttccccatgttcaataataattttgtaaagctgttatcatagtaccctgtctgatgggtgacaatgttttgattggcttttctctaaattctagtgagagtgagaatgtttttatactcattagaaagttctattttttattttgtaacttgcctacttatagttttgcccattttcctatggatcgtcttttttttattgattatatatgtggataataatcagttaacccttacattggaaataacttcttgtggtctattttcaactttgttcatggtgtattttatcctacaaaagttttacatttttatgtaaaatttctcttttatgtcttctgcttccttatgctagtgcttttctagacatattattatttacagaatttgtttcatacttgtattagtctgttttcacactgctgatgaagacacacccaagactgggcaatttacaaaagaaagaggtttaatggactcacagttccacatgactgggaaagcctcacaatcatggcagaaggcaaggaggagcaaatcacatcttatgtggatggtggcaggcaaaagatgagagcttgtgcagaagaatgcctccttttaaaaccatcagatctcgcgaaacttatccattgtcacaagaacagcacaggaaagacttgcccccatgattcagttacctcccactaggtccctcccacaacacgtgggaattcaagatgagatttgggttgggaaacagccaaaccacatcaacacccagtcaccaaaccctgtattccctgtggtgggcagcaactgaaatgtgctaatatgatattttacaacttgctttaaaacttattaaaataaggaatgttcctatgaagaatcctgaaaatattcttagggagcatgattattaatttagttgctcagggtattccagtataaatattccacagtttatttaacttgtctcctattgttggacatttttattattattaatgatgctaagaacattcttgtacatagtcattatatatatttccaaatattttattggtatagattcctctataaaaatgagaattatttatttatgtatttatttttgagacagggtcacattctgttgcccaggttggagtgcagtggcatagtcacgactcactgtatccttgacctcccggactcaagcagtcctccaacatcagcctcccaaagtgttggattacaggtgtgagctactgagcttagcctggggatcttttaaagcctgtcatacagattgccaaccatcttcacaaagatggtagccatttttatttcaatcggcacactacactttccaactctagattttattatttttaaaaagttgtaatttgactgtaataaacatacgtgtgcatgtgtctttatagtagaatgatttataatcctttgggtatatagccagtaatgggattgctgggtcaaatggtatttctggttctagatccttgaggaatcgccacactgtcttctgcagtggttgaactaatttagaatcccagaacttaaagtaaaattaaaaaaccaataataaataaataaataataaacaaaggaatcagctcaaagagctatttataaaaaaagttgtaatttggcaaaattgtcttaatgtacatttctttgattatcagtgattttttttcacattttctggtgttttataattttttcgttttatttgtgggcatgtgaatattctgttcctttgcccacatttctattggtgtatttagctttttcctattgattttgaaaacctcttcatatattaaatacattaattagtccttttatattgttgttgcttcatgagcatatgacattttggatatatatgataatttgattattatatgattattattagggcttccatctctgagtgttggtcaatgaatttgtgttagttattgcacttaaattcattgagtagttagcacttaaaatgcaaaaaatgaaacaatgtttttaagtattctttctggcactttgataatgtaattaacccaatgcttccgattaaaattaatcaatgcaatggtgtttccaagctaatttgataagtgtaactgatgattaccaatataaaccaggcacaaccttataaaagacttagtcatcacactgtaagagaagatggtgacaatggcgactgaactcatatgtgcgctcagtcagtggctctgaagctgacgagagttggctatctctctgtaaacaagtaaatgagagagctgggagtggggtgaagagaatcatatagatcaaatgttatcttccacgtcaatccctagctggaatgataatacaagagaaagacaaaaacttgtatgagaatttaacaaaacagagaggaatcattgtctttctctgcaaactggggattatgacttaagcccccatgcagcaagcttccctttgcataaatctcaataggcctggtgatttatggcagctcagattctcagattccttggttgatgaaagtttctctgtccagatttttatgataggctctcagagatttgaagagcaacttaatatattaaattctcttaggcattcttaaaatgacaggctttctgactccttattgtccttgtcactctccagtgagcacagtttaatttgcttcagttgtttgtaaaatttggaagccagactgaatgtgtttttcctgttgtgggagaaaaccacaataggatgcagccaaactccatgagctggattctaagtggaattcttgcctatcaaaatgtatttaatagaataatatattcattacttctttgagaatgtaaaaaatagaaataaaggaagaatatattttaagacagtgtataaaagctgatctagtagcacagtgtggattttatgaaggctaatgctttgctttattcataatttcaaatttctactctatgtgttgtcttctattgggataaatgatgtagaaaactcttgcatgtcattcaagcttaaaaaatataaactcctctctaagcctttgggagaatcagaactgttttcaatatgactattaaacatccacctaaaagtccacaaaaacaaaacaactaacaaccaccccaacaaagatagtatgaccacactgggtcgtactgtttttgtatgtgctggttgataattgtcatacatccctttcttcttttcctcatgcatgaacacatttatctgaggcaagaagggcaaaaaaaggagagaaagctgaaattacccagtttcacagctccggcaggagtccagtgtcctaggcagcctggaggtgactggtttccaggtgcactctggcagttccactattacagcaatgacaggatgcacttcatgcttttcaaggcatgttgatgtgtgttactgcatttgatcctcacctagaggttagtaggaaaggtgggcttgtttccaagaacaaactgagcacaaagtgggacttgccagagttcacactgtttccctgagagaatcctgatgtctgctttctagcctctggctcctgctgaaccacacttggcctgctcaatgctggtatgaataaaagttggcttctagtgaagcaaatgtgcccatggcaaggcctctgaattgaggtttaaagggaattgaaccaatagggtggaggtgctaagaattcagcctcttagatctttgttcctcagaagatgcggaggtggcagctggaagatttgacaataaagaatgaactttaacgtactgtgtaaccatgatatgaaaagatagactctataaatgagttggaaagtcagtcttctttaattcacacagaatattcttgaagttaaacctgcccatgggatagagttatggtaaacaccagtcactgagccacgagatgaaatatttctgctcctagagacaagctgggaccaagataagactctagacttttctggacaaggtgcagtggctcacgcctgtaatcctaacactttgggaggccgaggcaggtggatcacttcaggtcaggagtttgagaccagcctggccaacatggcaaaaccccatctctaataaaaatataacaacaacaaaaaaattagccggacatggtgacgggcacctgtaatcccagctacttgcgaggctgaggtagaagaatcacttgaacctgggaggcagcagttgcagtgagccaagatcgcgccactgcactccagcctggatgacagagcgagactgtctcaaaaaaaaaagaaagaaagaaagaaagaaaaaacagaaaaaaagactctaggcttttcttcttcagttggtgccccaccagctggcacaatgatcagctgggataggtagagaaaccccttgcaagtaacattttagtagtaagaagtatgaaggagtagaagtgtgaggagaaggggagggaatggtatcaagaaacaaagtatttccccctgttttatgccgaccttactgttatttttgttctgcctcgtcttagttctctctctcccatttgctatcctacagtggcagcaagtcagatttagagtgagttctctgtgcctctacggctcagggatgggatactttacccttctgaagggccagacgtaccgggaaaacattagttgaagctcccatgagtgttaaagacagctcacttgtcagtttgggttaagtactgagatatgtgaagattaaattcagagcaaacattagaataaaggaacataaaacccagtttcatcaatatatccaatgtttaaaatgcatttcatttctacctcacaagcagctacagaaagaagaaagggaaaaaacaagaaagaggaggaggtaatgaattatacggtgaataacatgaccacatacttttttactgcttttgaaatgtacctagactggagaattgctgtctggttttgtccatctgcacttttttttttttttttttgagacagagtctcactgtgtcacccaggctggagcacagtggcgcaatctcggctcactacaacctctgcctcccaggttaaagtgattctcatgcctcagcctcctgaggagctgggactacaggcgcccaccacgcccagctaatttttgtatttttggtagagatagggtttcgccttgttggccaggctggtctcaaactcctgacctgaagtgatccccccaacctcggcctcccaaagtgctggtattacaggcttaaggcactgcgcctggcgcatctgcacatcttgaaacacttggaatctctcttctgactgggatggatggtcatggctgcccacaggatgtcagggaaaagaataccctggacttcagaggaccactcaatagcattattcaaatttctggggagtaggaaggctggaccgcaaggcaggtgagatggagagctttgcctcacttttgggccctgatggaatctcagaggcactgccctccaggctgctgtgttactgttactatgatggaacagtagtcccctgtgcgttgagataagtcacggagccaggcatgtgtcctttgaaaggcagccacttctttatccatctagcatctgacttgtgaggttaggggtcccacagcctgagaggaggtgggaacctcccatccttcccagcaggagcctcgatggctgcacagagagggctggagtatctgtgagaggcgaggctttcattctctttatctgaaactgaaaaatgtaaagaacgtgtgtagtaatttaaaaccctgcattactgtccaaatagtaatatgtgtggagcagcattttttttagaaattatttttctgctgtatgcttttaaagaaaaccaaaaatgttttttaatcttaatttaaacatcactgatttgaccagtatcatttactatctatagatatatgggcaatattagaagaacctgcacacagttttgaaaattgaataaatatctttattgctgattataaagtgatacacgtttgttataaatgattcaaatgatacagaaatgtggaaaggggaagtggcctggcaataccattctctggaaattgccactgttagctataagtctgttgcaaagctgcagaagcttaaggaccagagttttaagtgagcttgtgttctcatattgggttacatttgttctctgtaaaaacacatagcatgaacagcagaaaacacattataataaaaaccagaagactgaaaatgaaaattcacacaaagctacaattgatgccaataagacccagacctttgcatttcctagaggtattgattttgttgtctttctggcatgttatggtttttgtagataagaggaagagtctttcgtgaacctgccaacctacagtatctgttcttactgttctactaaggatttgtgagatcattgtaatgttctggttttccatggcttatgataaaaagatatattgggaggcttaagggggtcttttttttctttgagtaatttacctgtaatcttttagaaatctgtgtataaatcccttctctggatgactacctgcatgtgactgtgtagtcatcatcgtgtatgactgcgtgaaacacatttattaggttcattacatctcatgtttccttattgatgatcatttattcacccaaatattattaagggctttctgtgtgcctggcaaagtgctaggattgagggtaccacaggacagggctggctgggaagagagacacattagtggacagctctcagccagtgtgagaaaagaaggtgcagaggagagagggactcctttttgccagaaggctccaggggaggattctcttggagtcctggtgttacatttcagtgacatgagtcagaaagtccagcaagaatctgtaggtgcggaatggcccagggatgaaggaaaaatcaaaatatgtcaagacaaagagatacactaatagagaagggagttgacatttgttaagtgtctactgggtgccaggcactggatgtcagctgcactcagtcctacgaggtacttagcattgtcctcattttgcccatgaggaaactcaggttccaaaagatgaagtaacttgctccaggtctcataacttgagttaccacctggaggcatcaggattcacataccgatgtgaacgcaccacagattacgctgtcacagcacaggctgaggagagagcttggcttctttggggagtgatatgttgctggggctggagtatggtgtgcattggaagaaactggcagaaatgaaaacatggagaatggggccagtttgtgaagggcgcttgcagcctatgtaagatttgctattagagtttgagaataccagcaaaagtttgtaagcagatctgacagctcagatttatcttttagaaagaaaaccctggctgccttgtttgggatggaaggatttgagaaaattggaggagggtcacagatttatccccactatgcttagatatacaaataaaatatttttctaaatttctccttaagacctcctcccccactgaataagtagagaaaaatgaacctgcatttagtggagagtaatcaactcagttagatgttgaaatagtaaactctaataatataaaaggccccttttagtaattcacgtgtcctcctgtgcctcactaaaatagtgccatagtaaaagagggctcacatgttcttgagattgtgcgagcgtgtgtgtgtgtgtgtgtgtgtctatcagagggtgaggcagggatcttgctggtgctgactgggagctggcattgctctgctcagccttggccattttgttaatatctgttgctgaagtgtgtggctgctgtaatatgtggttctataaccacaatccgttcatttgcccaatgcacagtgagtcagtgttccagggcactgggatatagcagagaaggagtttaataatcatagggtggccaatgaggagatgggaagaaaccccaaattcacctccctgaaaggtttggggatagggtttttaaagggtctggacagggctgaagtatggggatcactgattggtcaagaagtgagagaagtcatgggacagggaggtgaaaaaattgcattcttgtgctgagtcagttccttggtgggggtcttcagaccggttggtgtcagccattccactggaattcagaatctgaaaaacaccttaaacgattcttgagcaaaaagatcttatgattggatcatcagagattcaaagtataggaacgatgggggagtggtagcagatggtcagcatgctacgtgactctccctcagtagctgcaggagagtgggttgaagtgcaccagtgcacaggtcagtgactaactatgattctgcccaaagcagtgaattctctcccaggtctctcttgctggggcttcatgactccaggccatgagttctgatagtgcacttccctccgcagtcatccacaggatagttgggagcgtccatcccacggagatgctcagggaggctctggatagaccctttctttacctaactgctgggacaccaatcttactgatttacaggatgtggtccccacctctagggtcaccacccatattgtcatgaggcttggggtggagcaagaggacattgtgtgagaggatgtcctccagagcccctgagggaagtggcactgaagctctttggcatcagctttgtcatcagtgccttaagctcctcattcttctctaggaatttatccaagtggggagaagctgtaccacgtgtgtccctgcctccctctgttttctccacgtacctcggacctctccttcttgccacactcctccttgtgctcccaactcactgggacttcccttagttcatgccgtcctcctccctgggagaggggggcactagcttcgacctttgggctgtaatggcagctgggatacaaggagagaaagagacctgctatcagacagagcagcatagattggaaagtgtttcaccgctgtgacatctgctatcccagtgacaaagggttgcgtcagtgggtctagttctaggtgagggctaataaattccagaaagagtcctaggacagggcactggtgaaaccaaatgggcaagggctgataagggggtagaaattggagataactttgaggttcctaggtggagcagctgttgagtccagatgcacttttcttgagagaaaagacaagagaaggaatagttgtgagtgcggagggtagagggtgggagggagggaaggaaggtaacaagtacattccattttggatgtaataggaatgctgtttagtgtagaaatgtagggctggtgcctgggagagaatctgcctggagaaatagatttggaaactgatgagaatatccaaggagaaaaaagaagaggaacttattgtcattgtagatattgaatttaaagacacaaacaaggtcataactctgttttaattatttctttcactttgtgatgacccagtacttggtaatgtctgctccagttcctgtattaggacaggtgaaaggttacagaataccatccagggtgtctgctgctattttccatcctctaggggacctgtgaagccccagatctgagacagatctgtgatgcactgagttcttatcagagtgagactagacatacaagactctttgatgagcggctacaaataatgatttgcaggcacatgcagaggcagtgtttgatttttttgtgatttagctgaatttgtttaactcctaaaagtgtaacatgtagttattgtaactctttccatcattgttatgcctcagacacgctttaacctttggatgtactctgctaatgtaattgccttgctgtcttttaaaggctgcttttaattgggttcccaagcagcagctgctgttaaggtgcaggctgcagcctttggatacattgggctagttcattaagtgtttcctctccccatactgggcatttgggtttggatggcagccagcagttactgaaatgccatcagttataagattgccctttaagccactgatttgttattgtattgagttttgactcttttcctctcaaatttaagtggagatttattgaatataatgttaacctcaatacttcccattcccagttgtcttttcgtaagcgttattttcccctagtttataagtcttcagtcctctgcctgaacttgagagttaagaactaaagacagctgtcatttatggggctcatgactgtctgggaagcgtggtggattatctcataggcatggcccagagtcctcagtcactgatgacatgcacaggtaaactgagaggtctcttagctaatttttcctttttggtaaaattctgctgaaaatttccctctccaggactagaggtattcatataatttttttttttttttttttttttttttgagacagaagtttgcttttgttgcccagcctggaatgcagtggtgtgatctcggctcactgcaacctccgtctcccaggttcaagcaattatcctgcctcagcctcccgagtagctgggattacagccacccaccaccacgccaggctaatttttgtatttttagtagagatggggtttcactatgttggccaggctggtcttgaactcctgacctcaggtgacccacccacctcagcctcccgatgtgctgggattacaggcgtgagccacaatgcctggcctcatatgattattgacctgaggatttttacttcatttgaagaaaatgactacataactgtcatacggaataagcaggactgtggtagggggaggtgggacaactggaagaactctgttttggtttttggttttctttttcagagcggctctgtggggctggttcttttcatgctccaggatgaagtcttgggcaggcccagtgtattttctgttcactgtaatacaataaaaagttctctggtcacattttccttccagacagtctcagtttggtgattaatatgtccagcctcaggcagacgaatttaaagcgaaagcttctcccatcccatccctggctggaacttgctgcagggaaggccgatgccggctgctgggtctcctcaccagcttcctgggctgctctgacttctccaagttgggacccatccagcaggggtttcctctgtgtgtggtctgagtttaaagctcagtctttggggatgctcccctttcaagaagcaggacatgcatctcctctgcccagtctcctatgatcccccatcccatctccttggcactgggtgggattcctgcagcctctctgtgctgcagcttcttgccctgcaagctgcccttttcgctgtccttgcagccggctctaagacaagcccagcctggctttctcaggtgtggccaacttctggcccaaaggaaacactccctttctacttgccgttggtgggtgtattacttcccacatgctcccagacattagcccttccgattcttgcacaggccagacatcaacttcggaggacacaggaatgacccttagcaagctcgttggagctcctcacactagcttgaggccgagagaacacccttcccccttccccagggtgtgtgtgttggggcacaggtggtggaagtgggggacctagtgcacacagttctccgtgaagaaatttatgatctccaagagtttggccgtttcaaatctaactcttttatggccttgagtgagtgaaagtcaaaaccatttttagccacctcctttccaagtccaacatggtggttgagtacctcaccttgacacatggccattggtttctgtttgttgtccggaggcagcagctgaaactgaaacacaaagtcccattttaatatttgattgcctttggctacattgcccgttatatatagtatgattcttagagacaaaatatggactgctgctgtcactgtagttgggggccactggagggaaaggatctccaaagtcttttgctacctcagattagttagaaatggtgatattttccccccaccaagctagtttacctatttggtaacctgtttgtatgttttatttttttgcacgattaaacaaactccctccctccccacacggccctttcgccctccttccttccctcttccctccctccctcccttccttcctttcttccttccctccttccttccatccttccctccttccttccatccttcccttcttctccttcctctctccctcccttccttcctcccttcctctgttccttcctctccttcctctctttccctccctttctcccttccatccttcctccctccctctcttcctcccttcctcccttccttcctttttccttcctttcttcttcctcctatcttcctttttttctattcttcctttctgtctccccttctctttttttttcttcctctcaggcctctgttctttctcctggccagtgaaggagactttctttctatcttctctacttaagctccctcagtggtctccctagggccaagactctgcaatgtgtcccccaaggagcctttttgcctcttcatccaacatttgcataggagatgctcccctcagtcctgtctgggatttacatatgtacccacactggaactcttggcccacatcctggaacccatgacaccaatgccttcactgcactctcaacactcccaatgcacgtacaaacagaaaagaaataagtaggtagaaggcagaatagtgaatgggagagagaatgcttgggaaatggtaaagtaactgttggataagcctgcaattccagtcaacttcattaatgtagctaatctaagcaggaaatccaggtaaattaactaaaaattatgactaatgaaatggtttgaaaaagctgcgtatgtatttttaagggcgaaaaaaaaagcaggcaactttttggaggcagaggacaggttatattaacttttttatactttgaagtcctaatacaatgttttatcagtagttgcaggagcccaataaacaattatttaataaaagacaggtcaaagtcaaccagcttgttgaagctgaaacattttggggaaagatttcgtgaatagataagaatgagtggaattgagtaaatccaagaatttgcacataggtgtttttcccccagtttcctgcttcttattttttccccatttttaaaagttgagatataaatcatatcccataaaattcaccattttaaagtatacaatccagtggttttcagtatattagccagcttgtgaaaccatcaccaccgtctatttccagaatgctttcatcattcaaaaaagaaaacacagtgatggtggttgcatgactttgtacatttgttaaaacccatagaaccctaataaactatgggctttagttaataattatgcatcaatatttgttcatcaactgtaacaaacatgtcacatatatgcaaaatgttaataatgggaaaaactgtgtgtgggggatagagcatatgggagcttcctgtactttctgttcagtttttctgtaaaccaaatactgttctagaatgtctgtcaattaaaaaatagtgataaaaaaactcctcacccattagcagtcactctgctctgcccattcccctcgctcctggcaaccacttacctgtgttttgtctcttgcatgagttctttgaagaagcatttaagccatttgttttggtagttacagttaagagattgccgagtgtttctacattaaaatgtcacatccttataactcccatctgcccttgctcaaaacattagtgaaggatgaaatatgctttgaaaaattaaaatgccatagcttttcataaaaataggagaaaaatgaaaatcttgtcagtctaaaagtgtagtaaaaacatttctgctatgcgaaacctgaagttccaggtctgtaaactctgcagcaggcagagtcagctgcgagtttgaaactatgggacagaatcactgagaagcattctaagaatggcttgggatcacagtcacactcagagaacttgaactgggaactatgttgaggtcgtcctggagcaacatgcatgtggcagcttatctgtagtggttgagaaatcagtgaaaataataaagagatatacctgtgtggagaggctcaatgactatatcggcaatatctgcaacatcaccatggagtgggggtggggagttggaatttgatctgccagtcaaagagctggttctggtctgggattcttgagggtccagataaatatacagaattggagggaaatcttcccactctagacgagcctgaaaactgagattctaagacaccagattaccagaaagacatcagaaatgcaaacaattaggaaataaatttttctcaatgaaatgcacatcataaattttaatttgcatttaaaatgcaaatcataaattttaatttgcatttaaagtgcaaatcataaattttaatttgcatttaaagtgcaaatcataaattttaatttgcatttcactgagaaaaatttatttcctaattgtttgtatttctgatgtctttctggtaatctggtgttttagaatctcagttttcaggctcatctagagtgggaagatttccctccaattctatatatctatctggcccctcaagatgagatataatttaaaaagtacatttgggactcataaagatatggaaatagcatccatgaaaaggacaagaaattataaaacaaaaacaggtagctgtgaatcaaggacaggtagatatgaaaatgattctaccagaagccatgaaaataaaaaatttgctattaaaataaaaataacttgggaggttccaagatggccgaataggaacagctgcagtctacagctcccagggtgagcgacgcagaagacaggtgatttctgcatttccaactgaggtaccaggttcatctcactggggcttgtcagacagtgggtgcagcccatggagcatgagcagaagcagggcagggcatcacctcacccgggaagtgcaaggggtcggggaattccctttcctagccaagggaagccctgccagatggtacctggaaaattgggacactcccaacctaacactgcgcttttccaatggtcttagcaaacagcacaccaggagattatatcccacgcctggctcggagggtcccatgcccacggagcctcgctcactgctagcacagcagcctgagattggactgcaaggcagcagtgaggctggggtaggggtgtctgccattgctgaggcttgagtaggtaaacaaagtagctgggaagctctaactgggtggagcccaccgcagcccaaggaggcctgtctgcctctgtagactccacctctgagggcagggcatagctgaacaaaaggcagcagaaacttctgcagacttaaacatccctgtctgacagctttgaagagagtagtggttctcccagcacacaggttgagatctgagacagacagactgcctcctcaagtgggtccctgacccccgagtagcccaattgggagacatctcccagtaggggctgactgacacctcatatggccgggtgcccctctgagatgaagcttccacaggaaggatcaggcagcaacatttaccgttctgcaatatttgctgttctgcagcctccgctggtgatacacaggcaaacagggtctggagtgaacctccagcaaactccaacatacctgcagctgagggtcctgactgttagaaggaaaactaacaaacagaaaggacacccacaccaaaaccccatctgcacgtcaccatcatcaaagaccaaaggtagataaaaccacaaagatggggagaaacaagagcagaaaagctgaaaattataaaaatcagagcacttctcctccaaaggaatgcagctccttgccagcaatggagcaaagctggacagagaatgactttgatgagttgagagaagaaggcttcagacgactggtaataacaaacttctccgagctaaaggaggatgtttgaacccaacacaaagaagctaaaaaccttgaaaaaagattagatgaatggctaactagaataaacaatgtagagaagaccttaaatgacctgatggagctgaaaaccatggcacgagaactatgtgaggaatgcacaggcttcagtagccaattcgatcaagtggaagaaagggtatcagtgattgaagatcaaataaatgaaatgaagtgagaagagaagtttagagaaaaaagagtaaaaagaaacaaacaaagccttcaagaaatatgggactatgtgaaacaaaatctacgtctgattggtgtacctgaaagtgatggggagaatggaaccaagttggaaaacactcttcagggtattatccaggagaacttccccaatctagcaaggcaggccaacattcaaattcaggaaatacagagagtgccacaaagatactcctcgagaagagcaactccaagacacataattaccagatgcaccaaagttgaaatgaaggaaaaaatattgagggcagccagggagtaaggtcaggttacccacaaagggaagcccatcagattaacagcagatctcttggcagaaattccacaagccagaggacagtgggagccattattcaacattcttaaagaaaagaattttcaacccagaatttcatatccagccaaactaagcttcataactgaaggagaaataaaatcctttgcagataagcaaatgctgagagattttgtcaccaccagacctgccttacaagagctcctgaaggaagcactaaacatggaaaggaacagccagtaccagccactgcaaaaacaggccaaattgtaaagaccatcaatgccaggaagaaaccgcatcaactaaggagcaaaataaccagctaacatcataatgacaggatcagattcacacataacaatattcaccttaaatgtaaatgggctaaatgctccaattaaaagacacagactggcaaatggataaagagtcaagacccatcagtgtgctgtattcaggagacccatctcacgtgcagagacacacattggctcaaaataaagggatggaggaagatctaccaagaaaatggaaaacaaaaaaaggcaggggttgcaatcctagtctctgataaaacagactttaaatcaacaaagatcaaaagagacaaagaaggccattacataatggtaaagggatcaattcaacaagaggagctaactatcctaaatatatatgcacccaatccaggagcacccagattcataaagcaactccttagagacctacaaagagacttagactcccacacaataataatgggagactttaacaccccaatgtcaacattaaacagatcaacgagacagaaagttaacaaggatatccaggaattgaactcagctctgcaccaagcagacctaatagacatctacagaactctccaccccaaatcaacagaatatacattcttctcagcaccacttaacacatattccaaaattgacacataattggaagtaaaacacttctcagcaaatgtaaaagaagagaaattataacaaactgtctctcagaccacagtgcactcaaacaagaactcaggattaagaaactcactcaaaaccgctcaactacatggaaactgaacaacctgctcctgaatgactactgggtacataacgaaatgaaggcagaaataaagatgttctttgaaaccaatgagaacaaagacaccacatacccaaatctctgggacacatttaaagcagtgtgtataggaaaatttatagcactaaatgcccacaagagaaagcaggaaagatctaaaattgacaccctaacatcacaattaaaagaactagagaagcaagagcaaacacattgaaaagccagcagaaggcaaaaaataactaagatcagagcagaactgaaggagatagagacataaaatacccttcaaaaaatcaatgaatccaggagctggttttttgaaaagatcaacaaaattgatagaccgctagcaagactaataaagaagaaaagagagaagaatcaaatagacacaataaaaaatgataaaggggatatcaccaccgatcccacagaaatacacactaccaccagagaatactataaacacctctatgcaaataaactagaaaatgtagaagaaatggataaattcctggacacatacaccctcccaagattaaaccaggagaagtggaatccctgaatagaccaataacaggctctgaaattgaggcaataattaatagcctaccaaccaaaaaaagtccaggaccagacagattcacagccgaattctaccagaggtacaaagaggagatggtaccatttctgaaactattccaatcaacagaaaaagagggaatcctccctaactcattttatgaggctagcatcatcttgataccaaagcctggcagagacacaacaaaaaaagagaattttagaccaatatccctgatgaacatcgatgtaaaaatcctcaataaaatactggcaaaccaaattcagcagcacatcaaaaagcttatccaccacaatcaagttggcttcatccctgggatgcaaggctggttcaatatatgcaaatcaataaacgtaatccagcatataaacagaaccaaagacaaaaaccacatgattatctcaatagatgcagaaaaggcctttgacaaaattcaacagctcttcatgctaaaaactctcaataaacgaggtattgatgggacgtatctcaaaataataagagctatttatgacaaacccacagccaatatcacactgaatgggcaaaacctggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgtttgcagatgacatgattgtatatttagaaaaccccatcatctcagctcaaaatctccttaagctgataagcaacatcagcaaagtctcaggatacaaaatcaatgtgcaaaaatcacaagcattcctatacaccaataacaggcaaacagagagccaaatcatcagtgaactcccattcacaattgcttcaaagagaataaaatacctaggaatccaacttacaagggatgtgaaggacctcttcaaggagaactacaaaccactgctcaacgaaataaaagaggacacaaacaaatggaagaacattccatgctcatggataggaagaatgaatatcatgaaaatggccatactgcccaaggtaatttatacattcaatgccatccccatcaagctaccaatgactttcttcacagaattggaaaaaactactttcaagttcatatggaagcaaaaaagagcctgcattgccaagacaatcctaagccaaaagaacaaagctggaggcatcacgctacctgacttcaaactatactacaaggctacagtcaccaaaacagcatggtactggtaccaaaacagagatatagaccaatggaacagaacggagctctcagaaataataccccacatctacaaccatctgatctttgacaaacctgacaaaaacaagaaatggggaaaggattccctatttaataaatggtgctgggaaaactggctagccacatgtggaaagctgaaactggatcccttccttacaccttatacaaaaattaattcaagatggattaaagacttaaatgttagacctaaaaccataaaaaccctagaagaaaacctaggcagtaccattcaggacataggcatgggcaaggatttcatgtctaaaacaccaaaagcaatggcaacaaaagccaaaattgacaaatgggatccaattaaactaaagaacttctgcacagcaaaagtaactaccatcagagcgaacaggcaacctacagaatgggagaaaatttttacaatctacccatctgacaaatggctaatatccagaatctacaaggaacttaaacaaattcacaagaaaaaatcaaacaaccccatcaacaagtgggtgaaggatatgaacagacacttctcaaaagaagacatttatgcagccaacagacacatgaaaaaatgctcatcatcactggccaacagagaaatgcaaatcaaaaccacaatgagataccatctcacaccagttagaatggcgatcattaaaaagtcaggatacagacacttctcaaaagaagacatttatgcagccaaaaaacacatgaaaaaatgctcaccatcactggccatcagagaaatgcaaatcaaaaccacaatgagatatcatcttacaccagttagaatggcaatcattaaaaagacaggaaacaacaggtgctggagaggatgtggagaaataggaacacttttacactgttggtgggacggtaaactagttcaaccattgtggaagacagtgtggcgattcctcagggatctagaactagaaataccatttgacccagccatcccattactgggtatatacccaaaggactataaatcatgctgctataaagacacatgcacacgtatgtttattgcggaactattcacaatagcaaagacttggaaccaacccaaatgtccaagaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtggaaattgaacaatgagaacatatggacacaggaaggggaacatcacactctggggactgttgtggggtgggaggggggtagggatagcattgggagatatacctaatgctagatgacaagttagtgggtgcagtgcaccagcatggcacatgtatacatatgtaacaaacctgcacattgtgcacatgtaccctaaaacttaaagtataataaaaataaaaaaaaagtcaggaaacaacaggtgctggagaggatgtggagaaatagaaacacttttacactgttggtgggactgtaaactagttcaactattgtggtgattcctcaaggatctagaactagaaataccatttgacccagccatcccattactgtgtatatacccaaaggattataaatcatgctgctataaagacacaagcacacgtatgtttattgcagcactctccacaatagcaaagacttggaaccaacccaaatgtccatcaatgatagactggattaagaaaatgtggcacatatataccatggaatactatgcagccataaaaaaggatgagttcatgtcctttgcagggacatggatgaagctggaaaccattattctgtgcatactatcacaaggacagaaaatcaaacaccacgtgttctcactcataggtgggaattgaacgatgagaacacttggacatagggtggggagcattacacaccagggcctgtcgtggggtggggcgagtggggagggatagcattaggagatatacctaatgtaaatgacaagttaatgggtgcagcacaccaacatggcacatgtatacatatgtaacaaacctgcatgttgtgcacatgtatcctagaacttaaagtataattaaaacaaaattaaaaaaaaaacaacttaatagactggctaagtttatgctagatacagctgaatagagaattggtgaattagaagaaagtcttagataattcaatacagtgaacagagagataaagaaatggaaaatacgaatgtaaaggtgttgttaaggcatacagacagtggattgaaagattcaaacatacatcctatgggagttacagaaagagagaatagggggcatggcaaattagtaatatttgaagagattgtggctgagaactcaagcactgaattcaagaagctagaaccgcagaacaaatatccaaataacagatgtaaaaaggaatatggagaagaaattaataacacagaaaaacaacaacaataatcaagaagtcctacttatttcagaagacatttttagaattaccattttttaaaaaaggcacaaataacattaaacatggagaaaatgtaccaacaaatgttataaagaaaataatttgaaaacttagatgaaaaggataatttagaggcaaatgtttttcattttggtcttttttcttttcctggtacttaccttcatattttaaaataatatgcttatagaggtatttcttgggttatgaattttaaatatttcctggtgaatcgttatagtcattgcagatttagctctattttcctcctgccatcttcttaccttctgcctcccactctcctgttctgtatatataattatatcaataattttggtaaaatcagtaattttgattaacactatgatggaaatattgttattaattcttattaacactatcattggaaatattgtttactgcatagccatataatatacactatttttacttttacttttctagataagtttatgttttcttcctggaattaataattgccaccccccacatccaatttgcttagttttctatttgtatgtccttattttttggtaaatatttaaatatgtctgtgccactcttaactataattttttcaccaaatacttaaggacattgtatacctattccagatattttatcaatttttttttaatccctagtggcttcctttctagatactcccatcttgtccaaattgagctgatttctgtctggatcttctgtacagctgtcattcagagattttcctatgttacattcctgtgttggaaccatagtttcctgaccctctgtatttctatttcttagttaatccctttatttgcaaaagaatacatacaaggacttccttaggaagggatttgtattagttcgttctcatgctgctaataaagacatacctgagactgggtaatttacaaagaaaggagatttaatggactcacagttccatgtgtctggggtagcctcacaatcatggcagaagatgaaggaagagcaaagggatgtcttacatagcagtcacagaagagagagcttgtgcaaggcaactcccatttacaaaactatcagatctcatgagatttattcactatcatgagaacagtatgggagaagccacccccatgattcaattatctctcaccaggtccacacaacacatgagaattatgggagcttacagttcaagatgagatttgggtggggacacagccaaaccatatcaggattctacaaggaatatttttcaaactgttaaaaaatatgtattctgccctaatacttgattggtagtttagttgaatatagaattctatgttgaatatattttttcctcatgatattaaaggtgttgctctactttcttccggcaacttcaatgctatcctaatttcacatcctttttatgtggcttctttattttctgtctctctctggaagattgtaggatcctctttttgtcagtcctcttctgaaatttcatgatgatgtccctttgtgtggatctttagttatttgttttaaatttattgcacaatgttaagatacaaatataaagaaagtttaatatttgtgtactttcactcaacctgggatataaaaagatcaatacaaaattgtttatgtgaaatgattgagagaaagagattacaaatgaggcaaaaaatgttaaaaggtgcacgtaggtgaagtctttattgtgctctcggaacatttttgaagattaaaaaaagtcaaaataaaaaggtttttttaaagaagaaaaattcagttgaaatcccatgtacccctccttgaaacctcttgctatcctttctcccctaaagaaacccattatcttcagtttaatgtttatgtttccttgtacttctttatatttttctaactgtatacatatctaaaaataaatagcttgatatgcatagttttaagccttatggaaatgatatcatactgtatatagtcagaaacattttttgctcaacattgagttggttcatctatgctgttccttgtagctctaattattcattttaattgctttatgatatattattatacagatatgccttgtagtatttatcctttctcctgttggtggacatttggattgattccagtttttttgtaattatgaaatgtgaatatgtttacttgtaccaatatgtgattgtttctttatggtatatgtggaggagtgatattgctaaggtgagaggatatgtgcatcatcagctttgccaggttttgtcaaattgctttccaaagggcttgtgccaatttgtgcagccatagtatataattctttccggtgctgtctccttgtcaacagtattgtcaggtgttttaatttctgtccatctaatgggaatgaactgttatttttttttagttttcatttccctgattatgagtacaattaaatgtcttttaaaatttattaatcatttctgtctcatcgtctgggtatggtgtgttcatattttttgcctgtatttatattgagttttaaaaaaatattgatttgtaaatatttgctttttttttttttttttttttttgtagagatggggtctctctatgttgcctaggctgaagtgcagtggtgggaccatggcaaactgcagtctcaaactcttggcctccagcagtcctcctgcctcagcctcccaggcagctgagaccacaggtgcatgccaccatatctggctaatttttaaattttctgtagagatggggctttgccatgttgcccaggctggtctcaagctcctggactcaagcagtcctcctgccttggctcctcaaattgctgggattacaagcatgagcccctgtgcccggcctatattcttgacactaatttttttcagtaaaatgtgttgcaagtatgtctttcaaatctgtggcttgtcttttcacttttatgggtatcatttgttgtataaaagttttacattttaatgcaatcaacattttcaatctttttttatgatttgggctttgtgtcttgtttaacaaatacttttccatcccaagatcataaagatattctcttatattactttctaaaagttttaaagttttacttttaccaggatttgactcttccttagaattagataataacattttctccttagcctattcatatggtaagttatattaaaagatttcctagtattttactgtattttgatttttccaactttctgataggcttatgtttaaaaattgagtaaaagtgatttaaaagggatatacctaaaatataaaaagagaacattaaaaataaagtgatagaagagacataataagtaaacactaaccaaaagacaaaattagactatgatgccaaatgtataatttgggctaaagagggccactatatcaataaaatatttaattcattagaaagtgtagcaggtctaaacttgtccacacccaataatctatattatgcattaaaacatgtaaagcaaaaactgacagaacaaatggaaaaaaatgtaaagtgccccattacattggattttaaactggctgtcattaatataaacatcaatcaaaaaagaaaaaacaatatagagcatatacatctttcaacttatgaactatatagatctttatacataaaagtaatacaaccatagaggttgtaaatattagtaaatccattaatataacttaccatatgtataggctaagaagaaaaaccacatgattatatttattaatgatattatcctttttatacaaattgcttatatttttcccacatgtctttatgcattgcttacagtagttttgttatgcagaagtgttttatttttgtgtaatcaaatcattagtcttaatgcttccggatttcgagtcctagttaggacagtttgtcctattcagaggtacagcgtcattcactcatttaaaaaaatactcatatggcttaattttttttacattaacttttttgtttgtttgttttgagacagggtcttgctctgttgcccaggctagactgcagtggcccaattactgctcactgcatcctgcagccttgacttcctgggctcaagcaatccttccacctcagcctcctgagtagctgggactataggcatatgccaccatgcctagccaatgttttcatttttatttttgtagaaacagggtctcattatatttcccaggatgatctcaaactcctgggctcaagcgatcctcctgtctcagcctccaaaagtggtgcgattacaggtgtgagccaccatgcttaatttatttttttaagtgacttgatactattcctcaattagggaaatggaattgttgggaaataagcagaagaggaataagatactttataatgtcttactactactgatagtaatattataactagtatttgatattgttgtaataattatcaatacaatagagcattaacgtttctgatgcatttggaaattatcctggtgtatggtagagatgggggagagtttttctagtctctgttacacggaggtggtaacccttcatatgtcctgatgttatgcatggatcttagctccaacttggtgccctgcacagggccaagaccatgggggccaaggcccccacccccttggatgttagaaccttggttcctgtgctttttgctatggctttgcctctcatttttgtttctacacctgaggattccttttttctccccctgctttagcttgatgtatgtttcacccagtttgggattttccctcagcttggtttactgctttgccatactttggttcacagtggttaggaacttgtagaggacatatcctaaggggcttggaaataaaatggggtagagatgagcattaactctggaagcactattagtttttctggatctagtggcttgttttaaagcattttgaaactttataggctagagcatatcttcagatagcccatgtgttcaattacgacttaaaaatgtctgagattggccaggcacagaggctcacgcctgtaatcccagcattttgggaggctgaggtgggcagatcaccaggtcagaagttcgagaccagcctgaccaacatggtgaaacttcgtctctaccaaaaatacaaaaagtagccaggcgtggtggcacatgcctgtaatcctagctactcaggaggctgaggcaggagaatcacttgaaccagggagacggaggttgcaatgagccgagatcacgccactgcactccagcctgggagacagagcaagactccgtctcaaaaaaaaaaaaaaaaaaatctgagattgtactgactgatcgtgatctactgggtgtactgttattcgtgaatattgtcaaagggcaatgcatcttcaacttaagacatctgtcactttgtctaattcaaagcacactctaaactcaatatacatatatatttctgcatattttacatgagaattctccacatcttaacatagattattccaagctgattgtaaaaaatttctgctttagaactgtgatctgaggactctccttgttgtaaagttccccattccatgtctgtctttgctggaacatggagtggtttagtaaactagcatgagtttgggagtctttgaatcttggttatatgattatctctgttgtggaatcctgagaagccatttacaaatttttatcttcgtatttatagtataaaattgtcccttttttggtgcacagttctatgaatgtaaacacatgcttggatttgcgtaacctccataatcagtatgtagaaccattttatcactgcgtaagctccctcatgcgattcctttgtggtcacacactcccacccctgacctctggaaacccctgatctgttctctatccctattttacgaatatcacacaacaggaatcatatatagtatgtaaccttttgagactgacttttctattcaacctgatgcttttgctccatgttattgtttttatcaagaattcttctttttttaattgctgagtaatattccattgtttggatgtattgcatttatttattcactcaccgattaaaggatatttaggttgtttccagtttttggtgattatgaataaggcttatatgagagaaattattttacccctgataaatgccagttttttccctacttgagcccagttcctttcatccaacaataacttacattacacctctgccaaaaagaaatcctgatcacatcttgacccctaggatggcaattacatttcctttcccgtgtcaagtatgcattctggaatactgtgttgaacagaattgcaaggctacctctgggaaaacaggggtataagcaattgatgacatctgctaaggttgcagaagaggcaaatggcagcaattggactgcataattataggcatattgcttcccagaatggagaatagatatagaatagaacagacaataaaattagctagtgcagtgatgtagacttctgcgttcctgcagctttatcacaccacaaaaaaggaaaaccttttggaaaatatcatattacctttcatttatctgcatagccgaatttgtgcaatattcttttttgtacattatagaaaggtacattaaaggagtgttaagggttgacccttactgaggtgtgttaagatgcagtctgtggtatcttctaggtgcagagtcattgccaactggacccagagtgaaatgttacattttgaaataaaatttgcataagcactgatgcattttgtaaatatgtaccctttgtaggcagatactgtgttattatgctgttgtgcttgaaaaatagaactaagttttttgtgtttctttttctttccagtattactttactgttctttttggccatgaaggtcagaagccactggagctgcgctgtgaggaggagcaggatggtaaagagtggatggaggccattcaccaagccaggtataggctcagtcttcctgtgtagtacttgattgtctgggtcctgcattggggttatcactgttggtggtagttttggaagaacttgcaactctaagatgagttttctcctggtacctattccttagtcatgtgtgagatcattatttgagctttccatggctacattccagctaaagattaatggtaatagatacaatgataataataagtagtagtagtagtcacttttgtggatttcttcctatgtgccaagcactattatatgtgcttttcaattacagaatgtattgaatgtattgactcactctgtcaacaatcggcaagaggggcattataattccccctgtctgcagataaggaaactgaggcctggaaagttagttttcctgcctgaggtcacacagctagtaagccacagagctgggatatggccctagcctagcctacatttgtaaaccctgctctgtgcacctcggttatcaaaagaaggggatgacatcctctatttaaagaaatagaacactgtgatttcgcttccccctaagaaacatcaggaaggtggaaatgtgtgtacagggtcttaaacgggaactagaaatctgaaagagatacaaggcaggtccctctctcttattttcctattcaatccctaaacctggttcagttttgtttcccatggctctcaagctcttgctttttgcctgtccactccctaatccaggctgttgctccactactccctgctctcttgtcttgctcatctcttgggtattttggggcaacactctagctgtggcatgctttctttttcttcacctgatgagccttcccttctccatctgtctgttcctccctctaccactcccgccctgagacatctccctgcaagtcagccctcactggcgccctcttcaaatggctgcagcacttgcattgtgtactgcacgtgggcgatttagcaattctggttatcattacttttttaatatagtgaatgtgttagatttctgtttcctgagtgggattgtatacaccttgagaatgaggagagggattggggcacattcatgtctgagtgaagcgcattgctaattatgtagtaggtgatcaggagatttcttcagtttgattgtaagaatgaggcatttaggctgggcacagtggctcatgcctgtaatcccagcactttgggaggctgaagtgggcagatcacctgaggccaggagtttgagaccagcctggccaacatggtgaaaccccgtctctactaaaaatataaaaattagccgggcatggtggcacacgcctgtagtcctagctacttgggaggctgaggtgggagaattgctcagacctgggagttggaggatacagtgagccaagatcacaccactgcactccagtcttggggagagagcaagactccatctaaaaaaaaaccacacacacaatgaggtatttattctgagtgagttcaggctgttctttgaacccttgacgctttctctgaaagtctgccctccccttccctcgtctcacctctattctccctaccctcttcagctacttatatttaccaccttctctgacaagcagtgtgccaagtgttttatgtacttatctttttttattcttcacaataagctaataggatattattatccccattttacagaggagaaaacaaaaatttgtgacaggcatattggccaagttctaacacaaagttgttaagctgcagatctgggattcaaacccaagttgaattgggtttggacttcagaacctttagctaatgttcaatattgtacttatcttcgttatcctctttatcactacagtcttttcttgttctattttttttttcttttcctcattcaaagacgaaagtagattaatgtgagactagggttgagagtagaagatgttatttgcaaaatatttcagttccttttctttctctgagatgcatggggctggcaactaagtgccactctccatgtggaccccaggagagcttgccacgagtcatcatgaccccggcacatggttcagccgtccttgctcttggtgctctctgtttgagggttttgatccagacttaggactaatgcagaatgacttgctgtagaaagaaagtcaggccttcaaagatgaaagaagcatcaagctggcaaggtagagcccttgggtcatttccagacacaatcttttcctttctacaatctctattcctttctacctaggagttaaaatacataatttaaaacatgcctgttttcctatctttttcattccaggagagcaggcaccatcagtagcccaaatgcctttgtagttgtcaagcaaatatcttggtgaaccaaacacaaataatgcaaattgctttaaagatgattagattccaagtaagaaatctttttttctgtcccaggaatgcattttatcatctacaggaaactgagtcagtaattatttggtggtgtttgacatacagtcaaaaccagggcatgtgtgatgttgtcaggagacagactttagaaaccacttaagtggtttagatgatacaatggtgaaaattcttttctttttagatttgaagatttggttaataattgactttttcccttgatgttttgactttttggtccattaggtttgcttttcccttgacttgagacctaggactgggttctttgataatttcttttaatctgactgctttatactgtgtttttatattttctgttttgcattgagatatttcttaaatttttgttttctaaatcagggaagaaaacttttttatctaagcttgattaagttgagtttttggtttaaacttggatctgcaaaattcaccttgattttgttcatgtatgaacaaagccagaaagttaatgaagctgattcagagcaagaattatcagccatttttgcttggcattgtaataaaacacaattaattaattatggttggttgacttaacatttcaccctcgaaagacagtctgatggcattaattcagtactgctgcctttctaatataaaagttttaaatactcaatatttatggttttattgatccttttttaaaaaatcaaaacttttgattagtttagcatgagatgttcttttctgagctacaaatcctcctgtagatgccacttagatacaaagactgctcagaaccccttctctcatttacttttgttttcctgggatggcttttcagtaccagcctgggtgtgctgtctttgtgtgctatgaacatcacattgttctgttggctttcgtatctcagagcagaatctacttgccccactttgccttcagagaatcttagggtcattttctgggatgtcccattgcatgttttctcctttagatctggcccagaaaaaaaaaatcgttttggaattaacatttttcattttgaagctttgaccagtccaagaagctcattttaatgttttgcttaccattggccaatactgcatttctagaacacgggcacatttaggatatcattttaccacatgttatggcactagttcaggggacgctgctaccgagacccagtcttgtttttgtctggttgagttgaggccagagccttttcatagtagttaagtctatgcttattttatgtggttgctacttgagtatggaactctggacataaaaaataacctgatatttcttctttgttttcttgtccataagtgtccatcatggttgatttagttgtagacactaggacaatcaaaaactgacctggttgattgtgagtccttagggcttgttagctgaaaagacaactcttcaatgtttcatctgctagaacatggaccaagcaaagtatcagcagttaggagatagtcatggcctggacatggatccagttgtatatcttccaagggtcttcccatccttgactaagcctaatacccacaggacctagactatgacatttgggaagaaacgaggaaggttctccagagatgtagggggtagacttcaagggactttgtgactatctggatttgagcagtattagactagggtggcatctaacacatctctcaggcccctagcttggacggtgtcactctttgggagaagaaatgatgaatgaggacaggtttgtgggcaaagatgatgagcattggccaggaaatgttgggcaatttctgctggaaattggaagagtatgattatcgctgggaaaggaaggaaactgtgagacactgaattgatcccttggcgtgtggggtatgagagaatgagtatccagggggctgatagagaagtaaggtgtatcctgaggagggaggagagtttgggtttctaccaaggtggagggattgggaaaacagatattgagaatgttgagcctagcacagagcactgttgaatgtgtgtagctttgcacaccctgcagatggcttgtgtgtcctgtgtttgaaactgtcccactatcttttgcctgctttctgatttcttcagctgaacctgctcaaatctccacctcgattctcttccctcccctcagggtgtatcttgagcaggcagatcgtaggttttcctttaagggcagagcatacaaaaggaaaaaagaattacaaaaaggaatatgtttccactccataaagctcacagtcagatggtgtttggcaagggcctgacctaaccctttgtttcaccctgtcagtctccaacctgacgagcagagagactttatcatccagttaaacctttcaattaagccttattctcttttccagtaaagaaagctgtaatgcagcctcttggatctgtttttaatgtttagtctttttgattacctgtgtctgagacagctgttgttcattctctctctcccttaaaatacacacacatgcacacacacacagtgtggtagctgcaccaaacacccagaacctaatgcttgtggtctcatccttggaaaaaggcttaatttgcagcaaggtatatagtataaaaatctgtacagcactaaaggctgctgtgtatatcatatcctccccttaaaatcagccctttagagaatgcacacagagagaaatccctcacaaatcagagaagagtgatgacatagaaaagctgaaaatgtttcatgtgtcacagcaacatcacaagactagaaaaattagagatggacagtgatgttatagcctaaagcaatccaacaccatagtttgtattcttcctgtaacagtaaaactgtcactactttaaagatgaaaatgtggattttgttcatttaaggtattattattattatttgctaagaaattctgtcagggctttgccttcatatttgccacaatgaaagataattcaacattttttttccttttacagcctacagagtgcaacatgaaagagaagggatactactaaactactaaactgtgaaatatttcacttgatttgatggttacaattgttttctatagggaaaagtcgggcttgaattttcttattttaatactttgttaatactttcgtcagctgtctttccaacttctcagtgtttttgtttcaagtgcttgtcttgcacatttagcatccagctgaaaaggcagtcagaccttctgcctacactcaccgggcaggtgccccgtcctcatgcgcacaccatctcacctgcaggagggagccatcctcatgattctctttgcctgctccaggagaaccatccccggttcaagacaaatttctactttgagctctctctctgatttcttgctccattacttattccatttctctcttatatttccagtctgtttattcctcgctccttacctttttttcctgtattttttggatctcctaaaaatctctcctgtcttgtaagagaaattaaagccttttcttggcactgaatactcctctagctactgtcttctcttgcacatgcagcccggcttcttgaagaaatggttcggttgctctcctaggcacgcagctcttcctctctccagctcttcctggtgggttttgtccctactctactataactgttgtcacctgggtcaacaatgaatttccaaagcttttctttccttatataacttcaactttctgttcatatttaatacttacttttgaattacaccagtaatacataaaagcaagttccctaaaaaaaaaaaaaaaaaaaaaaattcagacaatacaaaagtaaagagttatagttccaccccctccccctttattccccaagcccatttacttcctcagaagtatttactggtaacagtttggagtgcatacttccagatttttctgtatatttgcatatggatagataggtagaatgatataattacagactttttatttgctattcatattattcgccatctttttatgctaatttggagggtttcttttaacattagtttatagggatctaagtcttatctcgaaattttcattccttttgtttacgatgtctctccctcctgattctccctttactcctttgacaatttcttcttgtcctatttcactactccttgtgttctgtccctttctttactgtggctgctatgtagggctttgcttttgctcttcctgtctcgtcacttggatccattccccagacttaggtcgtgtagatagagctgctctttctcaatactttctctgctaaataccatgctatgtgcatgatatctcatgaagtagctggcactatccccaggaaatctgagtattggagagatgaaatgacctcctgagggccaccagtctagtaaacgatagagctggaatcaagtcctgggcaggctgactccaaaacctatgcacttaaccacaaagatatatagcctccattatatgtagaaattcaccaacatgtatttttctatattgaactatctatatatcatctctccctgggtgctcagaattacttgatactaagcaagacaaacccaaactcatgtatttctctaggcagcttcatgttcccttcctggataggaatgtaaggcatactctcctgtacactcagtcactcaaaccagcaggatatcatcccctgaccccagcctaactgctcactgcagtcaccacttgtggattctaccccagaacatcactggtctgcgtttctccacatgtctgcagcattgccctggtgcaggccatcaacactgattgcctgtcctattgctctgccacctcgcctgtctcttccaggtcggcttccttcccatcgattctctacagttactagagtgccctttctaagcaaacatctgatctgctgaaggaattccggggttcccagttgcttttagttattataattcaatttacttcttattgtagaaaattttaaatatatacagagaaagagagataacagtcctccatgttgctttaagaagagaaaatattcattatttcactgatatttattgcttccctacccaatgctaggctttgctctgagttctgggatggagtgagccagtccaagcgaggcccctctgagctgacctctgcgaactcctcgtgccacccctccccttatgtcctgggctccagctggagccaccacatacaggaattttaatgtgtgggaatgtctcttccagtctgacttacaccaacacatctttcaggatggagctcttagcagcttgcatctttcctggtcctcttcctctacgagcaggaagggctgaccattcccttctttgagccctcactgtaacttcttatttcgctcgaagcacctaagaaattattgcattgatttgtttatgtgtctgtatctctctgtcaacctgaattccttcaaagcaaattgtgtactactcatcttttgtgccctgccccagtacagtgccaaattgcttttcagaaatgcatgtactgatttaatctccctccattagggcagaagaaagctggaatcattttttaaaatctttactatatcagtgggttaaaaatgatatattagtataataagcattttcttgattattgataagattgtgttttgctatcactaatatctgtctatatttactatataaattatcatctcatgtccttttcccattttttggtattggtgtttttctagaagtttttaaataagctctttgtatgacaaaaatatattcatcttttatgtttgttcaaatcaccctgcatcatttttttgtcttgtagttatacctatgggatttttttgacattagagtttttgaattaaaatgcaatcaaagtatattacttttggggggaagttgttctattgctttttaaaaatattttttaaaatcaagatatacttcatataccatgaagtttatcattttaaagtgtataattcagtgcttttctagtacagtcacaaggttgtacaaccatcaccactaatttcggagcattttcaacaccacaaaagaaaccccatatccgatagctgtcactctcaattccccacttcccctagctctagccaaccactaatctcctttctgtgtttatggatttgctcattctggacatttcatatagatggaatcctacaaacattttgtgtctgatttctttcacttagcataatgtttccaagcttcgtcaatgtggtagcatatattagtacttcattccttttaatggctgaattctattccactgtatggatataccacattttatttatctactcagttgatggccatttaggttgttcccactttttgctagtatgaataatgttgctatgaatatttgtgtgcatttgtacatgaacatatgttatcaactctcttgggtatatgcccaggagtggaattgccatgtcatttggtaactctatgtttaactttttgaggagatgccaaactgttttctacagtggctgcaccattttacattcccaccagctacgtattgagggtgccagtttcttcacatccttaccaacacttattttcgttgcttttttgcttagagtctttatacgttctcatatataaacccctttaatctattcttgttgaattaatatagttgtatctgtattcttgctggagaattttctgtgatgataaagataattctaccaatacctgcttgtgcacatggaacagaaatgaaagtctcagtgttaggaaagaatcattaatgtctattgtgatacaaaacattttcttcagcttcataatatagtactataaaagatatttacttttagaagcactccttaaaatttctctgttccaaggtaataattttaccattagtgatgttctgttgtatttcctagtaaaaatattttgcctgcttttatatttaattgtgctttagaaaggattatcgacaactttccacatgtcccaaagtttagtgaaatgtttaagtaacgaactgtgactgtgaacaggaaagaaggagcaatgtttagaagaggggtttttagtctttaatttttgttcctctttttgatctctcttaactaagatgcttgtgtttccatttactgtagagcagacagcttaggagggaagagtctgtcagtagagagaagacattggtggaggtgacagtgttaggacctcatgttaatgtgatatctaaaaaatattaattagccaatgaagtggagatactgacaggagagaacttgagaaccagaaacagtatgtgacagtaatgctgaaggggtgtgagtaaagatagagaaactggccttgcttaggtaaggtcaaagcaaatgttgctttgataggagctgtactattgtcatccatgcttggattttctccactcccaaaggcctcatgattctcctggcatgaggaacgctgattccaaacagttttctggataaaatttagcataaccctggagataggtggagtttttctttctttcttttttttattctaagtagtctttattctctgtgcacatatatacaaacaaaccacagagatatctctccccataaattagattcttaagtgacttttacattaaacaaatattaagaaagtatgataattacttgagttgtgttaaattcttcctttaattaagaaataaagcccacaatggataagataattcttttcttttttttaattatactttaagttctagggtacatgtgcacaacctgcaggtttgttacatatgtatacatgtgccatgttggtgtgctgcacccattaactcatcatttacattaggtatatctcctaatgttttccctcccccctccccccaccccatgacaggccccagtgtgtgatgtcccccttcccatgtccaagtgttctcattgttcaattcccacctatgagtgagaacatgcggtgtttggttttttgctcttgcgatagtttgctgagaatgatggtttccagcttcatccatgtccctacaaaggacatgaactcatccttttttatggctgcatagtattccatggtgtatatgtgccatattttcttaatccagtctatcattgatggacatttgggttggttccgagtctttgctattgtgaatagtgctgcaataaacatacgtgtgcatgtgtctttatagcagtatgatttataatcctttggatatatacccagtaatgggatgactaggtcaaatggtatttctagttctagatccctgaggaatcgccacactgtcttccacaatggttgaactagtttacagtcccaccaacaatgtaaaagtgtttctatttctccacatcctctccagcacctgttgtttcctgactttttaatgatcaccattctaactggtgtgagatggtatctcattgtggttttgatttgcatttctctgacggccagtgatggtgagcattttttcatgtgtctgttggctgcataaatgtcttcttttgagaagtgtctgttcatatccttcacccacttgttgatggggttgtttgttttttcttgtaaatttgtttgagttctttgtagattctggatattagccctttgtcagatgagtagattgaaaaaattttctcccattctgtagattgcctgttcactctgatggtagtttcttttgctgtgcagaagctcttgagtttaattagatcccatttgtcaattttggcttttgttgccattgcttttggtgttttagacatgaagtcgttgcccgtgcctgtgtcctgaatggtattgcttaggttttcttctagggtttttatggttttaggtctaacatgtaagtctttaatccatcttgaattaatttttgtataaggtgtaaggaagggatccagtttcagctttccacatgtggctagccagttttcccagcaccatttattaaatagggaatcctttccccatttcttgtttttgtcaggtttgtcaaagatcagatggttgtagatgtggggtattatttctgagagctccgttctgttccattggtctatatctctgttttggtaccagtaccatgctgttttggtgactgtagccttgtagtatagtttgaagtcaggtagcgtgatgcctccagctttgttcttttggcttaggattgtcttggcaatgcaggctcttttttgcttccatatgaacttgaaagtagttttttccaattctgtgaagaaagtcattggtagcttgatggggatggcattgaatgtataaattaccttgggcagtatggccattttcatgatattgattcttcctatccatgagcatggaatgttcttccatttgtttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtttgcttgttattggtgtataggaatgcttgtgatttttgcacactgattttgtttcctgagactttgccgaagttgcttatcagcttaaggagactttgggctgagacgatggggttttctaaatatacagtcatatcatctgcaaacggggacaatttgacttcctcttttcctaattgaataccctttatttctttctcccacctgattgccctggccagaacttccaacactatgttgaataggagtgctgagagagggcatccctgtcttgtgccagttttcaaagggaatgcttccaggttttgcccattcagtatgatatttgctgtgggtttgtcatagatagctcttattattttgagatacgtcccatcaatacctaatttattgagagtttttagcatgaagggctgttgaattttgtcaaaggcctcttctggatctattgagataatcatgtggtttttatcgttggttctgtttatatgctggattacgtttattgattttgggtatgttgaaccagccttgcatcccagggatgaagcccacttgatcatggtggataagctttttgatgtgctgctggattcagtttgccagtattttattgaggatttttgcatcgatgttcatcagggatattggtctaaaaccctcttttttgtgtgtgtgtctctgccaggctttggtatcaggatgacgctggcatcataaaatgagttagggaggattccctctttttctattgattggaatagtttcagaaggaatggtaccagctcctctttgtacctctggtagaattcggctgtgaatctgtctggtcctggactttttttggttggtaggctattaattattgcctcaaattcagagcctgttattggtctattcagggattccacttcttcctggtttagtcttgggagggtgtatgtgtccaggaatttatccatttcttctagattttctagtttattttcgtagaggtgtttatagtattctctggtggtagtttgtatttctgtgggatcagtgatatcccctttatcattttttattgtgtctatttgattcttctctcttttcttctttattagtcttgctagtggtctatcaattttgttgatcttttcaaaaaaccagctcctggattcattgattttttgaagggttttttatgtctctatctccttcagttctgctctgatcttagttattttttgccttctgctggcttttgaatgtgtttgctcttgcttctctagttcttttaattgtgatgttagggtgtcagttttagatctttcctgctttctcttgtgggcatttagtgctataaatttccctctacacactgctttaaatgtgtccgagagattcttgtatgttgtgtctttgttctcattggtttcaaagaacatctttatttctgccttcatttcattatgtacccagtagtcattcaggagcaggttgttcagtttccatgtagttgagcggttttgagtgagtttcttaatcctgagttctcgtttgattgcactgtggtctgagagacagtttgttataacttctgttgttttacatttgctgaggagtgctttacttccaactatgtggtcagttttggaataagtgcggtgtggtgctgagaagaatgtatattctgttgatttggggtggagagctctgtagatgtctattaggtctgcttggtgcagagctgagttcaattcctggatatccttgttaactttctgtctcgtggatctgtctaatgttgacagtgtggtgttaacgtctcccattattattgtgtggaagtctgagtctctttgtaggtctctaaggagttgctttatgaatctgggtgctcctgtattgggtgcctatatatttaggatagttagctcttcttgttgaattgatccctttaccattatgtaatggccttctttgtctcttttgatctttgttggtttaaagtctgttttatcagagactaggattgcaacccctgcctttttttgttttccattttcttggtagatcttcctccatccctttattttgagcctatgtgtgtctctgcacatgagatgggtctcctgaatacccgcagcacactgatgcgtgttgactctatccaatttgccagtctgtgtcttttaattggagcatttagcccatttacatttaaggttaatattgttatgtgtgaatttgatcctgtcattatgatgttagctggttattttgctccttagttgatgcagtttcttcctagcattgatggtctttacaatttggcatgtttttgcggtggctggtaccagttgttcctttagtgacctgggctgtgacatttcatttgggttttgctgtagtttgcttcatatatacgtcctcagtcaaaataagtggggtggaattctggcccagcaacaacaactttttgctaagctaatataatttttgcccttctataagataactaaggtctgtaatttcacactgtgcctctgctttggacttttcaacattttatttgaatgtttccttttctccatatggagtgatggtggttaggattttttatttatttttatttgttcatttatgattgatacatgattattgtacatatttacgaggtacaaggtgatgcttcggtacacacatgcattgtatcatgataaaatcagggaaattagcatattaatcagcttaaacatttattatttctttgtgatgaggacattaaaaaacctctcttcagcagggcacagtggctcgtgcctataatccaagcactttgggaagccgaggccagtggatcacttgagctcaggagttcaagaccagcctggggaacatagtgagacctcgtctccacaaaacaatcaaaaaattagccaggcctggtggtatgcacctgtagtcccagctatttggcaggctgaggcaggaggatggcttgatcccaggaggtcgaggctgcagtgatctgtgattgtaccactgcactccagcctgggcaacagaagaagaacctgcctcaaaaataattaattaattaattaattaattaataaccctgttttccagctatcttgaaatatataatacatgattattaattcttataaatattacacactaatattttattcccatatatatcctaatgttgacatctgtttgtactcaacagctgaattttgagttatgctttcaccaagtggatttatatgtcctttggcagggggatcctttttttgttgtgggagttgaactaaaaagcgaaaatacaaaataaaaaaatagctaaccaaatgaaaataataaggagattaggcaaacattttaaaacttgagtactacctagtaaatggaaaatttaatcacataagatatgtgttggcaatatagtagaatagaaatgccagtggtttgagaaatagtgaagggaagccctgcatgtgttttcagttgatttgatgcaatcctggagcagacatccatttactagtgggatatgtaaagaaagttttgtgatgcagagttggggggataccccagtaagagcagaataggagtagtaaactagggagccctaatgaaatcaatggcatgacctgaaaattactatgtgaagaataaggagccatgcatcctgggcaacatagtgagacctcatcttacgaaacacaaacaattggccatgtgtgatagcttgcacctgtagtcccagctacttgagaggctgaggtgagagggttgtttgagcctgagaggccgctgtactccagcctgggcaacagagcaaggccctgtatcaaaaaaaaaaaaaaaaaaaaaaaaagagagtgtgtaaaataaatcatattagatgaaataaatcatattagatgataaatcatattagatcatattagatgatttatttcatttgaataatatgatttatttcatttgacaatgacattgaatcatttgaacgactattctgtgccaagtccccaggcctggacttgtctgtaatctttttgcctggattattattgtaatagttccaactcttcccccttctcctcttgtgctccacccctacccttctttctcatcagaacagccagtgggatcccgttaaaaactgaaatcttggctgggcgcagtggctcacgcctgtaatcccagcactttgggaggctgaagccggtggatcacgaggtcaggagatccagaccatcctggctaacacggtgaaaccccctctctactaaaaaatacaaaaaattagccgggcctggtggcaggcgcctgtagtcccagctactagggaggctgaggcagaataatggcgtgaacccgggaggcggaggttgcagtgagttgatatcgcaccactgcactccagcctgggtgacagagcgagactccgcctcaaaaaaaaaaaaaaaaaagtgaaatcttgtaaggcctttgatcaaagcttacacctcgctggactgggggaaaacctgagactttctattgatctacgtgatttagaatcctgttccctcttctacctctttcttactccctgtcttaggccattcttgcattgctataaagaaatacctgggctgggcgcggtggctcacacctgtaatcccagcactctgggaggctgagatgggtgaatcacgaggtcatgagttcaagaccagcctggacaagatggtgaaaccccgtctctactaaaaatataaaaattagccaggcatggtggcgggcacctgtaatcccagctattcaggaggctgaggcagagaattgcttgaacccaggaggcggaggttgcagtaagctgagatcgcgccactccactccagcctgggcaacagagggagactccaccaaaaaacaaaaaacaaaaaacaaaaaaaacaacctgaggctgggtaatttataaagaaaataggtttaattggctcacagttctgcaggctgtacaagcatggcactggcatctgccccacttctggagagaccgcaggaagcttttactcatggcagaaggcgaaggaggagcaagtgggtcatacagcaagagcaggaaccagagagagagaagatgccacacatttttaaacaatcagatctcatgagaactcattcactgtcttgaggacagcatgaagccatgagggatctgtccccatgatccacacatgacccacacacctcccaataggccccacctccaacactggagattacatctcaatgtgagatttgggtgtgacacagatctaaaccataccattccccttgaggaaactcaccactttgtcattccctagacaggctaggcccactcccactgcagggcttttgcacatactgttccctgggcctggatgctgttccatcagctagccacgcatgtccctgcttcaagtcgtttctccagtaccatttctccatgaaagcagccctcaccgcttggttaaaattgtaacctctgcccccctacttcctgttctcctcttaccatttttcctctacagtactcatcaccaggtgacatatgatagatttgtcttattaatgttgtctttctctctctactactgtataagcttcataaagacacagatttttttcctactgtgtttactcctgtgcccagtattttgaacagttcccaaatatacaacactcagtaaatatttattgactcaaagaatcaatttggactcgcaggaacccaggaagaaggaaatcatgttacttataatcccaatgcatgaagtaaataactaccattaggattttatgtattttctcttttctccccacttaatattacagaaatattggaaagtatggaaaagtacaaaagaagtaactcaagaagaaattaaaaatcacccataattgctccagccaaagaaagctccctttaagttttgatgtatgtctctcattagagtacctttctctctgtctctctcttcccttctcctcttctgcttatgtctgtgtatacacttaattttctccctctgtgtatgaacatatatacatgtacatgtacatataatgtttatctcaatttcttgtttttttttctgtttatttatcaataaatcttgggtatgtgccattatgttatgactattttcaaaaaacatattttaaatggcttgttatcattccattatgaagatatattattacttatttaaccaatcccatattataaatgtgtatatttagattgtctccattttcttatatttgtttttaatgaatgaacattttgtttcttttgtatctcgttgtgcaagtgtcagattatttttcttgagtgatattattagaagtgaaattatgaaggcaaaggatataaccattttgacctgttttgatacatattgtgatattgtcttctacaatgactcacttcagtggtactatatgacaatatctatttactatatctttgttagccctgagtactatttttctaaaaatcttaaccagttttggtaaataatttgtaattctttgattaagaaggacttttttttttttttgagacaggatctctccctgtttcccatgctggagtgtggtggtgcaatcatagctcactgcagcttcaaaatcctgggctcaagtgatcctcctgcctcagcctccttgagtagctgggactataggtgtatgctaccacacccagctaatttatttccttccttctttccttcctttctgagatagggtctcattttgtcacccaacctggagtgcagtggcatgaataccatcattgcagccttgatctcccgggctcaagttaccctcccgccttggccccccaagtagctggggctacaggtgcatgccaccacacccagcttatttttgtatttattttgtagagatggggtttcaccatgttgcccaggctggtctcaaactcctgagctaaagtgatctgcctgcctcagcctcccaaagtgctaggattacagacatgagccaccacacctgatcccagctgacaaaaaaaaaaaaaaaaaaaaaaaaaaactgtagagatgagatcttactatgttgctcaggctggtcactcctggcctcaagctatcctctcacctcagcttcccaaagtgttgggattgtaagcataggccactgtgcccagcaagaaggaccctttttcatgcatttattagtcatttgtttattacattgtgtgaagcccttttgtgtatttcttgacttactaattttagccagtgtgattgattctctggcataaaaatgaaaaatttaacacccttacaatacctcttatgtccctgtcttttgcccgctctgtttttgttacttacatatttttagatcttaaattggttgacttcataacttaaaataatataattaaacctctattgatttatcaactttagacagtatgtattgtctctgctaggaaaaataagtataataagttaagacatttaatgtgttttcattgttttttcttttctaatcctgaggttttctttcattattatttattctcactttataaacttttagacatattctgttctctaaattgttcctctgtgttttgtcataggctgattctgaaaattaaaaaccaacaaggaacatttccatagtggttataacaaatattgtgtcccaaagtatcaaggttggtgtttggtcccacagagaatgaaatgtaccgtgtcattgaatatttgctccttgaagaagaaccttgtgtgtgtcaacttctagtttctttctaccttcctttacttcatctggcttgttttcttgcattcaatgtcattttattgtctttgatttctgttttgtttggttggaaaacctcctcataatgttttcctgcagtaagtgtgtggggatagtaagtttttcctgtcttgtcctggtacttggtcagtgattggttgtctgtgtattgtttattgttttagaaattgttatgcaggctcaaaatattttctccacaattctttgttgccacctagaattccaagttaatgatgaaaagtatgacagaaaaaaaaaaactatgacagcatgattctcacttccttttgctacctattgtttctctttggaagcttctataatttttctctatccttagaattctgatattttaccaagatgtatcagagtatgaaatgttttcatttatcttgtctggtatttggattattctatttgaactgtgctatgctcagttcagggaaagtttcttccatttctgttttttcttttttagatggagtctctctctgttgcccaggctggagtgcagtggcgtgatctcggctcactgcaacctctgcctcccgggttcaaatgattctcctgcctcagcctcccaagtagctgtgactatagatgcccgccaccacacctggctaattttttgtattttagtaaagacagagtttcaccatgttggccaggctagtttcaaactcaggtgatctgcctgcctcagtatcccaaagtgctaggattacaggtgtgagccacagtgcccagctctcatttctttattattaatattttttccctattgcagtgtaacttttttcctttctggaactcccacaagacagatattagacttcttggatctatactctaggttactcagttttccttttatatttccaatctctttatatttttgtttagtgttctttatttgacctctctgaccacccagcttagtttttagccatgtctgggttattggttagtaattccattgagctataaaattttagtaattatcttttttttccaagaacgcttttttaaaaaaatctgattactccttttccatggcagcctctttttgccttatgtctaatatccttccatgtctttctgtaggtagtaagtaccttttttcctgaattagctttgtttcttttaatgtcttttctgtttgttcatttggggctgtgtttgttatctcttgctgcttaacaatttttaaaacaataaacaatttattgttatacacagtttctgtgggtcaggaacccaggcatagcttagctgggtgcctctgcccaaaggtatctcacaaggctacaatcaaggtgttggccaggtctgtattctcatctgaatgcacaactggggaaggatccacttccaagttcactcactctgctgttggctaggttcgcttccttaccagttgttggcttgagctcagttcctaaatgactcttggccagaggcctcctacagtgtctactttattcatgggcctctctgtagagtagctcagaacctggcagctgacttccctcaaagcaaaccagcaagacagcaagagaaggcaagtgagatggaagccagagtcttataaaccgatcatggaattgccatcccatcactcctgccatgttgtattctttataagtgagtcacttaagtccagctcacactcaaaaggaaggcccttttacctaaggggttgagtactagaagccggggatcattagggggccatcttagatgctgcctactataggggccttttgtggtgagaggggagtctggttttcatgagtgtctgctattccttgtttctaaatgaaggatcttgtgggacattatgggtagttggtctgggcttactctgtgactgtgaatgctgcatcgtgtaacatgtgtcagcttccttttcagatatgtgggcagacagtaggaaggtgatttggaaattcttccttgtataattctataccctttagcccacacagctggaaactgttactggctactacccactaaaatatggaaacatgatgggatagtgacgtccttgattaggttatgttatatggcaaaggaaaagagttactgaagatatcattacagtcttaaatcagttaatattgagttaataaaaagggtcgttagtggacctgatttaatcagatgaaagaccttacagagcaggtgagaaatgttctcccactggctttgaagaaggaagctgctacgagttctacagcagcaaggaaatgaacttttctaacagcctgaatgaacttggaataggattcttgcccagtcaagcctcaagatgataatgcatcttgattgacaccgtgatcgtagcctcgtgacatcctgacctaaaggtctagctaaactgagcctagactcctaatccacagaaactatgagataataaatatatgttgatttaagagcctggaagtaaaatacactgtattcattttctattctgtaacaaattatcaccaaatttagtggcttaagttctgtttttacagaatagaaaatgaatacagtgtattttatttccaggctctcttaaagcctttcccttcttggttctcccttgtgtccacggtgaatgtctggagtaaacccaagctctgttctcagagtccagctccttcattagagttcttctttaggaaggtgccacccttttctagagaaagcagaccttgcactgtcagctggggacatgtcattgctgccagctgtgccttttatttcttatttttgaggggtgtgaagaggaggagcctaacttcacatattctaaaggtacttgtttaatggaagatcataacaattgcccttgcctacgctctgttgtttacatttgctgcttccgagcttggagactctccgggccactcttggtgagaagtgtgcttatgcaaggtatctgtatctgtggtttcctctactctcatttccccaccaagctaattctgcttgcttagtttttctcttcatggaattttacaaattccattatataggtgctgaggatgtctggtctattgatggcatattttcctgtttttatcatgctcttatggtttcattctttaaacagaaaacaattttcctagcaaagaccttggaagcgcagggagggggacgttggtgatgagtctgtgtgaagtcagccttgcattccaaactggacctgcctttctctttttctttttcttttttaagagaaaagaaaatactgctttgctacctaacactgatgtaatatatttgtaaccaatttggcatatttctaataaaactgatgagaaaggcagaatttttataacaattgctttttttatgctctattattatttttctcccttaagttctcccacagcatattcctatcaagactcttctatcttttcttcttcttttcccttcctgtcacttgtaatttcatagcctccctttctattctctttgggtaatttctcagaacgagtgacttaaaaatgttgctgacacggttcttttctaaccctaacaacacgcacgatacaggtgctgaggatgttgagataattgatctaaaattgtgattttagaagtgtcttaagacttttagttccaagcaacacaaaccaagtaagctaaacctcaaaccagtttaggttaaaagaaagaatttattagcaggacactgcagtatctccctgaaccccagcctaaaattgtgttccagcgtcatgagggcctggcaccaggaactagaaagctacaggagcccaggtagccattaactttctgtctcagactttctgtctctcctgtctttgcttttctgaacatccgcttattcttttctctcccgtcggactcactttgactgttttggctcggatgtggccaaatatggctgcccaaaaatggcaactagaatttccaagttaatattattgcagttcaagcaaataaagcgaggtagaatcccagattccaaggggaaagaatccatttggtttagcttgcaccagttatctctttttaggctggtttaatgtggtcatgagggcagcttttgtggtataaacatggcttgccatggcccaagttcccaaagaggaggtaagtgtgtggaagattgggcaggtatctcaaaacacttccgctgcaacattcttgtttatgtccagcgtgcactttctcatgagagaggcagtttagctggtgtttaagaacatggacttcgggtcagacataccttaatttgaatcccagccctgctacctactagctgtgcgatctgaggtcagtacttcgcctctgtgaagatcaaattccttctctgggcaattgggatcacatatctcctggggttgctgggattatgagatgaaataatgtatactatatcctatgcactcaataaatagtaactatcatgaattattactgtcataccattggggaaagatgatatgcatggaagaatatccatttcatcatcctgaatgatgcaagaagatctggaggcaaaattttagataccacagaattatatcatcagtaaaaatctgagagtaagttttgttttaccatacttgaccaaagacatagatacaggctaggctgcaggagttagagcccaaataatctaaacttaattctagaatataatttctatttctgttggctttagaaatagagtagtcaatgattttgcagtcttaaagagagcccaacagagttggtagtcactaatacagacataatagattttttccagttagtgcctgttgtaatggtctctgcattcattctgtttgggagcaggtttattttgattggctaatatcttactcggtgaaatattttgaatagcatccctggaaaccatgtgccagaattcaaaagacctcagtttttttgttaaagaagacacactactttctttttaaaactattacaatttcttttgtacttttcccacttctatggtaagattttttgggtagcaagtatcattaagtgaattcttagtaaaggatatgtaaaatgattatttaaattcttcatcgtcgaaggataccaaatgtaagctgaaagttaacatttatgtcaagtagagatagctgaacaaacaatgctcataacttctttttcaaatgtagcatattatattctatatggaactctatatagtagaacaatatctcaatgactaactgtgtaattttctctcaagttatgcagacattttgattgagagggaagtattaatgcagaagtacattcatctagttcagatcgtagagacagaaaaaattgcagctaaccaactccgacatcaacttgaagatcaagacacagaaatcgaaaggcttaaatcagaggtatttcccagtcaatagattccttctcattgtttcacgtttaccgtcatttcctcatgattacttaaggcctattcagggcaacattttaatcccaggctgacttcctctgacatcaacacatacgtggctgggcctgacctagacatgaatctaatgtctatattaggattaagtaaatgtgctacaggaacatatcaggataatgtgcttttttttttttttttggtggggggtggttatttgttctcctgatacccttcattagctcagaaattcaagaattgattatagcatttaactgttttcagataccctacagtaatgataattatgagtctgccatagattcaattaaagtctaaaatgacaactaagggagaaccagcaatgaattcagaaatactttactcttttagatttgaaggagtccaaccttctcccctccacagttttgaaaagaacatttggattaaactataagacatttgctagggtgcatttttccctggagttggaattcctgcctccccctccctccctcagagtgtgaacttctcaggccttgcatccccagatagtgaggctgatgcccagtgtgagcagaaggcggttttagagtccacagccatggtgtgtgcctgagtcctccctccctcccaggcctcagtctagatagagaatcctgaatgtacctttcccgctgtcctatccttcctcatgggcagtaagcaatcactgaagaatgggagaggaatgcagagaatgaaatttcctccctctttctgcccagggatgcattagtatcttctgagattcaaagaagggaataggacacaatgaaacctactagtaattgtatcctcattgacagaaacagtttaggcttgtcagttttggcaatgttcttgtcatttttattgtcatcagacaacattttcctttttgtgtcttgcaccttcctctgagacataccctgtgaatcctaggtggggttttcgccttctgctccctacacacatcacctccggtgttgagagtatgggtacaagcgtcctccaacagagatgtggcagcttctctgatgatgacaacttgcagatggtgttcaccatattattacagttgttaacttcccaattcgaccctgatatgtgatatagtgaaaacagcaacagaaaacttaacaaacctgcattttaaaagactatatcaggcactgttatttaaaacaaaattattgtgttctttcttagccactgtaagctggagcagatgcttgtctgctcagtgaaagaggttggtatttactccacgagagaagctcaacaccaggcgatgttcctcaatatttgtgtgtgtttatctgccttcactatgttctattttagtctgaatgtagattgcagcaaaaaactgtcagttgcaggtatgtcttctctggtctcttgacaggagccataatttatttcctactccctttcttttcccacctccttgccagaaaatggcagaggggtgtatttggtactggggacaaaatagaaagacaggctagagaggggcaattatgatcccttaacttttaaggtattgctggctagtaggtctgtataggttcttaagcttgtaagagcctgctgttgagtgccggtctagagaattttactgctatgtgtagttgagaggccacccagtcttgaaatgcccctcacaggtcacagaactgagctggagatataaagagatcccaggttagtttgatcctttttaccttttctgaggaattctcttggttggcttggaccagccccaaggctctgaagttcccgttacagttgccattttcctaaggatgtctgtgagtctggggtgccatgtggtttggaagactacaggccaatggccagaaccaggggctctgagctgagtgtcactgcatgtggggaccacaggacattgcaggcagccaccttcaggcgaggggatggacatatcactggactcctgacaaggtcttggcgggctcaccactggcagctggggctgagttttgggccaacatttctgctagcccagatccccggtcacactttacacagtcacttcttataaacactttcattggtgataccatgcttggggtaaagttcatgtttcccccatctcagcaccaaaggaagagagtgtgcataaaaagtgggtgtttcctgaggatctcattggaccacctttgtaggcagagcttcctgtgtgtatggctataatccagcatttcccaaatcatgaaatggaccaactttgtgttccagattattgctcttaataaaaccaaagaacgaatgcgaccttaccaaagcaaccaagaagacgaagatccagacatcaagaagattaaaaaggtagggcctggaggtttccagctttgtaggagcatggtgaccagtcgtctgttctatggtggtgtctttgccaccctgtgcgtgagccgggagcagccttggtgtttctgggctatggctcccagacttgccctgcagagtgatccagacatggctactctagagaatttctgcttgagatttctttacactgtctaggaaggatgccaaaaccaggcattaagacaatagtgttctccagtggggttaattaagtgctgttcaacctcttgattttgtgcggctttcatattttgggggaatattttttaaattacatttcaaaaatatttcttttagctttaatctttagtgttatttaagaaagattttttggggggcatgtgtgaagattgagtaaatcagcacatccgcttatatttctgttttattattgcttcttgtttaacatccacacaatcagcagatttttccctcttactgccatttataattgcacaacttttgcaatgaaccaaatgctggctctcgctctcactctagtccactgtgttttgatttgtcatttaggttttgatcctatgatcttgattgtcttatataaagcactactcagctttgttaataataagtggaaagcatcatatttgaggaaatttccctggatatacatcttcaaatcttatttctttttaatttgttattattcctcttattttatgctaataatctttcccctttcactgtaacaaaactttaatgtgctcagcatttacctggacactttaaagatgatcagcaaatgtttgttgattggctaaaacacacaggccagtgcactttctcaggcttgcctattatttttcacatcatccctatggaattcagatcaattttagagactatcatgttttctacaaaattgattttaaattatattttatattcttttttacaactttaaatattgctcagaatttgaaatagaaatgattcttaggactagtcaaatgttttcagttttccagaaataaaaaagtaaaataacactattcatttcttagaaattaatttttttttgaatcaagcttatgctattgtgttataagattaattagtttttttaaaaaaaatcccatctagtcagtctggagacaagattaattctattgcctttcctttaatagtatgtagttgcatgtaaagaaaaaattaataaaattcaattttcagatgtgtggtagaaactagtctattactaaataagtgaagcatctattggtcggcaagcaccccctgcccaagtaaatagaaaggttttacttaacacaaaatccaattaagttgatttttaaaaatatttctgttaaatgaaagaatactgataaaattttaaaaatatttttctaccttcttgtttcttaataattttttaaaccaatttttgtacttgttaaataggttttgagattaattttttgttctttatgtcccatttcaaaataatgtctgcatggaaaaaagtgttaacaatgaatgaatcgtttctctattttggtcttggcaaatatcaacctaatttttgtttaccttgatagactaaaacttaaaattggttataattcatggaaatttttgttagatttcttcaaataatctgaatataatttccccacatgattgtgttaaaatgtggttaatttttattgaggtagagtgagtttaatgcctgtataaaaactgataacatggtgacgacactggtaggcaggcaagagaattttagacattgcaaaagaagggtcgttgtttaatacgtgatcatttagaacatagtgtggaaaaaataaaaagtgtaaggatgtgttaaatagataataatgatactttggtagtgatttaatactttcaattatatgtgaatttacaacctactttgttgctgaatctgccacatctaaagtgagaaaccctagttatcataaaacaaatcctagttaattatgttataattttttatatttagaaaggactttagatttttttgttaatcattttattttaatttcatgaaaaatgaaagcagtctggtaacacgagattaaaaacagagaaaaaaacaaaacaaacaaaaaaaacagagaaacacgagatggggtcttgctgcgttgcccaggatagactggaactcttgggctcaagtgatcctctcaccttagcctcccaaataactgggactacaggcctgtgcatgtccagctctgtcggttattttatagatgaagaaacagagaatcagaggtcaaggtggttgcaagtaatggcagagcctctgagttaaaggttttaatatatacttgactgctcagtacccagcatttacctgggcattttaaagatgatcagtaaatgtttgttgattggctgaaacacacaggccagtgcactttctcaggcttgcctgttatttttcacatcatccctagggaatccttatcaattttagaggttatcatgttttctgcaaaattgatttttaattatatttcatgttcttttccataaataaatcaccattgtaactagtcagattcctttctgattttttgttctgtaggttcagagcttcatgcgaggatggttgtgcagaaggaaatggaagaccatcgtgcaggattacatttgttctcctcatgctgaaagtatgaggaagagaaaccagattgtgttcaccatggtggaggcagagtcagagtacgttcaccagctctacatcctggtcaatggctttctccggcccctgcgtatggccgccagctccaagaagccccccatcagccacgacgacgtcagcagtatttttcttaacaggtttgacattgcataaatcaaagagttatgagaaaaacccctttgtatttccaacaagaatttttacttaatctttaaaagggtctcataaattcatctctattagtttatgatagtaaaaataagaaagctattacttgtgttccattgttattttattttattttatttatttattttttttgagatggagtcttgctctgtcgcccaggctggagtgcagtggcacaatctcggctcactgccagctccgcctcccgggttcacgccatcctcctgcctcagcctcccaagtagctgggactacaggcgcccaccaccacacctggctaatttttgtatttttagtagagacggggtttcaccgtgttagacaggatggtctcgatctcctgacctcgtgatctgcctgccttggcctcccaaagtgctgagattacaggcgtgagccaccacacccagcctgcattgttatttttacatctttacttgaatcttggcatctaatgttcttaattttttcttctctatttgacctacattgtcttatcgcatggagatgtgtgttggggaatataatcactcataaactgaagaaaatggagtgattatgggtttttacatgttaattatacacaagtattttaggaagagcaaaagctaagacaggacctgagaagctctggtgaatttatttgctcaataaatcattagtttccttactgctgaggattcatcagtgaaaaatcagaaaatgcctgcctttatggaacttaaattttgatgcaggaagatagacaatgaacagcattagtgaaatagatagtatattatatggccatcagagctgtggagaaaaataaagaagggaatgggagaagggggtcaagggagggtttagtgttttacttagaattttagctatttgtttttgagtagatagtacactcacatggttcaaaagtcaaaataacatgaaaacagcagttagcagttgcactgtcaccctgtctctgtccacccgattccccccactttctatacgtaatatctgtactagtttcttatctatcctttcagtgtttctcaattttgatctaagaaactatgaatatagagtcttattttccctcttcttacacaaaggcaatgtactttaacatgtacttcattgtttcacttaacattattttctgaagatctttccatattgatacctaaagagcattctattaaaaaaaatcacgacatggtattacaatctgtgaatgtaccatagtttttttatagcaggttttcagaaaagtttcaaggatacggtgacattcgagcaaaggcttgaagttcctggaggaagagtgaggcaagcagagggagctgtgcgtgcaggggacatggggctttcacgtgcccggcagtccagcttgaggacctgccctgctcagtgtcagtgaagggaagagtcagggagttatcaaggtgggacatggtacagccattaacttttgctctaaatgagatggggagacattggtcaggttttgagcagagaaggggtgtgatgtgacttctgttttgaaatgctctctctggcttctctgctgagaatagtctgtagggagatcaattaggtggctattcaataaacagagtgagagatgagacacctgttaggtagctatttcagtaatccaagtaagagatgattataatggaggcagtataagtagttggattctgggtgtatttttaagtcagagccagtaggtgtcacggatgcaactagctggggccagtgtcacggaatttaccaaaacagttgtggataaagcaaggcagatttgttagagaatgtgtgaaaacatgttgcaagggtgcaatgggcagcacagcagagaaggggctgtctgcagagaggcaggggctggagggaagttttatacggtcgtgcaagagcgggctaggtgtggaaaggtcattccttgtgccagcgggttgtgtttctcagaacaattgttcattcttctcccctacctggagccttcccccatcggaggccccttccttgttgcttacttatccatcaggactcaacagttgggatttgttgatgggtttgatgtgggttttaagagaaagcaaaaaggtaagattgcaacgttttttggtctggacaactagaaggatggaattactgtttactaaatggtaaagattgagtgaagaacaggctgaggggaaaagatgacttttctcttggatctgttgagcgtgagatgctattagccatctaagtggagatgtcaagtgactagggatcagatatttgtttggagttcagaggaagattctgggccgaagatagaaatttgggagtcctctagcatacagatagtatttaaagctgctagtctgaatggtattaccaagcaagtgagtacagatggataagaaaagaggagcatggatattccaacatctagaggtcaggaagataaacaggagccagcaaagaagagtgaagaggatcctttgagttgtcaatgaaaaccagaagagtgagttgtcctggaaacgaaagcaagagggaaccaacaacgatgccaaaaaagtcaaatgagcaataacttagaattgaccatgggtttaacaactcggagtttaatggtaactctgattagagaccaaagcctgattggaggcttaggagagaacaggtggtggggcggagggaagaggatttcaaaagggtgggtatagaaaattcttttgagaagggctgctgtaaagaggagaagagaaacagggtggtacctagaggcaaatgaagagggtaaaagaaggatggaggagagagggaattgctgagcagtaaacttgcaaaggcgaaagtggacagaatgtactgctcaggtcaagagattgtcattagctgggagcatggcagggaaggaatagtacatggacacttctgtagttaggaggcaaggacatccgctgatggggcagatgggagggaagtgtcggagttggagaagagagaaagaggtgtggaatagtgataactagggcagggaaggattagtacatggacacttccgtagttaggaggcaaggacatccgctgatggggcagatgggagggaagtgtcggagttggagaagagagaaagaggtgtggaatagtgataactagggcagggaaggattagtacatggacacttcagtagttaggaggcaaggacatccactgatggggcagatgggagggaagtgtcggagctggagaagagagaaagaggtgtggaatagtgataactagggcaggggagtaaatggattcaggaatgttgtattaatgctgggaagcactgagagcttgtgttagcttattaggctagtggttgtgactttccagtgagatcagtcaggatggttgcatgtttttctttagccactttcagctgcatggatgcaggtgcagagtgggtggaggattgggattaattaggattggtgttgtggctgctgtggtgaagtgagaaaagaataaggaagttgaagctgtatacaaggaagagattataataatgagccatggaatctaaactgaggaaagaaagtagtgctggtatgagaggtttttgccaataaaaaggtggtgggatctggggatttaggtcatgctagtgtgaaagaattttggagtcagggttctaaaggcagtgaactgaaagattaggagtagtcagagaatgttgtgcttgaaattgagacagggaagggatgcagctattgacaatgacaaggtctagagtacaatcaaaggggtgttgaccgaggtcaatggaggacaagatctttggaggaagagttcaaggtcctgtgaggccaggatattgaaatgttgtttgtgtgcatattggaatccccaagaattatgacaagagtagtgttggagaaaagagcaactgtgagctgagagctcagatctcaaggcatcaggaagagccactggcgtgtctgtagatgagtgcagaaaggaagggtgatgagtggtagtctgataatacgagattaaaagctaggctttcttttgttaaaaggaaggagggagatttccccaccttgctggcaatggctcctctcaagtgtgtgggacatccaaaggagcctgggggtagcccttgatcctcaggcagtacagcattctggtgatacttcagtcaccaagtgtgcagtttcaacaggtctgatggcagtggatgggattgtgtactgaactctgataatgagaggaactggagagggtgggtattgaaaactcttttgaggagagctgctataaagaggaacagagaaacagggtggtacctagaggtaaataaagaggctgtgccacattcttttaggttgcctctggctctttgtttccactggattgcttgatctgaatcaggaaaggccaggtttatcatattgtttaaattcagagtcaagatatgcctctctttggaaggtaaagctataagctcttcatatagactagcaattatttaccacatctagacttagatggagatttgaaaagaaatttttaaaacttttttatttttaatttttatggatacattttatggttacataatacatatacataatatggaatggatatataatagctgtacatatttatgaggtatatgttatagtttgatataagcatatgatgtaaaatgatcaaatgtgggtaattgagatatccgtcacctcaaacatttatcatttcttttgtgttgggaacagtctaaatcttctagatattttgaaataagttattgttaactatagctgccctattgtgctatcaaataatagaagttattccttctatctaactgtactgttgtacccattcaccaaaccctctcttcatcctttccttccccactacccttcctagcctctggtaaccaccattctattcactacctccatgagattaacttttttagctttcaaatatgagtgagaacatgtgatacttgtctttctgtacctggcttatttcacttaacataatgtgaagaggtgtgtttttaaaggtgaggcttaaagaagttttatatcattactgttgtttaactagattccctttacatgcctttgaaattaagccctaggcagctcaataattttgaattttaacacaggtttatagttaagaaaatgcaatcttcctatttatatacagaattgtttcatctgttttctaaccatccaggtatcaaaatatgaaggtagatgtatccattagtttgtgttcaacataggacagagaaatccctcgctgagtggagggaattcactgcttacagaatctgttggaaaggctgggggagtaaagtcagggagcagcccttaaactgttgactttcagagaacatagactagatccagaggttaggaaaccactgccaccactgctgctgccacagatgcctctcagactctggaagctggttcccagaaactagaatcctaaagctgggtgctgacattgccccaaagcactcacatcgccatgactgactttcagccataggaagatggcccctacttccgccttctgtgtctttccaagtgcatctattagtggaactgaatttacatccagaaccatagctgcaagggagtctgggaaatgtagttttagttttacccctctccacctagaaggaggatggaatacagattgaatgactaacctataatacctgccaaagtagatttggttgaaatccttgaacaacaaacactacttagttaaattgttataaaagaaaaataaattagaatctcatggagccatttctgttttatttcgtggaccatttgaaatagtaaggatttcttgatgtctgttgtaatggaacttgactaataacaagccaagggatctcactgagatgaacggttctgtatttgattgtgtcactgtgttagttcagaaaaggcttcaaaggctcattgcagtaggttaattccaatgaggagaaagcaatgatgttttgactttggtaattacccttcctggcccttttaggaatttagatccctaagttatgcatcatccttattttagtatctctgtgtaggcttcactcttttcagaagattcttttgcatttctgtcttgggtatcttgggagtggttatagtggagttctctcaaaatttttgctctagatttttttcaacctctctccttctgtcaaaactcattttactgacagagaaactttctcctgagttatctagaatcacatatgaagagaaaaaaggatcataactttaattttctgattattgattgaaatactgcattctaatagcagaaagctcacttaaaaattgatgaagaaggttatgtgacaatgatttggtgctttctgtcctctaatatttgaatgttatatcagggtttgctgaggctgtcataattgcttgattgaggataatataatccatgttattattgggtatagtttggaggccctatgggacatatatattatgtatatattaaggctttaaggactctggattttaaacaaaataaacacattatagcaactaaattatattatttttcctttttttatagtgaaacaatcatgtttcttcatgaaatatttcatcaaggactaaaggcaaggatagcaaactggcccactttaattttaggtaagtgcattctttaaaggtgtaagattttcttttagagtggctgcaattagagtaaaatagctccaacattattcagcctaaactgtttgcatcaccctgttgacctgtgagcttctgtatcccgggaccctgtctccttgccttttgggtactttgggccctgcctcagtgttaccttttgattctttcccctggcctgtcatagttaatttggggctggagtcaagtgctgcccatgagtgcattctaccagatcatcattcaggcatcagggttgcggctccatgcatgtgtgacacctggtgctgggacccactctttgccattcctgcccagtgtaggtaatttaccaagcaacaagggaaacagccgtgtttactgtttctttgcagctgatctgtttgatattttgctccccatgctgaacatttatcaagaatttgtgcgtaatcaccagtacagcctgcaagttctcgccaattgtaagcaaaacagagattttgacaaactcttaaaacagtatgaagccaatccagcctgtgaggggaggatgctggagacattcttgacctatcccatgtttcaggtaagtcacttgggatgcattttgtaagtcagagtttccagctcaatgtcactgatacctagcgtgaccagcgtgagatgcttaagtgtgccctgggaggaattatggcacagatgtaccatctgttgctgtcttgagcttgaccctgagataaacaaatattgtgccacacattctctgtgtctcatggatataagaaaaccaggcatttttgaagcaaagaattcaagaatgattttttgaaacgctgcacaattttctctttacagaaagattccacacagacctctttcatggagtctcctcctccagcatgtttaaaaatattatttggtttacagaaataggattctgtgcaaatgttccagtttatgctagttgcataaaagattcttggggacggagtgactgctgggaaggtttctgttttccagcccatcctcccttcctgtcgcggttgctgttgagtctcccctcggctggagccctggagaacaaaaggaggacctccctggtcacagaggctgtggagactaggaaacagaaggcacgggtgggacctgaggactcttggcaactagtcaggtggccgcaggggctccctttctgggactagagcaacccaaggggtcaagaacacttgcattctttcctggatctaggactttaccgttaagcgcccagaagtgagaaccagggaggccaaaatgtgcattgaatctcctgttgttttgaaaagtgtcgattctgttcttttggaagagcattgagtgttcccattgtggaatttaggtggcttctggccaggcctccaaattgtcatgtggtaaaccgattctactaatcatgtgtgttatggttactgtggagcgctttgtcctcctgcgcaggcatctctgaccctggctaatcattttgcagcctcagaaagaaatgtggctgtggtgcacaattgtttgccttgaagtttgtcagtcctgctcgaaatcctggaagttgccgtagaagtttagtcagatttttaaccgaaaggatgcatttaaaaccacttaagtatagtgaaactttatagtgtttttgtttttgttttcctttggaactgaattgtttgaactctttgcctctcttaggaaatatttcacaagaaagatttcagacttttaaaacaactatctacataattggaatttaagattttatttataatgaaatatatagtatagcattcttctgagattctatgtgaatttttgacaattatctttaggttatgattcagtaccccaagttgtatctgttccgtaaccccaagtcagttgaatatacaaaggtagagtcgtgaaagacacatggggcattcagagaggaaccagcttcctacctgacagccccctgatgtctttcttcgtgctatttaattccctcttggtgtgattttttcagtattttgaaatggcagagctgtactttcgctgtagatgaggtgtccaaatacagcgaatgtaggtccttggaaaggtctttggatttctttaaaatgctgggatactctcccaccaccctgcccttcctctcccgaagactatgcctgatagcaatgactgagcattttgattgacccccgggaatttttataatgtcttgaaaagaacattggactgggaatctttaggagacctgatgtctcactcatagcatcggggaaaataattgaaccaaactaaatagctatttcataatttgtaaattgaggcagctgagctgagctctagttatctccagactctctagctctctgatgtggtgatcctagagtgactacactagttctgatgttttggattgggtaactatgtggtgtttcaaggagcttggtgttagtctaggagccccctccccaaggatgtggtgacctcaaaccttagaatgttgggtcagatattgaggctttctggcttttgccagacaagtctaaccagaggcttcagcttgtgggaggctttgatctggaagaagcctcaaagagttgagccagaattgtccaactgcaagaaatgagcaaactgaaagagcacagaattgtctttgcttgcttccccataactattttgaatagaccaggagaagtcattggagttctgtgcccaagggccttatgctcgttggtgtctcccttctgtcttcttcacttgatgcctcactcttcatccttctctctagaaataaccctagaaaacacttgggggaaattgccttttctagaagctgaagctgagaggtttttccttactaagctcactctctccttcttgttcccttgcagttctttcactaatgaagtgaaatagtcatggaggtatttgaatcccttggagggtccggttgtatctgcttctctctgtattagcagtggtacttctgcatgtttgccttgctcccttgtaagggtggacgcctcaggatgaggctagggttctcactttttttttttttttttgctggaggccaacagtggaagaggtgaccctagtttatactgccaagagacctctgtccagactttcttgagcccagatatggaggcagaagttagtgtaggggaagagagaggaggagaggcaattggaagcctttagcttgtatgtgtagaagagagaaggtgattgtcttcctccttctcggcccttttttgagttagtcagttgctgctgttatcaagctatgttgaactatggaaacatggagaaattgtagaatttggatgatgcagtaaaattatccccagttgaactatcagaacagtaagtccaagtattgccaagaaatttgttatggaaaataatgttgtcattaacataatttttatttattaaagacagtggcttggctggtactgtttaaattggcttcagctgctcatgtatttatttggatatgtatgtgtcgaaagtccattggtaagccaatcgtgaaatctgctcctgacaagaacagcagtgttagatgttctccagaaagtagctacttgctattctatccacttatttactgtaattggagagcaagctaattaatgtctataaagtgacaagtatttgctccataattgaaagcagaattatgattcatttagacagttcctatgattcttggttttgggggaagagatttataatcagctcttgaagatacagatgagccctttggagagctgaccacttctctgcagaacttcgtttgcctgctttttggcagtttcagtgcctgtttgttccttcaccataaggcagaaagggccagagactgaattcaaatccatctacctgaatcttagccagcgagcactttaaaagaaatttaagtaatgaggaaggatcatgagagtattgaccaaactcagttttgtggattttcagtgcattataagtactcaagctttcctacacctgtcctgtttgctatgaaaaattttgtacattagctattgattgccttgattttcttgtggaattactaattagaggcaaacttttatcagtcatgcaattatgccagcgaaaaagatatttgaaagcacacttatcccaggagacttcatcaagtgggacaaccctaagggctgtattagtgagaagttcatgggagaaggagcagaaaatctcctccatatatcctaaaaagggaggattctcctgtttcccacccttccacgatgaagggggcctatttgtgcttcctgaagccttgatttgatgacattccttagggtgtgatcccagagctgaagttcaatgtctgtgctaatggtggctgtgtctatgcatagtgtgtaaatggacacactcaataaacattggtaagcagcccaatgaaggccaccacttgcacaagagccaatgcagatccctaggtagggccactgacccttcaggacagaatggaagaaactgcacacagggtcctggaaagctgttgtagtttcttcattctcaaaggtactttcaagtgctgagtgagacctcagtccccgcagacgagagctcccagggtgagttctgagaaaagacagttagtgcactggtcagagctgggattatagttgacgctcccatttactgtgaggccaccaatggggcaagtttgggcaagttaccaaacttcttcccactttagttctctatctgtaaaagcctaaaacttcttcccattttagttctctatctataaaatggagacataatccttatgatgttagaggactggacacattggcaaagcctggagcacccagtctaacccccgagtgggtaatgttgtggtagatgttcatgcatgttattgttaaaattaagcccacaataaataagttgtgtcactagaaattaggttgaatctctatcatggtttattaagatcttcctctggttggtggagtttctgtctttgacagaattcagatagtctgttaataaacaaaagtacaaataaataacctaaacaatactttttactgcaaggaggtgaattgagataaagtagaaacagaaagtaataaaggtgaacatgtcttctcccaagttttaattcttagggagaatagtgcagtgggattgttgatttaaaaacattgcaaatggactaatatatctaaaatacagactcaagtgacttgatgatagctgtatctgtttccctctgaaccagttttcaaaaattatgattcaaaagtgtatgattatgtaaaaaaaaattaaagaaacaaccatctctttgtaccataacacttcaataatttccaccttttcatgtgttcttggtgaagtcttttttttggtgtgcatgaagtgtgaagtgtagttcattttatttgtatttcttttttaaaaaatgtgtaaaacagtaaaaagtgggagagtagagacaagcttctcgaagcaatgatggccctgcggagcatgtgccctgtcacccatcctgatgtcttgctcatactggcctctgtttgcatctagatccccagatatatcatcacactccatgagctccttgctcacacaccccatgagcatgtggaaaggaaaagcctggagtttgccaaatcaaagctagaggaactatccaggtatgccaagaacttataacaaaggcttgggagaggaaagcagcaagttagtctcttgtggaaacctcctgtatatgttctaaggaacaagaagcaaaacaaatccagcttctcagattcacctgaaagttaaatagtagcttgtgaggtgatattgaatcatcattcacattcatttgaaccaagaaaaatacgtatcttggaaaatgttcttatagcatgtgaatttatgtaattcagattaggtgtattttggtttaagtttggaaatgttcatgtttctttcagcattaaaaaaaaaatgatagccaggtgtggtggtgtgcacctgtagtcccagctacttgggaagctgagacgagggtgcaaggggtgatgattatttgaccccaggaatttgagaccagcctgggcaacatagcgagaccccatctcaacaaaaaagactctcagttgcattttgtattcatatttggtaagaagctagagaatgtacagtttgcatttctcagtgacttttcattgttacaagcacttatttatgtctgtgttactttagcttatatgggataaatggtctaaaggtctcttatttagtctgcctccaagaaatggccccctaatctcaatgacgggaactggccacaaaatgacatgttgctttcctgttgcacttagaagcagacatgcccaggatgctcgtaattgctgacccatttactgtttagaattatgaggcacattggctttgtttttggtcatgacctgttgaagcctggaaagatccagcctatttcccccaaacccccggttcaatcgatacaagcttgcaaccgagcttctcagatggagctcttctttgcctacatgctagggcaagagaaaatctctcttactgtgatcctgtctgtgttgtgtcacagagtaatgcacgatgaagtcagcgacactgaaaacataaggaaaaaccttgccatcgaaagaatgatcgtggagggctgtgacatcttgctggacaccagccaaacgttcatccgccaaggtaagtccctgtgaaatggacccgcgacctgatgcgctgtgcggctgtcacatgatctcggcacaccccggaaggcgttctgaacaggcgtgacgggtgcggtgcccgaaggacccccccacggccttcgccgaggcggtggttgaggcccacctttgtgctgtttcttttcagggaccatgaaaaacagcaacacaatcatagtaaagcacgagtggggcaggcagttacattctgactggacgctcctcctcagcggcccggacattctctgcagctccaaggaggaccggtcggcctggcccacggccgtggcagtgccaagtgctgacgatacccaggccaaggcccaggagaaacttgcgttgctcaaagccctttcacataagactggggaccatgtccgaagtgaaaacagctgtctgttgttcccatttttcatcagcacttccggatccgccccacacgatataatttgattcaactggtaactcccgttgccagatgaaatgtctctgatggacacttgccacgctttggtaatgcagaagctgtcgtgtttgcgaagtgtgctttgggggcatcactcgataaattaagcttttgaagagttgaagatatttgtgccggaaactgtggagaagcaacagcctgacagtgcctatttctcctcggctgttatttcaaaatgcaagacgtaaaccacatcccaagttatttttttagtgcttaggtcctctgggggaggggagaatgccccaggcaattgatttgagacaatatattgcacacatttataattttgaatttggtgaggagtggaatataaatttggaactcaaattaatcgttaatgtagtttctgtttataatgtgccaatacatttgaagatatttgtgttgccattgcctaccataatgtactgcttaaaatctctttttacctcatcaagaacaagacaatgttttgtgcacattaatttttgcacagactactttaaaagtttaatgcatgccattctattttccattatttatttacaaggagaaaccacacatatgttaaagtttgggagtgtattttaggaaatgattccttttctcatttttggctttagatattcttttttctttaaataagggtggaatataatgctgacaacatcaggcccttgtaatgcctcctctattcctctgcacagactgtgtccccacattggcttcctgcctgccagcctctgtgcctttccttgtgctgtccccagcctgggggctgggaatgtccttatccatttcttttgtgcctgttgaagttctgcttgtcccaccaggctcagatcagatacctcgaaggagccttttataatttcctcttcttcctcctcccctctcctccagttagaatggatttaccttccacttgtttccaaggcactttactcctggtgcgtgtatttcatcctcttgcttgtatacctctctctcctggttactgtaaactctgaagggcagcacttaaggaattctctctgccttaccttgtctagtatgatgctttttgttacagatacctggaaaatgggcgttgaattaaattatttactgaattgcaattatgactgtaaagtgttttatgttgtatttttcttgtattggagtttcctgaaaatgtctactaattgacttgtgcttgatagtatgtgagaatggagacgaaagtttctataatgtacaatttcttaaaggatttttgattgggaagtattataacccacaaacatactatattgctaaaaaacgtaaacttttttaggtctgagcttgaaaaaacattcaataatgaaaaatgctggaaggtcaaatactgaatgtcattttttttcactgcaattggagagaaaacaatcatgaacaatttctccctttattcatgcccatatgttattaattccttgttatgtaccacatgtttaaggcacttctgtcagctatgaatatttctgatattattatcatgttgatgtcaatataatgatttgccttttagcagtatttttctgcatgtgtggtttggttagttgtttaagagttatacagtaaagttggtttctaaaattcagacctcaatctgaaattaggaagtaatacaatcacagacaatttggaaagtttgcattgttttgctttggttactcctattatcacttttacatagcacccttaacgactttaagacccattgaggcgttttcaaaaattattattttaaaaaaatttagagggattcttattttctatgaaatggtctacaatttatctctaaaggtgtactaatatttgtgttaattacttttagggatgatatgtggtctatttctatgtgcgtgtgtgtgtgtgtgcatgcgtgcatgtgtgcatgtagtttccaccttatgtgaatttttattcataagaactagaaaaatacgtcatccagatcatctgaaagatcacctcagaataaaggcatcagcaactcttgaatgttttttgatgaggatttagtgattgaaataatgaaagttttattgtaaatggtttcccattattagtctgttggataggatacagaagactatattatagaaatggtctgatattatcattgttttctaaaatctattaatagtttgttgaataaatgtgtgagtgtctgaggcaatgataggaaaacagtctagctgcatcactggaggtcaaatcctgtctcccctacttccttgctgtgtgatattgggcaatttacttaacttctctatgcctcagtttcttctccttaaattggagttaatagtagtagctatcttttaggattgttgtaaaaatgagctaatgctcacaaaagcacctagactagtacctgcaagattatgataaactttaaaagccaagatccaaattttggaatgacttcctattttcaataacatgaaatatgtatgaatatttagtagaagataaaggcactctaagctgacattttgtacaaaatctattatgcattgtgaacagtgttttgtggaaatgtaagtcaggaaaatgaaatataggtgactgaatacaggactaagtgccttgagaataagacatggacctttctggtattttaatcattcctagactctaagtcatgcgctttcaatgtaccagtgttctctgaaattttaactttgggtctagagacagttatatcttctcaaatgcctaacccaataagctggaaatggttcttcattctttttcattactcagtagaattaagaataaggggcatagtcttgaatgccattctgtgggaatgaagtgattgaattaacagaaattttgttggaagttgaccccaattattagagagaccgatgaccaggatgcaaagaatcatgctatagcaatgatctgatgaattactaaatgaatactaagtatttctctaatttgtattagctagcgaggaatcctttcttcatatctcatagctgtattgaaacatcatgtcaaatgcaagagaaaatgtgaaaaaatcctcttaaaatgctttttccaaatatgattatttcacaaaccatagtgttgcaatttctcacttttaattcagatgtatacatttctgtatgtacctaatgtacacagtctcctatgtctcccttctacttggatataaggtaaacaattatagattaagcatattagtgtatggttgccaaggaaacatttattttttttgtctcacagctgaaattcacagtaattgctaatatatgagctaacagcgtattctgtaatttctttctaaattgtatttatttttatgtattctataatttctgacatagaaaatcactaaattgctagaagcatttactaacgaacacattattattgagttttcacagcttgcttatagcctttctgaaaatgactcccagagctatttgtccaccaagattatttgtccaagcctcagtctttcactcagccctaagtcatgggcctgatggctcatggcccccatggcagagctagaacttactctcttcccatctgtcttctttctgagtcttatattttatgtggctgaatcccctggctacatcactcccttctcacttaggcatgaccttaggcgagctacttggcctcagacctcagtttccccatctgtgaaatgggaggcattaaaccatgtcctctgcaaggcctctggctttgattgcatcctgagccctatgagcccatccttctgctgctatgacttgctcatagacttccctaacttctgcctcctgctttcccctgcctccagtactctatgtcattccttgctgcctgggctgccagccagtttgctcccacccacctcacctccttcattcactctcctcttgcccatcccttcgtgggagtcaagccgtctcctggcccattgttccccaatcccacaccctcacccaggacttcttccttgctattctttaggcccagaatagctgcctactctgtgtctgtcaagcatcccactgcagcactcaccaaaatagacagtgtgagatccaggcgtggaaacttgggtctcttgccaccctgtacacctttcaatttctgttaaaaagtagatgcaatttgcaacattcatatgttaatatgaacattttgtgactcacaatcatagttttaccaacttacatatatatattatttatatggagaactttagtggtctttttctgcttattgaagtagtttgtgctcattaaaaaaatcaagaagctagaaaaatgtatgaagaggaaaataaggttgtctacaatctcatctcttagtgatgactgttgttaatgttcaagggttggatatgcacttaatgattcttctgagggtaatatgagcctgcagaaggctgcatttggggtaggtggtaggttaaataaatgtaagaaatttgactatctcagggcacttcagaagtcagaatcaagaggttggcaagaatctttgttagtactttttggtttgatatttaacttagattggaattttatttttggggtagggggaggttgctatgagggtgaaatctagaaataatcaaaggtaatgttggtattataaagtctgtgtatagcttcccacattaaatggaaggtagttttgctcctaggagtatactgggtatagattttatgtggattattttctgtttagattccacaaataatttttatctcacataatttaaatgtaacttgaaataggtgtcctttaaaaatagttcttagctaaatttcactgaattatataatttatatatttttataatatacatgtattgtacattctatttttaaaatacaaggtaaactgtattaatatgctatttatctacattctgtgcttcaggaagaatacattgcatttgctttttgttatcatattattctatataattatgcaatatgtatgttattattaaatacataaattgattggatcagatcactaaggacagatggcagaagtgcttcattctttgaattcaattttgccatctttcaaacttattttccagtttatagatgaagaatcaagtctaaagtgtttcacaaaaatattaggaacagttcagcccttaaaatacaatgcattgtttcttctgctcagactggaagagagttacttgttctgatgatgtgtcacataaatcaatccctggtattttgggaaacagaccttagtgtttattgccgtggacatggtcctcacttgacagaattttaattgctgtgtattcttcatttttgtaatcaccaggttctcttattcaagtaccttccgttgagagggggaaacttagtaaagttcgcctgggttcgttgtctttgaaaaaggaaggagagagacaatgcttcttatttacaaaacactttttaatatgtacaagaagttcaggagggaagcttcatctgctcaaggtactggttttccataactgttccatttatcttccaagcacttacaagttattgaagttaactcatttgagactttcccatgcttggtattatcataaaacagattgtcatgattgcataatgagtgaggtaatgtactgttaccaactctgccatttaattcgttgtcatttaaattcaaagtaacagaaatgtattttaagtatgcatcaccataaagaaatacaattaaaatcgtaacctggacaaaattatatactgtactgtatctgtataatcatatacaaagttatatactagttgacaactactgagctacaaaaatcttctcaaatcactacaatgtaccaatgcaatatttgctaaatcctattttatctttctctgtactaggagtcagcaaactatggcccatggcttagagcctgtttttgttaataaaattttttgttttgtgttttttttgttgagataggatctcactctgttgcccaggctggagtacagcagcgtgatcatagctcactgcaacctcgaactcctagactcaagcagtcctcctgcctcagcttcccaagctgctgggactacagacatgcactgccatgcccatctaatctttaaaaaatttttagtagagacaatgtcttgctatgttactcaggctggtcttgaactcctggcatcaagtgatcctcctgccttggcctcccaaagtgctagtgtgagccactgtgcctggtgtacaagtgtgagccactgtgcctggcctgttaataaagttttattggaacacagccatgcgcatgtctttgtgtctgtggctgcttttatgctaaagtggcagatctgagtagttgtgacagagatcatatgacttgcagagcctaaaatacttactatctgaccctttatggaaaaagtttgcctagataggcaaacttttttattattgcttataaatattattcaacaccatgatgacagctttctactgcttaagccacttcctggttggtgagttcagccctttgctaaggtgcattactctctaaagccactgtggtaccatctaagtctcccatcagccgacttgctaaattttataaacaactgagtgagagtgggttgaaagggaaggattttactgaagttaaatgagttcacttccttttgcacatctaagtttaattttgggctctatgaaaaattatttatgatgcagaattgctatgctttcttccatggcaacttgaatatagtgtttacaaatcagagcttcccaatctacacaagaccttcagcgtcttagtgaaaaattggtttgtttccagacaggtggggttctgtctctaatagactgcacattgattgaggagccagatgcaagcgatgatgactgtaagtcaccttcgatcacttaggattctattagaattagaggcgggagagagaggctgaggataaactccctaaagtcatttatgtatgaaaaattgaaccatttagcccatgagccttgttaaaccatctttgggaattcacattttactgaatttgttttgtgatagtgactattcagtggcagatagagaagaaggaagagttgaattagagtgttggaattctataaatcatgggaattttttttaaaaaaaactatgaaatcagaaggaaaccaggattctagtctcaagtaacctactgacctcagcttcttcatctgcttatgagcttaataaagccctcttcatgcctgagaagtacgatattgctgaaatgagagtcccgatttgagtgcaaatggattgtataaatagaataatgtgaaggcagctatcactctttgtttttttgtattctcatctaattgtttgctttacatgtgttcaagctaaaggttctgggcaagtgtttgggcacctggattttaaaatagtggtggagcctcctgacgctgccgccttcactgttgtcttgttagcaccctcacgccaggagaaagctgcctggatgagtgacatcagtcaggtaagaaagtggcttttgccaaatttttgttttttaaatttcacaactcaaacttttggagatagtttttagaggttttttatctttattaaaaaattacactcagttgctatggtcactgccataatcactatgtatcttgataagctgtgatcattatcatttttgttgttgttgtttctcttcttaaggttaaaatttgcctgaaatgtagtaattggattttagttcctgggcattttacaccagcagcaaatgtaatcatttgtgttgaacagtattgagattgccctgttagtaataaattctctaatgactccactccatattttgcttatttgtttctgaagcagaataatggtgaaagatacaaaaacagccaacatagggctatggcaggaaatcatgaattaaagaatcaaaagagacaccgtctctagtatgaaacctgaaaataagctcctgtatttcgtatattaaaaaattagggacagaatttttacctttccttgatcagcagcgccagttggggaattgctccatttatttaggaaataatatgatttagaatatgtcaaaactagtcatgattggacttggacattcttattcaagctccatatgaattttggctctgtaggggaaaagtgttgctatgtaagaaaaatattttttaaggacttgataattattttcaaagttgttaactcaaagaaactggggcacatgaaaaaggtatatattgtagttttcatgcttttttttggaagagcttatagtaatttatatataagacaagtggaaacatgaattctatcatagttatttggaacttaattctttttttgagtgactgaaaattgaggtgaaatagaaaatgaatgtcaatagtaatcatttttatttgtcaaagaagttttacagacttaatctcatttgactcttacaatagtattctgaaggtaagcagagagaaattagtcccatttcacaggtgagaaaactgaggtctgcaaagttaagcatttgtcaaaagctgctcagctgcattgagtcagaatgtgaacctaatttgggtctttttttctgtttagcgctctaaacatcctctacaagagtgccttatgctggacttttacttatataccctcaggatggcttcaatggcaaataaatagctagaaaagaagccatttcttttctgcctgacaaggaaatgaaaatatgggatcttccatttttgtggacttgcatccttgtggtgatttattcatacgttcattagctctatgctatatcaattaatagcatattaagtctctccctatttgtaacacatctcttactttatgaaactctggatcattcattgactctttgaacatttattgaggaatcaccatgtgctgtcaggtattgtgcaggtaccaggaatacgaccatggttcttgctctcagggagaataggcaggctcatagggagcaaaaggaagtaaacagctaaatgcaaaaaattgtgtgcgtgttgtgaagccaagatatgtaggaagaatggggagaataggagtaggcaaaggtgtttttccacctgcttctaccttctaccttatgatataattagggctcctaagatacagacttgataaaagctcaggtgaccttctttagcatgactggggagacattgttaagagagaaagacccttggagtgcgtgaataattctgtgcctggtcctttaaagaaaggcacccaatgctttgcctgtcactagcaaaggtctaagtgagtctttccctctgcttatactagatgttaaggtagaaagaaatatacaacttcctccttatttctccaagatgctatgggtattatgctgcttagcaaaaaaaaattgtactagattatatcttcagtggaaggaggctaaccaaaagttgtatctgttttttctgttttttttgtttgtttgtttgtgttttttttttgagatggagtctcgctctgtcgcccaggctggagtgcagtggtgcgatctcagctcactgcaacctccacctcccagattcaagtgattctcctgcctcagcttcccgagtagctgggattacaggtgtgcaccatcacacccagctaattttgtatttttaggagagatggggtctcaccatgttggccagggtggtctcaaacttctgacctcaggtgatcctcccgcctcggcctcccaaagtgctgggattacacgcgtgagccactgcactcggccaagttatcttttttagtgatggggataccatcacacaaaatgactatggcattttgtggctttgacatttgtggttttattcattcaacaaatatatttatgcagtgatatatgcctggcactgttctagagatttgtgacatatcatgaagaaaagagacaacaacaacaaaattttcttaaccttttgtaacttccattctaatttggggaagaccaaaaataaatgataagggtaataactaagcatatactattttatattagaaggtaatagggcaaggtaagaaggattgggctgctgaaggtgggtgggttggtagagtttttaaatggtggtcacctcattctgaaggagacttttaaacaaaggctgtagtaggtgatggagataccgtgtgaatatgtgatgccatgtgagagggaacagcaattgcaaagactgtaaagtaggaggatgctgcatgtttcaaggaataccatgaaaggcagtgtggctggagtagggtatgcgagagggagaatagaaaaaaaaagaaagtcaatgaggtaacaggggccagatcaagaatgcctttctaagccaatgaaaggggctttggcttatactcagtcagatgaaagctattaaaggatttcagcaaaggaatgccatgaactgtcttaggtttcgaaaggattgctgtggctgctgtgttgaggatgggctgagggcagagggtgagagtggaagcagggagatgagtgagcaggctgctgcaatagtccaggcgagagatgttgagagcctaggccagcatggcaggagtggagttggagattagggatctgagcctggattcattttgaaggtagaaccagcagagtttgattgtggattagagctgagatgtgagagtaaaagggtgaaggatgacctcagaggttttggcctgagcaactggaaggatggagttgtcattacctgagatggagatatctgctgggaaaagagatttgggggtgaaaagcagaaatttacttttgaatatattgagtctcagaagtctgctagacatttgagtggagttgataaataagcagtgggatatagaagtccagcatttagagagagatccgggtaggagatactgcatcatttgggtggtatttaaggctgtgagactgttgagatcgccaagggaatatgcataggtagaagtaagagggctgcagactgagagaggggtcaagtcagggagaatagtgaagaggaccaagaaggaaccaccagtgcaaccggagaacagccaagaggacatggtgtcttagcagctgagtgaagaaaacgtgtcaaggaggagggagtggtcacatgtcaactgctgccaaaggctgagtgaagtagtgattgttctagtatacttagtgattttgctgctgtggagtttgaatggtgggtgggtaggtggtagggacagagtgctgtgctcttgactgagcctagcctgctgcccagaagcctgtatctcagctggctttgttctctgcttcaagcattttccttttataggagagatttcgtatccattcatggaattagtctctcaagtgtatctctggacatatccattattaataagataagcttactgaatgcttgaaatgtactatttaatattttattgtgtatatgtgaaaatatggacacacaaatgaactagaaatattcccaacacccaacacactaaaatgtttatcaaaataccttccacagataacctacattagaattacgtgaggactgtttttaaatgcagattccttaacccacattccagatgccattctaaactccataagctccatagatcacttctgcacaattaaagaacctctgtcctgaagagtgaactgtttccatctctaaagtctccacaatcttgccatatagaaataattgtacagtttgcctctcagtgtatacatacatcatgtttgctttttacctcatttacttctttctatattcctataaactcttcatattcatattggctatctattattcagctgcattatattaaatatattcagctgcatcaatttactgcttttatagctttttctgaataattgagcgttgagtgtatgagctgtttccaagtttgaggattaatatataatgaggtgctaaacatcttcatgcgggagttttccccttcttttaaagtcccttgttggtgtatagttagagtataaggctggtgtaaaaagcctgatcactctccttatttcatgattcctagtgtgacagactgccacaattccttcaagaaatatgtaagttataatttcactacatcatcaacaaggtatctatgtaactctcttctaagtcttgccaatgttaaatttgtcacatttatcacatttttctatttcatggaaaagtgtttttgccttctagtggttttaatttacatttctgtaattatcaatgagattaacattttctactatttctgtttgtctttttatactaggtagacagtaattcactggcactacccttatagactagggatgtgaacattttctatttagattatgaatatgttctccattattttgtcgttttaatttttgtcactatttttcttttttcttttttttttttttttttgagacagagtctcgccctgtcgcccaggctggagtgcagtggcatgatctcggctcactgcaagctccgcctcccgggttcacgccattctcctgcgtcagcctcccgagtagctggcactacaggcacccaccagcatgcccagctaattttttgcatgtttagtagagacgaggtttcaccgtgttagccaggatggtctcaatctcctgacctcgtgatccacccgcctcggccttccaaagtgctgggattacaggcgtgagccaccgcgcccggccactatttttctaaatcttactttttctggcttgatttgaagccaccttgctaagctactgtattgtattatactaatcataggtagctctttttttaagatgataaagtggttcctgagtattgctacaatcccagtttcccataagaaactctacaaaacttaagacttttagctttgccaggtctctctctctctgaagctgtaatttttagaaggaacgattgcttgaatgattaatcacactcttagttacaccagtaaggccataattaactgttggcgcctctagcaaaaagtgcaagtggctaatggtctcaaccaataattcttcccctttttcatctatttatagggaacgatttgaggctgaagatttgactatttatttcaataaagcacattcatttgtgcttgtctcagtgtcatacataatggtttattaaacagatccactgtaattatggctattaactaaaatgcagaattaaaatttatctctgagcttcttggtttggatagatgtcccaaaatatagacctgtgtagacaaatttgtagcacactggacatgctttctccctaaaaatagtttttcggaaatcaagagggaattttctactttaacataaaaaggtgaattaaaaaaattgactctaacctttcttcccagtacttagaagtatcaagaaggtggaaaatatggcaacacagtagaccgctggtctttaaataggtactgccttaggtaaaaccctgaaaaactcttggtggagaagtcactcgcaacacttgtccaaagaccagctgcttcaaaatcacttggggcttttgtgaacatacgtactcccagatcccatcccagccgttacaaactgaactagactatctatgatctaggaatctaattttgttatcctgttaatttcaaggtttattgtaattcatataaattcaagatgacattaaagatatctgaaaccctgcttatttgaatatatttcttcttaactaagtgaactgtatacaggcaccacttcttcccaacaaccagggtacatgcttacataaccataaatatttaccacaccttcctctgtaagtctgttcatgtacacactcacatataccaattctattatagtttaacttttttttttagaacagaactctttcttcattgcagcattactccaagtcccaaatggaagtaagataaaagcaaaattctctggttgaaataaaattggtagacctagagactccaggagccatttttttttttcacactcctgtttgtgaagcctggggatgtccctaaagtctggggatgggaactcattttgaaaaccattcccctattttatataaatgtatcataataagatcgatctatctatcatctctctctgtctctctttctttctctctgtctctctctctctccatccatgcatctatccatccatccatctcatggatagattaaaggttgtgtaccaattatcaaagacatttttatataatttaaaatatgacttcattatatggccttttgacgtatggtttggattgaatgtatattttgttctcctgaaacttgaatgaaagtgaaaatttccttttattcctaaaataattttgatgcttgacaatgactcagaaagatttatgaatgagacttgacactggataatgagatgtgcagaaatggtcacataaatctcctcttttgagtttaaaacgtttatctcaagttccaattctggtagtatggaggactgagctgatttaggttcccctctagctataaaaacagaaatgtttaacatataaaatcattaaaattaaaaaattttaatgcgtaggtatatttatagataggaagggaaatctcttgttgccagaaacaagggaatttaaagccatagcagaaagcttgtaagctaaagacttacagacttgggaatgattttagactagctattagttccacatcctaggagtattaacatataaagagggcaagagttggcctaaggcccattaatcaagttctctatttaaagtctgggcattgaaagggtgttctctttgtgaaaaaagaacctaaaaaactgtacccattgacccaaggaaagaaataaagaagtttgtctttgttttgggttctgaatttttaaaaatcttctttttaaaaatgaatgtggccagacacggtggctcatgcctgtaatcccagcactttgggaggccaaggcgggtggatcacttgaggtcaggagtttgagaccagcctggccaacatgatgacaccccatctctactaaatgtatgaaaattagccaggcgtggcggcacatgcctgtagtcccagctactcaggaggctgaggcaggagaatcacttgagcccaggatgtggaggttgcagtgagccgagatcatgccactgcattccagcctcggcgacagagtgagactctgtctcccaaaaaaaaaaaaaaaagaatgtgtctgtggcctacatatttgaaatcagacttattcacatggtgtaaagtgccaaactgagaaattgttataaaaataacttttgagtgttgaaatcccaagcatgcttgcagcccgaaacacaaagccactccattagcaacacttctacaatctggggctcgtgacatgtgctcaaattaaaaattacaaatcttgtgagtaaattatgtatcatgagtgagactcagcaggcatggagagcagtagaattagcgctacaagaacctgaagtaatagggtgacaacttggaaaagaccataaaataacaaggcttaaagtataataaaactataaaagaaagaaagaaaccgtaaggaaagaagagatcactatgcaaaaaatccaggctgacctgtcaaagaaccacgtagaaaaatctaaaactagaaactacaggaccacaacattacatactcattagaaattcactgaaaattcattaaagacagtgagtcaaccatagctagtgagatgattaagagccaggttatatatataggtatgtggttctatacctatatataggtatagaatataggtatagctatattctatatagctatagatagatatagatatagctatagcatatattctacatacctatagaatatagattctatattctaggaaattacctcaaatacagcaaagagggttaaagagatggcaaatatgagaaattcagatggaaaatagagttagaaggcccaatatacatttctggaatgagaattgcagaaagaaagattcaagggaatagaaaagatgcagtctccagagagaaaatgagtaggaattttaaaagtggatgaaagatatgaatcctcatactgaagaaacataccaaattccaagctgcataaactcagataaaaacctcatctagacacgtcgaggtaaaactatggaatataaagcacaaaaagaaaaatctcaaaaggtaaaaagacagattgcctttgaaaaattaaaagataggaaaaaaactttttcacaaggagaaatttgtaatggtcactgtatctttgttatagcagaaaatgaaaacctcttaaatgtatacatatatgagattgactaaataaactgtaatttatgtttatatagtgggatatatagcagttaatatgaatgaacgaactatgcatataaatatgaacaaatcttaaaagcagtgttgtgtgagaaaaatacaagcatctatataaaaaatttaaatgcaaataatattgtaatttatgatgggcagatacacaaatatatagtaaaataagaaaagaggaatgaaagaaggacaaatggatacccatcagcttcaagatagtcattacttccagagtagagagagtattggaatggaaaaaaagaggaggatttaactgtgtttatagtgttttacatccttaacagaaaaatgatgatctgtagaaaatatggcaaagtgttaataatagttaagtctagtggctggtatgtggatggctcattcttttatgtatatttgaattatttcataataaaaaataaaaacattaagataaataaaagtctatatctattcatttttgcctgtatctcttaaatttctaactataaagtcctatattcgtgaagagagagagatgagaaaaaatgaagacctcttctttcctatttcgtagatgaataatttatttaaaaaataaatagcttaatagtaataaaattctttactcttcatttttcatcgtttttgtgataattttcagtgtattatttcccctttccaattctcttttatataatttcatggtttttcaagttaaatattgttccatccaaagtagtactctatgtgtattcatattaggtatgaaaagccagatatattttatattttctctctcaaattttatgcagtattctgactaagctgtttatatgtaacactgtagctgatcaaaaatgtctcagtgtgtctcttctgtttttctccacaaagcctttccagatcctggaaaacagaagagacacacagctaaaccctggattggcaccatagatgaagggtggaggaggggaaagcacttgcttcttatgttgggaacaggagaaaaagttctatttcagctccctggagtgggctcatctctcactccttggcacttgggttacacatcgtggcttgtggactatggaagctgactgtcttccctactcctactttgaaccctgcagagtttcctggacaagtgaactgggcagattggtcttgagacccccttcctcttggttccctctttcaaaaagcaaaaactgcttcccttcttgtctctaagaggagggaagtggacaaagtcagcccccagagaactgcatcttaagataccctgattgtgggtatcctgtagctttgatgggctgccaggtagctctgcccttccattctctgactgttagtgcaggtaggatgacaagccctttgaactcatctccagtggtgcatttcctggattttcagacccaattcctgtattccccaggggtttggactatgaatccctaagaaacaggttaaatctctgccttctgaccccctgtccaggacgagacagagatgcttctttatgacccaggtctgtgactctggccacctccagcgcccgtccccaccttgtctgggctccacttaaacagtgtggttgtctctggagctgtgtgggagctctgggctgagtttaagtggtctccccattacctcacctctgttcttgatggtgcagtcattctaaggctgttgtctcagtaactatgccatttgcttagaatattaaaggaaattgaaggaacattgttcatttcccacaggtctcaccaaacaccatgtctactttcccacttcctgtgttggttacccaaggggcttcctcagtgtgattcagaaacactgagagtgaaaagaagtctaaggagtagctagaaaggtcgctgggtgaaggagcacttacccttgtcagtgtgcaacccctctccccatccaatccttttcctcattaccccaccccctgaccccgccacatagcttgggaagaacagggatgatgttaatctgttttgtccccatcaggattagtaaagtgaatttgaagtgacttgccttactcatcttcaaactctttcatatattacttttcttctctttatcctcatttcccagtacttagcccagtgtcttcacatagtaagtacttgataaatgcagatgtaagacagccatttagtaaaatcccaatgctgtgtaatcaatgcatcttcttggtgctcttgagaattcaaaacatagactgtctaactttgtttaaactctgggtgattcgaaagacatttggctatgtttttttccttttaaatatatttgcatcagaaaatttaaaattgccttataaccatggccatctttgattttaccttgtttttttctcttgcttttattcagtagttcatcaatttttattattcctttcttcaaaatatgtatgtccaccctttcctcttcattctcacagtctgccttaggggaggtatgaatcatttcatttactgattcagtattattctgatcatcccttgggtctccattcattctcccctcgtttccattgaacgaataccaccatgaggtcagtttagatctttcagcgtaagtgagctgcttagaaaccctcagtggcttcccatctgcctataggataaaattaaaattcaagactcctttctctatagcctgcctccaactgatttctctgtcctctctcttactttcttctccattatgaatgcgtgcaccagccagccccatctcttcattcttccatgtatgttcccactttgaaacagggcccttgatgtgtattttcatcaggtcctgacagaactttcccatagagaggtagtgtggcctttcttggggcacaagaggatatcccacttactggcagcttggcttgctggttgaaacactgactctacataactggacacacaggatgcagcagtttcaggatttctgggaaaacactatttccaacttcctgatgctcacgacttacacgaactaggataagagaagcagcatttcttcagtgtgaagaagagcagcccctgcttttttctagaaagtgtgaaacctgtgcttgcaaccagaccagcagaggaaggatgggcctctgagtcacattctttggggtccactacagggttgtgtgtttggaattgtactttcagctgtttatacaaaacagtttgccaaaacttgtagttatttaaagatattgttggccaggtgcagtggctcgcacctgtaatcccagcattttggaggcgaagatgggaggatcgcttgagcccaggagttcaaggccagcttggataacatagcacgaacctgtctctacaaaaaaaaaaaaaaaaaaatctcactgtggtagcacacacctgtagtcccagctactcaggaggctgaggtaggaggatcacttgatcctaggagtttgaggttacggtgagctatgattgtgtcactgcattccagcctaggcaacagaatgacagtgtctctaaaaaataataataataacaagatattgttgaggacattgttcactacattattcaatatttctcttgatgagaacccatgagataattgtcctgtctggtcctagaccaggattaattgactttctactaaactgtgaatttcgtagctaacactgagtccctctttgagttgactactccacagccctgctaattttgaggctcacttctggcaagcgctctcaacataaagtatgtgtggtggttccatttcaggcttcgtcttattgtttgccatcctttatctaaatcatctctgattttctcacttatcttgactctgtcttattatatgtgtttttgtaatccactcgtgggataaggtggagcataaattcacatataagcaaaaatggccaaatttataggtagatgatcataattatttatatgaaaatataactccaaattacttccagatgctgtagcttaaggaaatatattgaaggggagcttaaaaatattctacttacttgccacaagtggcatcctttatgctttgtagttgaaataatggcataagacatgaggaaaacaaagttttaaggaaaaacaagtatgaaaatggctgaaatactaagtagactgaatagtcagaattccagtgatctaaagtttcttaccggcatattcactcttttattagaacattggtgtttagggtagaccctgagttcaggacctatgtgaggtcacgttgcaatcagcttcactgcactatttaattatagccacaaaacactatatagtatcatagcgactagaagctattttttattttaaaaattgattatattttttcattttcctgttttgttcaaagggaatatgtataagtcaaaataaattcttctctaacccaaaataattacagagagaaaacgcaaattgataaggcatagattaaataatgaaggcagagaaaattagcacagcttcctgaactctcctcttggaaaagagaaaaagatgatacaaggctttaagcatgccagagacaggagaaattacacactgtcccttcaccaaacagcattagtatcagtaggggctgccagaggtactagtaaaatgtgggaatttattggcaaagaatacctgagaagcagaggcagagcttactagtgagacagaagatgaattccatcctaggaagccactatttccaatctgactactctacaccaccccctggttgcagaaaatgaatatagcaagagcaatcatggtcaggtcccaatcacctctcaaatagcattggagctgccaaagaattgtgacaaagtgacattgtggtcagaattcttgggaaacacattcaggggaagtacagctgttgtatctgtcctcaggtatttgtcaggcatttagttgatacagttttggtgtctgaatactgaatctgttcatcagtgtataatatttacctactctgtgtgtgtgtgtgtgtgtgtgtgtgtgtgtgtgtgtgtgtgtgtgtaagagacagggagagagaaattgaatggattcttttagctataaacaattgtgggaatatatgatctgcctaggctttcatgtgggttgtaattgtcaactttttatttcacagtgtgtggacaatatacgatgtaatggtttaatgactatagtgtttgaagagaattccaaagtcactgtgccacatatgattaagtaagtgtgagaatcctttcctttacattttaatcaagattaaattggcggaacatgtaaaaccttgaataaaatactgtgtcaatagaattctgcttcttgttgagaatatgtttcttgacaggaatgcagtgattcatatgattccattataaatgagactatcaaaatggtttttcacattcacagtttattaactcatagcatagaaaaattgttttttatactgttacatatgtcttcactcaggacaaaatcctaagatgttcaagttccatataaaaattaaaataataggccaggtgcggtggctcacgcctgtaatcccagcacttcggaggccgaggcgggtggattacctgagttcaggagtttgcgaacagcctggccatcctggccaacatggtgaaaccccatctctactaaaaatacaaaaagttagccgggcatgatggcggacacctgtaatcccagctactcgggaggctgaggcaggagaatcacttgaacccaggaggcagaggttgcagtgagccgagatcacgccattgcacttcagcctggacaacagtgcaagactccatttaaaaaaaaaataccaacgaagacttcagttttgtgcctgatcagttgttgctggcacccaaatgcatcttttgtcccccactgtggcagtttaccagtgtctacgtccaatctcatttgtgtaaccacttacatacagaccaggacttttctgcctttgggtgcacagaggtgacacttaatgaactggaattgttctcctgttaggacagaaacctgtatcttggactgtaaagattttctattaaatccaacatatctatagtacactagatttattcccaaggcagagtgaagttttatgtatatactactattttttcccagccttattgagcctgattatcctcaatcagaggaaagagatttttgcaatctctgttccttctgatggctctattcttccctgaagtttgtattcctccctatgtatctatttccctatctataaactatgaagaaaaatcccaatgtttctcagagttaaaagaaaaaaaattatcttattgtaactgtgtcttcttactgacagggcgtcactttgtaagcactcacttccttttaaaacttaccaattataatagatgatttgggtttgatctctcaagattgctttttaagtgtttaccaaaaaggagttgctgttatcataggagacttcagtaatgtattatatttttcttgagtgtctcttaggaaataaagtaagattctactcagtgtaataaaagaaagctaaataatttcataatatttaatttctttacttaaaatgaaaatgtaatcacgattttgaaggaaagtggtgtaattagtcagttttattttaatttcatgctggcttcaacacattttttgtcctagtgtttcaaataagctaattatagtcaaaagatgcaaagctcaaaactacaaatagaatgtgaaaatcatgacgcttattaggtgaaaatatccctttatagggtatgtagactatgacttcttttaataatacttgatctcaactttcttagaaattagagattttttggtggaaaatgatgggataacaagtgattatctagctcagccatcttctggacagggtgatgaattcataaaattttctcagatctttttacgaatgagcaaattaagaaccagaaaaataaagttggttgagggacacatagtgagtggaagaaagagccttgttattttcaagaatctcaaaagatgcacttgggcatttcaagatcagtaatgtaactcaagctaacgggccaccccagtcagctccttggcagggtgaagctgctcattgaaaatgctctttcaggcctgcagatgaagtacttccatctgcactgagcatactttgggctgggatgtttctaagagcaagctaagaaagcagttgattcctttttatccgaaagaaaatagatatataatttcaaatccctcaaagcgctgaaagggctaattaaaggcattcacaactgattctcagccaacagattcttagcaagcaattggctcactgaacgtcactgaccctaccctgtagcatatcctttaatcaagtggtgaaattcaggacttcattgatcgccggtcctgaaatgctgcagtgaaggtgaacaagggatctcagaaggggaagtgaaagctactggtggtcctcgttgtccacttggagaggctgccagtgcaatggtctgaaggtgaggggttcggggcagccagatgggaggttttacagaatgacaaaagcagtggattgcaggatggcagtggtaggtgctattcaggggaatatcttacacccattacttttttttaagtgaagacatttttaataccacagaattttgaaaacataataaaaacataacatgtcacacttgcaacttatggattacacagtattcagaagatagatatccttaaaaggcattaataagccaggaagaatgaaataaatgaattaggcactcaaatcaggaacttagaaaaagaatgagagactaaactgtaggaaagtgtaggaaggaaataagaagagacattaatacaatataaaaaacagtagaaggggtaaataaaaagagctgattctagagagcaaaatacctaaccctatatccatcagtttaatccgaaaaaaataaaaggggaggggtgaggaaagcacaaatgtacaaaattaaaagtcaggagaaagaaataactgcggatatagcagtgatatctgtgtccccctgtttgggaggtgtcacccactactttttatgcacacttttgatattttgctttaagggcataagcaatgctttcccccactcctaaagagggcttttggcttcatcttcctaataaaacatgactgaattagagagaaggaatccacagagtgagacaaattattatttacctcctccattattaattctggctttccaaaaacttgatattttcatagccctgcctatgcctatatgtctatatgtcatatagacatacacaatcagccctctacctaccagtcaaccgcagatccaaaatatttggaagaaagaaaaacaaaaaatagctatacaacaataaaaaataatacaaatttttaaaatacaggataacgttttacgtaatattcacattgttttaagtattgtaatctagagatgatttaaagtatacaggaggatgtgcataggttatgtggaaatactataccatttcatatcagggacttgagcatctgtggattttaatatggtggggggatcaaggcaccaatcccccaagaatactgagggacaactgtgcaattatctctctcctatcaaatgcagtgagaagcccactcctgagtgtgtgattacaaacgctgaaatattcagtggccgagggggaagcctcctcctggttttaccatcatgttcctgcctttgcacgtaggtctgatgcccgtcttcataaagacgacactgacatttgcttcagtaaaacactcaactcctgcaaagtgccccagatccgttatgccagcgtggagcgcctcttggaacgactgacagacttgcggtttcttagtattgatttcctcaacacctttctgcacacctatcgtattttcactactgccgctgtggtgctggggaaactctccgacatatacaagaggcctttcacctccatccctgtcaggtacacctattgctagaggttagcctgtcattcgcatatggccctcttcgttccggagtcaccatgaggatgagcaggccagctctgcaaagcagctcctagggtgtactagcttgcctctgaatgtaccatgcccctccagcagaaggccatatgtaaaggtcacacagagttccccaggcacgaagttgaaaacctgaaatttccagttggcctttgcttgttctgtgattatttgtaaacgaactccattgctttcggcttttcttttttctttctttctttctttttttttttgacaattatgattttaaaactttaatatgcataagaatcagttgcgtgtggtgtggggagggtgtcttgttaaattgctggctctgattcagcaggcctggtgtggagcctgagttctgaacgtctaacaagctccccagagatctcaatgctgctgtttggaccacagtttagtagcaagggattagacgatgcctaataagtgtctgtgcttctttggcaggtggagggtatacatgtagcatttagattaacggaagtccagcaatagaagtgcaatgagattgtgacctataaatgaagggaacatgttcttgaatgacatctgggaattcatttcacttggctacaatctcttagccacttttgctctcatttttaggtcattggaattgttttttgctaccagccagaacaacagaggtgaacatttggtggatggcaaatccccacgtctgtgtcgcaaattctcttccccgccaccactggctgtgtccagaacatcttccccagtgagggccagaaagctgtctttgacttctcccttgaactcaaagataggagcattggacctgacaacttccagcagtcccaccaccaccacccagagtcccgctgcgtctccaccaccacacactggtcagataccactggatctcagcagaggcctctcttctccagagcaaagcccgggaacggtagaagagaatgtcgataacccacgcgtggatctgtgtaacaagctaaaacgaagtattcaaaaaggtattatctagcacatttgcataattacaccccacatttgctggccgcctgcctcctcacccttccttttggaacactggttccctttctttacaactgtaatacttctgcatagaaagtagaatgagctcaatggttagttagaagagaaaattcctgtagattcttctggcccttctggaacagaaagcaagattagttgtccttatgcccctgtagtaaaaggcttattgtggtcagttgtctatgggagaatagcatatctgaatggtattgctagagagttcttggaatttggttaagactggttggctgaagagcctagcatggtgctttgcacactgggaggttgtgggtaccctcacccgtgagctcaggctgcagagctttctcctcctcccttatttgccttaggtacctgtgtacctccagcctttccctgctgaggatgagctaggctggaagtaccacaatggcttctttagtttagttatgaggacagtgctccatgttatagcagaggtataggagagaaaccaaattggagacagtgttaattgcttgtgacgtagccaaaatagtttttttaaaatgttgattaggtcatagggtttctggcttcaattctctactgacttcctgtcacacttagaataaagtacattctccctgccagggccttcagttctgtgagacatggatcctgtccccctctccagcccctgctcctgccacgctccctcatctactaggctactgttacattgatttcctttttgtgtcaaaagcattttggtctttcctgccccagggtccttgcacttgttctttcctctgcttggccacttttgccatgtaagctccatgagatcagcagtctgtcttactcacctccataccctcagtgtcttggccagtgcctgacaagtagtaaatttttgttaaatgaatgaatgaaataaaatatacagtgaactgatcgagggtcctctctcccatcattttagctttctcagcttggtacggtgtagggttggaagaggtgattcttgttgcttttaaagtccaatgtttctgtaatgaaaataaaaatgattcacagtgaaattacaaacagcttttaaaaaactgtataagaactgacttattgataatataataaaaattgggcaataaatcagacaaagtgtccaatttcaaggtggattgcccagatggatgcatagaggcttgcctttctacctgcttgaagcttctatgtgcttctagctcagatcatttaaataagcttcctgagtgaagtagttaatggaattttaactggagtggttgtcataatcaaaagttgcactcttttaaagtctttaaattgacaagttagcaactaaggaggaggaaagggagaagataattaaaaagtcattagaacaacaagcttaagcaaaatcatgatggattcttatcaggaataatgaggcagcgcacaagctgacaagtgcattcagggttgcacccagcgccagtgcttgggaaaccctgtggagggaatgactggaatggggcatgggggtatgggaagtacaggagctttcagatcatggcaagttttttcaccttctttactgcactgcggtagataggagaggagaaatctggagataagtcgggattctctctttctctctttttattttgttttattttgtttttgttgaggaaacctttaggaacaaacatttcagtgtccaacaccagtggcttggaggctgtggtttgattgctcatggggctgggatgaggatacagtaaagtctgttcaagaatcattgagtgagcctcttctctgtgcaggatactgtgtgtgctagagtccacaatggtaaatagcaccttcactgtcatactctagttatgtggataatacagacacaacataactatatgggcaagtggtataagaggtgtagatagagtgctctggaagctgaagagcagggagatcacatctggttgagcagaattaagaagtgtctttgacatgagccaaaacatatgtgggttggaaagaagagatgggagaatttctgggcaaagagaatatataagtaaaggtgtggtggtaatcactagtggtgaatgccatttcttttttttttttttttttttttttttttttttttgagatggagtctcactctgtctcccaggctggagtgcagtggcacaatcttgactcactgcaacctctgcctcccaggttcgagctattctcctgcctcagcctcctgagtagctgggattacaggcacgcaccatcatgccttgctaatttttgtatttttagtagagacgggctttcaccatgttggccaggctagtcttgaacttctgacctcaggtgttccacccgcctcagcctcccaaagtgctgggattacaggcatgagccaccatacccagccagtgaatgccatttctgcaagtatcacaagcatcactgcttctgaaaggacaggctttgtcctgttttgacagcatgggcagccctgtagagcagaccttgttagtagtcctcttagggctttctagcacggagtaaacttcaaaacaacaactctcctagagaatctttcttctcctccttcttcttcttaccatcttaagtatctttaagtgtatagctcaatagtattgttgaacgacagacctctataactttttcatcgtgcaaaaccgaaactctataatcattgaataataccccattttcttctcccccggcccctggcaaccagctttctactttctgtctctacagatttgactgctttaagtttaagtacctcatatatgtggaatcattcaatatttgtccttttttgaatggcttagtttacttagtgtaatgtcctcaaggttcaaccatatgatagcatgtgatagaatttccttttttaataggtagaataataagaaaatgcagtatgcagatactacattttctttatgcatttatccatcaatagacattttggttgcttccacctcttggctgtttgaataacggtgcaatgaatatggtgtgcaaatatctatttgatatcagcatgattaagtgttccactttaacttgttgtgcagggaatgttccacttcgatcaccaacttccctagttttagtcttcaaggtgatgatccaataccttatcatgaaagctgcttgagctactgtctaggacaaagtagaaatcaatagtttttttccctggaacaataagctggaaaaaagttagacttggggtatcttactttgttttgggctgttatagcaggatattttaaactagataattgtacatgaatagaaatttatttctcacaattctggaggttgggaagttcaagatcaaggcactgacatcttgtgaggcccttcttgctctgtcataacatggtggaaggcaacacatagacgtgaaagagaggagagggggccaaacttaggcttttataaggaacccactactgcaataatggcattaatccatttatgtgtgtagaggcctcatgatataatcacctcttagaggtcccacctctcaacactgttgcattgggaattaagtttttaacatgggaactttgggggaaacattcaaaccataacactctgtcccttttcccccaaatttatgtccttctcacatgtaaaatatattcattccatcccaatagcccccaaagtcttaacttgttttggcatcaactgataagtccgaagtccagagacttacctgaatcagatacgggtgagacctgaatcagatatgggtgagactcaagacatgattcatcctgaggcaaattcccttccaactgtaatatggtggtaggaccagaataggatagatattcccattgtaaaagggaaaagtaggcaaaaagaaaggtataacatgcctcaagtaagtctgaaacccaacggggcagacattaactcttaagactccagaataatatttcactccatgtgctgcctcctgagtacactggggtggggttgggtgcccaaagccttaggcaggcccactcccatgacttttctgggctcagcccacatttcagctctcatagattagagcctcttgtctgcagctctctcaggctggtgttgcatgctggcagttctaggatttctgcaatggcctcactctcatggctccactaggcattgccccagtgaggactctcttcagtgtctccatccctgcaataggtctctgcctgggaccctaggctctctgcagcatcctttgaaatctaggtgaaggaagctgtgccttcacagcttgtgcattctgtgcacctgcagaattagcaccacatggatgccaccagtgctttccatgtgcaccctctggtgcggtggccgaagctgtacctgggtttgcctgggccacagctagtgtggctgaggagcactgcacaggaatgtggggagcagccctgggcagcaaatgctgtggtcccttagattcctctctgtcaacctggccctcaaggtcctatcttgtctgaaagatctctgaaatacctttggagtctttctcccattgtcttaatgaataacacctggctctcttttagccatactctctttagtactaatctttttagcgaaaggtcacttggccacagccttggtttgcactcccaaaaaggccttttcactctttacgtggctgagctgcaaattttccaagtctttctgctctgtttccctttcagttataaattctgcctttaaaccatttctttcctcttgcatatatttaaaagtagccatgcagcttcttaatattttgcttataaatttcttccaccaggtatcctagttcattactctgaagttctaccttccataaagcccttgggcataaacacaattcactcaagttctttgctactttgtaacaaagatggcttttatgccagttttcaacaccttgtttcccatttccatctgagacctcaccagaattgcctttactattcatatttctaccaacattctatcatgaccacctaagtaatctctaaggagattcagactcttgaaagctcttctcttcttctgagcgctgactattagtagcatcatccttaacgctccatccatggcaatacaggctttctctagcccattccttcaaactcttccagcatctgtccattacccagttccaaagccacttccacattttcaggtattcgttatagcagtaacctcacttctcagtactaattttctgtctttgttttgtgctacctgagactaggtgatttataatgaacagaaatgtatctctcacagttctagaggctggcatctggtgagggccttcttgctgcattataatatagtggaaagtatcacatgggtgggaaagagagtgaagtaggccaaactcattctattcccaagataaaggcattcattcattcatgagtgcagagtactcatgatgtagtcacctcttagaggtctcacctctcaacactgttgcattggagtttaagtttccaacatatgaactttaggggacatatcaaatcatagcatggagagaccaagataaatgagaaagagctggatcaagctcttagggaaggacactgacacaggcttcgaagacctgtcagtacagatattggacagagtgggatcatgtggacacagccagtggctgctggagagctttgtcatgtggcagcactgatcattcatggcctggggccagcagatggagggaacctgtgaataacagtatggccgaaatattaggctctttctcatattagagaattaagttgaaggcttcatgcctctgcttctcactggatttccccaaaacaagtgatttagtgttatatttttttcagttaatttatccagatggttcataggttagaaatatcattttagagttccagtactctaaaatagttaaatgctgagctctttccactctgggtaatggagaaagtccaagattgtatgtatctaggaggggcccatggcacttggtgaagcccgtagagccaacctttactccagagctgtcagctcctctgctccccaggcttcttagtcacattcaccacctaatgcatcccccttagctctcattttaccctgatccctcccttaatccttccattaagccacttctttgcatctttatttcttttccctttctatagctgtcctctaatttctttttaatgcatttatttcccatcttatacttaaaaatatttaaggtggtcattcagagagatacagggtacaactacattaaaatgaaataggtagctggacatggtggctcatgcctgtaatgccagcactttgggaggccgaggtggaaggatcgctggagcctaggaattcgagaccagcctgggcaacatagtgagaccttgtctctactaaaaataaaaataaaaaaaatagccagatgtggctgtgtgcacctgtggtcccagttactcaggaggctgaagcgggaggatcacttgagcctaagaggtcaaggacgcagtgagctctgatcataccactgcattccagcctgggtcacagagtaagaccctgtctcaaaaatacaaaaaacaaagacaaaaataaaataaaataggtaaggaaatcagacaatgggagaaaaggaataagttgtgtgtggccaagtgtatggttactgaacaaatgaatactgtgtggtcttctgcaattcctagagtcccctgactttggttccaagctcctctgctggcacagtaaagacaggaatataatcaattattgtgattcatattgaaggctaggaatagattggttgtgcgggcacatgcttgctagttcttgagactgagaacaatttatcctgtggatccctgcgaaggaaacactctgggtagaaagtttagaattaaggctcgggttgaggtagctctttggcatttttctgaataagtgaaacaaattacagactcagttgtagggttttttgtttttgtttttgtttttttgtattggtgtatgggcaatactggtcgtgaatagttttaggaaagtcatggatgaacactacttcagcatgagtctgaaagttgtgtgtgtgtgtgtgtgatgtctgtaagagccaaaagtgctgctgtgtgaaccctgctgtctagtcttaaaaatttgagttgacaaagaaaaaggagacattgatccatctttaatttgaaagatgtttgcgtgtatcacataatgttaacacttaaaacagttggcaaacttgaatatgaatcccgtgccaagaacttacacattttctgcttttcacttaagaatacaaccccacaccacctcattgtataatatcagttttgccaattaggtccctattgatgccatacgtctccctcactgccatccagctattcatttcagggcatgttttttgaaaagtgctagtgacctttgtccatttttattgtcattgcaatgataatgccagccttgcaaaattttctggcaggagaacgtcaaacaatgtgaggagaaagaagcgaaataggaaatatcctttaaaatgagtgaggcaatgaacttagggaaaaaataattcaatttaatttccctccaactcattcctcacgtctgttccagactcatccaacattcactaataccctctcttctcattaccagtcagtttctatcttcttcaaccccaggtgcttctacaaaacacaaatatcagccagactcagatatccagattccacccagtgatgggttctcaacaaaaaccaaaccaacagcaggcaagaaaggcaagccaaagggtcgctcactgtattcagaccccattactccctcagtgttcacttagaccatggccgtgcaacttagccacctgtgttgctgcacagcccacagcactagtgtctgtttctgtgttcttagtttgaaaattgcctgcctgtgggctgaaagtgctcccgattttagcatttgttttgagccacatctgcccactcgtcctgcaggcaaagctgtttgcaaggagcctgatcaaaagtgaatatgccagaaggaattctcccctcagcccccagtgctggcatggtttcttctctctgtaggtgcctgttagcttacaggattcttctttgctttcctgttctttcagaacagtcagggtccatccagcttttctcattgggaaatttcctgggttcaatgtaattgctgtctaatgattttctcattttcctgagatgactgaatggttgaatcagaccaaggacatgtatttgatattctgctcgttcttacagagcagatgccttccattactgaattttggggcagttatttagaaaataataaaaccgacagctaagcactgattttttttgtctgcatcttgcatcgttgccagctttactgtaattatgtcattcagagaaagattctaaccatttccttttcctggcccctttgtgtttcaaaaaagcaaaattgtggccatatttctaagcggataagtcacatgcaagtataaaaatggccttagatgaagtcattagagatttttgaaagtttgttgagtgaaatcttgaatggaatggcaaagcaaagtagttctgctgacaggattaatgtacaattagtggaggtgacactaagctgttatcaatgggaattaatgaaaagcccaagaagaatggaagaatcgttggaaatgtattacatttttgtggtatttttctctgaaagaacatacacaaagttgtagtcttacctgcttaataaatcagtgggaggggcatagaaacatcattagtaatggcctaagggtgaccctaaaatgatgtgtgtgttattcttgggatgttagctgcagcaaagaagctcaaatgaccttaaaccctcccaatggttcatttaaaagattttcacgtgtttcctgctgatctgtagctctagctcagagatacccagtagaattttctgggaggatagaaatactgtatatctgggctgttcaataccatagccactagccacatgtggctgctgagcactcaatgtagtgcaagtgggaagccaaaataataatttaactttagttaatgtaaatttacatagccacgtttgggtagtgctgtcattttggacaacatagctttagatctctgggagacccagagatccctggtgagggccacattatagagattcaaactttggttggtttagggggcaacacaggcaaagaactggtgaagttccgatttgtaatcccaatctgatttttgacctgacaaagttatctttccccactcagagaaagcaaaaacatttggaagggcaggggatccaccacatacccccgtttactttaacatctgctgctgcatttgacagaaggggctggccagggtcagctagggtcagccaggcccaacagggtcatcaagacagggttagagaagatccttttttagatttagtgtcattagtacttgacttgatttcatattaaagccctttaatgaaatgcttattatctgtaatgaacttttgtttccatgcatgatactgacaagaagctcttgaattcatggcctggttgttaaaattcatgatgttttcaagcagcagtcctagagtctgcaccagcggaccgagcaggagtggaaagctcccctgcagcggacaccacagaactttcaccttgcagatccccctcaactcctcggcacctccgctatcgacagcctggaggtaagagctcaagagggactcagaaatagaaacgtgaaaaatgatttctagcttctgaacctttcctttgcctaattgtttcactgccaaaataatttttttagtctcacttattgaaaattaattggaagcaaatacagtcggccctttgtatctgtgggttccacatccatgggtttcatatctgtggattcaaccaatcacccatcaaaaatatttggcagaagaataaagcttctgtactgaccatgtacatactttttttcttgtcattattccctaaacattatagtatgacagctatttacatagcatttccattgtgttagttattataaataatctacaggtggtttaaaatatacaggaaaatatgcatagattatattcaaatactacacgattttatatcagggacttaagcatctgtggattttggtacctgagggagatcctaaaaccaataccctacaggaaacaagggatgactgtaatgttactgtaggaccaagtggtggaaaaataaatgattagagaagatgtcattagtctaaccaacatttgtttagttccatcattgcattgcattttgtgaggagtaacgtgaatcaaaaggctctttctttagatgttagctagctgaagaatctcagtgctgggtttaccaaaatgttcccagtctctgatatattaccatgagtcccaatgtagtctgtataagtggactcctctgggcatcacaatctggggagaccctattaataatattatttcatctaaaataaggtccaggtacatgggaccccagtcatcattattgctagtggcagaaactggcatatgtattttgatatatagttaagaaaattgtaaagcattactccataatttgtttgggaacataataaatgtcctctaattggagaaaaaaaactaatcagaacaaaaggtagaaatattttaattatctcccattttccccactgctcaaataaatatatccaaataacagttgttttgaaatgtttgcttttctcttcttaagccaattatttcaagtcagaacagaaaattacacaattatgaaaccggattcaccccaagtaacccaaatgaaaaggcttttttttttggtttggagacagagtctcactctgttacccaggctggagtacagtggtgcaatctcggctcagtgcaacctccacctcccaggttcaagtgattctcctgcctcagcctcccgagtagccaggattacagccgtgggccaccacgcccagcagtttttatatttttagtagagacgggttttcactttgtcggcaaggctggtctcaaactcctgacctcaggtgattcaccctcctcagcctctcaaagtgttgagattacaggaataagccactgcgcccagcctataaaggcatttttgactctcataggcatgcttcaaatagggcattttagcaaaaggtaaagtatatggctccaaatggttatcggtggccttagcagcttggtagaagctgttgtcattgccatgagctctgagagcaactaggaaggtctcagtctggctgttgttagatgtctgcctttgtggatattagcccttggggctttaaggctccaagtcagttatgggttatcctgccatttgggtgtttctggtaaatgaaggtgacaaattagactttcctggcttgtcatagtactactatggaattagccagatctctctattcttcttagagctttggtcagtccaggtcttggcaacttccttgaccattgccacataggacagatccctttgacttcattgtaacctggaagagtttgggaccaaaatctatggaagtaaggctctaccaaggcaagagttaaatgctgttcaaggcgttacaattattagaactctactttatattctcttttcatatgtttatattcacatataaaatttttaattcacataaggattatttggaaatcctcatcttgtttgtggattaactaagccaaatcctttgtttcttccctgatataactaaatcatagagacatagaaacatgggaaggaggctgaaacctgtgataatatggaggaactgaacaaggacagcatcacatatttctatctagctgaaattttgcctgtgcatctgtctacttgccaccttgttccaaaatgcaataagtctgttgtggaaagagaaggtagagctgttttatgcgtttgtgcttgggcacattaagcagctctttgcttcccctcttaacgtgtgtatttattttaggcatgattgtgaaacattagggccaagctaataaaagcccttcaggtcagaatcacagtggactgttttcactaaaagcctgagcgaggagaagcagcgagcttggcaccagcactgccaaacgctgtgtgtacagtccgaggagtgaaagggactgcaaggttgctcaatacatcctttcgattttaaaagggccacacttaaaccatctgtactgttaagggtgttctgagaaggaaattctgtcagagggaaattctatcagtaacatgatatggtatcttttttaagaatatttttatattaagatacagtttacataccataaaattcacctttttaaagtatatagttcagtctttttttaatttaatatattcacaagttcaggcagccataaccactatttaattctagaacattttcatcacccagaaagaaaccctataaatatcagccattctatactcattagcggtcactctccattccccctccaaccccagcagccctaggcaaccactaatctactttctccctctatgggttcacctctgctggacatttaacacaaagggaatcatataatatgtgaccttttgtgattggctccttctttaacttggcatgttttccaagtttatccatgttctagcatgctttggaacttcattcctttttgtggctaaataatattcccttgtatttttctgtttatcaattggtggacatttgattgtttctactttttggctactatgagcaatggtgctatgaatattcatgtacacgtttgtgtgtagatgtatgctttcttttctcttggttatagacccagagtggaattcctgatgtgcaatcttgttgtttgcccattaacagagataatacagggcatttggcccagtccttcatctggtgcaggaagaaaaatgatgatttttgttacagaatattatccatttgcctcaccattccatttcctttcttttcaaataaccaggacagacggcggacaatgcccactgctctgtttcaccggcttctgcttttgcaatagccacagctgcagcaggacatgggagtccaccaggtgagtaggggagcagctatgtacagatatgtgaccatttatattaagtcagtggcccgtgtctgccagtgtcttgatgagacactcggcagctctcacactggaatcccagcattttgggaagccgaagcagaaggattgcttgagaccagtagtttgagactagccagggcaacatagagaccccatctctataaaaaatttttaaaattagctgggcatggtgttgcatgcctgtagtcccagttactcaagacgctgaggcagaaaaatcacttgaggccaggaggctgaggctacagtgagctgtgatcatgccactgcactccagccagggtgttaaagtgagaccctatctcgacaaaacaaaacaaaataaaataataataagagaatgcacattcctagctctttctgagtcagtgcttctgggaagagactgtcttttaaatgagcatcttcagaaatctccttatttggccaggcacagtggctcacacctgtaatcctagcactttgggaggccgaggcaagcggatcacctgaggtcaggcattcaagactagcctggacaacatggtgaaaccctgtctctactaagaatataaaaattagctgggcatggtgtcatacatctgtaattccagctactcaggaggctgaggcaggagaatcatttgaacctgggaggcggaggttgcactaagccaagattgtgccactgcactccagcctgtgtgacagagcaagactccgtctcaaaaaaaaaaaaaaaaaaaaaaaagaaaagaaaagaaaaaaagaaatcccaccatttgcaacagtatggatgaacctgaaggacattatgttacctgaaataagccaggcacagaacggcagatactgcatgatctcacttatatatggaatctaaaaagtcaaatgcatagaagtagaaagtagactggtggttaccaggggctggtggggaggaagggaagcggggagctgtttggtaaaaggataaaaggttcagttgcacaggaagaataagttctggagatcaattgtacaccatggtgactagttaaaaatgtaccgcatacttgaaaatggttaagagagtagattttagatgctctccccacaaaaaaatggtaagtgaggtaacagatgttagttagcttgacttaatcattcttcagtatatacgtacatcaaaacatcacattgtaccctgtaggcatatacaataaaaaataatcaaataaataaataagcaaaagctccttcaggtgagtctcactcaggcgatctgtgggttacagctctgagaaactctttatcagagaaggttgttattcctcctgtgttgtttgacagagttcttcaccctttataactcaattactgagaacacgtttccattttaattgagtacaatgctaaaagcatatgcaaggtgggagggagggcttgtggagtgcggggagccgagcggtgcagctattgctttagctgactcataattcatttccagtagctccacgattctttctgagttgctgtcagttaattttcagggtaaagaaaaagtacttaaaataaaagcacagtattttaatagataaaaattatattcattatctctttcctcttctctcacgtgcaaggaggatattatgttaaaataaatctgtaagtggtttagggctgggcgtggtggcttacacctgtaatcctagcactttgggaggccaaggtgggcagatcacccaaggtcaggggttcaagaccagcctggccaacatgatgaatccccatctctactaaaaatacaaaaatcagctgggcgtggtggcgcacacctgtaatcccaactacttgggaggctgaggcaggagaatcacttgaacctgggaggtagagtctgcagtgagccgagatcatccagcctggatgacagggtgagactctgtctcaaaagtaaataagtaaataaataaataataaatctgtaagtggtttaaatagccttgttgctgtgtcttcacctaaactaaacctatgggctccaatcgtcatgatttgtagaaacatgagagatggcatattttgctaattagccatttttcacctttgtggtaacaaaggaatcctttccaaagcttctgaaccaatattcacaatagtaactagtaggtattatctgtgtgattttttttttccaaattgaggaccaaaaagagatgttctctaatggacattaactaccatagtactttatatattatttatcattatatatatttctctaaataaacattttgcaaattgaccacattctgtttctttagcattttgccatatgtgcttcactggagatgtggtcaggcaaattgggatgtgctttgccccaaatattcttaaaacctttccccaaaagtcccatcagaataacaaaaagcagtctataatggtcaaaatatcaatcttgtcgatacagttggcttctatgattgattaccttctgtaacagtcaacattttggggggaaataagggaggcttttctaggctttcagcagagttattgtcgattgtgatttgctaagaccttctcctgtcttccgttctcactcgctagtctgcctttggaaaaagtgaaggacaagaacatctcacagatttcctaatttaaatatggtttgtgagggaaaataaatttggggtttatttgagatgagcccattccccatttgctggagggtagggagaggtccttttttcacctgagattgcaatgaagattgaatcgtttgaatgtgctttagagaatggctttctgactagctttcccaggcatattgggccagaaggaaaaagtaaccaaaacggccagctctttctccctttttgaaagcctgctgcttttctgttgccttttttcctacttctcccctgcagctgaaatagtcttaggaagaaaacccttcttcagcgagctggctcctggtggtgctttctgaggagggcagaacggacttgctaacagactcagtcaatgttgctaggtgttggggagcctgaaccctgtgtgagcagactgctcttttatgacagtgctgttgatgttgcctatcatgcagtctgaagccacatgatttgatttcagaagtagaggcaataagggatttgattcaacagtgcccatggctctgctgtgaaggcagcaagttgcacaggggtcagtttcaatggctagtggcggtaagaaagggggtctcttttggagtggagaccagtgcattcctggggctcagccactcagaggaactggtcccttagcagatttcacctgcctgggagaactaggcagagagcagaaggtgtactcagagcagaaacagggaagggctaagaagataatctggatttattggctagccagggagagcatggtgttgcccgaggagggctagacctagatacctggacaggtgttcaaaggaagagagtgctggataagagtcaactcccaaacagactttgtatctcctctgggaatcaggaattgccagcccggatgcatccaggtgagttgcaaaggcaagcagaagaaagattgcatagacaaataaacaccccatgctttcatcagtgtctgcaggcttcctgtctgcttattcagctgtgatacagatagacttggggatgcagctctgctgtgtccttgctcctaacaggaaacaaggtatagcccagccaagccagaggtctgcggagtgggtttccatgtttcaggtgcctctgcagattccctcttgctttaatactctcccagcccttcccttgaccccatctccatcaaaatatataggaatctggcacctctgggttataactgtcaattaattattatgctctcaaacattaactctaggcatttgtatattaaaccatgtctctttaagtattgcttagaaaacttccttaatgcattaaaaggaatttcaaatgcaatacaagggaggacagcaattttttttgcaaggaggtcaagacaagatgttcctgcctgaccccgggggcaaggaaaactgattttatttgtgggtggtgccctgtgatctgtttgggattgcctgccctgctgctggggtctcagcctgcctaatttccacatagactggaaaagcctggttttcaatctttttggggggtcgggggaacaaagtctcgctttatcacccaggctggagtgcaggggcgtgatcttggctcactgaaacctctgcctcccaggttcaagcgattctcctgtctcagcctcccaagtagctgggactacaggtgtgtgccaccatgcccagctaatttttgtatttttagtagagatggggtttcaccatgttggccaggttagttttgaactcctggttttgggtgatctgtctgccttggccttccaaaatgctaggattacaggtgtgagccactgcgcctggcctcaatctctttttcttcctttaaaagaaaagaaaaaaaaaaaaaagatctagagccttcccttcccaaaattggatgagtcttttccttccatgtcatgctccctttgtttacctgagtcactgctatccagagaatccatatcctgcccctcaaaactcgagattcggattttatgctttctgtgaatgtggtaacctttcagggaatttttaatggatttttatgtagacccataggtgatacccaggattgtagtgttgtgctttcactattacttctctgtctgtttatagtgtttctctgacaaagaaacacatcgcaggaatgcagcttttagcagaagcattattgtctcacgttccctgttaatttcaactccctaccaacactttctatccttgctttgtttttttcctcaacacttatcactatttgacacactattttttttactaatttatcttgctttattatccatttctccaataaatgtaagatcgacgagggcagagatttttatctattttatatactgcagtatccccaatatctagaatagtattgtatatgtagtaaatgatccataaatgcttaccgaattaatgaatcaatgattgaatcttcatacttgcaatagggaatattcagtgcagaaaagaaaaaactgtactgtccatatatttttatagtgctgtggtgtttttaaattgtttgttgttgttgttatttcaaggtaaaagagttttgtcttatttctccgactgatctggggaggtgataccagtctcttcaagtcagcaagcaggttttgagtgtcttttgtgtttagtatcacttttttggatacccacaaccctgagctgagcacctggtagacttgtaaataagcctcattgtcttgttattcatttgatgtaagacttttcctcacactcatgattggaaagtccttgagatatgcctagacctgaggcctagggtcactgtaaatgtttgctgccaatcagaatgcaagcactaactaaactgttaaagcttcatactgtgtgatattaacaagaatgggttttgtgttgcacccatacccacagaaccaggcttttggtaccatcattgatctacaaattaggcccagttacagatggatcctgaatttgtaggcctgatgtttatacaatttggggaaacacacctcaaggaaaataatataaaattataaatataaacttttagggcacctcccggggctttggaagaggcccatacaaattgagaaggcctaaagcttaagctttcttgacttcctgataaatctgcttttgagtccaatccagaaaattcttggaatcgcaacagctacaggaaattttgtatgctggggagtgagggtgggggcatcagtgattgtcaatgagtcattagccatctttcttctaagttagcccagagtcaggtggtataatgaaaaaaagcagaagatggcatcaattaaatatgaacagttgaccaggtgttaatatgcacactcttctggtgactagttggataagttggtagtggtgagtagagcagcatgatgtatgtattgccaccccgatttccttttccaatgtcaaacagtcctccttttcatagggctttaactctatacaggataggactgaaacaaaggatggttgatggtgttcttgtgtgccaccacactgattgaaatgtatttgcaggcacctgctcaaattgaagagctctgcataaagtagaaatataaatgtgtgcatttcaaatggctgctgatacagggaatctgcaggtgcagtttggatatagttatgatatgaatagaaatgcaaattcaatgaataaatatatcagagcacatcattgcacttactatacacctgaagttgtaggattaattatagagtttgtgaaatgatataaaatgcagtatgaaagtgtgaggtgggttatttttatgagagtagaaatcatggcagtggaggtactataagcaactcctggttatctgtgagcagattatatgttttactgttctatgcaactcaaagtaaattaacaaagtagaggaatagttgaatgcacttataggaaaattaatgacactgttacaattgcttagataaatagtgaatcttttactggtagttacctggtacttgtaaagtagataattcataatctgttttatcttctgtaaaaccagtcatggcatgtgtggtaaatagtagatctgaggttaatgtgagttgggcttggatcggttttttaaaatactgatgatatctggtcctatacctaaagattctgagttgattgatctgggggtacatcgtgggattcaggaattttttaagttccccaggtgatactaatgtgaagccaagtaggaaatgcttgtgtgcgtgtgtgtgtgtgtgtgtgtgtgtgtgtgtgagtgaatattttactgaggtaatgtcagttaagggtaaaaatttggattttccaaatttcatgttagatttggatgtagatggatttcatgattatttgattaattcagtagaagaatgtggttaaaacagttgtgtaatcttaacccacaccctcaggcaatttaggaagtatgtctggatttcattctacagtctagtattaatttacatattcagtgttttaggtgtagatatggtaggtgggctggatgtgaggagtgctagactgagtcctgtgtgcatcaccttggacggtttctctctgggcctgttgtttcatggtggaagcctgagagctcagctggtgcactggctctccaggtgtgatctctgggcctgtagcatcagcataacctgggaacttactggaaaaataaattctcgggccacacatcattcctactgaatcagcatttctgaggatggggcacagcatctgtcttttacaggctctttagttgattctgatacatactaaagtttgagaagcagtgaactagtataatgtctgagctgccttccctgtttaaaaatctgactccatattacttgtagtagactatacagtagatgaaaaacctaaatttgaatctcttcctaagcactaagtacaactcaacctttatcttttggtagtttttgcacagtatgcataattgatgttgttccaagttgtacatttaaattctcacttttcttcatcatttaaaatatggaaggttgcctagagttctgcatcatgttagaaaatctttttatctcaaagtaataaaaactgttgtagtaattattctctagttacatttttataatggctttattgagctataattcacgtaccatacaattaacctgtttaaagcctacagttcaagctgggtgtgatggcttatccctctaatcccaacattttgggaggccaaggtgggaggattgcttgagcccaggagttcaagaccaacctgggcaacatagtaaaaccccatttctaccaaaaaaaaaaaaaatagctgcatatggtggcacacgcctgtagtcccagctacttgggaggccaaggtgggaggatcttttgggcctgggaggtggaggctgcagtgagtaatgatcgtgctccatcccagcctgggcgacagagcaaaaaccctgtctaaaaaaataaataaataaaaaagtctacagttccatggattttaatatattcccagagttgggcaacagtcacaatacattttagaacatttccccaagccctttagctgttagcagtcactccctatttgtctcttcctctagccctttgcaactgctaatctcttttctgtctctataaacttatttgttctcgatatttaatataaatggaattactcatacaatatgtgcccttttgtgactggcttcttttactagcgtaatgtttttgaggttcaaccatttttgtagaatgcatcagtcacttgatcctttttactgtggaatagtattctattgtatggatataccacattttatttatccattcatgagctaatggacattgaggttatttctgctttttggctgctgtgaatgatgctgctatcaatgttcatatacaaatttttgtgtgtttgtttgtttgcatttatgtgagtacatacccaggagtagatttgctaggttgtgtgataagattatgtttaactgcttaataaactgtcaaactgtttttgaaagtggctgtaccattttgcatttccatcagcagtgtaattgagttccatttgctccatacaacagagtagtcccaattcttcccttgtaatattactgtgagttattttacttatccatatcctataatcatccaatacattgttattattattaatattttgagatggagtctcactctgtcgcccaggctggagtgcagtggcgcaatctcggctcactgcaacctccacctcctgggttcaggcaattctgcctgcctcagcctcccgactattattactttaagcaaagttatcttttagatcatttaaaaataagaaaaacaaaagattttcctttatcttcattttttccttcttcagtgctcttcttttgtttatatagatccaagtttctgacctatatcatttttctctgcgtaaagaacttcttttaacatttctggcagggcaggtctgccagcaatgaattcctccagtttttatttgcctgagaaagtctttatttctccttcacttttgaagcataacttcactgaacatagaactctagcttggtggtttttttcttttaacactttaaatatttcactccactctcttcttgcttgcctggtttctgatgtggtgttgtcattcttgtccttgttcctctgttggtgtttatttcaagaacttctctttatctttagtttgctgcagtttgaatatgatatgcctagatgtgattgtcttggtatttattctgcttggtgttctctgagcttcctggatctgggtttcgtgtctgttattaattttggaaagctcttgccattattaatgcaaatatttctttgactcagttcttcagtactccaattacttgtttgttataccctttgaaattgtcccacagttcttgtatgtgctcttctgtttgggttttttccccctttcctttttctctttgtgcttgagtttggaaattttgattggcctctcttcaaggtcactattcttccctcagctatgttgagtctaccgatgaatcagataaagacattcttcatttccgtgtctgtgtttttttatgtctagcattttcctttgattcttagtttctatttacctgtttacattacccatctgaacttgcatattgtctactttttccattagaacccttaacatattatagatatttacctacttacaatggctcaacttacaactttttgaccttatgatggtgtgaaagtgaagcactttcagtagaaactgtgctttaagtatgcatacaaccattctgtttttcaccttcagtatggtattcaataaattatatgagatattgcacactttattgtaaaatgggctttgtgttagatgattttgcccaactgtaggctactgtcctgagcacatttaaggtgggctaggctaagctgtcatgtttggtaggttagatatattaaatgcattgttgacttacactttttttcatttaagatgggtttattgggatgtaactcagtcataagttgaacagcatctgaaatcatagttattttaaattcactgtctaataattcccaggtctttgtcatatctgagtctgattctgatgcttgctttatatctgttatgggctgcactgtgtccccactaaatgcatatgtggaggtcccaccattaccctagaatatgactgtagttgaagatagggtctttaaagaggtcattaaggttaaatcaggtcatatggatgaaccctataaggaggctattaggacatacacatagactaaggcgtgaccacgtgaagacacaggaagaagacggccacctacaagccaaagagagagtctcagaagaaacaacgcgctgactctgagatctggacttctagtcgccacagctatgagaaaatacatttatttagcaccaattctgtggtattttattatggcagcctgaacaaattactaaagtctctttagactgtgtttcttcttgccttttggcatgccttgtagttttttgttgagacccagacaggttatatcagataatagagactgagaatgataggccttgaagtgtgaagatttatgttatctggctagaatttgggccgtgcttgatgtttgctgtagctataggaaccaagggcttcaaattccttcaatgccctttttgtttcccttcacaacttggggctccctaagtactccttctcagagagaatctgttttcgagctctttctgctgtaatctactgttatcttactgggtctctgttagggtggggtgatggtggggaggaggagtcttctatatcttccaatgaaaccttagtgttttaatggactggcatcttgaagctgtgacccttacaaacgtttctccagtgatatagcttcttttcccactgccccctgcttccctggctgctgcattcccaatttatttccttgaatccctgacccctgtagactatattattttccccgtagctaagaagaaggcgagaggggactggaatgggaaaaatgtctttttccaagtgggataaggcttaggcaaagcctttttccctgaagagctggctttcattgtagagaaggccctgggcatatttccagtgttactcttcccctctccctgcaagagccatgaagagatctttctccggtgtttactgggaggacttggtgtgattcctggaggtaaagtccccaaatatgtggccgccctcctaagaatgtggttctcaagagcgtctcactgtcatgctggtccacactcaacctccagaagttcatcaatacaaccattcaagtgctgctaccaggtcccggttccagcgacttcagctccaggtaggcagatctgtgtctctctggatgtgcttgttttttttttttccagagtttgtgatgaccatttcccttgaaacctcagttttctggtgtgtccaagaaaagttgttgattttcaggctatttcattcctcttgtattatggatggatatggtaacttctaagttctttatgtgtcagagctgaaactcagattctcaacttggtgggatctttattgtgatctattaattttgtaggtcaaattggggagaaatgcacatcttaacaatactcagcctttcaatccattaactgggaatgtcccttcatttactgagatcttctctcacttctctcagcgatattttatattttttagcatacaaatcttacatttgttttgttgcacttattcctaagtatttgactctttttggtgttattgtgaatagaattgtttccttttatttttagatagtttgttgctaatatttagaaatataattgatttttctaggttgtcttgttttctacaactttgctaaattcatttattagttctactaggtttgttttcaaagattctttaggattctctacatatagaatcatttcttctgtgaataaagatagttttatttcttcctttccaatctatacgcctttcattttctttctttctttctttcttttttttttttttgagacagagtctcggtgtgtcacctccacctcccggattcaagcgatttgcccacctcagtcttccagatagctaggattacaggcagctgccaccacacacactaaaataacttttcgtatttttagtaaagacagggtttcaccatattggccaggctgttctttcttgctttattgcaccgactagacaaaaattaatttttataagcctatgttttgaattgcaagcgcttctttgaagtccttgtcaagcaggggaactatacactggtgatgatatagttggtgctcatattttacagtaataaatataatgatataaacatacaatcagctcacaaaaggcgcctatcaaaataatcccacaaagctctttccgtacacatcccattggaattcagactttttttattttttgagagatagagtcttgctctgtcacccaggctgtcatggagtacagtgacacaatcatggctcactgcagccttgaactcctgggctcaggtgatccttcctcctaagcctcctgagtagctggtactatagttatgcaccactaaatctggctaattttttttaggtttcgtagagatgaggtctctccacgttgcccaggctggtctccaacccccgtccttaagtgatcctcctgcctcggcctcccaaagtgctgggattacaagtgttagccactgtgcctggctggaacctgactttgaaactagattagctgtaccttaataggccttgttcagaatcactgggtaattcccgaataaaagtatccaaggatacttcttttcatctacttgttctttcacaccattcttcaacagattcaggacacctttttgttttttcctactggagggtatcctagtttgggacatattttctattgtttttttccaaaatatattaaaaatatttaaacattatttcactaaagaccagtactttaacaatggtcccaagtcctatttttaaacacacacacacacacacacacacagacacacacatgcacacacgcacactcactcacattttgcttggaattagaattgtggaactgcaaagctgcagctttcactggtgtgagtacactcctgagcctgcgaagcagctagaatgctcatggcaggtgggctttgcattctcttcctggaaacatgccacgcagcaagctagatcacagagatatctttgctgtgctttccaagcagacccaaatcctgttccagctggcctgtccaccttcttccctgatggtgctgcactgccgagttccttttctttgcactttcccttcccaggctccctgcaggctgctctcttctattactgtctcttctcagcaaaggtacaatgtagttgattatgcctcacatggcttaattgctgcttgattacattactgtttcatccatgtcagggccaggcaagtaacctaagtagggatggagaggtgctgccatgtttgaaggacacagccactgcccagcccctgcagattgttgccatgaggggctgcaggactagggctgtcagatgtgttttctctggtttttttttttctagccagaaatcttgatatttatgtgaaattttctgttttgaaatgttggaagtgaattcacactctttaaaaatactgtccaggccaaacacaatactttcatgggccacatttggctgtgagccaccagtgtgtgacctcagatttactgtaatcacttccagctggagttgtaggttgatacagctaagatttccagagacactcctaaatattagcagtaaactcctgaatctcttcagtgccactcccatgtatcttctattccttttactgggtgattttacagagagttgatctcttctcgggcactgtgcttgaccacatttgctttcagagggtaatcttatctcaaaggtctgagcctccctcactatgtcatcccctcactatggaaggggcacagtggggaccgtctctcttcatctcacgttatagattctgaagcaagtgtggcatctggagtggtgaagggtcttgcccaggttctcatagttattgagaatgagcctcagatctctccactgctaaactgctgctttctttgccctgatatagcctctaatccatattaacttcaaaaacagcaagagcttgggaagcttgaattgcttaattttgttattaactcttgcttctgcctttctctgcagcacgtccatttctttccgtctttttcccacctctgtatccacctagcattcccctaagtgatagacacagcagtttggggactccagagagatgagcctgggggaaattagtagtctgtggatgggttcttagttgaccagcagttagcattgaaggatctgtgatttcattcacagcattgtggaaatcagggccttagtacaatggtatgatctggttagaggaagcatgtatttctgtattgagaattggattaaatttgcagtgagatattgattactgtgaattaagttgatgtcacatatatactctgctgtctacagtctcaggatttgtgagaacactcagcactgtttaaatagcttaacagcatgcataaacttataagaaaggcacagaatctgggctttttccagggtctagattacaagctaaaatgtaaaatttgggcaggaattacatatcaattttctgtttcaaaatcagaagcttaatatcatgtaggtgttgtactgcattgatttccaatggagtgtagatggggtagaataagaacagccggggacttcctcaaaatattcctgtcccggtggggattctgagtggcctcccagaggcaagcagtccagaagagagatgttattgatggcaatgtgctgcacgtgtgaatggtgtgaaaacagaaggctaaacatcactgctctgctatctgccagccctaaaaagaactatgctcactttctgaatgcaattctctatcttctggttagtcagaggatgatgggaagcaggctgcctgtgtaacctgttttagcaatgacattcagaagtctaaggtcaaaatgttggctgcatgcaatgtttcttatatggggccctcaccatcttttcattttggtgtagcccacccttgccttatttcttattcatctcctctttttctgtatcatgctgtctttttaccttgctaggttctcaccttttggaattctgctcctatttcatggagatacatcctcttgctaggacaggctatgtgctttgcagcacccagtgtgaaatgaaaatgcaagtgtccctgttgaaaaaattattaagaatttcaagaattcttattaagaattattaagaatttcaattaagatgcagggcatctaaccaagcatgagaccttctaagcatgggcggtgtgtgacacaggctgtacaccaagaaactggccctgcctcttgcagtcttgtcaggagtccagcagtctcttaatgcatccaactgggtcctgtagtaaattgctctcaggatgtggcctccagtgcatttctaggattatatcttggttctgtagaagttttctgtggtgaaaaatatattcgtagtatccctttattttaaagacgaaaaaatcttaggctgggaaagaccaattagaaagacaaaagctatctgaacataggacttctgattctttgaagaaaatacacattttttattttttatttttatttttttgagatggagtctcactctgtcgcacaggctagagtgcagtggcgcaatctccactcactgcagcctctgcctcctgagtcaggcgattctcctgactcagcctcccaagtagctgggattacaggcgcatgctaccacgcctggctaatttttatatttttagtagagatggggttacaccatgttggccaggctggtcttgagctcctgacctcaggtgatccacccaccttggcctcccaaagtgctgggattacaggtatgagccaacacacctggcctgaaaaaaaatacaaattttttaataataacatacaatgaaatacttttaacaatgcaggaatgctgaaaataatctctgatgagtcagaaagactctcactatctaatgatgattcagagtaagcataaaaacaaaaattatcatcatataagattaaaaagggcaggcacggtggtgcacgcctataatcccagcactttgggaggccgaggcgggcggatcatgaagtcaggagtttgagaccagcctggccaacatggtgaaatcccatctctactaaaaatacaaaaattagccggacgtggtggtgcacacctgtaatcctagctactcaggaggctgaggcaggagaattgcttgaacctgggaggcagaggttgcaatgagctgagatagtgccactgtattccagcctgggcgacagagtgaaaatgtctcagaaaaaaaaaaaaaaagactaaaaaaattctgtttcctggactttttggttatttgaatctttataataaaggcaatagggcaaataaacagtggtggtcatgtcagtattatgcaaagctgaaaattattatgcaggaaagttagaaatagtagacagcctcaaaaatatacaatgaaaagtggaatttctcaatgaacttttttgggagaaataaccaatgataatgttgtgattatgtaaaatttcatcagcctcatacattaaaaggatgtgacaagcttttagttaaaaaaattttcaaactgttatgtcaaagattaaatgtggtagtcaaagtaatctatggaaacatactgcttttatatgcttggtggtggaagtcagcacaagtaaaccaaacattaaaacttctaaggtctatggtaagggaggaaggggctttcaatctgccaggagaatatccccttagactgtaggtcctgtgtgtgttccttatttatgcaccagctgtgattagtacaggttgtgcccttgccggcacttacagcctatggcttcacaagtgctgggaagacataaggcgataacttgataacatgtagttagcctttttaattgattgtaaatacatagcagttatgggtcatttttatagaggtgaagctcccaaagcttcacctacatcttgcaaaccattctcctatgctgcccagatgggcatttctgtatataaattgagtggttgcacttattatcaacatagcaatgacaacagtgatttagagttatacacttcaataggcatacaatatactgagcaatggtccaagttttacatatgttaacttattgtgaagtagttaatattactatactcaggttccagcagaggatacagagagttaagtaaatcacctaaggtcacttaggtcacacagggagtaagtagcagatttgaatcctgtcatctggctcttctaaccaccaccctactctgcttgaatttcatcagtactttattgccttggcccaatgcacacttgatgtttaaaaaataagggaagaatgccagactcagtggctcacgcctgtaatcccagcactttgggaggctgaggcagcgggaggatcacctgaggtcaggaattccagaccagcttgaccaacatggagaaacccagtctctactaaaaatagaaaattagctgggtgtggtggcatacatctgtaatcccagctacttaggagaattgcttgaacctgggaggtggaggttgcagtaagcctagatcatgccattgcactccagcctgggcaacaagagtgaaactctgtctcaaaaaatgaaaaataaaaaaaataagtgaagaaggggcccacagtctaacctgtcaccaccctaacctctgccttatacatataaggcatagctggaaccttgttatttgggtttctgtagtgctgccattttgtttaggaaggacatgaacctttctcttgcatggtctggtggttttaaaaatataccacaaattcttttctacttctccgttcaagaaatggtgctaaatttcccttctctttagtgtgggctggacttagtaacttgcttctaacaaataaagcggaagtgatcgtgtatgactttggcacctaggtcatcaaaagcttagcacctttcatcttggtcaatctctctcttggatcacttgctgtggggagaaccagctaccaagtcatgaggagagtcgcacaggggaaaaaactaggaactaggtcttctgccaacagccatgtgagtgagctgggaagcagaccccgtagccccagcacagccttcagatgactgcagccctagtggacacctggactccagccgcatggccctgagcccgatccacccagctaagcctccgaattcttgtcttaaacaaactgtgagataataagtgtttgttgtttgaagtctcaaattttagggtgatttgttaggtagatacagataactcatacaggtggtatcacagtagccagtaaactttgaccaaattattcataatcacgttaaacgtaaggggcatattttcattttttgaaagagaagcatttctgggcatcccctgtggaacacagcaccctgggcttatactcaaccaaatgttttgaaattgagggagtatatttgaaattaacatgtagcttaaatctgccttgtatttcaaggttcccgaacagtctttctcttctctcatcacctgaagtgctctgaattgaatagactcatttttctctgctgtttgagagcctagagcagtttgattttaacacaactgttgcttagcaataagaaggaacttaatggttccagtctattctgcaaactgagaggagcctcccctgtgtagctattgtctgtgtgtaaggctgaattttaaattgcaattatcatttgaagatgaaattgaagctggcctatgtgacacattctatgtaccctagcagctcagttgcccagggagttagactggcccagtttgaggtcccttacagacatgctggtctcttggaattataaggtatttagaagtataagacaaagctggaaagaaactagtaaattcctcattggtaggaaaacaggtggtctgtattcactatatacttattttgtgattctgggacgaaaaacttggctcttaaattgttgtgactagaaccggggccaatgattttagaaaagaatccatagagaagtgggaattctaaaatttgtcggggtgcggcagagggtgggatgtctagccaccactgacctcgctaccctgctctgttggaaaggctcccagaaatgtcagctgcttagaatttttaaacacaaggtgtaaatctgattgttcatcagaaaggttggtatcatttcagaagcctccacccaaattcaaagtgttattctttcccactctgtagactaaattatgtacaagcttacttgatttttaaaaatcttcaattggttatataggtctttctgtgtacacacagtaccatatcaggtactgtggaaggataaaaatgaaatacattgagtaaaagtacaagagtagaaggcattgcttctactctttaagaactggtcatctagttgaaaaggttagatgaacaggcatagagtacatgttaaatgatcaagatgtgaactcctgcacgctatataataatcagtataattatcagccaatgttgttaaactctggatttgaaaacaaagtgtcgcattaccaaaataacaaggcttcagtgcatgaccctgaaataataggttaatatagtttcaaattatttcataggctcttccaattagtcagctttctctggcagcagattttttttttaacttcgaaacactttcttcctctggatctacaagttatactttatgggtatgcatttcgtggtttatgtaacagtctgaggaatttagctggtatattagattaggtggaggcagcatctgtcatactggactaaattaatatttccaagatttctgcacatgcatcataatgagaagtgatgagagacatattggagcaaattatacttcactggttttgaaaatcaagagtcataaacctgcaggaaaccccaactagcctaactgaaatcgagtaaaataatagtgctgtgatgtgctcttatgtgtgtgttttttaaaataaatgtaacaaacagccatgggggaccaactgtctcctttttcagatattactggatcatcagctgtaaaggctctatgtttaattatgtctagcatttgaatggtaacagcgcagatgttacctgcctataatcctcctcctctctacagattttgctttgttcttgcttcttgtttttgagatcctgcacacaagttgaaattaattaaaaacagtagagcaacttagtctggataagccttcatctggcaaataatgttacactgccagagatttcctctgccaaagtcagttctcttaattcccgtagatgtgtatgaaacaagccatagtcccctttagaggcaggcactaagtgcatacggtctcagcagaggttagagtctcctgccttgccttccttaccttcctcactgggtgttaatgacctgcaagtgatgttctttttgtcttttttctgtactagcattatggatttacgaagacctacgtattcattacaacgagcctgtgaagtaggaaggcagatatcatcttcctcttctgacagttgaaggaacaggctcagtgagggacagagacttacttactcaagggcagttataaatcacaaactggactcctagtctagtgctttaggttacttttgtttagtggtatttcacagccacatctctctgatatttcaagggacagctgaagaattaattggtatgcggctctcacccagtgattttaactaccaaccagcttctcagattcagccacttcctgcatataagaaagctctgagaactgccttttatccctttgtgcagttcatagtttcggtttaattttccaacagggctcagggcatatttggatactgattgatatacatagaagacatatttagggatctgaacctatttctttgttctcataaacattgcttcagctaaacatgtaacaaaaccatcacagcaagtagaagaaacacctgaacgcaccaactagatttgatttatttcctttgtcatttaaaaatccaccctcgaacatcacactctggggactgttgtggggtggggggagggggagggatagcattaggagatatacctaatgcgaaatgacgagttaatgggtgcagcacactagcatggcacatgtatacatatgtaactaacctgcacattgtgcacatgtaccctaaaacttaaaagtataataataataaaataaaataaaataagaagaagatatacaatcaacaaacataccaaaaaatgcttaacctcactaattattggggaaatgcaacctgataattagtgataatgcaattaaaaccacaaagagagaccacattactcctgcaagaatggccataatttaaaaattaaaaaataataaatgcagtgaaaaggggactcttacactgttggtggaaatgtaaactagtacaactactatggaaaacagtatagagattccttaaagaactaaaagtagaactaccattccatccagcaatcccactattgggaaaataagtcattatatgacaaagacacacgatcatgcatgtttatagcagcacaactcacaattgcagaaatatggaaccaaactgtatgcctatcaaccaatgagtggatgaagaaaatgtagtatatatgcaccatggaaaactacttatgcataaaacagaagacaaaagtggcctttgcagtaacttggatggagttggaggccattattctaagtgaggtaactcaggaatggagaaccaaacatcgtatgttctcacttataagtgggagccaagccatgaggatgcaaaggcataagaatgacacaatggactttggggacttgggaggaagggtgggaggggaggaggggtaaaaggctatatattgggtacattgtacactacttggtgatgggggcaccaaagtctcagaaatcaccactaaatcacttatccatgtaaccagaaaccacctgaaactgttgaaataaaattttttacaattaaaaaaaaaaaatccaccctccatgagtttcaccatcttctgatggagacttagggagagaagcctctcattctcaaagactggctgccctgtcacattgttctttctaaacagctttatgcatatatatttcacataccacccagttcacccatttaaagtatctaattcagtggatcctagcattgccctgccatctttagtgggcttccagtcttgatttttgaaaacacccaggctgcctactgtagaaagagttcgcttgggatctatgagaaactcttcactctgagtactgtggggtgggcggaggatacagttaggaagctccatgcccttgcaggttcacaatctaggcctgaggatttgagcttctgttcttattactttaaggagggaaataaggggctgtgtgcctgttccaaaggacaatggatggactctgattgctggtgtctggtgatttggcagtgggaaaaagaagttcttagggtacgtgggccataagggccttagggagaatggccatgagggcacgtaagaatggctctccaaggggtcagaagtaaagagtggtcaagagagtgaattccaatatcaaataaacctgcacctgagttctgccgtttatttagctgtgtgacctggggcagcctctttaagtctcatcttctcatctttaaaatgagaagaatgactgtacccaactcacagggctctcctgaggattaaatgaggtgaaccatgtgcagttcttagctcagcacttggaaccatctaagtgttcaatgaatattttctgctgttattattggctgtttcctccacttgatttataagcttcttgagatcagggacggtgtgttcaccattagatctccagcccctatcgtcaaggcagaccagagtgttgaagtgaaatagatgcatccccccatcatccatttattctttggatttcttcctgactcacttatgtgcatgcatgtatgtgcacgtgaacacacacacacacatacacacacacaagcacacgactccccagactgatttgcaggcaggaattagtaaaataactgcaaaagtttaaactaaaaagtttaaatttaaaaaaacatatactaatggtgtggcatcccatgataattcaataaaaggagtgtaatttctgggcacaatcaagagacccagaatgaatctgtgctatataatggtgttcaccacagatgatgctgtgtataatgacagatcactggaaagagaagagccaagaggcttgccaataggttttgcagtagtaatgtgaggagatgcttatgacctgcactgggactgttcaggaaggggaagaagtctgagaaatgttagtgtagacagttttgatgggctatatatattttattaaagtttaatatatcttataaactgagttatcacagctatatgtgaaaggctaggttaataatatgataatgatctctgtttacaattagctaagtattaggtgtcacaagatatctgactgcgaagaaccaaagagaggggactagatgtacttcaaagatgggcttgtccagccctctggcctctggagaggcatcccctgagcatgttcctttatgcctcacatcattttaaaaaggtcttgaggcagatctctggctgtactgcaagtacagtacatgtctgggctccattcaggatagagttgaaaggagattgggtttttggtccacaggaaaactggtacctttttttttttttttttgagatggagtctcgctctgtcacccaggctggagtgcagtggtatcatttcttggtgtctaggacttatttatggctgcttcttgcccattgacactcttctactgcctggctgacttgtgccagaaagagacagttttattggatatagaaaattccaagaatggaaaggcaggaaggttaggatcaaggaaagcacctccaagatgctcgaatacttccctgttgctttatttcactgactgtggtcacttctgctattttcttacttaagagttctttgagacttcctctgacactgctccagccttgctagtataacatgggtccagctgctggaactgacattcctggggtgattttcataggaagcaacttggaccatatccaggactacactcagctatattggtgctatgatcatgtatatgtttcagaatagtttccaatgtggttcaattcagctaacttttttttagtcttgattactttttagacacaatgattataatgctttattcatttatgttgcagtactgggtttttccatagtcagaaggatcttgggaactaatgttaaatctatggaagagagattttttgtttgtttgtttgtttgagatggagtctcactctgtcacccaggctggagtgcagtggcacgatctcggctcactgcaacctccgcctcccaggttcaagctattctcccatctcagcctccagagtagctgggattacaggtgcgtgccaacatgcctagctaatttttgtatttttggtagagacggggattcatcatgttggccaggctggtcttgaactcctgacctcaagtgatccgcctgcctcggcctcccaaagtgctgagattacaggcatgaaccactgcacctggccgagatatttttgttcaaattcaaataaagattatgggtactcaactcagcctttggacaattactgctaataatttgaagttgtcaccaatgatttatatattgttcttaccaaagtatggtttaatccatctaagaagaaagaaggatatacaaatttaagctatcccttcttccttcaatatctgtaggtttttaggcaacatattactcccttcctaccacaaagctatctgattcagaaacagggtgactttatcctagatgtagatgctatgatgtattatttgccaacattttatgtgcttaaaataatatgagaatggtagagtgaggagctcagcaaatttccttccccaaaacaatgacaaaattgtacaaaattatcaaaaccaaccatttatgaactcctgaaatctagcacaggcataccaaaatagaaaagcttttattcaggagaaagtactgaacctagctagataagaacagtgggtgtctatggcattttagcctgagactgctcttgtctccttaccccatctcctttagtatgggcaaagtatgaaaaccatcagctttgttgtcagggggcactgactttgatttggagcacagtagaatgtgggaaaacctcatgctgttgagtgttgttggaaacattagcaatctcagtggcaaacagcagggaacatcaacattgcaactagcctgaagttgtgattctgggtggggcatggaaataaaaaactcaacaaaggaattagaattaaaatggtacattatgaaatatttatttaacactaaagaaggcataaaggacaagcaaagaaacaaaaagatgctagacatcatgataagtaaagataccagcattgtaatgcacccccagtatgtctatatcctaaacggtgtgatccgtgtgtatgttaccttacatggcaaaggaaattaaggttgcagttgaaactaaggttgcaaatcagctgatcgtcagataggaagattactctgaattattcaggcaggtccaatatactcacaaggatctctaaaagtggaagagggaggcagaagagtcagtgtcagataatgcaatgtgagaaagactggagtggccatagctggctttggaggatgccatgagccaaggatggagggcaccctctagaagctggaaaaagcaagaaaatggattctgtcttagagtgtcctgaaaggaatgcaaccttgctagcaccttgcttttagcccagtgagatctgcatcaaacttttgacccctggaactgaaggataataaatatatgttgttttaaaccactaaattcatggtaatttgttatagcagcaacagaaaactaatatggaatgaatagaaagcaaatagaaaaatggcggatataaatagaaccatatcaaattccattaagcattaattcatggaaaatgcaaatcaaaaggtaaatattgtcaaaccatataaaaaagaaatatctaaccatatgccatatatgaaacacattttcaattaaaagacacaaataaattgaaagtaaaggaatggaaaaagatattccacgtaaaaaaaattcatgagagactggagtggctctactgataaaatagactgtaagaccaaaaaaaaaaaaaaacttattaacagcaaagagcggtgttttataatgaaaacacaggcaattcttcaggaatatataataattataaatatatgcatctaacaacagagccctaaatacacgaagcaaaaactgacagaattgaaaggacaaatagacatttcagcaataataattgttaactttaataccccactctaaataattgatgaaataactatacaaaaaatgaaaaggatataaaagagcttgaacaacactatcaaccaacttgacctaatagacatatatagaatactccatctgatgaaagtgtatacatttggggtttttttagacagagtctgtctgtgatccaggctagagtgcagtggtgtgatcatagctcactgtaatcttgaactcctgggctcaagtgatcagcctcccaagtagctaggactactggactgactaattctttttttaatttttgtagagacagggtctcactatgttgcccaggctggtctcaaactcctggtctcaagcgatcctcccgctttggccttccaaagtgctgagattataagtgtaagttacagcacctggccagaatatacattatttaaggaagacatgaaaatatctccaagatacaccatacattaagccataaaataagtcttactagattttaaaagtctgaaattatgaaaggtatgtttcgagaacacagttagaaattaataatagaaataaacttgaaaagtctcaaatatttagaaattaaacaacaaattgttaaataactcatgggtcaaagaaaaaatagatatttctttgacatactggtttcatttcctttgtgtatatatacacacagtaatggggttgctggaccatatggtagttctatttttgatattttgagaaacctccacactggtttccataatggctgtactaatttaccttttcatcaatagtgcacagagttcccctttctccacatacttgccagcatttattattttttgtctttttgataatagccattctaactggggtgaggtgatatctcactgtggttttgatttgcattttgctgatgattagtgatattgagcatttttttcacctgttggccatttgtgtgtcttcttaagaaaaattagaaaatgttttgaaacaaatgaaaatgaaagcacaatataccaaaatatatgggattcagttaagtagtgtttagagagaaatgtatatatttcaatatctacattagagaagaaaaatgatctcgaatcagtcatttaagtttccaccctcagaaattatttttttactaacatctttcacaaaagacaccctcagaaattggtaaaaggaaagcagaccaaacccaaagcaaacagaagtaaggaaatattagagcataaatcagtgaaatagaaaacaggaaaaaacattagagaaaatttttaaaaagccaaaagtgctgcttaagaagatcaacaaaactgacaaatcttaaactagattgatcagtaaaagacaagataagacacaaattaccaaaatcagggatgaaagcagaaacatcacaaccaaccctacagaaattaaaataattataaggaaatattatgaacaactttacgcaaacaaatgttctgtccaaccaaacccatgcccaaaactggcagcagtggagtcccataaggagctaccccagaccatcctgatatagaagctggttaggattccaagaaagaaagaagcactgaacgctagggtgactggtctaaagcatttattaggagatcttacaaacagagggcttcagagtcctctcaacagatagagagacaggagatgttctggccaggtatgtctataatgagggagtcgggttatggaaattatatgggggattagggaatttgacttagggctcgggctagtttctacattttagcaacatgtttgacctttcagtgttttgggcaacaatctaaacaactttatcttgcctgggaatgttcaaggcctaagtgtgggttcaagcctgcagcagagagcatgcagctatgtccaggtactttatgttcccctgtcaggacaaagaaagaaagttgagggggaactgagggtccctacaacaaatgagatgaaatagataaatttctaataagatacaaatgatcaaaactgattcaaaagaagaaaaaaaaaatctgaacagagctataataaagaaattggattagtaattaaaatttttcccaaaagaaaacctcagacctagatgggctcacaggtcttttctaccattatttattctttaaatgttctacccaatgtttaaagaataaataatgctgatccttcacaaaatcttccagaaaatggaggagaaaacattttttgattcattttatgaggacagcattaccttgataccaaagtcagacaaagatacaagaagaaaattacaaactaatatccctcatgagtaaaatgcagaaattctcaataaaatattagcaaaccaaatccagcaacttatgaaaaagtttaacaccataaccaaataggatttttcctagaaatgcaaggttggtttaatatcagtcaattaatataatacatcatataaataataaatgataaaaaccgtatgattatcttaaaatagataaaacattgcaaaatatttaatacccattcaataaagtaggaatagaatgaaaattccttagtttgataaaaatgcatctatgaaaaacctgcagttaacatacatagtggtgaaagactgaatgctttcctcctgatgtaaagaacaatatcaacgatgcctgctcttgccacttctattcaacattgcgctggagtatctttaaaatgcaataagaaaaagataatttaaggtagcctgattagaaaagaggaagtaaaactgtcattattcatagatgacatgaagcagtttgtagaaaaccttgagaaacccacaaaaagcccctactcaaactaataagtgcaacaaacgaaggatacaagatcaatatataaaaatcaattgtattttgtatattaacaatgaacaacccaaaaattaataaaacaattctattcacaacatcattaaaaagaatcaactacggctgggcgcggtggctcacacttgtaatcccagcactttgggaggctgaggcgggcggatcacgaggtcaggagatcgagaccacggtgaaaccctgtctctattaaaaatacaaaaacattagccaggtgcggtggtgggcgcctgtagtcccagctactcggagaggctgaggcaggagaatggcatgaacccaggaggcgggaggttgcagtgagccgagatcgcgccactgcactccagcctgggtgacagagtaagagtctgtctaaaaaaaaaaaaaaaaagaatcaactacttaaaaatacatttaacaaaaaaagctaaagtcctataaagtaccaaacattgctgagagacattagtggagagatataccaagttcgttgactggaagacttaatatttgttaagatggaaattttcccaaaactgattcatagattcagcacaattcctatgaaaataccaatagcctttgtattagtctgttctcacactgctatgaagaaatattcctacctgagactggctaatttataaagacaagaggtttaattgactcacagttccacatgactggggaggtctcaggaaacttacaatcatggcagaagacaccttttcacagggcagcagaagagagaatgagtgccagcaggggaaatgccagatgcttataaaaccatcagatctcatgagaactcactcactatcacgagaagaacatggggaaaaccgcccctgtgattcacttatctcccaccaggtccctcccaatagggtttatggggattacaattcaagatgagatttgggtggggacacagccaaaccatatcaggctcatttacagaaatggacaagctgatccttaaagaaaaagtacagctttaaatacaaatattggaaacctcagctagctttgtttttggtagggtgctaacacttctgtggaaatgcaaaggactcaaaatagccaaaccatcttgaaaaaataagaactatgttggaggacttatacttcctgccttaaaacttactataagactacagttagcaagatagtacagtattagcaaaaagatagtcatatagatcaatggaactgaattccaggattctaggaataaattcttacatttaaagttgttgattttctgtaaaggtatcagtgtaattcagcagggacagtggtggtagggaaattggatggctacatgcataaagattaatcctaaatgttaagagccaaaattatgaaactttgataagaaacataggagaaattgttagtggattgggttgggcaaaaattttttacatacaacaccaaaagcaagatctataaattttaaaatttgatacattaggcttcatcaaaattggaaacttttgagtatcaaaagacaccctcgagaaagtgaacagacaacccatagagaaataggagaaaatatttgcaaatcatacatctgataaggaattctatacgaaatatataaagaagttttacacctcaataataagataacctgagaaaaaagaaaaaatgggtggaagatttgaatagacagctcatcaaagaagacaaatgaaacatgaaaaggtgtcaatgtcgttagtcattagaagaaatacaaattaaaaccaccatgatattcccattagaatagcaaaataaaattgacagatggtgacaagaggcagtaagaatgtggagaaacaggaaccctcatacattactggtgggaacgtaaaatggtacagccacttggaaaacagtttgccagtttcttatgaggttcaacataagcttaccgtagaatctagcaatttcattcctgggtactaggtgtctgccatgagaaatgaacccatatgttcctacaaaaacctatacatgaatgtttatagctccattattcataatggccccaaattagaaacaatccaaatgtccatcagcaaatgaatggatagtcaaatgtgatatattaatacacatgaatataaatgtgatatattaatgtataagcaatcatgctatatattaaatgtgatatattgcaaaatgttctgcaataaaaaggaatgaatgactgggacatgctacagcatggatgaaacgcaaaaatatgctaagttagaggttggcaaatgtttttttaaagggtcaggtagtaaatatttcagatttgtggacaagatggtctctgttgcaacttcccaactctgcctttgcagtgccaaagcagcaacagacagtatatgaatgcatagctgtagctgtgttccggtaaaaccttatttacaaaaacaggcagcaggtagtttgctgactcctgtgctcaatgaaagaatctggatgcaaaagaccacgtactctacgattcctttacgggatgttacattaaatatccagaaacagtaaatctataaagacagaaaaccgattagtgattgcctggcttgggggtgggaacagggattgactgcaaattggaactaggggtattttgtgggtgattgaaacgttctataattggattgtggttatgattgcaaaactataaatttactaaatatcagtgaactctgtgtgggtgaattacatggcatgtaaattacacctcaataaacctgttaaaaagaacatataatttcatttatttttgtttctgttgttttactggcttagccattttctactcatattattctcattttatcttcagtgaaagacctgttttattagtgactagtgtccatgctaacggcagtgcctagggagttttataagaatcttggaactttgaattctcttcagagcaaaagttgatatgtgttaggtgaactctttttgaaccctctcccagggatcttattataaggaaaatcctagttagaactacgaagcaggccgggtgcagtggttcacatctgtaatcccagcactttgcgaggccaaggtgggaagattgcctgaggccaggagttcaacaccagcctggtcaacatagcaggacttcgtctctacaaaataaaaaataggccgggtgcggtggctcacacctgtaatcccagcactctggaaggccaaggcgggtggatcacctgaggtcaggagttcaagaccagcctggccaacatggtgaaaccccgtctctactaaaaatagaaaaaattagctgggcatggtggcgcacgcctgtaatcccacctacttcagagagtgagacaggagaattgcttgaaccctggagatggaggttgcagtgagccaggatagcaccactgcactccggcctgggagacagggcgagactgtctcaaaaaaaataataatagctgaggcagacagatcacgaggtcaggagatcaagaccatcctggctaatacagtgaaaccccatctctactaaagatacaaaaaaattagccaggcgtggtggcaggcgcctgtaatcccagctactcaggaggctgaggcaggggaatcgcttgaacctgggaggcggaggttgcagtgagccaagatcgcgccactgcaccactgcactccagcctgggtgacagagcaagactctgtctcaaaaataataataataataataataataataataataataagtcaaccaggtatggtggcatgtgcctgtagtcccaactacttgggaggctgagatgggaggatggcttgaggccaggtggttgaggctcctgtgaactatgatcacatccctgcactccagcctgggtgacagaacaagaccctgtccctaaaaaaacaaacaacagcaacaacaaactctgaagcaagctttgtaacatcctcaatgctgcagtatctggaatcaaatatcagggactgtggttttggaggtaggtaagaaagagcttttaactgtgagcattttcttcctggcttccataaaagttctaataatatccaacctatactagagtaggtagattaacttatctgatgctgaaggaattgtccatactttctgaggattatgttgtcctaagaagaacacttatgtgtgaggttgtcactgtgatcaccggattcacaccaccgggtctgagcctcagatgggtcaaggactcaatttgaattcctgcctagggtcattgcataactagttggccactgcaccttagcaagacagtaagttagtaaagcataaaactctaggcatttttgatacataggcaagctctcctagagctgcaaattatcttgctggtgacagagttggtcatactgagagagaaggcctcctgacggctggtgcaatggtctgctgatttggtttcatttcactcattggagagcatttctgaggtatgaccttgaaagaaaatagcctttttcatcatctgggctgatgatggagaataagctgtaatgaacgacctcactgtatgattgagatgcgttaaatccttgctctccagttcttagaatcttcaggagcaagaggcaatgatgtatccctcaggagaacatgctatctaccagtcatagagtttgtatagtttgctaatattactagacattctacagctgcagaggatctcttagacaatatataaatattgtttgtccctagtgtagcctctttccagcttgtatacagagattcccatatatgaactttagtgtgcaaatgatttgatgccttgttaaaatcctcataatgaagatgttattaatataaacattgttggccccaaggaactcattgccagcctttgtcctgtatgcattatcatcttctatttaaattcttttattttgccagtcagaccgttttttttttttctgaagctacaaaagaatgatcccttgtagtaattggttctcatttaaaggggaggttagattctgccaggcaagcatagactgaggcaggcttaaaacgcgtagcctaactgttttttaaatatgggctcagttaataggggttcagcacacacaaaagatgggctcaaaagtgcctgatttactgaggaaggtactcagagttgagaaagaagcctctgcacaaattctcctttgctctgctggaatttctttttcttttctttgttgggggtggtgggggacatggggggcagtggtgagaagttgattgtgagaagtatgagtatttaagtagaaattatgcagatcagttagaaggcagacttcagccctctggggctggtacctctaaatgtggaatgtgctggggggtttttttgttttgtttttgtttttgtttttgagatggagcctcactcttttgtccaggctagagtgcaatggtacgatcttggctcattgcaacctccgcctcccaggttcaaatgattctcctgccttagcatcatgagtagctgggactacaggcacatgccaccacgcccggttaatttttgtatattttagtagagacgggtttcaccattttggtcaggctggtctggaactcctcacctcgtgatccacctgcctcggcctcccaaagtactgggattacaggcgtgagccagcacacctggatggaatgtgctgttttaattgagtgccaagacttgccagggcactgactcccttgtttgcctctgacatccgacaggaaaaaagcagctcctggtttctaagtgcaaacattgagcattgcaggctgattcctgagcactgggtgtttgtcacgtgctatctattatccattaaagtttggtttgggggaacaaatgagctaatttccgtgggaagagatttgttacaggaaattgggtatataagaaagaagggctggaggagtaggctccaggctgggcatctaggaatcacttctggaacaccgtgtgcaattggcccatcaagggggctgctgtctctgtggtggggggcactgggaaagcaggacatctctgctagaattgctggcctcaagaagacatcaaattagctgcagtcagtgatcaggaagctgccgctgcccctatgggaggctgcctctgcggaggctgcctctgtgactccacacctggaggctgccaccctatggcaggagagtcctagcctctacaaccacctgccagctgagacagctgcagcagcaggaaaatagcctccacctcacttccgtcttctgggccttgatactccatttgcacttggaacctgagttgcaggagagcctaggaagtgcgatttctagcttttgagccctcacgccccaaagtacagagaggaacgcttctctgtcttagtgctttacctgtcttcagttatgcttatgaaagaacgtccatttttaaccatcttaattcaaatatatatatttgaattaaggtataaatatattggggaaatgtgcataagtgaaatagccaaataggtacataaggtgctctcacaaatttaaatgcaactctgcagaccccccaaactcactactttacaatatcttcaggcaaagcagtttttgtgcaacatgtggtctcgctacaaaagaaacatgcaattagagggttctcgtgagatccaagtttatgtgcatatgggtgtacatcaagttctgtgcttaaaataagtggtcctttatttttctgacctgggagaagtacagatgtgatatatgtcccagcatgagatgctgtataatcagagagctagactggccactacgctgggaggcatttactcattcaagaacccttagaaggtggagaaattagaaaccacgactgatgtggtcacatcatcattgatgtgaatggaacctggtggtattgtgcagtgcaaaaattctcttacttcatgaggttagtgtgggtgttaaatgtgttaatatgtgtaaattgcttagaacagttcccggcatataataaacactacataaatattagcattgtattgttactattttccataaaatggggataactctgacttgcagacttgtgaagcttaaatgagcttagtccctggcataagtaaacactgagtgatgttagctataaaataattatagtaacaataatgtttgaactctaaaaatgatgctttcaatgtagtatatttcctaggccatttaacccagaggtcttctacctctgaagagtaagacagagctgacataaatttgagagaacagcacaaaggccatcttcatttcttcaagactgggcattttctcagcaacctgcacattcactccatgggtttagtatactttacagcctttccataggacctcaagtccaagaggttagtttacttttggaaagttgtttttctaaccaaaatgacacattcattgtggttattaaggtctctggactcaaaattgggccacgtttgatgaaaaaaaaaaaaccctcatgaagtttaagaatgaatatggttcattaattcatatttatattaaccaaatattttgacttgatttggcagaaaatatttttttacaagtatctggtagacttgaatcatttctagactgttaaatcatttcttgggaagttgcatagaaaatactttcagaatttgtggttttcaaaaaggactttgtctaatgaatagcgatggcaacacagatttaggggtggaattcttggggagcttctattgccttctggcagttgcataccaattagtaagtattggcctgatcagcaaagtatggattgtagagggaggaatgatgaaattcctctataggagttagagtcctatgtagatgaggggaagacatctaggcggggcagaagaggaacttggaggctctcaaatatgttttaagagttttcagtaatctgtgttgaaagttttcaacattgagcattgagcggccattttccactaaaacgatagaaatcgacttgttaacactttgcagagacatgaaagacaggcggagccaatccgcagcctgccagtgtggagggttccccaagggtgggacccagcgtgaccttgcccttgaacggtgggcgttttccaggggcttaaggtttcacaactgtgtacaggcctctcttctgagtcctcagttgctgaactgaaagtactttacaatacctcaagtcttgtggttacggaccctggggaggaggagatgggaagagaagtgtggtaaattccaaagcagggaggtttaggaacctcctgactcaggaaataccaaggtcttcccataaatggaagcagtctgtgttggtctatttatccacaaatgataaagtgaataaaaaatctctgatttaaaaagtaggaagaatcgaacagttggaccgagtccctaccatgtgtaaggcccttttccatgcagggaggtataaatgtaacccaatgttccaggcctccagtactggaccccaaagcgaggcccgattcttttcaattcttgaattctaataacttaatagctgcttctctcaccttgtaatcagtatggatcatcacaggaaaatccatctttcaaagaattctttgggaatatttccaagaatttccagcactgttttcacctgacattatccgcctgaccttgcctggtgatgctgctctaggccatgtgtcctgtcctaactatatcaacagccccacctgctggtcctgtgtgcctctgctgctcgtgccaaagctttgactcatctccagaggtgtttctgtgatgcccactctcttcatggccacttctggggccagtgtagatctctgccaactagcctggagctaactcgtccagaccatattacttacaccttctataagccctgggacttattccaacacaccaggccagactcctggtgcttgactctctggaggccccatcatcctttcctactgtctgacctggttctgtgccatataggtccacctgatatatctcagcatcattgaacctcaaagagacaagatgggattgtagtctatttccattcaggggccttatgtaaactcatagatgcagtcaggtgtatagaattggtgttgcctgactttactaagaaacacccaggaccaaagcaccagcggattactggggcaaaaagtaaagtgatactttacttctttttttcttttcttctttttttgtattttttgagatggagtcttgctctgtcacccaggctggaatgcagtggcgccatctcagctcactgcaacctctgcctcccaggttcaagcaattctcctgcctcagactcccaagtagctggaatttacaggcgcgtgccacgacacctggctaatttttgtatttttagtagagacagggtttcaccatgttggtcaggctggtctcgaactccagacctcaggagatccacccacatcagcctcccaaactgctgggattacaggtgtgagccacagcacctggccgtgaactttacttctcctgacaaaagcccttgtctgcttacagatactccaaggatacctaagataagcaagaaagacacagcctctattgtcacatgtgagggagtggcggtgttgaggaaaggcctctgtgcacagacgggagggatttatggatactgaaggggaaggatgggggagggacgaagggctggtaattgaggtcagcgaaaggatggtatcagatgcatggtgggcaacctgagcttcatccaaggagacactaaggaagggaccttagaggcatccagataagctccttttgtgaccaaaaaggacactgagaacccgagatgaggggatttttctaaggccgttcattgagctaagccgatttaaaaattcccagtcccttctgagatgttcttcccagctcatctttagctttccccaggggtaaaggaaaagaatgaggacgaaactgcagagagcttttgaaagaagggaaattagggtgtctcctgatccccctcatgaaatgacttcagtctttaagtcataggtggcagggtcttccccgagtgaagagacgggatgatcctggcagtatggagttaaagcatcaccacactgagctgttagcaccattgtgagttatgttacattgccctccatgggtagagtgacggatacaaggctgtcagcataaaggacctggcctgtccaagtctggtcttcccagcagaaattcctacttaacacagttagaagaactcactgtaatacatacacacagcaaccaatttatccaaggcctgttttgtatcagtcctgaggactggaggccaaccaagacgtagctattgtttctgccccatagcagcctcggatgagggggcagggcagaaaagcatcaccagtagggacacaaacaagagaaactgcaaaaccgagagattgttaaaatttgcaatcatcaatcagtcagttgttaaactaatccacttgaatagaattctacagcaagttggttagaatccgtctgaaattcttaactgcaggggtttcactgcacacatcagtgtgcactcagtgatagtggtgttctcctcgctgggctttctgtaagttccaacgcagggcacagaattgaaaatggaagcccccatgagcagctgcaggcagggatgccgtcactctgacccctcggcctctcctctctgtggctgcctccagggcacatgaggaaaagcagatgcctcccctggcaagttctgatggaaagatcaaaggtggggagtaggagcaacgaagagcatgactgaacaatgacggggtcaggccgactcggcactcagacacagcagagccattctctggagagactcttagggtggtgctgctgggactcacaggaagacttcagatcttaaatggatattctgcactgccagacaatcctagtaaagtcatgttcctacactgccttttaccctttaccgccttcccctcttctcagatctccacatccccttgcaggcttggctgatgatcttgtctcatatttcacagcaaaagcagatacaaatggtcaaggatgacctcttccctccactgatttcgccagcacactacacttggtctcagcctctgccctctccccgaggctgtggagtaatcatccccacactgcccttgggtcagcccctccgctttgccccatcccatcccttttcacctccttaagaactgttctcctgcagttacccttttctctattgacatcaatttccccctttatcaatcattcctatagcatgccagcgtctttttttttcttctctttttttttttttttttttaagacagagtctggctctgtcgcccaagttagagtgcagtggcgtaaccttggctcaccacaacctccgcctcctgaattcaagcaattcttctgtctcaacctcccaagtagctggggctacaggcgcacaccgccacgctcagctaatttttgtacttttagtagagttggggtttcaccatattggtcaggctggtctcgaactcctgacctcaggtgatccacccacctcagcctcccaaagtgctcagattacaagtgtgagccactgcccccagcaccggtgtcttaatatcacccattttaccagctatggctcccttcctctgcttcttttcaaagcacaatgtgttgaaaatattggccatacttaatgtctccacttcatcaccttctttttcccctcaatttggacttttactccgtcactcttggaatgactgacccaggtcactgacaaccgatagcttgccagagtcaaatccaatccccttgtcttactcaacctctcagtggcatttgacacagcgatcacttcttccttgttgaaatatttcctgtcctcttgggttccatgagactaatgtgcctgggtttccaggacttgctctcctccttcttttggtctgctttgctggctctttgaccaatatctcctggttgtggggccacgggctttgtctggtacactctgtacctatgtgagcccatccagacttctgatttttaagtactgtttaaatgctgatactctcaatttgcatttccagtgtgatcattagatgtctagaggcatctcacacttaactatgtctaaaatcaaactcttgatttcctccctcaaacctgcccttgccccatctcaggaagtggtatcatcatctacccagctgaacaggtcctgaacagtggagccattcctgattcctctttccctcagaccttaaattcgtttttgtagggcttccataacaaagtacctcaatctgggtggctaaaaaaacaacgatttattttctcactgttctggaggccagaagtccaaaaccaaggtgtcatcagggccatactttctggaggctctgggggagaatcctgccttgcctcctcctagcttctggtgtttgctggcaatccttggggttccccagctggtggcatcatgactcccaatatctgcctctttcatcacatggtcttcttccctctaggtgtgtctgtgtccaaatttccctcttataatgattaggacgcaccataatccactttgacatcttaacttggtcacatctgcaaagaccctgtttccaaataaagtaaccttcacaggttctgcatggatgtggatttggggagaatactattcaattcagtacagaccttcagatctgattgatcagcacatcttagcccctccatcaccaatgattcttaccatctacagccacagcctttgcccaaacctgcaccacctgcatcacctgcaccacctgcatcacctgcatcacttgcatcacctgcaccacctgtatcacccataccacctgcatcacctgcaccacctgtatcacccataccacctgcgtcacctgcatcacctgtaccacctgtatcacccataccacctgcatcacctgtaccacctgtatcacccataccacctgcatcacctgcatcacctgcaccacctgcaccacctgcatcacttgcatcacctgcactccctgcaccactgttatcatccacaccacctgcatcacccgcaccacatgtatcacccataccaccagcatcacctgcaccacctgcatcacctgcaccacctgcatcacttgcagcacctgcactccctgcaccactgttatcacctgcaccacctgtatcacctgcaccacctacagtatctgcatcacctgcatcactacctcactcttggcctctcctcgttccactttgcccccctccagtgcacactgcacatggcagccagagtaacctttctaaaatgtaaatcagacaatatgattcccttgggcaaaacccgctgatggcttcccaataccagagaataaaattcagctatttaaactggcttaaaagaagcttggtgattttgtctactctctgactttacctcccttttcctgttcccatgattcctgggctgcagccatactgggctgcttcccatccctccatcaagcagagctgtcccagccttttcaatcactgctccttctgcttgaaacactcttcctccaaatctccacatgactctgtctttctcttcattcatgtcccaactcctgtgtttctccttagaaaggccttccccagcccgagctagctaatgtgccctttctctcacatgggcctagtcaccctttttctgttcaatattggaatttaccttatttatttgcttatagataataatagcacttgtatgatttattatttattatgtctgcctcctcccagtagaacataggttcctatgagcagccaactattttccttgtccacaaaagaaaactcctacccattgattggcacaaaaatgctcagtaaacattttgtctgaccaagctgggctagctttgtgcttcctggtttccgcccttcctcccacccttcctaccattcatgttgtaatggtaaagcctactgtgtttagacattaaaacctttttgtataaattattatatattaaaaattgaggagaagaaaatggcccattttcatcctcccttattaaccatctctaaaattatctaatttggcttctttggaacatctccactaattcggtggccatccccctctccttgcatacgcaggcgcatgctcattcacaactgaacacactttaaatgcaccctccctgataagaagctaccactcactcctgatcccatgcccatggaaaagcatttctaggtgtgtatgtaggattttgtagaaagaaatacagagggttttaaaaatcgttattattttggtttgtggggaaagtttgcttaatgccaagggggtgaatattgtttcacatcaggctggagtgcgacatcttatccacaggaggtaactaatgccccatcaaggaattcaaactaaagcacacaaaatctccctcccttcactttttagatagttggtcacaaagttgagcagacaagaaaattatcagaaaattcaaagtgtgttccttttgtgtttgtgtgtgtgtgtgtgtgtgtgtatgtgttctgcatattaaccatttctagagcatttgctgtattttcaaaggcctttctgagtaatatggattttgctgtcaagaaactctgacctggagtattatatttcttgaatttttagagcactctattttaattttccaactggttcatgttattgtctcccacaaacatgttgtcacctttctgcttctaacccatccctttccttcttgccccagacaatttctggaagtctttaaactggctcaccctgtggcttcacctcacactaacccctgtctccattctcctttggcagaagtcaccttccgcctttttcctggcagtatattcttgttgcatttctatacgagcataaaagctgatgacagcagcgatgggagggctgataattacatagaaccaacaggaacaacttgctgctcctcatgagttggcacgcaggtggtatgtgtcagtgggaggagcctgcattttagaggcatttatctggtcataaatcctgggttttttttaccatctgtgaccttaggtggatgttggacttctctgaggctcagtttcctcatctataaaaacaaggaatatgtttttatggaattatgggaattaaaataaataatacacaaaggttctcaataagtttcattttaaattcaatatataatcattcctttaagaatctaaacaacacatgttgtttaaaaaaactatgagaacaatttaattgacagttttaattactgatttccttgaaagatgaaagcaaagatattgattttaccattcttcatgtatttttcatcacaaataatgatagatctgctgagctgctttccctcgtctacaaggatgtgcgtgtgtgtgtgtgtgtgtgtgtgtgtgtgtgtgtgtgtgtttattgttacagttaactgcacttagagaaaatctcaggttaacctgagtaaggagatgaacttaaaaactgaaggataagaacacacttatagaaaggtaaaaacagacaagcaaatccactctgaggcatatttgttcattgcctcattagcatcttgccaatgacacccttaagaaactgccccttcacattctggccatgtgctttgtgtgggaacttaccaccccttatccctaccattgtcaaatgatgagtttatagaaggcctatgatgcagtttatgtcagcaaaatgcaaggatttgtttgggggccctcggatagaaacttcctctatcttcagtggaagtttccagaaagaatgccctctcatcctctggatgatgtgtggtgagattataaaactagcaaagccttacccatcttttctgcttggcagtgagacagaaatgacatcatatgcttctgaatcaaatgagatctgaatctagaactatcactgtctccagatatgtgaaatggcaatttcctttctactccaagccagtttgagttggattttctgtaccttgaaaacaaaagattgccaactgtactccattaagatagaagcagttaggccgggcgcagtggctcatgcctgtaatcctagcactttgggaggccaaggcaggtggatcacctgaggttaggagttcgcaaccaccctggccaacatggtgaaaccccatctctactaaaaatacaaaaaattaggcaggtgtgatggtgggtgcccgtaatcccagctacttgagaggctgagacaggagaattgcttgaacccgggaggcagaggttgcagtgagccaagatcgtgccattgcactccagcctaggtgacagagcaagattctgtctcaaaaaaataaataaacaaataaagatggaagtagtttagaagcagttgaatataccagcagattactacaccaaatgtcctgccctatccagactaaagttgagcttccataatcctaactgttatcctaactcatctctccagaaacagtatgtcaattcatagactcagtgaacactgttaccatgatgtatgtatggaaaatctgcttgtctgcactgaccagctattttcagtttactagatgtgtaaccttaaacaagttacttaacctcatcatgtctaggaaaatgttctagattggttcaatgggcaatagggagacatgagaagtacttgagttggaggagtaacaaattaaaggggtatttgggaagattattctggaagagataggcaccttactcatttccaaggttttgagttttgtaaatttggcgtcttacttgtttgaagcccatctcctcctgctttatagagaaaacttcacgagagcagggagcatctccctttgttcactcagcacctacacagtatctggaacatagtaggtgctttatagatactgattgaataattgaattgtggatagaaggaaagtgtaagaacagagagaatgaagaaaggaagaatatctcggagacaataactgaaacccatatgtgtagcacacagcatggcagcagaagaatggaaaagaagggataaatctaacaggtgctaccaaaagttcacagaatttattgactgaatgagaaaaaccaaggagagacaaagaagagtaaggtgtcccacctgagaggttgaaaccatggctatcccatgaagtcaatgggaaagttagattggggagcagttggaagaaaagacacatacacttggtttttagatatgtttcttaggagaggagaatgtgtcattaatatggacatgtctaataggaagtttgaaatgaggagtttggggtactgttggaactggaggtgtcaggttggaaggcatagaaaaaccacaagatagggcatgtccccaagagggtgagaactgaatggggacaaccctagaaaagaggaaccaaggaatcaggcagaggtggagaggctggagggtcagggagagaatgaagagagtgtttggcgacagagcaaagcaggcacagtgacaagaggagaagcatcttctgctttttcctcagcatgtttcatagcaaagcacaaacttgattacccaggatttcagggaaattaatgcagattctttaaacatagtgctagtaatcagattgtctatatcagtcacttttaaacttttttattgcaatccacactaagaaaagctctggtccacataattgtcacataagaaatgtgatgagtttgggaaaagagcacattttgaggaaatctaagttcccattagacaagtaaaggttttgccttaaaatccatgacaatatgaaacatatctgtctatttaatagtggtgtcatgctctcacacttcaaaatttagaagagagatagaattaaaaggaaagcattttctttctccaaatagccaaatagcgtcttctctcatacctttaagtgttggtttactaacttgcaagagaaacttaaggcttacactttggatcctggcacaggggtgtaattaagagcactctagttttagaaatggacagacctgggctcaaatcctggttctcacacttcttagttctgtgacctttgccaagtttcttagcctctttggtttcctgtttctttgcttgcaaattgggataacaatgtttaacctatgcagttgctcttatgttgaagaagccgcattacttatggtactatatttagcacttggtgggcatgtgatgaatggcaattgttattattgccttggttgtgagggttaagttatagaccacttgtaaagctcatagcaaagcacctggcacaaagcagcaataaatcttaatgatctttccataacagcaaccaaagagtagaaatccagttgtaatccaagtgcacggtagtatacaaaccagttacatgcttttatcttgcctacagttctttagaaaaatatctactggggctgggcgcagtggctcatgcctgtaatctcagcactttgggaggctgaggtgggcagatcacctgaggttgggagttcgagaccagcctgaccaacatggagaaaccccgtctctactaaaaatgcaaaaaaattagctgggcatggtggcgcctgcctgtaatcccagctactcaggaggctgaggcaggagaatcacttgaactgggaggtggaggttgcagtgagccgagattgtgccattgcactccagcttgggcaactagagcgaaactccgtctcaaaaaaaaaaaaaaaaaaaggaaaaagaaaaatatctactgggcaaagcaaagcacattgataacattgatgctgttggacagattacgtcccatttgtatgaaatgaaaaatgatgcatcactgaaatggcattcttaattcctaatttgtcccaaatgcccttgggacaatttagaaatgccccaaaccagatgtcatctctccaagagacatgcctgtagcagtttgatcattttttgtaaaagggggtgctgtatactcattagctgtgattgttttaactgtgctgtcatgtgtgaagctgatcgtgcattcttgctatgacatagacatcgaggtccatgccaacatgcttccaatcagacatgcccatctcaccacttttcacagtctttaaagctatgtgaacaattttctacaacttgccagagtgtctgctgcaaaccaccacctaaatggggagctccttggacaatatattttaatttaaatatggactacactgctaattggtggcagtaatcatgtggaagccattctctcctaaaatcatagatccacccccaagaagtccttgtaccattttctggaaaagaaaatagcaaatatttggggggctttagacatctttgacatgcgcagcataacccaattctccataatccgggagaatctattgtattaatatctcacatgtggaatacatactgtatgtttaaattagagctatctaatagttctcatatctgaaattcttggcggtgatgatggaggggtggggtggggagcatcaggttcctgatccctgtgcctactgatcattgcacatgtggacggtttgtgcgttttataattttggattgtgagctcttcttcaagggctttctccatggtgatcccagtgcaggctgaggtatgtgttcctcggcagaggttttgcatgtgcttttgttggggtcctcagggtcatcattggcctaggccactttttattttaacttctcattagatgggtataccatacaatagtgattcaacctgagcctctggcctgcaggaagtgggctgtgattatctcttcttgaggagaatgtttccaccctctcccacaaccccactgaggcagaggcagacaagtttcttagtagtctccttttgcaggtaggataaattttttccctgttacgttcttttatggaggggtggtcctttgagagttccaggtttatgtgggcgtctcagttcccatctccccattcccacttcatgaaggtcctggggcttcttctcctgaaccatgtggatgttacaatcccaacaccatgctactgatagccttccctcccctcagcacagccagcatcagttcagagacttggttctgcttttcagatccctctgtgtgtttgaccatggaaaattccttactttcttgagaactcagctatgcatttagaaggatatttgttatattttactcagaatttctgtttttaataacaaaagattttttttccaagatacttactctgccaagaacacatcatcaccatcctctgacagaattaaaatgtccactggtgggtggaagatgcctgtctacattcgaagaggagtaaggagaaggggcctctggcctttagaaacttagagatttttttttttctcttaactcactcgttagctccgagaattattctttcagtcattcactcagttatccttacagtcatatatcatgcaatacaacttagtaagttcatactatgtaggctttcatttttctgcaaatgtatattgtatacagcttctgctatgtgccagacaggtgcttgtgcccagtaagatcatactagatccctgtcttcatggatgacacaaatattaatctgataatcacatcaataagtgtacaatttcaaatgtgctaagtaccataaagtagatgtgtgtggtgccgtgagatatgtaatgggggctttgtccaattcaggctggaaagcgctcatttggagaagtgaaattggaaacaaaagtggctttcactaagtgaaaagaggagtgataattgtttcagatatgtagcagtatgtgcaaaggccctggggtaaggatgaatgactaaaaagaagtgtggtgaaatggaagaaggagagaaaaatatggtttcagaaaagactgagaggagctagggctaaaccaccaaagaccttgtagtttgtgttcaggagttttgtatttatcctaagagccatctaaagagctttaagcactggaacaacacatcctaattttctttctaaaatcctaaagatctttctgacttcagagaggaaaacaaatttgaggaggcaagagtgacagtagagaccagctgggaggctgttacaggagaccagaggctattacagtagacagagttgctggtagctcagccccagttttggttttgtagatgggaagacatgggacagatttgagatttatatagcagataaaattattaggaaacagcataaagataggacaggaataattccaaagtttcaggtttacataactggagggagggtggtatttctttactgagctagggaacactagaagaagacaaagtttggtgtaaaggccattggttatttatttatttattttttggacacatcaagtttgaagtgtgtttgaaacatataacaggaaaatagaaagagacaattggatattgcgtatatggatctggaactcagagaagagatctggagatataaatatatgactaatttgcttgtaggtaatcatttaagtggtaggcctagacgagatttcctagggagcgattatagcctgtcccctggatatagggacatgaaggttattggtaggaccttaaatgggagctgttttgtcgctgagatgggataagaagcttcgagtaggatgtagagagaacaggaagtgaggaagttgaatcagtgagtatagacaacttttttttttttgagacggagtctcgctctgtcgcccatgctggagtgcagtggcgccgtcttggctcactgcaagctccgccccccgggttcacgccattctcctgcctcagcctcccgagaggctgggactacaggcgcccgccaccacgcctggctaattttttgtatttttaatagagacggggtttcaccatgttagccgggatggtctggatctcctgacctcatgatccaccgccttggcctctcaaagtgctgggattacaggcatgagccaccgtgcccagcctagacaactctttcaagaggtttgccactgaagttatgtaaggctttaattgatgtttaaaggaaatgtgatttcattgtgattggaaggcagaatcttttaaaacagtgtgtcagtggaaaaatattaaaatggtttcttgataatgaaaaggtagccaagatagagacattagccagcacagagaagactcaaagacagtgaatcaagattgatttgtaatcgtagctaacatttattacagtctcactgctgtgcaagtgccattttaaatgtttagcatgtattaaaagtcttaatcccacaacaactttatgaggtaggtacgcttattatctcatgaggaatgtgggaaaccggtcaccagagaggcaacctaacttgccagggtgggagaacagtgatttaagagcaggcactctggttgtggaatccatggggtttttgtaaatttcctttttaattgacaaataatgattgtagatattatattcttatggggtacaatgtgatgctttgatataggtttatgtcgtggaatgatcaaaccgaactaacagatctatcacctggcatatttactatttgtgtgtgtgtggtgaaaacatttaaaatctactcttgtagtattttttaaatacacattcttagccgtgatgctgtactgcttctcagtacagggatgcacagtaaagtgtttgaatcatccataagccaagatatggcctaattcatctacagatattgaaaatgttatcggttgtgcagttactgcgaggcaaaagtataaattaatgctgactcaaatacttggttaagattccttcttggctttgtattatagagtaagacaggcataaatggaggtgtcaggagagcagctttagctttaatcagtggtcttcaataaatatgtgtgcattatttatttaattgcacctgtaaccgcacgagggccttgctgctgagagagtaataggtgagcggaattcacaatagtctgaagccacgcgcacctctctgccaagaagtgtcatctgtgagtttcgttaaccaatgtcctaaaatatatgaccttttccaggtccctagggagtggctttaactgcaacacgtgtgtgtttctttttctcctaaggctttaacaacaccgagagaacatgtgataaagagtttattatacggagaacggctaccaatcgagttctgaacgtcctccgtcactgggtctcaaagcacgcacaggtaagtcagtgccctcattaattacttgcaaggattttttaaaaaatcatctttttaagttgtgacacatgtaaaacacctccctactctttggagttcaatgtgaaaccttgacactggaacttaggaagggaagaaataggctaggcatacagatcaaagcagacacaagtgtcttgccaacatccactgtttcagatctgcaaatgacgtgacacagtgaaacggggctcctctgtccctgcagcttctgaggaaacagcactcacccatgggcacctgagccacaacaaggcctctgtgctgtgccacctaccctgggagcacttttcacagggtcttctctgtaagtggagctatgcttgagaggctgccaactgcagtggtatccccgccccccacccagctagacacaaacctcacggtcccccctggaggtaaataacactctgggatctggtcagggagtgctttctgggcctgattctggagatattttgtctcatgcccgttgatgttttgggtcccaatgctgtttttaaattgtgttacactgacaggacacccacttgttatctgtttatgtgttttcagtgcacgtttgtagaatttattcccctttcacaaaacaagtcaggtgccactttgcccccctgatgtgatgcatgcataatgcttttcttacccactgccacataccaggcaggccctcctggacacccacctgcctggcaccctgcaaggagcatttgagagagagaatgggccctgcctggctcagagcagaacatgtgcagcatatattaaaagaaatataatcaaattgtcagtctgctaatgagaatcgtgtgttataaatggcactcccatgggtaggtattcccaggtctttattattaggttggtgccaaagtaattgcagtttctgccactatattcacagagcccatcacatgtctgctgcgtggtcctcggtagtgacagtctgttcaatagggtcaccatgagggcaggctcctgaaacccctgtggtaagggaatttactaattaggaaaagtggcatttaagcctcaccacaagtaagcccatagaagttcttaaatattaattaaagtaataaagatagcatactaaataatgtaaacattccatcttacacatcttaaataaatagaaaaaatttaatcctctatgattcaaattccaagaaccatccttagtgcatgagaaatgtctagtctcttttccctgtagtctcagtgagctgctggtaaatccattttgcctcactgcagataaaacactataatgagttttagcatttacagtttttccactgtctgatggtccatcttattcctctctgattttttctcaagaatcttgacagttaattcctggggcccacagtggcttctaagatgcaaagtagctttgcatcttagataaggctgagctggttctctcccctggcctcagctcccctcctcccttccaaatcttctccccagagccctccagccttggttcccctattcaccttacttcccttttctcaatccccagtgccctctttttctaattatctcaaacaggaatccctcccaattcacatataatttttacagtagctacaaaagtaccacaaagcaaatgacagaatgctgggagttttttatttttggtgaaaaaattcatagatggggagagattagtgtatggaagccctttacaataaagagttttacagtaaggtttgccacctgatttggcagctgaattgtttagacggttcagctgcgttgcgacctgagtgactgcagctgtgcttatacatgagcaagcttgtccatctccaattccagttagagggatcccagctcctcagactctccctccagcaggggcataggtgagtgatgtaaatagctcagggatccagtcttctcttctgacctcaccattgggtaaaatacagaccctggctatttcgttcactgatgtgcccaaggaagttcttcccataaggtctttccttacctcccctgcatgcatgagtgggcctcagggctctatggctggttatcaatgccctggtgcaaccttgtcatgtgaatctcctgtcaccttcctcatcctctctgtatgagtacacgaccgtgtgcaggacatttctgtgaaatttccacttaatgggaattgctttagggcattttttttcttttttgctggctttagtgtccagattccctttcttccttttactgactcacttatggctgcccagtaatcatttggcctccacaatgggtggtttgagcaagtcaaggcaggctcttggtgatggattggtaaatggttcgaatagacagagctgctctcagctcacacagtcttcgggcctcattgtgtgcatactgcctcctctcaccaactgtgggcctagcctgggccatttcattcagaagatgtgaaggtggccctggcttcacagagcctaagcaagctgactgttatggtgctttcagagtaacagcccatcttggtatctttatccaagtttatctgcaggtctttactctcccaaggcagcatatagctatagatgggactgctggtctgaaaacgtgtgctataatccagctgtcaaccaaccctcacccttattgtttttggttttcacatcataaagcgaagggcttggatacgatgatttttaattatctgattcactttgtactagttgagtccatttaaggaagaatatagcattattgtggcaacctgattattttgaatcagtagcttttaaaaaatgagtaggaagttgtactcatctcaaaactacagccaagcatggtaacagttacattttttctcacatggtgaactacccagggaggccacttcgatttctagaaacagaaaagctgtagatccacatcaatcaagatgtagatttacccacagatctagagaatcaaggctgccacagagtgttcgacatcatctaattatttctcacttctcatcaaaggtaactaacattggcagatactaccttgagctttattcaggagaattaaaaagttgcagaagtgtggggttaggggttggttctccagagaaataagaatgccccaggatgtcacctcctaactctaccccatgtggtgctaggatagcatttcatcttctggagccttctagttttttctttagttaatatttggggaggctaggatgttccatttttagggggttctaaaaatcttcctatgtgaatacattctggcctattgctcctgattttgttataccttctcactatttgttgccttttaagttgaaagtgaagccacaggcccaaactgggtttctctcatgtgccttgtctatcaatcagcagagggaacagcagcccagagtcaggggaccagtgttcttactccagctctgccaactgtagctcctgtggggccccaagctggtctctccacctcttcgggtgttagtttcctcttctgaaaatgagaacaaccatccctgctttacctctcccaaggatgtgatgaagttaaagatgatgctgaattaagcataaagcatgatattgatgtgtgtgatgaaatcccttttggctatggacaggagagatgcacatttcatcaccctacaaccagcctgtaagctccttgcttgtctcattcatctttgcatctcctttcacatagttctgcaatgctgaacacatggcagatgcccagtaaatacttgtcaaattgagtttatagtttaatgtttccactgttcattctctcctggaggtcattttctagcctttaaagtttccaaagtcagcccagacagagactatgatcactaatggatcagaaatcagggccatgtgtttagacagtctaagtaaaggaagtgttttcattagaggtctacatgcttcttgagcatctcctgctgggaggccttacatatcgtttacacaattcccaggtccctgcaggtttcagacctgtagtgctattaaccacatgttcccgtgattgcttttgtcctctgcgcgcagacagatggatgggggctggctatagacatttcagatctgtgcacaagactctgtcgaaggcctttcacgtatgatctatagcaatttttgttttcctcaattaccgtattgaccaaccaattctgaagagatgctctgtccatttattcgaggaatttcacagaccatgaatgacgctggtaaaagggctgcagctgtgtctgcagattaccactggcgccatcaggctctgggtactgtctgaatgacaagtggccgagaatgaaacagtcacatattttcttaattggaggcttaggggcatgtttttaaaacatgagatcagacaaaaatgacctacctacataaaaatctcctccccaaaggagtttacagaggaacactgctactcctttttctgttttctcacctccttgattcattcactaataagaattgggcaccagaatgttccagacattggggtaggtgtgggagtgaccaagatccaggcagtctctgacctcaaggggcttccagccattgggaaaatgcccactaacagccactggacttaacgtaattatgtgtgtggccggctgttaaatcgaattcttcagattgtttctgacgttcaggcagaggaccaaaggcacaggggcaggtaaaataggtagcagcaacagcctgcatggccttaatggagtggctcggccacctaagcaagaccagctaagagctcgtgaaatcaatcctgctagcaattgtgatcacccacctgtgggaagttgaggtaggagaggtcaaggagagggagatttccagagagaggcatctgtgtaagttccctaccactatggggaaggtggggagatgcctccttttcacttctagccacatgggaaatgcttcaaggaaaccatccagctagcctccgtgttaaggtgaaaggtgctggctgggcaaagtgaagagtggtggatgctaggagtgagctgtattcatatgtgtttgagtgaaccagatgggtccatggggagtccaatctggatggccctgcatcctgcccaagaggacggcctggaggggtgacgcgtagacagacgctgggtgaaaaagaccactggcagcccagggcctgggggagttgaaaatgactcacaggaggacagacattgccagggtcaggggagctggccataagtctcccacagagaggtctccaaaatctcaccaaagtgccccacacaggaaaagctggccactgcccacctgccacatctagagagagccagggctgggctccccttacactatcatactaaattattgctttcccctggacctgaggtacaggatcagaagcaatagccagctagtagagaggtggtggagacagcagaaagggcctcctgtgcaggccactaggatggaagcagcccacgccagggctagagggaggctggactgaagttttgaagaatatactgaactggacattttgactgttgaaatgacaccattcttataagcaaaaagtactgaaagacattggtgcctgcccagaactccatgtcaggtggggaaggataggctatcaactggtttactgggactggcaagaagcagtaatgccatttgatgattccgttattacttatgatacagggagtctagggtcccttgggagagcaatttcacaaaatctatcaaaatagctcagctgttatatttctaactcactccagttctcttacattcattttatggtgaacaaagagacacatttttagctaataatgaataacttgagtttacatttcagttaacatgctttttggcatttttattgaaatatcacataccgcatataaagggcaataaacttcagtgtgtaggtcagtgactttctgcctctgtatacgcccatgtaactgccacccaggtcaagatctgggacatttccagcacctgagaggggcctccaagtctctgcccctcttcctgttaccccatgctctattagttttagtattgttcccattgacattatgagctttttatatattcaggacaaaatcctttatctgtcaaatgatattcgtttctctcaatttgttcttttacatttagcattgcttatggtatgttttacatatatgcacccttttcccattataagagggttttatatatactctatcctataaacacagacacacacacgcgcacacacacaaaacagagtccttttcactctttcattaaaatatatgttccctaacactgtcataacacaattaacaaataaatatagtctgaggtagaagacaggaattagcggatctcacaaccacactctagtcactcatagcagctgaggtgagaatttttacgtctccaaaaatcacagtaggagttaaattcagtcctcatgtgtctttgtagcagagatctcagagctgggggtacttcgaatcctgttggaggtgtgaagttagggtgatcttgatggaaatccctgctctggcatttactggctgtgtctgagcaaactatttagctcctccaggcctccatttcttcatctgtaaaaatggggattaatgccactttttcctctgtgggagggtgaggattatgtgagttaaaacatacagagtagccattacagatggaggctcaaagcactgcagatgctgctcttgatagagataaccttgtgaaagcggcatctggtccaaacccagaccttcaagcaggccaaatgctgttacccccgtttgaccagtgaaccacctaagtctcaaaggggtttagtcagcatcgcccaggtaaacttgctgtgatggtggaaatgttctatgtcatggtgcccagtacagtagcctctagccacatgcagctaattgatcacttggaatgtagctagcatggctaaaaagctggagttttaatgttattgaatggaattaaatgttaatagtcccacgtgactaatggttacagtataaacagcacagttctagaccactcaaaggtaccatagggaaacagacccagctgtcaaaattccttccagtctcccacagtgcctcattcctctgaaacaagaacccgaccgggtggtctccacgatggctccagcaataagcctgctgaagggggcacacctatattaggtttgtggagaggaaaacaaaacctttatgtaacctcagagtcactgttatctcagagaagaccatggctctttcccagtaaaggaaccaaccaatgagcatccgtctgctccacagaatttaggttttggggctgcagtcccagatctgaggtaaagtggggacatgccctctgacttattaaggtggaaaagtgtgtgacggtgtgatggcctctacttagtgtgctcaaggtctcagggatcagattttcccagaatgtgagtggacatagttcatctcttccgtttcttattttgacagatgacaggggcggcttctaaatttttttgttgactatttggcattgcctagtgaaacacaaaattcagtgttgaattagagcactgagttcaggtttgttcattgttcttgttcattgttccaaatctgaaatggaggttgggctaggacaaacacagcacagaattttcggtgtgggcaggagaatgaaaagtgaaagaaacaaccagctattgagcaggcagctgctgtcacctctcctgacgttcctggcctgctgctgtcacctctcctgacggctcctggcctgcttccagccctgccctcctcatccatccgggctcgtgtcagttggccacagggtacttttctgtcacactcctggcctggtctctgccccttaaagagcggatcttctcttccatttgcaaggcaatctcagcatatgggggcctgacctttgagatctttataggagaaagatgcctctctgctgtgaatagggcttttgtccccacttcctgaagaagttcaagactttaaaagcccctttccctaagccttcaccatggctggatgagacttccagtgcagaagtgtgtcactaggactctgagcaaggaggacgaaccattgaattgcatagaagtcatctaggagcagcctgaagtttggtatcggtttagttatgatatggggcacatggtcttttatgggtgacttgagaacctgattcttagaatgaaggtaggtagcttcctctgtgaagatggattctgaatgacagaaacccaatttaaaaaaaaatactgtatcacttactttatatcagacactgtttcaagttgttttcaaatattaagtcacttactgtgactccactcgtttgagggagaggaggtcgatgttgttattaccactgctttacagatggggaaatggaagctcagactgaaccatttccctgaggttccaccgatagcaaatggcagcagcaggtttcagtccccgccgtctggctgcacagtttttgccgggaacccccaatcttgcagcctctccatcttgcaggccaactgttgagatgcagaccgctcaaaatgtgaaacataaaaacccgcttctgactcaggacagtgagaatagcacatgtcaacactgccaatgctttccctgtttctcaatctttccttaggaaagttacttttgaccctgagtctattttgtgttgctcaaaggatttgtacttgctaaaggctggtgcagggaggagtgctgtgcccctgctgacaaccactgcacctcccaggctgagatggtgacagcagacgccccggccagcctccccaggccacctgcctgcaggaagtacagtcagagctgcccgcggtgaagggccaggaaacccccgctgttcttgaagcctcaagaccccagatatcccaccttgacaagtgggtgagatgctgcccactgctcaggcaccacagagtgccacgaggctcctgggcatgtccccagctggtaggactgatggggataccaggaataagaagataaaatttggtctcaatgtgaaatgctagcagctatgagatgtttttaaatgactaatgagttgtctgctgcttcagccttgcaaatggtgttttatgttttttttgttgtttctgtgtgtgtttcttttttttttttttaagagatggggtcttgttctgtcacccaggctggggggcagtggtgcgatcgtagctcactatagccttgacctaccccttgcctcaagtgatccttccacctccgcctcccaaagtgctgggattacgggcatgagccactgtgcctagccacagataattttatacaatcaccatgtcagaggataatcgatggcctatatactttttttttttttttttcagagacagagtctcgctctgtctccatgctggagttcagtggtgcaatcttggctcactgcaacctacacctcccaggttcaagcaattctcctgcctcagcctcccaagtagctgggattacaggcatgcgccaccacaccaagctaatttttttgtatttttagtggaaacggggtttcaccatattgacgaggctggtctcgaactcctgaccttgtgatccacccgcctcaactttccaaagtgctgggattacaggcgtgagccactacgcccgacacacttttatgtcagtctcacccttttattatttatcagcacccattcacttctagctgtcgacactgtcagcctctgcgtatctcagctaagagatcccaaacatccaccaggcacacaccagtgtttgttcacaaacagattccccatgacagccgcccaaatgaaatagagaatgctccgtttaatttaaataggccagcaacttcagttccttttggccccttctgatttcctggacacataggctgacccttatctttacggcagtgctgggtcctgctgtaatcttttactgaccgctgccctctccttctcccctcagaacagatgccttaggcgtcacatttcacttcagttcttcagaggttcctgggtcaaaaaggtctcagatgaggagagaaacctggaaacttgcacactagtttggattccattgttagcttgctagtttccacatttgtaaaattggcaaaattatctgtgtgaagttataatgcacaaatgaattatttgtcatatctctctggaaaatatgaaatgtaagaaactattatctgataagtatggattttcttttcttttttttaattccaaagatagatttttattctttttctctggtccaggcaaacaaccaaccaagtaagaaaatcctagttccttgaactatttaccaaagttttttcttatttttatacatccctattgttatcctttaaactctccttacagtgagacatttacagcaggatttattaagctagcataagctagatttaagcttttaggaagtgtgccttcaatggcactgattttccgttttcattagctgccgaaacagaaacattttccccattgaactagtgggattccttaaccttttgtggatggatttcgttgatggaattttatgtacttcgatagcttcttatctctgttgtaagagttttctgatgcaagtgccatggagagcccttatttttcctaatttgtctccccactcttgtaatcactcttggaccttggaagcatttctggagactgcggcatgcaaccctcagcatggggaacaatgatcctgacatcacctggtccttgtttgatccgaccaggcctggaccagtgctctccatcacttcagagctgcctcagaatgccaagagctgacttaacatttgtgttatcaactggttctcaaggccccacggctctgccttgcttgttgcctttctctttgtgttcctctcctctccactctgctctcagatgtcattaacttatagctcccaatctctttgcataaagtctctccttgggtgaatgtcaaagatgctacttcctgtaactctaagtgcatcttctccttggggaaggaaggatgcacccaccagctttctttgtcagtctttttccctcctatggatcagggtaaaaagaaaagtataactaatgactactttctagttatattagagttaaactcaaagataattttgttggcagggggcattacttaagaaagttaaatacagttttaaatattggcaataaaaggatgcccttccagacttttcattttccctctggtctttgtcattttcttgaaaatgacaatccatataaatttaccacctacctaatggaaaacacagcatctgaaaaaaaaattctctttttttctggtaaatgctttttaaactgactgattcccttttggggcgtaaagatgtaagcttggaagcgatctgattccggggttgtggggcagtatttaaagattcctgtatgcacagctgttcagaactaggggctgaattttagcagtcattcaaatgcagagtcatttgtcagcaaatgatcaaataaatagttttctggatgggttttttccttctcactgaattagtgtcattcattgccatttgccgcttcccagttatttttgttctaacatatcttccacattttcgctgtgccttctccccgtagcctcccacttcacatctgctaaactaatttcccaaaccaccagtttaaaacttaggtagcttattaccacttgtctcaaagtcaagtattctcccccatggacttttatgcattcattctacaaacgtttgagggctgaccaggagcaaggcacagagcttaccagatttggggtttaattgtctgtgggttttactacctgaaacataagtccccagatgattgtcaggcatatattttctctacattctgttcctctttgaagattcaagaacctactgagtagttaatgactagtaagtattgaacgtgtattggaaagtttagaagtactgtcgtattgctatgtagggtttaattccaaacttattgcccttccttatgtttttctattagaatgttctttttcatcgtgtgaacaatgaggcttttaaaatatttttgtagttaggcaatggaaaatgccagaaaaccctaccctttcacttttccagcaagaagccctgattcagagtccctgttgccccaaggtggcgccgacgcaggcaggccagcggtggtggccggtgagcaaggcgagcgggtcccctgcagaggctctcatcccaggttttagccagcacaatctcccctggaagagggtttcaatgttaaagttttgaataaggtctcttctcctcagaagagttgaaaaccaccttggtttaggaggttgtctctagttcatgaacatgaggaatgcaaacctgtgtaccccagacctgtcaaggctgatttgcatatatcatgatcattcagtgcctttgcctcagcttcccagtttacaaactggcccgagtctaaactaactctacaccacaatttaaattcttcatcttgtgtagtcaagacagaaaacagtagtatgtttttcattttcttgaaaatcattaaattaaccccccacctcttatttctgagctcaacacatcctgagtccttctttataagctctttgttccagattttaaaattatttgtgtgattttaatccactctgcagtattttcactttccttttaaaacctctggccactgttaggaatatactgtacttattacactgagaaaattactctcataattctctttagcctcaaactgtgtttatagaatcagattttcccaatgtcctagagttcccttggccatgtatagtaaattactaattactaccctgctctcctgaaagaatgaatatcatttctaaaatgcctaagctatcaacagggattcgttttaaagtgctagaaaatctgatttattgctttgcagatgatttttctggtgtatgatctagcctcattaatgcaaactagtttattcagactggaaaccacagtttccagatccccgtctcaaatggtcatcagtgaagggagatagttccaggctctgcaactgtttgacatttcagccttcccttccccaagccagcagccactaagtcactgatagctgcttttttctttttttctttttctttttttttgagatggagtctcactctgtcacccaggctggagtgcaatggcacgatctcggctcactgcaacctctgcctcctgagttcaagtgcttttcctgcctcagcctcctgcgtagctgggattacaggcgcccaccaccatgcccagctaattttcgtattttttaatagagatggggtttcaccatgttggtcaggctggtcttgaactcctgacctcaggtagattcacccgcctcagcctcccgtagtgctgggattactggcatgagctaccgtgcccagctcgatagttgctttatctcaagaggttgagtggttagaaaagcagtttaaaaactcaggctttagccaagagtttagcctggatctaagtcatgggcctgccacttgctaactgtctgaccttggataagatacctagattttctgtacctggacttccccatatgcaaaatggaaatcatgatagtaaatatgttgcagtattgctattgacgattaaatgagataataaagtagctaaaatgtggccaggtgtggtggatcacatctgtaatcccagcatttcgggaggccaaggcaggtggattgcttgaacccaggagttggagaccagcctgggcagcatagagagagccccatctctaaaaaaaaaaaaaaaaaatcttaaaaattagctgggcatggtagcatgtgcctgtagtcccagctacttgggaggccgaggtggcgggaatcccttgagcccaggaggtcaagactgcagtgagccatgatcacaccattgcactccagcctgggtgacagagtgagactctgtctcaaaaaaaaattacctagcatggggcaacctctcactgtcttacttacaattactttaggattttgtttgttttttgttttttgttctttttttttttaactgatccaggtaaaatgctaattttcctaattatttatgaacatgttgagtagagtcaatacaattttggtaaaatagactcatctcacaatagcatctctcccttggaagactctggcatcatcggtggacagtgttttgctcctaagcgtgtgctgggtgccacactccatcccttgacagtttttgtcttgttcctggccagaactacccgctttttgcaggtggtttctggacctcagtttccaggcccagcctctcctaagggtcagtagggcgtccccaaggggggccccttgcagatggacgccctcctcaagcctctcttggtttcttttgttaatgtttctttcatgtgcaaacccacccagaagtctgctgctccgcctccactgcagagcgttgtttgttgagttactcagtaattctttttgaaggaacaagagctatgggctccttttcagagaatgaaatataaacgtcttgcattttctgagtgcgccacctttgagagcagggcggtttcttcgttcgaatcctctctctccacatccctgcttcaggaattggaaaacaaaaactaaattagacgctgttgctttgataacttcaataagtacctcggggtctcttgggtgccatggattcgctctcctggcgcatgaggcttcgtgcggcttcgtgtcataaacatgggcaggcgacatccctcctccaggcctgcgggctccacccaggggcccgcgccagagccaatgctgacccgggagcgccatcttgtgggcgcctcgattgctgcctccgagaaggcgctcgggtacgtcttattccaccgtttcaggacttggggaaatgtagccaataattacatgccggacaattacaacatagctgtcagccagacattaggaatcacttatctctggatttaaatagggcaaatgtctttttgctgctttagatttctttctattgaggagcagctactgtattttcaacagggacttttgaatgaccaattctgtattttacatgcatttgtaaaaaataaaatcattctaggtagtacatcagaagatctagatttcttttacttcttgagattttttttttgtgaccttttttttttttttgatagataaacaaaggtaatgtaaggtcttgctactcaaaaggtggaccccgggccagcagcatcagcatcacccgggagcttgttggaaatgcagaatccttatctctgttccagatcccctgaatcagaatctaattttagccacaacccctagtgagccctgtgcacatgacagtttgagaagggcaagtataaaggactacgaaggagtcagaaggactggtgttcttgtcccagcccctccatttccccatgcttctcatctcagcccatgtgatcacctctcttcagcctgtgtggccgatatgtgacgggagaccatgagattatggttcctgacttgtctgatgctgggtcagctaaggaaggattaaaattttatacacggccgggcaccgtggctcacgcgtgtaactgcagcactttgggaggccaagaagggcagatcatttgaagtcaggagttcgagaccagcctggccaacatggcgaaaccccatctctacaaaaaatacaaaaattagctgggcgtggtggtgtgcacctgtagtcacagctgctcgggaggctgaggtgtgagaatccattgaacctgggaggcagaggctacagtgagcccagattgtgccacactccagcctgggcaatagagtgaaactctgtctcaaaaacaaacaaataacaacaaaaaattatatactaaaggtcactttgtacattgtaaaaacctgtgcaaatgtaagtgaaaattatggatggcaaaaattcttccatttcatactccactatcagagattctgctttgcattatatcagagtctgatttatatcatcagcagcaaagcaactattcaactgcgaccatttgtcatgcttcaaatagtgtcttggcagatttcattaagtccttcaaaggtccctctcagaccagtcttcccagagttcaaaataataaaattacattatgcttttcttaacaagacctttcccacatttgccatcctggggccccagaagcgtcccccaccccactcccccctcccccgttgagcccagtatggggcacagtaggtactcactaatgccggttgatcaaaccactaattgaccctcagcacggtctaaacagtaacctgatatccttcacactaatcgtgcatttatgataatcagattatttgtatcattagagacctgacatagctacatgaggactcagttgtctcactaatatatgtgaaatattcattaaggaaataaagtcctgatggctgagaatgtagtgcacaaagattgatgaaagtgagagcattaaccgtttacaaacatccctttaccttgaaatgagggagagagtggaaccaaaggaaagaacactggcaaactattactctcttctctttatgtacattttaaaaaactaatagcaaaaaggtgtttggcaataaataggtgaaattttaggaaaacatcatctgaagccttaatattgatgagatattgacatctatgttgctcctgggccccagtggctcttgtttctgaagaattgggactatggtcaaacagtgaaaagtaaaatattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcaatccggcctgggcgacagagcgagactccgtctcaaaaaaaaaaaaaaaaaaaaaaaaagtaaaatattgggaataacttattacaccatctgccacccaactgaggtacaaaaatactaaattcaaattagattagacttgcattgtctacaatttgtgaaattatgatcttgttaattgtttttaccaaatatagtaaaatcttgctcttttctttttacctgattcgttgcaattaacaatgttctctccaatcatttaaaaggattcagaatgtcagtgcttcaaaattactttcctgaaagttaaaatgtaattataataagtaactttatatgggggaaaataaacactcatgtctgtacatataaagatatagtctatcagagtaagatcctcaaaagcaggactttgcagtgttcagttcatctctgaatacctaacaattcctctctgctgcctgcacgtgttttataaggatacatttaattaagtaatgaaagagacacaattctacctttttgttctttttttcccaacatttaccttgaaaattttttgagagaaaaattgccagaataaaagaaagtacactgatacacatctagaatccctcagaaatcattcacatgtttaacgtgtattctctctctctctctccccagactccctccaagaacaaaaacctgttattttttttttaattgcatttttattttagttcaggggatacatgtgcaggttttgtgtggcgctgagatttgggctttattgatctcatcacccagatagtgaatatagtatacaacaggaagttttccagcccttgcccccacctccctccctccttttggagtccccagtgtccactgtcgccatctttatgtccacgtgaaccgaagatttagctcccacttataagtgaaaacatgtgatatttggttttctgtttctgcattagtttgcttaggataatggcctgtatcttcatccatgttgctttatagaacatgattttttttttttttgagacggagtctcgctctgtcacccaggctggagtgcagtggcgcgatcttggctcacggcaagctccgcctgccgggttcacaccattctcctgcctcagcctccagagtagctgggattacaggtgactgccaccatacccagcaaattttttatatttttagtagagacggggtttcaccgtgttagccaggatggtctcgatctcctgacctcatgatccgcccgcctcagcctcccaaaatgctgggattacaggcgtgagccaccgcacctggcccatgatttcgttttttaaggctgcatagtattccatggtgtatgtataccgcattttctttatctaatgcaccgttgatgggcacctaggttgattctgtgtctttgctattatgaataatgcagcaatgaacatgcaagtatatgtctctttttggtagagcaatttattttcctttgggtatatacccagggattgctgagtcaaatggtagttctatttttagttctttgagaaatctccaaactgctttccacagggactgaactaatttgcattcccaccaatagtgtataagtgaagaacctgctcttagacagccaacagtaaaatgatcaaattcaggaaaatttcagattggcagaatgctctctactagtgcatagtcctgattccatttttgccagttgtcatagtaatgcccttttaaagcattcgcctcttgactccaggttcacaggttgcatttagctgttatccctttggtgtcctttgagctggaagagttcctcagtttgtctctgttgtttatgacactgacatttctgaagagtacaggccaatgcttcttcaaaattagatcaatttatgcattttaggcagaaatactaaggatgtattacattacagagcattacattagtagacatatgatgttggtttcttccatcatgggggatggtaactttgatcacttggggtaaggtgttatctgccagattctccctttgtaattaataagtaatctctgaggtgtactctgacactgttaattctgttctctaatacacttcattcaaccattttagcattcagtcatgatccttgcctgaatcagtgattactgctttggttgaaaatggtgattttttgccgggtgcagtgtctcatgcctgtgcggtggctcccagcactttgggaggccaaggcaggcaggttacttgaggttaggagtttgagaccagcctggccaacatggtgaaaccctgtatctactaaaaatccaaaaattagccaggcgtggtggcacacacctgtaatcccagctgctcaggaggctgagacaggagaatcacttgaacccgggaagcggaggttgcagtgagccgagatcacgtcactgcactccagcccgggtgacagagtgagactccatctcaaaaaaaaaaaaaaaaagaaaatggtgattttctaactcatttatttctttgcatctactatttggaattctactataaagaatagctttaggctgggtgcagtggctcacggtcgtaatcccagcacttcgggaggctgagatgggagggtcacttgagcccaggagcttgagaccagcctgggcaacatggcaagaccctgtctctacaaaaaatttaaaaattggctgggcatggtggcacacacctgtagtcccagctacttgggaggctgaggtgggggacccccttgagcccaggaatttgaggctgcagtgagctatgatcacaccactgcactccagcctgggtgacagagagagaccctgtgatttaaaaaaaaaaaaaaaaagaagaagaatagttttattttctacctttttaaaatctgtctgtctttgtgagcatcaatatcgatagggacttacaggttcttcttattaaactggttattgcttattactctcattattcattttgatgctcatattgtcccaactttccccagtgggtgcctcttcaatctcacttctatgttcattcgatgtggccccattagtctgtgtcattctttagctcttagcatatctatattgatgtagatatagatattgatagccttagcatattttcattcaagttactgcttaaatgacagattttattcttgcagcaaatattctttgagatactggtatgtcacagttactgatcttactcatggtccagaaaaaagccaggcaattaaattggccctttcaatggaatacagggagttgacagccgtgagttacgtgtgccgtgggtgcacaaagaaaagctcccaatcccactgggtgaattaagaagactccagggagagtgcatatcatctcctaggcccaaaatatgaatagaaatacatgtatggaggcggcatagtgttccaggctatgagaagcacatatctcttgaggaactgaaggcatttgttaagtctaggacagtgtgagtgtgttgggggcgtggtgtgtgttgggggcgtggtacgtgttgcaggccacagggatgcaagcagtgtgagagaagaggctggaggggtgggccagggcctcgtaagctctgttaaggacccttcccaatggctgttcctagaggcagttgttctcaacactgactgcacatttgcaccccctggggagcccccaggggagcctgtcagaactaccaataacagaccaccattcctaaccaattaaatcgggaccctaggtgtggcagggaactctagggtccatacattttaatttccatacctagcttctagagaatttatcatggagaatggtgtcatgtgtcatagagctaaccctttcaaagctaaaatttaaaaagattcattttattttacaggatttcgaactcaacaatgaactaaagatgaatgtcctaaatttgctagaagaagttttgcgagacccagaccttcttccccaagaaaggaaagccgccgcgaatatcctcaggtgaaggcagctgaagatgccgactggatgacattggttgattcctgctatgttcatagaaaataagagccaataaatcttagaatcctggggacagtggggactatgttctcagcagtaaagtgttatgtattatcttctctttcctgggggcaatttggggtctgctgtctcaggaagactcgggacggggtggtataactcgtgtggagtgcagttgctgttatttatggaggcagacagcggtttactatagaaccaacagttaaagaaaggaacccttgaggagcctctcctgcaagtccggcaggcatcaaagagagatgatgtttcctcctgtgggttgtaattgtttattgtaagctcatgtttgtgagtgtggttgtgtctgtgggagtctcgtgcacctaaaatgtggatgtgacatcacagagtagttaggaattttctttggctcatttcactggtcctcgaccagcttttctacagcttgtcagtttaggatttccacatcacgtaggtggtatgactatgggggattgtataaggtatgactccacacttctatgtgataaaggcttcaactttgggtgtactgctagagattgtgtccatagttgttgcacccagtatccaagtgggtaacaagctttcttatagcttcttgaactggtgggtggattttttttttgtccactctatgtggaaagggcagccattgctagctttgtgcagacatttcagttgcagcttcccagctcactcataagtacgtcctctgtccgtgcttggggatgggaagcccagcatctctctgccagggtctggtacttctttaccactctcatttctagttccctcttcatttacaacctctagaaatgacccttcctttcctcgaagcttggctgcattgtctccttgttacatgttatccagaatgtttgtgtcatccacaggcagtctattttagctcagtccatgtttttgcaagtccttccctgatgcagcaacaccagatgttggtttgtgatgtgttagcaactggcctgtaagtctttcttagcccccattagctgaagatcccatagccagaccgttctttggtgtagggtctcttacaggtagaattgtatctccctaccccctaaaagatatattgaagtcctagcctcccatacctcaaaatggacctcatttggaaataaggccattgccagtgtaatcagttaagatgaggtactggagtagggtggaggtattggagtagggtggaccccaatccactttgattggtgtccttataagaagtcaaccatggaagacagacacagacaatgccatctgaagatggaggcagagactgagttatgcagctgcaagccaaagaaagccaaagatcgctggcaaaccaccagcagctaaaaaggcaagggagggttcccctccaggattcagaggcagcatagccctgctgactgttcgattacagacctctgtctggaaggtgagacaatacatttctgttgttttaagccacccagtttgtgggattttattaaggcagccctaggaaacagttaggggccttcttcactttttccattctatgaaaacatctaagtaagcccagggattccactactgtgtctgttttcagattttaaaattgtaagtacatattgaggtgaagcctgatttcagtgcatgagggactctgagtgattactgtttcttttctcttcataactagtttgttatgctctttgcatttaaaacactaatatttaaaaactagattcaggaagtttgtgcccctagggatatttgactaaatagctatcagggaagtgagggtgttcaggctgggaaaaactgtcaggatcaaccagtatgagggccttttgttgccaatcccctcaagacgcccatgccagactttacccatcaattctgagagctttctctctgcaccaagaggtgacctcagacgtcagtcagttggagttggttcttaagatgaatcctgtttgccatcccaggtcttgattattcatcaggcttcagatgtgccaattctttctgctgaataatgacctgagagttagcagtgtaagattgatagggaacagaaattttagtaggcagtagagcttgaaactacaacactgagcagagtctgattctaccttttgcaggatgtcacaaggctaaatcttggctcggccatttatggatgtcaagttctcaaccggtccaaacctgtttcctcatttataaagtgggactcataatagctacttcattaggttgttgtgaagagtacatgatgtgaaatgtgtaaggaggttaacacaatgcctgaaaagtcattagcactcgtagtaaagtgagtattattactgttagaagcactgacagtagttcctggaaaaagtagtttctgccgttaaggccatatggcccaagtgaaaccaggctggatcttagtcaactcaactttctttaggcttcgtcaccttttccacacaaagacagtgtggaccaatcccaggacagacactggttgcttgtggctctgtttttggactaccctaattgaaagaggaattttctattcatacagcttggataatcccatttccttttatttggtgtgtcattataaatgcacaattattaaactggtgatactgctgatagacgtggtagtgatggtggtggggaacccaggatcctggaatgttcatcaatgcccaagcatcgccagaagactagaagcaaatcttttctctattggaactgaaccagaagtgcagaggcctccacatctgaagggaaagaattctgaaccatgccctctagaaaacacaggctatgactgtgagagataaaaaacatatcatatggtggttaagtgcagccctgacatttagagatttatatgcattcctgacatctaagagatatgaacataaaacatgttttcatgcataggttacattaatgcaataaagcaaatgctcttttgaatgaagcctccctgactcacagtctcacaggggtcacaattaagtgtatgatgaatacacttaattgccatatatagtttgttgccctgtttgtaaataaaaacctgtactcaaaacttatatttctaaaataccatctctcctcctccaaagttgtctaactagctgtcttcaaaatctattcagtgtagagtttttctagatacccaacatgccacaaaataaaaagaaatagtgattaacttcttggatgttcaactgtgatgggctcaggtcatagaaaagtcatcctcaaaccccacatagcatcaacaggaaggcataaaatgttaggtaacttaatggcaccagagtgcctcttggaaaatgagggtaagatcattgagaagaggaacatttgatgggagctaactaactttttgactttttctttccaagggaaagatattacccagcttcataaaaagatctttcccactggtacacataattatggagccacagatctctctccaggaacctagaatggtggaaaagatgatgtgcactttcggaaaagtcacttttatctcccatgtgtaacccttacatgtaatttaataggctttggagaaagagttagctttaacttattttttcctcatcttaatctgccctttaagataaaatgactatttctttctactcacaaataatatggctaagtgccgataagagggctgctactagtataatctagaaggctcctgctcccccttcagacagccgagggaagggagttgtgtttattgactgtgtgctgtgtgtgggacccttgaagaggtgccttccctgagcctgcttaagagaagcgcagagtaaaggaagggcccacaaccctgagcaacttagtcagtgtctttgagcttttgtttccttatctgtaaaacggagatcacaatgcctgcattatctgctgtcctgtataacaatcccttggaagggatctgttaggatacaggagatagtgcatgtcaaatgtttagcacatgcctggcatagagcgggcatacaggaagccatctctgttgatattatgtttttgagggttgtggctgttgttttaatcaactcagaacacaacagaacatcacatcatcattacttcttttaaaagtagcttcctcttactctagtttctcttcatatcgcataaatctttcgccttttactaaaagtagcttcctccagcagagtacatggtttgggaccgtttaactattttattttgttttattttatttatttatttttgagacttgagtcttgctctgtcgcccaggctggagtgcagtggcgctatctcggctcactgcaagctctgcctccttggttcacgccattctcctgcctcagcctcccgagtagctgggactacaagtgcccgccacctgcccagctaattttttgtatttttagtagaggcagggtttcaccgtgttagccaggatggtctcgatctcctgacctcatgatctgccctcctactattttaatgctttgagtatgtgcttgtgccttccttttggaaaacataaaatgcctggctccaatggcaaattatgtaattggatgcctactggactccagttttcctggactctgaacgtctgttgcacaaaaataccctctactctgaaaccagtatttaaggtattaacttgtgtttattcattcactcattcattcattcatcatttatttttttaaaagatatttattgagagctgaataacatgtatgagattcagggccaaaagtgtctgaggaaagtccatctggaatgcaagggggaagaagctatctgctggctcctgcctggcattgttcagagtcttgccacataggaaccccctgtgcttctggtctacgtaagcttgagaaaggggtggccctgcgtctcctgcctctgtgagggcagggaaagcccacggtaggggatagaggtgtggggaggagggcactcaggcctaggagtccaactggctgatagcattagaggatgctccattttacattatggatggtaactcagagctcacccagctcaccctcagactcactgtgacggtggttgtttcatttacaaccttgtatgtaacaggttgcctttttgttctaaatcagctgtcctgatgattctctcatgccttgagcatgttttctgtttggggattgctcatctccagctcagcagttggttgtgctgcatggccttgtagacccaaatcctcagacctcccatccagggaaaaccaaactgcatttgtagttttgttcctaggttgtctattttttctttcatggaggataatttgatatctttttcagggccctttcacaagatgaccaagatgacatccacctaaaattagaggatataattcaaatggtaagtctgaccacatttttatctagcacaactatgtgcaaactacctctccaaggcgagcaatatgcttgtaaccgatcaaggagtgttgtagtattaggccctctgtcctatctgtgaagctctgtgagatgaaccacatttggtgtggggtctagcagttggtctaagatattcatgttggctttgatacttttagctttctgccatttttttcatagttagaatttagtggtgaacttcatgcttccacacatgcagctgtctgcctcactgacctgcaatgagatggcaggcgccctctcctgggtgtttcatttccctccctcatctcttgcagactgactgcatgaaggccgaatgctttgagtccttgtcggccatggagctggcagaacagatcaccctcctggaccatgtcattttcagaagcattccctacgagtgagtgccaccccccacagcagcagggctcggctgctctagctgtcttagaagttgacattattcctaaggcaggttgtgtgtatgtctgtcccctcagttcctgtgtgagtatctaccagttgtttccatccatggaactggcacgcctctgtgtccagcactctgcaggatgggagcaggaccaacaacagcaagggacaaagaaccctgcccagggacttagtcaacctgagtatcagagtaatttcgagtgtttttaatgactatacaaaataattcctgtatgctgcatctcacttgtcccttgtttcttgctgtgtctggtgacctgctcaggaatgaagtgaatgatcaggaatgctgccctgaagacagcccatctgaccaggtggagcttctgccccgctgaactgcctggtcagggcaacatgcggtacaagcctaaaaggagcgcttttcagccctgaccacctgcgccctcctgagcgctggggagaacaaaacgcaatccctgcctttgaaatctgcatcctccaggagaatggcaggcagcgcagagtggagggagaaaattctgcttctgactaacatttttggtagtgatgaaatttttggaccctctgctaaggcttaatgtttttaaaagctaatcctgggaaaatagtcttgatttctaaggtagtacttaacctctttatttcccttgtgttggttcttgttttccaacttcagagaaggctttataggatcctaatagggacacagttccaaacatttataagagaaagctggaagctgaagaatcttcctttttggcattgagaggtaaactgcaacagccgaggtaaaattcacttgtgaggctggcagcagcaggtgtcaggaaccattctaggccatgtcaaatggaatttttctaatattcgtgacaactgtccaggatcatagccaccatatttttaaaaacttaattggttttgtgttttgttttgaacttccagggagtttcttgggcaggggtggatgaagctggataaaaacgaaagaactccttacattatgaaaaccagccaacacttcaatgacgtgagtaaccgtaacagtaaaaccgtgggcgtgtcacaagaagatggatattggggtctaaagactcctctaaaacaaagcaactctgtcacccactttttttttttttttttttttttttttttttttttgagacagagtctcgctctgtcgcccaggctggagtgcaatggcgtgatctcagctcactgcaacctccacctccctggttcaagcaattcccctgcctcagcctcccgagtagctgggattacaggtgcatgccatcatgcctggctaatatttttgtatttttagtaaaggggtttcaccatgtcggccagactggtctcgaactcctgacctcaggcaatctgcctgcctcagcctcccaaagtgttgggattacaggcgtgagccaccgcacctggcctgccacccacttttaaacagaattgatgggatattgacgacaagcttaaatctctaagagctcacagtaatgtaataatgtccaattaacttcctgacataaaaggttcacctttgatggtacccagtgctcaataatgtacaggttgctgatcctatttttatcatgattatcactacttcctgttcatatattgactaacagagtgagcagtacatgtgtcactggcccctggtggtgttggtcacggtaaggctgggttggtgcaagtcctcatcattactgaacgttcagcctgaattacattccagggttggaaggggcctcttggagcataatcacattgttgctatagttctgtgcagcagtggccagctgtcagtccatcttacagctctgcttttccccagcggtaagattgggagatgcttttatacctccccgctcttccttagtgctgttctcatagtcttagtcctgtggtagaacaagtaacaggtgtgggagtgtcttctggcctatccaggcaacgggaagcctccccttccagtttcactaaactatagtaaaaggaataacgattttaaaaacaacaacaacaaactaccaggaaccccataggtaaattaataagtgatctagaatcaaaatgcaaaaatgacagtttagattcccaagacagtgtttcatgcaggctttccccaaagcacgtggatgctgtgtgaatgctaccacacaatgagcttcagtgccgctgctgcctaaaggacaagggcatggcccatctagtgcctgccctgagaaacagattccctgctgtgggaagcaaacctctgttacctgtggtgaaccaacacaggggatataatggacactcaaagagaggttcgatcccaggctccagacccacatgtctcctctgctgggacgactgctacattgcattcttgacaattacagatggaacctttcatctgcaccccagagccgccaagcctgcttcttcattgtcctctctgttctcagtcttgggtagtggcctcaccatacactcactcacccaagcacaggatctagacgtcatcttctcccttaccagctcacccttaccactgcccaacatatttgcaaactctaaatctacatatatctcaggctcttccccaccctgccttccccgctgccaccaccttgatgtggccttttaccttgtctctccaggagctcctgactcatctctcccctgcaacctcactgccctccaatccatctgttaggttcagagtcaggttccagcccatgctgaggtctgaggggagtgggtggatgcctgaaagaacacgtagggggccgtaggtaggtgaaagatgattttgttcagcgggcgctctcatcagcagctgtctcattagcagctctttcatcagcagctctcttacgctgtctcttctgtctcagctgcttgagccagtcgctcccgcgcacagctgtgtggccagctctcacttgccttcagggtcagcagcttaactctttctctgggcatgagctcctgtacagtgtcaacagggcaattataccttttacagacaatagtggcttagagccaagtgatggccttccgtgttatggctacatggctgtgatcacaagtggagttatacacctgtgctctaaactcactgagtccctctggcccggatgtccaccttggcctatcctagaccaaagcacagccatgtaccttaaaccatcctgcatgcagtggcacaggaatgacttctctgaaaggtcaatctaattatctacctccctttgacaaaaatctgtcagtggcttccccttaccttagggatatggtcccaacctgtcatacaagagcacagcccatctgtcacccttgcctctcccagtccttgtgcccctcagatggctgccaggtcctccattacaccatccctcccacctctgtccccttgctctcatacttagatcctttaagactcaatgcaaggctggagactgtagctcacacctgtaatcccagcactttgggaggccgagctgggaggattgctttagcccaggagttcaagaccagcctgggcaacatagtgagaccctgtctttataaatacaaaaaattagccaggcatggtagtgcacacctgtggtcccagctacttgggaggctgaggtgagaggatcgcttgagccctggacatcgaggctccggtgagctgtaatcatgccactgtattccacctggggcaatagagcaagatcctgtctccagaaaaaaaaaaaaaaaagactcagtgcaggcgtgacctcttcctagaagcctcctctgtactagaccagatgccccatgctgcctgtgtattcccaaaccccaccgtgaatagactcaactttgtgtttcgctgcatggcatttacctgtttatgtatctgcgaccctccccttcccacctacctaggctcagattgccttaaggtcagggatggatttatttgtctttctgttcccagcacctaaaagaatctattctatcccatttcctcaatagttattggcaagaacttcttcatcgaaattactgattaacaaaaccacttcttcccaggacaaactggattccaaataattcctctcctcacgctaaggatgcgcaggcactcagtgaacagcactgcagtaggtgctttagcgaatttccacagtgatggtgttgaggcactatgagatcttaagtgtcttcagaatcatcaaagaatgggtgaatccatcagacttggtgtatggatataagattacacgccctatattccctttgttaatacggtaatctcatttcactttttttttcctctccatattacaagagctgagcttcttaaactggctttaagtaataaaattacggtacttagcctcaaaactataggtccttttaactgctggtgaagaataagatgaagaaaatgttcttttccttgcagccaagtgattctggtttgagagttaatcagctcagaatttgatctaactgggggcaagtgtttttttctttctctgtgataactgtggcttctcagagtgagtaatcacacactgttgggggccaaggagtaaagggaaaggccccagggagtgacatccatgatctacagacattgcctttccgcaggcgttaggttattctgtcccatttcctcagtaattattagaaatgacaccatcaaaattgctgaggaacaaaatcatctcttccctcaacaagcgggaatccagataacccctgtgttcactcaaaggacaaacagatgctcattagtttattcttatagactttagtctctttagaaagttggtatctaaatgtagaatatgatcttcaagctactcaacaccctgccttcctgacaggtctgcagataatttacatattttgcctaaatgcactgcttggggctcttagactgcctttcggggctttttgattgtctcagatgagtaacctggtggcctcccagataatgaactatgctgatgtcagctcccgtgccaacgccatcgagaaatgggtggcagtggcggacatctgccgatgcctgcacaactacaacggcgtgctggagatcacctcggccttaaacagaagtgccatctacaggctgaagaaaacctgggccaaggtctctaagcaggtgagcctcagcgtgtgacacagcctgctgctaagaggaggagaggctgggagatgggagccaagttaaatattactaattaggaaatcattaactgaaatgagccgctcagttgccaaagaaaggtgccaacatgggtaattacagggctcttaccacttaattgatttcattcatgtgcatttctaaaacattcattaaagcattttgggggacagccacaaacaatgtggttgtcagtcaagagttgtttcctgaattatttcggagggtacattgattttgagcaagcacacttatgtccagtgggtccattctttctctcccagagtgagggtgcaaactctgtggggccaaaagccagggacaaaaggcctcatttttcacctttctcttgctcattcctgtagtagatgtaaagttttggcataataatttagatgtgcagaaatacaattttcattttctttcattaatctcagcttgcctatgcctgtcattttcactcagataatttcaagattcaaactaaatcatgattcttcccctgccctttctcctggccttctccctgggtgttgggtgccttggagggcatctctgggcttttgggcacctgtctgctcctctggcctcctgtggtcattctttgctgatgattcattgggtacaggctgctgtgaattgcctgtacctggtgtcacctggcctgcttgccctgcctgggaacaatgcatggtgattgcacccagggagcctggctgacctcgtctcaggggcgagggggaaagggcctcaaagggcctcaggggaagtttccaggctctcacgtcccattggtgccagagaatagaagggtctacatcaggccctctctgcctaaccctcccctgccttgctgtgaacacccagagttggtgaggggaatctacagagtgccacctccagggtcccagaccggaagatctaggtatgttctgctgacatggcctaaaaactgtctcattttatcaccctactctgaggatttaagcccctctcagagacactcattatttcttttccatcttcattttgccctccaagcttttccctttagcataggagaacaatttaatttctccatgtggcaggaaaccaagcctaagtcctatcttttatcttacctttctcagagtaaaaatgcagtgctctgagaatcccaaatttggccccttagaactcaaaagtcctcttttctgtcaacaatggacctggtaaataaaagccacagtttttaaaaatactggttaaaaacaaaaaaacaaaaaaacaaacttttgttttgagatgattatagcttcacatgcagttgtaagaaataacgcggggattccctgcaccttacacccagtttcccccaacagcagcatcttgcactactacagacagtatcacaactaggaaatgaacattggtgcaatccaccagtcttatccagatttcaccagctttctagggatcaccagctatcaccaagggatccctaaatcttaaagtttccaggcccactccgtagttaagtgatattcttgtctttgataggatgctggtttaggaataaccgaactgatcatgaaatagagatgatgagactaatattgaaatgattgtttcaaaatttgaatataccatctgtagaggctctaaataaaatattagcatttcagtcacattataggtcactcacagtggccttagcatgggctagtggactgtcccccagagaggctgtctctagagccaagcgccttactccagtcatggtaggtagggcctggttgcagatataccctgcttcagacacctttgatgacaacatccgctgtacagctgtcccttctctgcatctgagatcagccggggagttgttcagcaggcctgataatctgcactctggaacccacagactggtctgttgctgtaggacaggttgtacttttgaaacttttttgagcaaggttagccctggaccaagcatgccatctctaagagccctcagacaccagaactgggaagacagccctttgcctctcaggaagctgtgcagctcctctccaggtgagacaaagtagtttgaggaccctcaacctgggcattccaagttcttctccaggcaggacctggatcctccatgcccagccacgctgcctggatgtgggtattcccaggaatgggttatcctccccaagggccaccctaccactctcctatgttcatggaagaaaccccagaccaatgtcaacaacaatgttatttctcagtaattatcagttatacttctctaacaaatggatgaagaagatcacaaaagaaaagatctgtagtagaggacattgcttagtcaataccaaggtaaccaaacatgtgctttagtcatttggagattaacactctaaagggttcatcgcaaaagctgtctgacatgagacctctcctttaagattctatattcggcctggtgcagtgactcatgctgtaatccccacattttgggaggccgaggcgggcagatcactcgaggtcaggagtttgagaccagcctggccaacatcgtgaaactctgtctctactaaaagtacaaaagttagccgcatgtggtggcatgcgcctgtaaattccacttgtcaaaaataattgacaagcacatgctgaatatagaatctttttttttttttttttttttgagatggagtctcgctctgttgcccaggctggcatacagtggcgcaatctcggctcactgcaacctccgcctcccgggttcaagtgattctcctgcctcagcctcccgagtagctgggattacaggcatatgccaccatacccgactaatttttgtactttcaatagagatggggtttcaccatgttagccaggatggtctcaaactcctggcctcaggtgatcaacccgcctcagcctcccaaagtgctaggattccaggtgtgacccactgcacccggcctacttgtcagttctttaagtgcctaagttttctatccgttgcagtgtttctttccacacatttttgctctctttttggctaaatgtgtagatacaggcacttcctcttctccatatgttgttaacattaaatgtaaacataatgccctgtctctacatcttagaatcctatcacacaatgacctttattctggcaaaggtgtcagcacctgtcaccaaagaagagaactgaacatcttttggcaattcactgtctttttaaaccatagtattttcatcacactaagttttttcttttctttttagacaaaagctctaatggacaaacttcaaaagactgtttcctctgaaggaagatttaaaaatcttagagaaacccttaaaaagtatgtctatcttaattattaaattattcataattcagaaatatatttacataatgtatatagtatacaaacagtgacctaccacctactttgctttgaaaagaaaaataaatgggaaacaacttgtatcatctaggtatttttctgattgtccttattatttggaatactgtgcatacagtaattgtcttatggatatactcatggcatgcagattaagaattaagaaggtaataccaccataataaatcggactatcttttactgtaaaaatgttcttgattcagttatttcctaatctaagcacaattatttcctgtgagttttatttaaatattccagcacctgttgattattatttttgatctttggtttctagattattccctttctacacacacacacacacacacgcacacacacacacacaaacacacacacacgcagagagagagagagtttgagattctcctgcaactggtattctcatgatctaccacatgtactttggaaaaacatgagtcctgtgatggtatgagtgaaagcaagactaagactaataataataataatagcaataatagcaacaacagcaataatagtataagaactaattaccaaagtatttactaaatgacaggtttcatgctaagtgcttgatgtgtcttatgtaagcctcacaagaaattcaagagataagcttttctatctccattttacagaagaggaaactgcagttcagagaatgttcccagtatcacttagtaattggtcaagctgggatttgaacccagctcctcccgcatcaaaagcccatgtgcttagcctccggcctctgagaagaccaagtatacccagctctctctaaaaaccaaacaaaacagtgtctcaccttagtctgagttgtgatgttaagtctacactttctaaaacatttaagtaccaactaaaacagaaaacaagtttttaccagtgcaaagctctaactgcatggatttttccatctagttcatcaaggctgaatacttgatttaaagaggtaagaccatagaggtttccctccaagcttctacccctcaaaaaagtgtgggcagtttacaagtattgcaaacaattactgctagcaaatgctttgtatttgtctctaagatatcctgttgtttgaatatgccattttttttcaaacacgtagtaaagcaggggctgtcattttgtattatattctactgtgaaatgtgtttaaaattctgcgtattatgaatatgcttctgaaactgaaataaaaaggttttgctcttcagtaccaaaggaggatactttaatcctcctttgtttaatttggggagggaaatagacatttattcaaatgagtctcagaacagtgcctcttggtcttgcagttgtaaccctcctgcagttccttatcttgggatgtacttgacagacctggcatttattgaagaaggaacaccaaactttactgaggaaggccttgtcaatttctccaaaatgagaatggtaggtataatttcataattagcctgtttcaatggctttagaggtttatagagaagaggctaagtaataaaagtcaatgtctgctttttttttttctcttctttttttttttttttttttttttgagaaacaatctcagtctatcgcccaggctggagtgcagtggcacgatctctgctcactgcaacctctgcctctgggttcaatcaattctcttgcctcagcctcctgaatagctgggattacagttgtgtgcctcatgcccagctaattttttttttttttttgagacagagtctcgctctgtggcccaggctggagtgcagtggcgcaatctcggctcactgcaagctccgcctcccgggttcacgccattctcctgcctcagcctcccaagtagctgggactacaggcacctgccaccacgcctggctaattttttgtatttttagtagagacggggtttcactgtgttagctaggatggtctggatctcctgacctcgtgatctgcccgcctgggactcccaaagtgctaggattacaggagtgagctaccgcacctggcgaccagctaatttttatatctttagtagaaagggggtttcaccatgttggccaggctggtctcaaactcctgacctcaagtgatctgcctgccttggcctcccaaagtgctgggattacaggcccggcccaatgtttgctttttaatcttgcggtggaagaggaggtggatactgggactaatacccgatgtgggctgattgaggagatttttggtcatgaaatccttacttaaaccaatgtctagaagggtttttccaatgttatcttctagaatttttatagtttcaggtcttaggtttaagtctttaatctatcttgagttgatttttgtataaggtgagaggtgaggatccagtttcactctcctacatatggcttgccaattatccgagcaccatttgttgaaaagggtgtcctttccccaccttacgtttttgtttcttttgttgaagattagttggctgtaagtatttggatttatttctgggttctctattctgttccattggtctacatgcctatttttgtaccagtaccacgctgttttggtgactgtggccttatagtatagtttgaaatcaggtagtgtgatgtctccagatttgttctttttgcttagtcttgctttggctatgtgggctcctttttggttccatatgagttttagaattattttgtctaattctgtgaagaatgatggtggtattttgatgggaattgcattgaatttgtagattgcttttggcagtatggtcattttcacaatactgattctacccatccatgagcatgggatgtgtttccatttgtttgtgttgtctatgatttctttcagcagtgttttgtaattttcaccagtgttttgtagaggtctttcgattccttggttaggtatattcctaagtattgattgaggagatttttggcaaagccatttcagcatccccaaggagatggggaatccaaggatggcttcctaagactgaccagtgatagacacttgctgaaggcttcttgctaaacagccaggttcttttttttttttttttttaaagacacagttctgttgcccaggctggagtgcagtggccagtgacatgatctcggctcactgcaacctccaccttccgggttcaagcaattcttatgcctcagcctcccaagtagctgggattacaagcccacgacaccacacctggctaatttttgtattattagtagagacagggtttcgctgtgttggggccaggctggtctcaaactcctgaactcaattgatccacccacctcggcctcccaaagtgctgggattacaggcatgagccaccatgcccagcctggacagccaggttctaagcactaagctagaagcaaggagcccacggatgacagcacccagagcttgcctctcccaaacatgaggccacatattgccagctgttccccagttttgaattcagtatctttttgcttttggcatttcatgtgcctccttgagagtcaagaaagcaccaaccatagggaatggtcaggcaggctccacccgcctcactggaggaagggactgacccttctgggaagaggcctcagaagaatgtgctgcaatgcaggaaatacctttctttgcttttgttgttgtcattttgttttgtttttttctctgttagatatcacacatcatcagagagatacgccagttccagcagacttcctacagaatagatcatcagccaaaggtaatattatgtggctgtgaagaaattaataaagaaaaaaggggaaattaatgaattagaaaacaacagtaaaagttgatccaaaataccaaaagctagctcatagaaaagaccagtaaaatagaaaatctttggctagtctgattaaaaaaaaaaaaaaaaagaacatcaattcatcatcaagttctattgattttacttcttatatttcttgtgaatcctcttccatttgtcttcactgccagaacccttggtccaagctgccgatatctgttgcctgctctacttgcattcactctaggatgcaaaattcattctacaaattacagctaggtagagctttctgaaatgcaaagtggattattttctcccttacataaaacattttcctggcttcccgttggtcttaggattaaaaaaaattaagaatctttgacatgactgtgaagtctcgcattatatggcccctacttttttcttaaggttcagttcacatcatataccgccttactgtctccatcctagtcacaaatggtcttttaccccattttttaatagactttacttttttagaatagttttagcttcacagaaaaactgagaaggtagtagagaaaattcccatatacctcacagccaatgtccctattattatcttacattagtatgatgtgtttgtttgacttaatgagcccatattgatacattactttattattattttgagatggagtctcgctctgtcgcccagcctggagtgcagtggcacgatcttggctcactacaagctccacctcccgggttcatgccattctcctgcctcagcctcctgagtagcccgccaccacgcctggctagttttttgtattttagtagagacggggtttcaccatgttagccaggatggtcttgaactcctgacctcatgatcctcccgcctctgcctcccaaagtgctgggattacaggtgtgagccactgctctcagccaataccttattattaactgaagaccatcatttattcagatttccttattttttacctaatatcctctttctgctccaggatcccatccaggacaccacatgtcatttaattgtcaaaattctttaggctcctcttggttgtggtggtttcttagactttccttaatttgggtggccttgactgttttgaggagtagaggtcaggtattttgcaggatggcccactgtggaaatctgtcagatgtttactcagggttagcctggggttatgggttattggaaggaagaccccagaggtgaagtgccattttcatcacatcatatcaggggttatattatcaacctaatttctgactgttgatgttagcttgaatcgcctggctaaggtagtgtttgctgggtgtctccactgtaaagttattctttttccttccttcctcatcctgtattcttgggaaggaagtcactatgaacaccccacacctaaggaatggagaattatgcctgcctctccttgagagcgaaatatctacataaattacttggaattcttctgctcaagagatttgtttcttctccatttattaatttattcaatcatttatttatatcagtatggactaatggatttgatacttagggttgtcatccaataatgttttattctattgctgaaactgttccaagcttggccatcgggtgctctttcagttgacctctttgtcataccccaatccatgtagggttttctctttttcttttttgaggactttcttactttctgatagtataagatgctccaggccaggtgcggtggctcacacctataatcttagcacttggggaggccaaggcaagagaatcacttgagcccaggagtttgagcccagcctgggcaacatagtgagaccctgtctctacaaaaagtggccgggcgccttggctcacagctgtaatcccagcactttgggagtccaaggcagccggattacctgaggtcaggagttcaagaccagcctggccaacatggtgaaaccccatctctaccaaaactacaaaaattatccaggcatggtggcgggcagctgtaatcccagctacctgggaggctgaggcaggagaatctcttgaaaccaggaggcaaagtttgcagtgagccaagattgtgccattgcactccagcctatgcactccagcctgggcaacagagcaacacgctgactctggagggggagaaaaaagatgctctagactcatcttttatattttgcccccgtcctagtttcagatatttctgccaaaagctctagttcctttttttggagaatggtttcagcaaccaagatatgggctttagatatgcttgcgttatggaggtatcagctgacagagcataggaatctatgtgtgtatagattttatacacatctatttataaatatatctctatgtaaccatcagtatttgtattaagctaaatatactgatgcccccaactctattctattaccatgtgaatcattccagccctctccccacatttgcttatctgtaaattccctctccaacagtgagagacacactttcttttaatagcccctaggttttgccctatttctgtctgccacaaggcctttacctatgttcttccttctgtctggagtgccctttcttcctcattgcacagtttacttgtacacagcttaagtatcacttaggaagactttcctaactttcccaatccccactccactcttaaggttgtattgcaccatgtaagtctcctttctagcacttactgctggagtcaccattttacatttatttgtgtgattatgtgcacatgcatgatatccatgaagttcagagctggacctactgtgtttattgtcatagccccagcatcttgcacagtgcctggaccatagtagataataaatgtttcttgaattagttaattcaagtcaggaaaaagacaaggttgtgaccatcactgctactattcagatttgaacaggaaaaaattcaccacggcaatgaagcaataaaaagcaaaaggtataaaaattggaaaggtaaagattaaatactataattcacagacgatttgatttagaaaatccaagagaaaaatctaagaaaaactgataaattactaaaggagtatagcaacttgacatgcaaaagccaattttcaacacattggcaataagcaattcaaatgtaatataaaaaacctcaatcaaaatagcaacaaaatctgtaatgactaggattaagtggaacaggaaatatgtaagacctttatgtactgaagtacgtaaggagaaagttgtatcatattcatggatcaaaacacttactattgtaaagaggtccattgtcctcaaattaatctataaattcattgaaatcctggtcaaaatcccaacaggtttttcatggaacttgacaaacttatcttgaaactcttagggaggcatagataggcaaaaaacagacaagaactttttggtaaataagaatagtaaaggagagtgttccctaccagttatggccacatcctaaagtgagagtaaataaggcaggactcagccgggcgcggtggctcacgcctgtaatcccagcactttgggaggccgaggcgggcggatcacaaggtcaggagatcaagaccatcctggcgaacacggtgaaaccctgtctctactaaaaatacaaaaaattagccgggcgtggtggctggcgcctatagacccagctacttgggaggctgagacaggaggatggcgtgaacccgggaggcggagcttgcagtgagccaagattgcgccactgcactccagcctgggcgacagagcgagactccgtctcagaaaaaaaaaaaaaattcaggactctactggcacagcagtgcaaatccagtagggcagaagaaagtccatgtgtgtgtttagtctacctgaaaatctaatacgagataaagaaggcactcaaagaaagtgccagaaagaaactgaccattcaataaatagaacaggaattttggctctccatcttaccattcacaaaaataaattccagatgagttcattacctaagtttaaaaagtatttatattatttgaataaaataaaggataaaatattcatgacctttggatttgaaagaccttcttaagcacagaatgcaaaagctgtgaaagccaagcttgataaagttaatgaaaattaaggacttctatatgacagaggaccattatttaaaaatcaaaatataagcagtagacaatgagacaacatttgcaacatatacaacaaagaaacagaataaaagtgtttccataatctataagaaaagcataaacaattcaactggtaaacctgtgaatagttaattcatagaagaaaaaaaatgaccaataaatattttttaaatgctcaacttcactagtaaaaagagaaaatgtaaattagagtgggacatcgttttcacttatcggattgacaaaaatttaaaagattgataatatcaaacattgcttagggtataggaaaacaggtactgtcatgtactgtaggtgcggaagctttgcaggtcattttccatcatcatttaaaattaaaaattggtatattgaattactggaactcttaccattgttggtgagaataaaatcgaacaatcactttgcaaaactgtgccatttagaagtttcttaaaatgttaaatgagcacttatcttaggacctagcaatttctctcttaggtgtttatccaaagggaaaatgaaagcatgctcattaaaagccttgtataaaatgttcataacatttctaaataatagcccctatttgggaagagctcaagtgtccatcaacagatgaatggataaacaaattatggtatatctctacaatggactactactcagccatgagagggagcagactactggtacaggccacagcaaggctgaatctcaaaacactatgctgagtgaaagaaaccacacatgaaggagtacacactgtatgatcccatcgatatgaggttccaaaatagacagaactaatatgtggtgatagaaaccagggcagtgcttgattccaagagcagattgaccgagtaggtgcatgaaggaacttttggggatgctgaaattgttatcatgaaatgtatgtaagttacatggtgtatacatgtcaaaacagatcaaactatctatttcacttttgtgtgttatatttcaataaaactaaagaaatattttcatgaaaatcccccatgccccaacatattcatttctagtgtcaattcctttcctttcacttctgatatctaccctagcctagcagagtattcacgcatgcactccaggaagcatgctaacaaggaattcactgaaactttgtgtaacagtgaagtattgacagcaactcaacatctatcaatatgagattattaaataagctccaatatattgcactattaatactgtatagcagttagagctctatctactgtcacagggagctctctccaacctatcattaagagatgaaagcagaataaaatgtgcaccatggtgccaattttagggggaaaaatgatttctgtaagtacatgtaatctctataaagacatagaaaaacaactgggagaaaacaaaccaattagtaacagtagttcctcttgagggaggtacctgggattgggggttgagagaggactagagatgttcacctttttttttttttttttaacaatggaaacatatttatgattttttggtcaaataagatttttagttgtttaagagaaaatgttgaattgtgttagattccgtcagaaaatgtacgcactggtgtctgaaagaggtaaaagctgggacttccccttttttttcaggtcgcacagtacttgcttgacaaagaccttatcatagatgaagatacgctatatgagctgtcactaaaaattgaacctcgactccctgcttgaagatctggccttgcccctgagtccacgggatgttcatggaaagcaggacagacagaattgtgtatgccttgcctatcacggtacagcacgaagccaggctcctttctccaccaaagaagatggaaccagactggaattctgtctccagagagaaacccagctgtttgggtcaaagacagatgcttcagacttgggtgggaaggtgaaagatggctatttagaaagctggtggcacgttttacataagggaatgtcagatgggagatgctagttgccattttaacaaagcaggtaaatcggtaaattttaaactctgtccatgttctgttagaactcagggacaaggatccatgaaaaagacctgtgatgtttctctggcgctttactggcctgggcacacctaccaatcttctaggatttgactggttccattacatttccttttggtataagcttcacagaaaagctgacacttcctctacagagatggaccaaaacataagcaatttcagtctacagcatgtgcatggttgtcagtgcattctaaatatttctatgtgaggaatggtaccttctgaaactgcctttccagtctttaggcaatgggataggaaagaaagaatgaaacacaaatggatttgtatgtaacatttccttaattaaatgcagtaggctgtgccccagaggattccagacagtggctggctgaggtgggtggggagcttttccttgagactgttggtcctaagaagccagcccttttggagaggcagctgcaaaaaggtgcacgcccatctcaccgacaaaactgtggaacagaaggccaccaagtgctgtggggaatcatgggtttcagtgctgagtgaaaatctatacctaaaaatcatctctgcaccttgctttgtttgttttctttccccactcatagtactgcaggaatctattctcatttacacagacctttttttaggcttactatgaacattggctgtattttttttaaacagtttagtgaaattttcttttcaaaacccacacttccatatgctgttcgtagatctctttctttaaaaactgatgttgagagatctctgagaatattataagtgcatgggaaatgggcccaaccaccgaacagctcttacattacaaaaccaaatgcaagggttagtcctgctacctgaggctggggaagtgaccttccttttcccaagattgtcagttgttgaagaaatagggctatctcattgtttacctccctcttctcttctcagggagactgctgctttaaaagaaggaagagaaaaaatatagttctatttccctgaacctgttgcacctgacattttctcttagcagcatgaaacttattgatgctgacaatgaaaaatggatctgtctggctgctttccctctttccttgcactttaattatgttgctagagctaacagactaataaattccacctgctggctcttaagactcagtgaaagagctagcattggtaatgcaccatagaggtagagaatgtacactttctgcacggtaagtgccatctctgtatgtaactatatagtgaaatatcaactaagtaaaagaaaatataatatttgaagaccattcccaaaatattttcaatagttcatattagccaacagtgtagcactcaacccaaggagggttccttatggatgctttctttttcttttttaaagttgcttgtttgttctctttagtttcaaataagaggttgacgcatcttgatgcatgatgagaagcatgggctgtttggatcctaacaacgcataacttgtgatttatttctcagtgctccagaaactgagggtttgaaataatatgtatcagttgcaccaaacacctcaaggtcttgcagaagaaaagtaaaggttagctttcatggctcaaaagcatagtcctgaagggtgaactaaaaccgggacaaatctgtgagaggaccacacacatactagtttcgggccaaacaacacgtggaaaggtgcatgcattctactctgccttggagttgccagagtccttcagagggaaagggatggttctgtgtgcactttttctggaagttcggactcatttctttgacccaaatgttccagagacactgcagccattcttattaacaaaaaataagacaggagtttccaaatgctccttcccttttggatcgcagcttttcttcaactagtgacaaagcttttgcgcctatttcctgcaggatgttggaactgccccgcactggtcatattaggcactgtcaattgctatgctgacttttagggggtttttgtttgtttgaaaaacagggtctcaccatgttgcccaggctggtctcgaactcctggactcaagcaatcttcctgcctcagcctctcaagcagctgggactgcaggggtgtgccactcactagcctttcgcatttttgtttgagaattacaccactttctggagtctgcagccttcctggagctgcaagagggcaagagagagagctccacctctgagggagtgtctgttgatgacctgcactattcgtgtgccagctgggagaggaatgcacattttaaaatcccttcaatttggtcaaattaaaaatccccaagagcaatttgcagtgttttttctggtcgttaaagtacccatcctcttctgcctacacacaaagcatgcattcccagctgcatctgcctctagtccattatggagacccatttctaagaggagatgggaggtcaacctctaacagccaagtagcgaacatgtatactgtaaaattaacctagaaaatcagaagaaaaatccaatttcatgctttcgaatgaatgcccacattttgtactgtcaacgaaattatcttggagcttttaggggatgccttttcgttattaactgagacatctagttttgctacagggacaaatctcttacctaatccaatatattatttgacagattcaggcatgaagtaaaacgtcgtcacttttccttagtgcttttctgaaggaatttaaagacggaattttaaacggccattgcaatattttcaagtggctctcataccaagtcccattactgtttgttaaatttcagtacgtcttaaagtactacttataaacaaatgaaactcagagaaactgaatcacctggaagagaaaaatccattatggtcccatgtggagtgaataatgatggatcagcaccctttctctcatgttattgtataagacgagacttttgggccagcagcgattgggcagcttttaaattcttaactgaaaagagtaatgcaatacagggattattcccaataaaattaacttttatttaaaagcaagagattttacttagcttttttttttcaaagtttgattttatccccttgaaaaaaaatctcttcactttaaagtataaaggtttttaaaaatccaattgcaaaatgtattatttttacaactatcgaaaaggcataaaagagaacatactatttatggctgaagggtatagccaggctaatgtgcacagagggaatcaataaataaaactctttttcatttcagtaagaaatcagattgtaagtttaatggctccattatagataccaccgtgtaatagaagacttaagtcaatgaaatctaatcagtgtgtcatttctcagcggccattggtgacttaaaattaagatgaggcagagccaaaatggaaaacagtcattttgttgtaggtataaacacatgaacgattcagaaaattattcatctcagctgccatgcagcatgacattaacattaggattgatagcactagtctgatctgctcaaggaaaataatagttctattatacttaatgatgttggtttttacacagctcatttcatttttcactagaaagccagttatgaaagagagctggcctaggcatcccggccctgagtcctaggcccagtctccaactggaaaaccttaggctggtgtttacacatccctgagcctcagtttcctcatctgcaaaacggtgtgaatagtaatccctgtgctgcttatctcacagggctattgtgaggaccaaatggattagactgtaaactgcaaagtgctgtccgcacatgaggtcatctgattactgtcctcagatctcttttgtagaggatttcaatgtatttctttatcatttgagtgtgtgtgtgatggacgaatatgtgtgtgagtttgagaagcatatcgttcgtgtccagttactttgcaaatttgtggacatttgtgattggacagaggggtttgtgctgtggcctaacacttgccaagtgaggtgtaggttatgcctatatgcaaattaaacttcacctttcttgaatattcagaaatctcactggtttcttcatttaactctttttccccccatttttctacattgtcaacttaaaaccatgaaatgtatacatttagaaaaaatagaacttaatttcttataaagggttacaatctgcaggctggagcctctggccaaagccaaaagcaagcacttcagataaaaaagggagaggctgagatttatgcccaacaagatgagccttacatatacatttagtaggttataggataatcttatgaatatttatgagaggccctaatgcatgcatagccagtaatcatatatgttacatgttacatacaacccatgttcactttgggatggagacttaaaatgtagtaaaattgggctctatatgtcaaaagatggaacacagggcacaaagacgcttggtgtgcaatctctgtaaaccggccagaaccggctgtggtctgtggtcagttatgaggatggagtgctttgtaaggctgaacacttgtcagggggaaactgcgttgagggaagggggggttcgccacgtcaggttgtctgttgaagttgaggaagaaatcttccagacatagtttttcagtaactggttttagtttaattttaggaaagaaagtcttgaggcagttatcgaggtgggagagcgttgggtgtgactgacctcttgccttgccaaagctgtagaatctggtttttaatgtttcctggggtctctttttaccacaatgagtctgttttgttttgcttgggggcctaggggctttatttttattttacatcttcttcatagcagtgaactccttcagatatattatttacttctaaatattacttctaaagttcagggagaaaaacagtttagaagaggccctaaaattcaaagaatttggggaaagctttgaaatgatacgaaggatcaactaatcacactttctttgcagtgcttagattcttcctgtgacatccccagcctatatttgatacctccaggcacagagaactcactactacctggaacagctcagtccattgcacagcagctcaacgctcctgaatgggtggtggagagaggagaagccgccagggtagagtcctggcctaatagtcaccaggctccacctaggaggggcttctgaaataagactcctgtctacccctaaaataactgcagtggttatatggattactatatatgaaaatactttaacttctatgaagttgtggcaacatttagagctgatggaattaagttacagttgctggacacaagaatagactaaggaaaggggtccctcctgcccaattctgaaatgagcaatccaggctggtgcgacagaggaacccaggttcctttcatcctattacttgctcatcccacaaggcgtcatccttgccttcgaggtcaaatctggggcctgctctagccacactcctgctggactcaggaacagaaaagagaataagtccaggacattttcctttaaagcaaatgatatggcagtcgcacacttcaattctgttcctgcccttatggcagaagccagccacagggcagcctggtgtggctagagccccagagcttcaaaaggagttggtaacgatgagaagggaatagatgccatgtgacagggatggcatttgaaagatttccagaaagccagaatttctactgtgagtcccttgtagagatttcatccccatcacaccacctttataataagcttgaagaggaccagtcccccaaaagaagggtggtaccctcttttctcaacaatgacccaatttttcttctgaccttactaacataaacatttactctataaaatataaggtgttgaggtcgggtgagtggagggggccctaaatgttgattaggcaattggggaggaaaaggaggtttttgctataactgccattctttaaatctacaattccatgctctttaaaagccttataattttctggatctgggagctgggctatttcagggtcaatggatttatttcagttggtgcctgaactgacttgaaacaagtgtgtgtggaaaagagctattttgagaaggaataaaccgagactgccctgatgatagaatatgcaagctggtgggtcttgactccttaaaggattatgaaattaatttgattggtcccaatctttatataaccaccccaatcaggaaacttcccatcccgccaaaaggccccctcacgtgctctccctgtcagtaccccatgcaaaggtaaaatagatgatatttttaaacatgggtcgtgtttaaaagaaatggaaactccttcagagaatgaaggagaaccacactgggtagaaggttattcctggggctccaccccttgctccatcaagtcctctgagcatgagctgggctctgagaaggaagagacaggaaccaattggtcatgtccacgtggcctcagaagctgagtacgtgacggtcaccagatgcctaggcaggctcccttgaaatggcagggctgctgtccaaaatcctgctgggtcattgctatttacaggcagccttcccggcgtgcggtggatatcccaagcggggctatttttaagcagggctatggcctgccgtgggttaagctggtgtggacagaaagcgagatgatctagccatctactgcagggggcctgatcttgaacagaaacctgactgtaattgtccctggatccaggtcccagacaaagacgctggaaggaggtccctccagcccctggctcagggcccggtcagctgctggagccaggcagcttgagacatcctcctctccgaccttggcttgaggggttcatcctccagagctcaccagggccccaaggctggtacacctgagagaagagagaaacaaatcccccaacagatgtgcaatttcacctgctggcccttccattctgagatccagagccctggcaaaggagcctccaggaccaggcctgggaagcaagactggctccgccttttacgtttcagagaaagggcaggtgctataaagggcccagcgcccacgggcctgccttcaagggtacagctgtgggggccggtgcgcccggaggtctacgctgggattggtgaggtcctctggccccgccccgccagggaggatttccaggccggcccgaccagctcgccctgcatacacttcttggctgtgtgcgctcagcaggacgtgggaggctccggcttcaaggtcggtgagtccgtgaaactctgctttattcctccaaagaggggtcatggctagagccagtgtgaagggccttggaggagtggatgccgggctgtagacggggaccccgttaggacgctgactgcgaggaggcaatggtgactcgctaaagccagcagagctcccgcccttggccgaagcgacccctcctccctgcacacaggtgggggcagctcagcaccaggagcagaacaaatcagcacgctgcctgcagggcctctttttggtagtgaatcaggaatttttctcgatggaaaaaaaaatctaaaggctgtattttgacgctaagtttgggacaactttaaacttaaagtgtctttcccttgtaattcacagagtctaatccactcatttctgggaatgtttttccccagcagtctcagtctcaaaagacatgtaaatcagtgacttgggatgaactaactagaaaattaaaattttgagaagctatttgctcataagcccaatagccaggcccagtttaaacgggcaaatagtattgctagagattcagttttgccgtcactaatactaacacattgataatgagacaagtaaccgtctcccctccccaccatccttacctttcccaccggaggttaattaaaaaaaaaaaaaaaaaaaaaaaaacctatggaattggccccacgtgtttcacctgggcagaggcctgttcttcactagcttgcttgcttggttggttgtcccggggttaaaatcagtcctgttcttgcccctagagtggtctgccttcaaatgctctcctccgaatgtgaggaagagtgacatttgacaaacagaccaaaacctttaggtctcctcagtgctgccctttagaccttccagaaagtgttgccaggctcgtgacccctcacagtgtcagctgagtcaagtgaggggcagttagtggccctcaggacaaggttacgctaggtacaccagtgtgctgtttccagaagggctgcttttcctgtctacggctctcacattttctctgttctgaactcgtgtccttggtctgttctctctgtcctctcatagaggcgagcatggccacagcatgtggccagagacttcctgacaggcaggctcttccgggaggctcttggccttgtttggcggtctgagcacttcacttcctctgcattgataggcaccttttccaaagaccccagactttggagttaatcacgcctgtgggttaaggcactgtcacagcaaagcacaggagtgccacatgcaccccatggactctgccagcctcatgaccaaatcatatcattaggaaatgggccataggcaggtcagttttcctaaggaaactgtgggttgggtcggggggagtaccatacagaatggggagtcctggggtttcagacacaggagggagactgactttgcccctagctcagaggccctgggcctccatctctgccatagcctacagcaggctccatttgtcttcccaaaggaagccacgtagagtctgtgtcaagcattctgggagctcctgcccacagagccaggaatccagcagcaacccatgctgaaggtgactgctggaggtcacactaacccttgccaggaagcctcagagactccctcccttgggcggggaagaaggcagcccacttcacagcacttcaaaggactagatggctcctagcttcctgttttcttgaaaacaatttacccttgagggacaaagtctggtaacggtcccatgccttcatcacaggaggcctaggaaaggcctctgttttacagagtaggattctaaatatctccttcctgcctaggactgtctatttgctgagtagaacagtaatgccaagagtgcccattaaggttggctgcgtactaagtggttttgaggtaacgcacaccctttgctatcttagaactgggaggagacaggcattttctgcggcctaggagcctggcatcgtgagaatttgttcagagtgttctgtggagctggtccaagcccaaggacatcctctgttttggggtggctctctggatggaaagctgacacgtggtcctcctcctgcccttccacctgccctctggctgaggagttcagacacatggacgctgtgaatggctggaccagaaataaatctgagtcagcagaaaggcagacatggtccatccgggatgcccaggaagagcagggggctcgggctggaggcagtgacagaacccaaggcctcctcttcacattctaggatgtcacagaaccagagaagagcattaagaccaggatctgaactcccagtatacctgcctgggaccaagaaatgtacagcttgtggccacttaacaaaagggcttgatgtagctgtcgttgtttttttaatgcggagggcagtgtaggaacaaacaggatattattgcttttggctctgtctggctgtgctcttgcacctccccatcgctccaaatctccctggcttggagcccaggtattctgccaattttagcctagatgctgtaagcagtgtttttcaattcaggagtcattgtggtgttccaggttagggaaactgaggcagaaagcttctatggggtgagagctggagaccaccttcctcttcacactggcacagcatccctagcaaggcctggcaggcacattgagcactagagtcagagtggagcgggcagagatatccctggcgtctgggttacttcagcgggagcctgaggacaggg

SEQ ID NO: 347 - DNA, 34387 bp, Homo sapiens
tatacatctatcttattagttctgtccctccagagaaccgtgactaatacatcattctccacccctccctgtgttcacattgtttgccccataagtccactctgtcactggcacatggcttgctttggccaacaggatgtgagcagatgtgacacagcagatctttacaaaagcacttgcacttttctgcttaggccttgctggctgagtggccataagcacatgcctgggctagcctcctggagtataactcccctgggacagccaaattgtcctagttatcccagctgtggccatcctagcaaagccaatagccaaccagtcccaagcttgtaagtgagcacagtcaaaacaaggaagactgcccagccaacagcagctgactgcagaggcatgagcgagcccagcccagcagagataagctaagctgagcccaggtcagctaagaccctgcacacttgtaaacaacacagtttattcttgcacgccaatgaaattattgaggttgctcattacaaaggattagtatgtcaatggatatctggtaataaatgcggtttaaacatccagcaattgaggaatgctgcaataccttgcagcaattaagaaagctggtataaagactatactttcagggatcatttctatagttcattactaaagaagtctatctgaacatgtagaacacatgacaccataaggaggaggcacaacattctccctagagcctgaagctggctcttggtgtttcatgactacagcagccatttgccactgatgactgttctcttccaggagaataagaaggagaagatgcagtttgggttgtttaaaaaaaagaattctgatgcagatgtatattgacttgaaatgttcacaacagactgataaattgtaggcggaatgggaatgggaagcaggttgcaaaacaatgtatgtaatatgataccattttcataaaacatatatttacacatttgcatatgaatgagtcaggtctgatacacaagatgctgaaagtggttatttccaaatggtaggatttggggtgattttcatttgttgtttatctgtgttttagagttattctataggaacatgtgtcatttgtacaattttcaaaggggagaaaaaaatcttttccatagagtacagcattaaaaaattttgaaatcctttagcttatccataacaaccctgagtgtgtttcaagtactttttgtggaaaaagtcattgtccgctcttgcagcatcctgtccaggagacttggtaacactggcttgtccaggattcactaagggattgcaggtagcagaacctgcctgtctgatcccactggtaaccctgagctctgtggttggcagtggcttcatctttccagcccacacagagacagcgaagcctaaaagctcctctaccttggaggaggcaagggttggggtcactgcggttccctactatcctaacagcagagtagagccttcccagtaacttcttgcccacagaggttagttatgacctttaggaaaacaaaagagaccttttaaaatttcctactaacaggaagccaaatttcatacattcagagtaagaaattcaatgccccaaggcaggacaaggatagctaccaccttaatccttctaaaggataaaaggacttcctgccggcctgcctgcctgcatttcctccttccttgctctatttttctctttctttttctctctctctcattcttcctcttttcttcctttcttatcccatttgcagttaggcttttacctaaaacaaatcctagtttaaagcaagtagatccgtccctttactgtccttaccagttctcaatttgcaataaatcccaaatactttttttttttttctgccattactggtgctgttgctaaaaccctcctcagagagctggtgaaaattacccatcaggctgatggggtctcatggaatcatataatccgatcccagcttgtccctaaaacactcacttctttccatcattcctacttccttatccttttgccgaattcgaatagatcttaatcttttcagcacttttatgccccagcactcctgtcctaccgtcctcacattctgtggagacattgactcagaacatgcccaactgcccttgcatctccctctaaatggctccctgctgtttgtttccagtgtatcaccctcctcacctcccatctcccgccaagctctcgaccccaacacaactggttttccctaggacagtgattattttggttcagatccagaggatcatgaggagtccatgaggccctgaaggtgatccacaaatcttcagaaagcaaagcagaatctttatgtcaatttttaggtgtgagtccctagctttcttttaatttccaaagggctgtatagatctagacagtgctttatcagttaccctctctttcttgaatttttaggctccctccctttcaactggtatccccttctccatctacacataacctgggtgtaccagggccatggacaactacgaaatataattaccaggtgtattggtctgctctgtttggcataacaaaatatcataggcagggtagcttaaacaacagaaacgtattttctcacagttctggaggctggaagtttgagattaaggtgccagcatggttggcttttggtgagggttctcttcctggtttgcagatagccattttctcacattttcctcacatgctctcatgacctttccttggtgcgtgcattcaaggggcctctctcttcctcttctaaggacactagtcctattagactacagccccatctgtatcccttatgacttcaattaacttttttgttttttgtttttttgagacagggtcttgctctgtcactcaggctgcggtgcagtggcatgctcatggctcactgcagcctcaacctcccaggctcaagcaatcctcccacctcagccctgtgattagctgggaccacaggtgtgtatcaccatgcctggctaattttttgtatttttttttgtggaaacagggtttctccatgttgcccaggctggtctccaactcctgggctcaagtgattctcccgcctcagcctcccaaagtgctgggattacagacatgagctgtcgcgcctgcccatttaaccttaattacttcctaaagattctgtccccaaatacactcacatagggcagagaaaagggagtgttaccacttcaacatatgaaacttggggcgacacaattcagtcaatagcaccagaaataaaaataacttgctttaagatatcaaagttgctatctttgttacactgacaatagattcctaacttatcttttttctctggctgcttttaagatcttctctttatcactggttttaagcaatttgattatgagatgtcttagtggagtattcttcatgtttcttgaacttggagtttattgagcttcttggatctgcagattataattttcataaagtttggagattttttcacatcattttttcaaatatgtatattttttgcttcccattcacagacttgaattatatatataattccaagtggcacatcccacttcctgggttcagtgggatagtcctacctccctggagaccctaccaaccaacacatcttcagcccctccctcctgaagtggccacagcagctcaaggaagacagaaatttaagtttgtcccagagataactaatgctctttaatttttaaaattcgttcttgtctgagtcttttacttaggccagtttctattgctatgcctccaagttcattaatattttcttctcattgtaaagactgggggacctctttcttaagtgatctttgtcttaagatttggtgcaatatatcagtagacctaacagaatgaatatctaacaaaagaaagttgaaaactaaatgactgttacctttctctttgaaatactgtaggaatgaaagttagatatactttgtgacttccacgagacactgaccatcacacaggctgtgatttttatcagtgcaagacgcaaggtgagcaggctcactgagaaaacgcacaccagggacttcacagttcctgctctgcatgatgatatggactagaaggaaaaagatgttagcatgagggatttctgatcagggtcaagctgtgttctgatcactaatgacttgtcggcttgtgggatggaggagcaatgagtgtctttggttacaaactgtgatctacctaccaattgtgaaaactatattcacaggagtcgacagcagcagttgatggcaagatggtactcagaaatggcattgatgtaatttaggacgtggaatcataagtgagacagcacacaattagaacaaagaattggcagagggggtcgacttgggaagaaaggtgtggatataaactgttactgaagaagacaaatagattgttcatgacactgagactttctacgataccatagcggaagagatgcccatgcatgtggctgaccttatttcattccgaagtgagatagttttggatgcagtgctcgttgttgctgaataagtgaccacaatgtgcattgtgcttctttctttggaaatatttgaatcttgtctcaatgcttaaaatcgatcagagatacagattttgatagcaaagtgacattagtcatgagcccttgtgaagatagtcattatttttttatcttctttagagttagactgagggggtgggtataaaagatggggtctataacatctttctttcttagaaatgtatttcctagtcccatggaaatggttgcattagatgttctctatcatttaataatatacttgtggactaaaagataaaagtgctgtatgaaataagccaattatgttaaactagcacatctgcctttactgcgtttatcattagtctgaatagaaagacctttaaaattaattttttagaaagcatttgaatgcattctttgctattgtatttattcaataaagtatttaattagtaaaaagatattgtcttctgcaatatctaaccttctgttaatcttatatggtgtatttttcatcccagatttcaaagttttgctatctaggctttcaatttgtgtcttttttgtattttctctggctcttctgaacttttaaaacatttaacacaattacaataattgttttaatgttcctctctgttaagtctaatatctgtgtcagttctgggtcagtttttacagaccgattattctcctcgctgtgttttcctgccttgctgtgtctttgattggataatgcaaattgtgaatttcaccttgttgggtgccaaattttttttttttttaattcttgtatgttttcttgagcttttcaggtcttgcctttgtgctttgagaggcactttctggagcagtgctcagtctagggttaattattccccaccactgaggcaagaccttactaagtacccagtgccccatgaatgatgagtttttccagtctgactgatgggaacaggtaccatgcctggcacccactgttccttctaatcctttcagatggctcagtcctcagcctacacgcatgcactgttcaccactttgctgaatggccaaggggatcctctgtggagctttgggattctctctctgtgcagccatcttctctccagtactctctctttagaaccacggctgacttggtctctctggacactcacttctgtcttttcaacttcaggagtctgccaggatccatcttagttctccctctctgcacagtgacctggcaactctgccaaggtaattctggggtaatcctgggactcacctagtttgtttccaatgttgttcattgcctggtgtccagtgtcttgaaaactgttgcttcatatattttgtttgtttgtttcaaatgggaggataaatccagtccctccttcactccatcttgaccagaagcagaagttggtagctattgttattttatcattcattcaagatattttaggggcacctactatgagccaggcactatactaggttgagtatacagtggtgagccaaaagaatatggtcctggtctcacagcaaatctgtcttatggcgatcaacttctgccagaaggcagtaaatatggtaggccctggatttacgaacatggacatgaatcggctgtgatcatttctctcaaggaattcagaattagaagggaagaaaaattaatacaaagctgactgtgagaagtatgtgagatacaaaggctctgggcatattgatgaagaaataattaattctgatttaaggtataagggaaaacttcatggagaaggtgacatttgagttgggacctgaaaagttcatgtaattttgaatggtggagaagcaggagggaggtagagatgctgaaagtgcttttaaacatgtggcagacacagctatttggcttgttcttcctcgcccacagaaccctaatcatgtgcttcagaggatgctacatacagtactttccagctcctaccagtgagtcttgattggttgaaatcaatcatggaatttctattccccatgcctgtcactggatccagcataggcacatgacacaattctggccaatgagatatgagggacagtctgctgggaaagtttatttttcaaagaaagggagagaacattcctttcccctactgtttctgagggagaaacaaaaacaaaaacaaaaaaacctgattccttgatgatgtcctgaaaccactgaaattaaccaatctgaaaccaatataactcatgacttcttgttgcatgagatggtaaagttttcttcttgtttcagtaacttctggttggatttttgttgtagttgatggtgttacttttggccagatgcgggagaccagcataccctaagctgatcagtttacccatttgaaactcgcttttccttttcactgaatcaaccctctgctaaatgttacttatcttgttcttgttcctctgcttcatcaagaatggaggttaacctaagacctaaggcatgacaatgcacttagtcactcttcccaaacatgcacatgggggggagatgcaaaacagctttgaaaatgaaagaaagcaattacacagtgcaataccttgactattctgtcccatcatccttcctgaacctttgattgggaggacttgaactcttatggtagggtggagggatgaaaataaatataaaggaaaagagtgtaggcaagcccaggggaaattatgtaaattcttccggattcacagcagtgctagaattctctggtaattcccacaggagccaagactacctctgaaacaatctaactgttggaaaccaccagtgtctggcaggaagccaactataacaagggcaaaagatatgcctttttggagagtctggaccaatcccagggacccaggccagcctgtggccaaagttgtgaatatgcaaaaactgtcaccagtctccactcgctttcccgttcccttcctagtccccttctttttctagccccaatctttttctccctgttcctcctcccactcctccttctcctccctcactcactcaacaattcatatcctgcttgcctgatgagcacagaaggtactaaaccgcctaccttaggacacttgcatttcagcagggagctcttacacccccaaggtaatgctcctctattgctagaaattcagatctctaggctggctgggggaagcatgtctggtctcaggcacagtacttcttgtgccatgcaaagtcagctggtgggaagggggggatccaaggaaaagaaggggactaggaagagaagcggggatccaaggactggcttcccagctctcactgccagccagtggggtcacaaagacattgcctcaaatgtggagctgtcctctgctagctcgtacaggatcttatccttctctcacataactacatccttccatctagcttatcttactcaccttcagtctcaatttaaatgtgtcttcctctgggaggccttccctgattgattcccatgtctggatcggttcagtacccccagaccactacatgcctttctctgtgagcacttgtcatgctgacttgtgatccatggatctcagttagccagaatccagcacagcctgacacttagcaggtgctcagtttatggaacgaacgaacgaatgaacatctgttcatatacactatagctctgcagacaccatgattatcttgttctccattgtaccctcagcacccagtccagtgcttaggctgtagtagtaagacagtaatgatttattaattgattgaaagagggcgtcccaagaaagggacttgcgtctatgttgcgacgacatctttattgcaagggcaagaagcacatcccagacctttttgaaaacatcagggatggaggtgggaggcaaggcaagatggaggaaatttctaggagtacagatatttagctgtcatggtgggtttccctcttcaactatcgtttcagttttctagggtttttttttttttttatggagtttctctcgtttcccaggttgaagtgcaatggcatgatctcggctcactgcaaccttcgcctcccaggttcaagcgattctcctaccccagcctccgactagctgagattacaggcgcccgccacctcgcccagctaatttttgtatttttagtagagacggtgtttcaccatgttggccaagctggtctcgaactcctgacctcaagtgatctacctggctccgcctcccaaagtgccgggattacaggcatgagccaccgtgcccggccttctagggattcttaacctggggctcataggtggggcttcaaaagatccatgaatcctccgactctttaatcaagcacccgtgtcagtagctgtatgtgcatttttctggaagaggatcatggctttcaatgagtgtcaaaaggctgagactgctcgagacctcaccgtccaatacggtagccattagtcccgtgtggctctttaagtttagatttaaattaaaatttcagtgcctcacttacactaagctacacatcaagtgctcaacagccactacctacaggccagaccagatagagggcatttccatcattgcagaaagtttgatgggacagatatctgtattggtagcattaccaactgaatacaggtaagattggatccaactagtgcttttgtaaaatgagttaccaacatttagaaataaaacataaaaatctaaaatcctgattgatttcatttgggaaacaggactatctatcagcgtggggcctgcgttcccctggcagctggaacgcacagtaccgctccctttagagggactcttggtcatatagaagttccccgcttgaccctccttgacgactgacagtacgaccctcgtttctaggggacttcgcccgtcttggtctccttccaggctcgcgtttgtaaccagactccaaattttactaaatggggttgaattgggtttgagagcacatcttagagcagggtctagggctgagattcggggtctcagttggaagttgaggaagggcaacgtctccttccttacagttttcccggaactgtaggaagtcagagggaattttatcctgcacatctgttgcttgacaaagaacttcccaatcctcctccgagccctccagtccctagcccagttcgcccgggcccgcccctagcaacaagatcgcggggaggggccgaggcgaaacacgagccccgcgcccaccaccccagctggcgacgtggctccgcggccccggcttcccccggcagctcagcgaccaatgggcgcgcgagcggggccgcccgcagcttcccagcccgaggcccaggcgcgcccctctgctccggctcggggcgggcactggcggagggactggccagtcccctcctccgcgccggccccaaccctgtcgctgccgccgcgctccgagtccccattcccgagctgccgctgttgtcgctcgctcagcgtctccctctcggccgccctctcctcgggacgatggcgcgcggtggccgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggtgaggccgcggccagggccccgtggggggcggcgcaggtgtccgagggccgcctgggcgagagccacgcgggataccaccgccaaagcgaaagcgaaatcgcgcgcgcggcctcgaggatggggccctgcccaactcggcgctggggctcaggctaacttgctggagggccccgggaccccagcttggagatcgccgccgccgcgccccggccggggtggtttctcgcggggaggcgagaacgtggcagcggccgcgggagccaggacggcgagggcccgccccctcccccaggttgcatcagaagggaggggagagtgcacaaaagaagagtttgtccacagtggcctgttagtgccatgagttcctccccactctctcgcagtttctctctgatcccccactcccggggagaagggcttgagacactcgctaagaaaatctcagggatgaacataaatggataaaagatgaaggggcaggcgagcgacaggcttgcttcctggtctcggccgcagtggtcttgccttttgcctaatcgccctgtaaatctatcgtaaggagtctgggcgcggtgactcacgcctgtaatcccagcactttgggaggccgaggcggggggaggggtggggagatcacctgaggtcaggagttcgagaccagcctgaccaaacggcgaaatcccgtctctactaaaaatacaaaaattagccgggcgtcgtggcacacgcctgtaatcccagctacttgggaggctgaggcaggggaatcgcttgaacccgggaggcggaggtagcagtgggccgagattgcgccactgcactccagccggggctagagtgagactccatctcaaaaataataaaaataaaaataaaataaaatctagtgtagggatacaaaaatccggttgaaaagggacacgcagtttccgattggaaacacgagggagcaggaatggaaacggttcgcctgaaacgtttctgttggcagcagatgtctgcagaagcactcagttctttggcaactgatttgtttggggggcaaaaagctggagggttctcttggtggtggaggattttgacttgggctgttaaaggcagttgagtcaggaaccaaacccgggaaacaaaacttcggcgcattttagtacaccctccccgggtcccctgaggaaacacttgggcactgtgcggaggtatctggtggtccttgcacagaggacccagcaggcagcctggtcccagatggaggcagggctggggaagaaaccagcagtcctgcctattgggcaccaggtctcagatctccctgaacctgattcctgggggtggaggatcttcatgttctgccacatgaaagagaacacagccatccctgtgctcctgggggcctccaaaggccaaagtgtttcattggaatatgaggataaattatacctattgtgtaggtgcaccatttgcctgctctgataaaaagacctttgaacttcaaagtcacctccaaacaattaccttttatcttgcagagtactttctcttctcagttaggacttaacaataggggccattgatgagttcagtctattgtattgctttgaggcacttggagactgatttatcctggagccctgagtggcagccacattgtcactggagaggaggcagggagaggttttgggatttggaaaactttataaggtgtggtcatgcagcttccagttaatgccttcattgtgacagttcagcctagtagtgagaaaaagtgacggtgaagttggtctggatttgatccttgtatcaacaccttgacttcattcatttattcatgcaacaaacatttgaatggctactgtgtaccaggccccagtttagataactggcaggtacaaagatgaaaccttatgctctgggcgtcgaagtgcttgtaagcaaatgtggaggagagaagcacagacaaactagccattatgcacaattgctgcaatgatggcctataaaacctactgtgagcacattcaggagaaggagccgccaaggctgcaggttagagagaggggattggggctgtcacctgatcagagtttgtaggatgacttggaggttgccaggtgtacagcaggggaaggccttcctgaagagaaaacagcccatttctaaagggtttgaaaagcgttctggggcatgaggggtggtgagtctgcaaaggggcagggaagggaagtgagaggtgagaatggaggggaaaccaagggcagagcaggaaggaccttggtgagatggacatgagatgttatcctgtacattgtcaaaatgtcataatccccaaaactcattgggaaagtcaggctggcaggagggcagtacacagagaacataatcaaggcacagactagaccagtggcagggagaggaggtgaatgccaaaggggcttggtctctccggattccaggaggggatgaatctagacaccagtgggaggcagaactggcagctcttgctcttgactcaatgagggggagaagagagaggtaggaatcaaggggacatccgggtctctggccttagccaccagatgggtgatggatgcaccattcacttgtaggttaaatgtggggtagaggcggggtaggaggtgctggaaattatgggtcctgtttgggatggggctgagtgtgagaagctgcccctctgtccaaagcttctgtttcagtggtcccctccaagattgggctgaggaggaatgagtgtggctggatctaggcaactttgtcaccatcacctgtcagtcctgaaaatgtgacagctctaaggcccctaaagacacctggaccagaggttgcaaagtgggaacccgtaggctgcatgcattcataaatatgcgacacagtgtaaattacttgcccacgtttaaagtttgaatggtttcacatacagacccccatatctggcttctcttgacacctttattcccatgtgtcagtcatcgtctgcagcagagtcggccagccctatttggcggctagcagggtacctccaagtggccataggtcccatcaaaaggttttgctcattctgttacctgttggtgttgagaacaaatgatgatggagttggtctgggtttgctccttgcatcaacaccttaacttcattcatttattcatgcaacaaacacccgaatggctactgtgtagcagctaccatcagccactgatctagattattgtctttagtgaggaaaagcatgcattctctcctttattcctcacaacattccttgtgaagtaggtgttcagtttacagatggggaaactcagagagtcaagacacttgcccaagatcacgcagataatggggaccagaggcaggacggggatccaggtgttctgatgaaagtgctaggcttcatctccatcctagctgcctttcccaggatctcccttgacattgttaaagagaaggttaagatcttatttattcttacaacaaatatttattgagtccctaatatttgtcaggctgagctatgtcctagatgtttatttggcatagattagatgctgtcctttccacaaaagaggattgtagagtctgatgtcattaccctgagattatgtttcccagttggcgttgggtaacccactggcatgtctccactgtgtccccaggatcagagcagtgcttggcacataactgggctcaacactgcacaatgttaaaagaattctgctgtgtctggctatgatttcctgggggaagaagcctgaagacacttgaagtttcatgttttagtctttttttttttttttaaagacagggtcttgatttgttgcccaggcttgtttacagtggtacagtcatagctcacactgcagcctcgacctcctgggctcaggcaatcctcccacctcagcctcctgagtagctggagctacaggcatgcatcaccattcctggctaatttttttattttgagacggagtcttgccctgtcgcccaggctggagtgcagtggcgtgatctcggctcactgcaagctcagcttcccaggttcacgccattctcctgcttcagcctcccgagtagctgggactacaggcacccgccaccacacctggctaatttttttgtatttttagtagagacggggtttcaccgtgttagccaggatggtctggatctcctgacctcatgatccacctgcctcggcctcccaaagttctgggaccacaggcgtgagccaccatgcccggccattcctggctaatttttaaattttttgtagagtcaggatctcactatgttgcccaggctactctcaaactcttggcctcctacctcagtcctcccacctcagcctcctgaagcactgggatcacagatccagcctatcttttaggattgagacctgttaaacttgcaaatgaaggggtactttcaagctgttggtgatgtttacaccttcctgagaaagaggagcttgggttcttgggttcaggtaggaggtggagacattgattattcactcctccccttctcgtgtacaccctcccccacctaaaaaaaagttataggagattttctctgtcaaactatcaaactgatgaatttgtttcccattttttattaattaaagattaattgccactcagaatgtctgttgacaagaaagttttaccactgaagctgttagaattccagcccaaaacaaagaaagaaatctagagttagcctgtatgacctcctcccagataaatggactacaagggtgaaacttttttaaacactggggatagcttggaggtgtttttgaagttccccactgggatgctgtcctggtttgggaccatctggtctagagatgacaaaagtgggttcccagcctgaagtttgctctgggctagcatttagggtacctcagtggagttcagtgggaaatttgtgaaacctaggccagctgtggagctggtataggagtctttaccctaagagcagagggtttaaggttcctagagcggatcagctggtcaagttttgtgaatagattctatgatgtcaaggctccttcagccctgacatttgtgctgtgtccaccatctggtgtcttcttgctttacgtttcaagtctttgtatccatggtggtgggatttaaaaaaaaaaatcacttatcttttgatttacatacagtttccactttttgccttggacctaagccagaagacatgagttctcaccccagttttaccaaatactggctgtgtaatcttagaagttattccatttctctgggcctcagtttccgttactccaaaatgagggtgctggactacagcagggaagattaataggtttcatcttacagatcagctctgatccgttgataatggccatcaccagagcacagtgctgagaattctgagagcacctctaggtttatcaggacagaggggcacgatccattagcagtgtctgccatcagcactggttgggggaaagcacatcaaccttggaaggataaacttgaagattccttccagcctccttggatcattgattctgttgtagttgtatgtgcattttggattgtgcaggtgtttgatcttttgctggaccagcatcacacaagccttgataatataacagccttgtgcctgtgtgtgggtttctttttttttttttttgtactgcaggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggtaagaggtgctgcaggagcgatgacacagtgggggcccagatcacaagctttttgtagactctctcttctcttatcatatccactcccttcagggagatgtcacagcctcctaagtagaacctgcttgtataacaccctcctctgtaaactcagaatgtactgagttgcttacactgaatgaagttacaggtgggagggaagggctgtgagggctaataaaaaaaatcccttagattgagaccccatctcaacttcgtctcagatgcacacacggagaagaaagcagaaaggaagtgtgtctgtggtatattttcaaaatgctgcctaattctggatagcaaggattgagtgggccggagcagtcagggaaggcttcctggtgtgggtggtttggaaactggagccttggagaatggatttatatttggagaaggtgggtcaactggaggggcaaagatgcagcaatgcatgcagtaatgggaagggtttagatccaagacaaacaagatcgggagaaggaaggagaaatgagattacagaggcacggggtgcagacctgctgggtgcatggtgaggttggcaaagaaacaggcccaaggagaaccaaagatgcactcacgcggccagaatcggggagatcttgaaagccaggcacggcgttgagacaagatgttttgggtaccaaagagcctctgtatgttccagatctaagaatgagatgatgaaagtagagttctgcaaagagaagtatggcagtaatatagtctaaagcctgcgctcttaaccacttgcagtaattcccctaatatgccatgaggcctagattatggggtggcttgaagggactgatattagaggcattctgacatagaatgttttaaagaactcagtaggtcgggaccttttttccctatatgtaccatttgagcatgcaggatgagtgatctggcaggaaacgcctttcttgaccgcacggtttaaaaacatttctgcatacatacatcctgcaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggtaagataagtgaagagtctgggctgggaagagaccagggagaaaactgcctccaaatcttgtctcttccaaagagagaagatttttcagcctgaagggaattggagaaggactctgaagtagagtttgttggaatccccgtctacccagaaaattagtcaggtcaggctggctgctgtaacagatagcccccagttgtagccatttaacactagcaaagcttgttccagccagatggacctcctgggctgttctctgagcacagttgggtacccagttctcctctaagcactcctgcttgtgctctgccatcttgtagcttcaaagtcatcctggcaacacccagctggctgacaaaggaaaagagagggaatgagaagatacagtctttgtttactcttccggccagggaatgacacatccccttcacgtatgttccactggtccctcctagatatgaagaggctgggaaatacagtttagatacgtgcctagaaagagtaaatggggcccaggcacagtggctcacgcctgtaatcccagcactttgggaggccgaggcaggcggatcatgaggtcaggagtttgaaaccagcctggccaatatgttgaaatgctgtctctactaaagatacaaaaaaaattagccaggcatggtggcatgtgcctgtaatcccagctacttgggaggctgaggcaggagaatcgcttaaacccaggaggcggaggttgcagtgagccgagatcgtgccattgcactccagcctgggcgacagggtgagactccttctcaaaaaaaaaaaaaagaaagagcaaatggcttaagtgagcaactagctagtctctgccccatttttcaattttaagggacttggaaaaagactcagaaatggaatgaattggattgttaaaactgtatggaaatgtaaagtaaaaattatggctggaagagatgctacccttagcgggtgggtctttggagggtgggtggatcaggccctaggctttgaggaatgactatgcttgtaaggcctcagaatgtagttgctttccgtagtgtcttgttgggtcccaaatgtcttcattttccatgacaattaaataaatgccatcacctgttttcctgggcagatgcaccaacccagttccaactgtttcaatcctgggaaacagatggctagagcttttgtttacacgagctgtggatggttttagttatccaggtggtggaagggtccactcatgcttcatcctcctgactgccatgactgtaaggactgggcagtggctccaagaatcatttctctttaccactcaacattcatgtagtgttagctaatgtggcagaggacagtgcaggtggtgaatgatcccgagtagactacgagcctttgggagtggctctctgctctcaggttggctctttggtttgacccaggatgcctctgagttgctgtgccaatgaacagtaaactcatttaattattgacccaatcaaaaaatactgaataagaggtcaagtatactaaatacagagcacaatacatcaaaaagtcagatatacttttattttttagttgcccactgtttcacatttctcttgacaccaactcagtattcatagtcctgttagcactagagtctattcttgtggtcatctaatccagtggttctcacactgggtttctcgcatgttccccagtgggtgttttggctggatggtggagttagttggcctggcagggcctcctgatatcgtcagagcacctctggggttacaggtacatcttgcttgctttgaagaaagcattctgctctggaaactggggtgggggattaggaacagaaactattgcctgttttttacagataaaaaactagttcccagggaagtaaggcgatgagccagaagtcaccaagcattcagccgtaaaagctggacaaatgaggacaatagaattctcagacttcttagagcacatggccatcttgcattctgttttaccttttgcttcctaggaaaccctggaggacatcgacaagaacggggatgggtttgtggatcaggatgagtatattggtgagtactgacctagagtcttgctcagctgtcctgactgggccacatgaccccacccacacgtctggctactttccccagacgtctcttttagcaacagctgcaagtctatacgtcactcctgggagcttccagcctgcttgtcccatcagccctagtgatgtagtatcagggaagtattattaggcctcattcagtggagaagagatgaaaaggctggccctacacaaggctggccaacagttggccccatgactctgagaggtgcccttcatcacactgcctagttttacctttgcaaaaggacattggagatcccatagatttacagtgaagatagaggagacagtgtcagggcaaagcctctaaaactggactgggtcaatggagcctagaaactctgagtagatgcagctgtgattaacagaactgtttatgtgtctgagcactttgcagaaaggcattcttcttagaaagataaatgctttacagagtgcacaattgcccaataatatgctcattttgtgcccctcgtttcccatcctttggatgggagtcctatagtgtcaaattaatgtatttgggtctgaacccaccattgctggttagagcccttcctggtagccccaaatcccccccagcccaaccccccgctagaaaggactagagcaggcaacaaggacaattccatttgatcctcaccacctgctatggcacatggctccagctgcaggctcccttctcatggcagctcttttcccaagtctcaataaagtaaaagctggaaaatcatttggtttaggtgttgacctatgaaaagagaaatgaaatatgtataatttttgtacagatttttaatcaaagccattaattacctttaaatgtaaaactcagagcctgagttgctgtctctggttttgtggttgtattactttgccatcccagacacgagaacaagtgccttcagcaatgaagagcagactttcctctaatcattagaaattatgtttgatcatgagccaaacactgttccttgtgtgtcattggtaacagacaaggtagctctcgccacagtaattaaagtgatcttggtggcactaccctgatagaataacatatgctgacagctccctcatcagagcaagcagttgagccttcctcttgctgggtccacgtgcgagggtcacgttcggaggcgcagacctcttactgtggcactggggatgaaatgagactgacagcaaagactgcatgatcaaaacaaacaatgtagtgcttttgattgaaagtgtgcgctctgcccagccctccggaactgtgcattgaaatggtgcaaagtcagaggcagaactcttcgagtggctttgcctaaaagaagcatcccattctttacagtgaatagggagagggaggtggaggcgttgcgcttgaaaatcgaatacctagtgactcacaggcagaggaaacccaatgtattgactcgtcatttcacttctcggggaggcttctcttcaagcggcaccaagtggaaagtgtgtggtggggggtggtagtaggaagagcactggaattaggaaccctaccttcaccaattagctgtgtgaccctggggtaatcatgtaatggcttcaaacctcagcttcctcatctgtaaaatgggggaaaaaaagtgagcccatttttacaggattcgatgaagctcgaattagctaatacatattacaactctttctcaaaaacaatgtagacatgtcagttaggggtctaccttgtagtcaagggtcttgtctttttttttccttcacttactacctgcttcattcaccacctgacatttccaagctctgcttccgtgacagagaaactgcctgcagggtatctctcttttccaagagctactgacacacacacaatgcaaaaacgtttcctttttcttttccttgccattttgtacaatggggataatgacccatcttgtagaattgttataaggatgaaatataatgacaagtgaaagccctttggaaatgatataaacaatagtactaaacacagtggctaagactctgggttgaaagcagagtgaccatgttcctgtgcagcctccagctcatatgagctgtgggtcattgggtaagactttacctcattgttttcatctgtaaaatgggaattataacagcactcactttgtaaggctgttatgtgaaaatcaaatgaaaactgtgtgtagaacactttatacagtatctggaccatagtgttcaatgttagtcattattattagttttcgcttatgtagtgccagtttgggttgtagagggcttttacatcaaaatggcacatttgatcataatagccccatgatttataaattatcatctccattttacagacaaggaaacttcaggctcagtcactgaactaagtcaaaagccgggatttatcttttggcttctaaactcagttctttctactccaccacatggccttcatcatgaataaattactgcatcattatccccaagaagctgcctaccagctgtttgagttaggtctctggattggttgtcgcctttcctaaagctcaggaggtcaagtttgttttatgggggtgggggaggtttaccttcccactttcctttgtaaccaacaataaccttcccttctagcggatatgttttcccatgaggagaatggccctgagccagactgggttttatcagaacgggagcagtttaacgaattccgggatctgaacaaggacgggaagttagacaaagatgagattcgccactggatcctccctcaagattatgatcatgcacaggctgaggccaggcatctggtatatgaatcagacaaaaacaaggtatttcccattcttctggaatcactgattgaagggagacagtttacataagatcggttttgtttgctttttcggcgatagcattgacccatgtggccatgtctttattgacttttccttcttgtcctacagtggagacctgtaaacttgagctaataccgtgataacccacagtaaaattattaggccccaactttcctggaaagtcagctgtgagccacagacttacattaagtcacatttcctaagattgcagaactttgtgggcaggacacgatttaagaagtataccccgtgttgccctaggatcagcttatttatccattcattgtcaccaaatacttatcaaacatctgtgaggtgtcaggaacaaggaagcccatcccattaaagcccagacatcctcaggcaagctcaggtttctggctttaatgcctagtacttcggtatctattgataaacatccaaataaacaaatcaatacatttagaaaaatgtcctgcctattccccactttgctgattgcccccaaattctcaggttatgccaacagtcagtttaggcagcgaggctgtaagaggaaagtggcattcttgagggcctattttgggaagaccaacactgcttgtgggcacaaatggattctagcttctgaattactcggggacttccctgacacgttagcacggtttttatagcaagaggctgttccgatttggagttttgcaatgcagtcatggtagatgaaggaggtgcccagtagcttctggattactaaatatagtattttaaatgttgtacatcagtgaaatgacatgaacatcatacagaactagtacagttaccagagcttccatgacagtgctctttgatctcttctataggatgagaagctaactaaagaggaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgtccccccgcaacagcttataccatggaatgaggacaaggtgatactctgagctgtggactgaactggcagacacaacctgtacagattgaaatttcaccttgtaaggaggaagtgaatgaaataaaggatccccctaaggattttctactgtgtcctgtggtgtttgacttcacagatgctatttgtgacattattcatatagcataaaacagtggggttggatcccatgaataacattataaaggttctggggttttttttcatccaattactagaatgttcagaatagactcatatttactaatttaataaatgtatgtacttaatgcctttacttttctaggtcattttaactataaaatcttcctgaaaaaggttgcacctggaaaatctggacttcttccctgggcctatgaggcgctgtaggaggaggcctatgggatctggcccctaccagcagtagcatcatctccttaccactgtccctttcataccgcctatagtctggccccagagactttctagtcctcagacacaccaaggtcattcccaggttgggccctttgcacttgctgccccctcacattcagaatacccatctctcacgccctcgggtaacacatggtacttcctcaggggggctttccagaccccactatttaaagtaatcccaactcgaatctcggtttcacatccccattttattttcttcttggcatgcattactatttgtattcatttccatgccttctgtccaaattgccacaaagtgggggatttacagtgacagaaacttacacggttctggaggccagggtctgaagtcaaggtgtcagcagggctgctctgcctctgaaggcactagggaaaatgcctccttgcttcttccagcttctggtgactccttggagttccttagcttgtggctacatcactccactgcgtcatctctgcctctgtcttcacaaggccttcctctcctttctctgtgtctccccttggtgtgtcttttataagcacacttgtcatttgatttagagcccacttggattatctaagatggtctcatcttgaggtgcataattacatcatccctttttccaagtaagatcacattcacaggttctgggggttagcaggtggatatatcttttggtggggggccttcattcaagctaacctactacaccacttgacattatattgtttggacattgcttgtctctcccaagctagaatataaaccatgagaccagcagtctcgttttctgatttactgctgtttcccgggactgcgaacagtagagtctattagcaataaatgctcaggaattatttgctgaatgaatgagaggctgatggctttaatcaaagggaatatctctcagggaaaaaaattctgtaaaaaatattaaaatagctaacaattgctaaatgggaactttgagcgatttgcccaagattccacaatgattaaatggcaaggcaagacatcaactccaggtgttcctggctccaaagttctcttccatttagctttaagttttgctgctccaaatctcaaaatttcatatgttttctctttatttctttgctcatccacagcatatgattatgtggtaaggaaatgagaataactccgctttactagaaataagcatatggctttttttttaaagcaatgagaagctgttttttaaaaaatgagaaaataatattgtgtaacctaattataagcataacaatttaaaaggtgatgacattatttttcacctccaaaaaggaatatagttgatttattattgtatgtagtaagacattaaatatatttggagcattaactttttcctttcaagtcagtgcacattggaagactaaccctgaacgatactagagcttctggggctgaatttaacactaaagaatgaaaaccttagctaggggcaaaactgttaacatggtgatttgtaaaaccttagatttctaataaggtctgactgtttcaaggaaaacatattttgtttctaggtaacatttcaagtctgattatgaacaaatgctacaaaattgatctgtaatgggaaatactgtaatgtcacaaagcattatttaatgcttaatgtgactgaaagcattaattgctaggagccattgtctgtccaagcaaaacacaaacacacattttacactccgcgtctcttactgtaggttttcgaatgaataaaagtgtcacaaaaatgtagttagaaaatctgccatacctgaaggttttcttcacctgtttggaatatggtagttgttcccttattagcaaatgcgtgagtcgtatcttctcagaagtccccagcaaacagttgctgtgtggctgcttgttagcagctcagctaaaatgtctcgtggggtgaggtagtgagtggttgacgggattttttttttttccttctagatttattttgtcactttcataatgaaatctcaggtttctccaagaacgtgcagttgagatttggctgtctctgaagtactgaaatgagtttatagcactagaattcccactaaaaaccaatgagtggcataacgttcatcactttggctcacactgaagtattaaaagtctgagtactggctggaaaccttgtgtcatcagtaaactcatgagatttacatgaacttggggctatttccaaagaaaccatccccatcctcaattctggtcagtcccagggtccatggctggggatacataccctaggtgtaatgcgtcgcaccaccccatgtgcttttagtacctctataatttttctcatgtaaaatagaaaatggagtctgattctcccacagaagtccatcaaagaaaatggctgtaaggattggctaccttctacctcaaaggtgtttgtgtagtgagcacttaagcatttcattgctcctaggataaacactaatagctctgtaccaggaactataccaagcacatacatacatttctttctcatgtaaccctcacagcagcccttgagattggtacttgtaggaaagaggagaagccaggttatgttgcagtaacagacaatgctaacatctcagtggtttaaagcaacagaggtataatctttgcttttgcaaagccagctgtggcctggccagttgtctgtggtgtggggtctcagcaagatatctccacaagcaaccatatccactggagaccccacacaggcaatccactgctgccacctaaaagtggcccctgtcactcatgctcactgacattggtcagtcaaagcaagtcatgtggccacttctaacttcaagggagcaggagagtgtgatcctactgctgaaagcactggtgagcagcatctgtggttaccacagtggattcccatcttacaaatcagggaactagaaagggaagtaatgcccaaagccacccaactcacatatgagatgactgtataattgattgtccagacaaggacacctttgccaatgaaagggaggagttttaatcaatatctccctgaatcctggacaacctgctctgctcactttgggactagtaaagactcattccactccttgtctcactatgttcttccccaagggttgagaagtccatgggccaaaaaattttgcccattcagagccagtgcctcctgcttctagaccatgctccaagtccccagatgactccagaactctctgcccaaatgaccccaagtctcttccaaagcctgggtcagcctcttccccaggtatatcttccaaagggcaggcaacatggtgggtaagcccacctctagtcccaaaggatggccaacgggcagctgttggggggtggacttgatgtaaacctgcaggctgcggtgttcacacacactgctatggtttgaatctatgaatcacccaaaattcatttgctgaaacttaagacccaaggcaatgacattgtaaacaaaaaagtatgcgtcaggtctcaatcaatttagaagtttattttgccaaggttaaggacatgcctgggaggaaaaaacaaaacaaaacacagaatcaaagaaacagcctgtggtctgtgcttttctccaaggatgatttcgagggcttcaatatttaaagggagaaagaggctgcaggggaaagagtgagataggatatggaaatccacaggttgcaaggaaaaaagagcaggtaggggaatagtgaattatgtattcgtctcctgctcagtaaatcggtactttacatacagtaaggggaatataaagtagctacctgtggaaatacttaacttttatcggtaggtatctgctcaggagcaaaaggaaagggagcttcttgcatgactcagctttcggcttaactttcccttgtggcagagcgaattgggatcccaagtttttattttcctctcacagtattaagaggtggggcttttaggaggtgattagttcatgagggcagggccctcatgaataggattagtgcctctataaaagggctcaagagaactagctaggcctcctttttgcccttctgccatgtgaggacccagcaacaaggcaccatcttggaagcggggagaagccttcactagataccaaacctaccagggctctgatcttgcactttctagcctacaaagctgtgagaaataaatttctattctttataaatgacccagtctaaggtattttgttacagcaacaaaaacagactaacagacacacctacatggagcccattggtaggaagaacaataatagagtgacctccattttttattcccatgatggggcccacaagtattaggggatggcctgccatgatgctagggcaaccaggatcgtcttgggtaaacagagacatgtggttcccctacttagaaatggcagataaggccgagcgcagtggctcaagcctgcaatcccagttctttgggaggctgaggtgggcagatcatgaggtcaggagttcaagaccagcctggccaacatggcgaaaccccatctctattaaagatacaaaaaattagcccggcgtgatggtgcacacctgcaatcccagctactcaggaggctgaggcaggagaatcgcttgaacccaggaggtggaggtttcagtgagccaagatcacggcactgcactccagcccaggtgggtgacagtgcgagactctgtgtcaaaaataaataaataaataaataaataaataaataaatggcagataagggatacaaatacaggtctctctgttaatcactccactatactgcctctgattcaggagcctcttagtggaaccaacagggctatcaccacaatttttaaaactggtgggagggcatggtgtcatttgaaaattcaggactactgtgatgagatgcagagttggtagcatggaaagacgggtccaaagtcctggttgaattcgagttctaactctgccactcagaagtgctgtgatcttggcaggttaccctcctcctgaagagcctgttctgttttaaagtggggatcatcatcataatacctagctcccagagtagctctgcaaatgaggtgagataatgcatgtgcaaggagttcgaggactgggaagtgacacacacataaaaggattgctctctgttgaccctcctgagcaggtcaagtgccagagttcaggtaatcaatgcctgcaaacaccaggctgctgtttaatcatcttttcatgctttagaattattcctgtgaagcatttttaaaacccccaaatcaatctattactaggttgaactaaatggcctcaatgacaaaggaatagcacttcgcaattgtttttattatggtgagggtattccaaagatatttataagtggcagggatttggaactcaattccatagcagatggagagtctccatacatgcaaaaagcattcaagaatccagatggaaaaggtcactggggattatgttttccaaatcaggaaactgaggcccagggagattaaacccatggttttccctgtggcactgaggtggagacagaccttggactagaacctgactcagctgtcttctttaaaacctcaactttctcatctggaaaatggtgataataacacctgttgtatagaacagtcatgatgattgattgaagcaatgaccgtaaagcattctgtgtcttcagcattcagcaaatggcagccatttttattatgaccctcaagtatggtccttatgtatttcagcatcaaagatttattttattcatagttacctctagactgcaatccatggcatgagtgactgattgaggttatggatttaacagaaaagtgtcaaaggtttattggttggttgttgtaaacatgtaaagaaagctggctttactgcactgaagtttacatcttctgtaaaagggaggtctgaacagtacctacctcataaggtgactgcaagggctcagagaggaaagcccttagccccaagccttgatgcaagaaggcacttgatcaatggagctagatgactctgttataaaaaatattaatgaattgacagtcattttaaggtcaaaaatatatgcaaaagaatcaaaagaaattgtctagagaataacctaaactttattttatgacatacacaattccatgtacagtatgtgtgattcatatggaagctgtcctcatcagctgcaggaggcccctctggaagtcttctggaaggcttgttggcttgccggtggctggattcacaaagacttaaactgaagaaccagtggtacaggacagagcatcaaactgtgccagcaggggatggccaaagaaaaaggcatcactgaggtcacggtgatctacggagggcagctcctcagtgggcttaggtggaaatagagcaaggaggtaatgcacactggagtgactaactttctccacaaccaaggcagccactgggatctaaggaaacctgataggtgtgtggtagatacaccaattggccaccctgaaccccagcatggaggatgactgcaagctagttttcaggccacagtacctagaagattagatcacaatgcttattctggggcaccatgatgctgtctcccagcccaaaggcagcctgtttcagtagcagagggctctagcctcaaaggaccttggtccaaatcccagctctgccacttaaccaaattacctttggcaaattacttaacttccctgtacctttgtttctttttattttatttattttttattttacagtgctctgcatgttcagagaaatctctagtaatgaactatagaatgatcccttaaaatatagtctatctcagtctctacaacaatctaacatcataacctacctcataggctgattgtgagaattaaatgacgagtgtataccatttaatatattaacagttcctagacagggtaagttcttattaaacattggctattattaatacatgcaattccttttaatggcaaaaaccacaatgacttttgcaccaacctaatacttacgtccctcttgttctcttgcttctcacaatgaaaagtcaggtgcttttatgctaaatgagaagggaaactcatttattagagataagttattgtgtctcttatttctgctgctagatattaatctcaaagaacaggggctgggtcttgttcactttttaagtttgtctaataggaacaaggtgacacttgagataaaatttggaggctgaacagaatcggaaataaaaagcatcgagacatgttgtcttactgtcttctcctcttgacaaaaattaacattgactatgagagttcattgtgaaggaagaattacggcttgtataaagtttgactacaaagttattcattgatgcattgttcatggagggaaaacagaaacaagctacaagtttctgctcagggagggcacccaccaagagtgtcatgtggccagcccccctcagggtacaccacggtcacccatggtgccatgagatacgtccaccgactgacgtggaaagatgttcaatggaaaagatcaggttacagaacagcatgttctaccccacgtgatctcactcattatacaagaacatgttggtttatgtacatattgcctagaaaaaacgttgaaaagctaggctgcaaaatgttttcagtagttatctagcagtggaattgtggataattttttttcttctttttgcttacttgaatcttcccaaatgaacataatttgcctttgaaataagagaacatgttattttttcaatggctgaatgtaattttttttaaaagaagcactagagggatgagcagtgggataaatgaggctccttcttccttctgccaacgtcctgcccccacttccctgctttagaagtcttcctcatgagtactgtgagagtgctgctgtaacaaaataccatagcccagggggtgcttatcaacaacagaagtttatttcccgcagttctggagactgggaaggtcaagaacaaggcgccagcaggtgggtgtctggggtgtgcctgcctcctggttcacagatggctgtctttttactgagtgctcacatggcagaagaaggtgagagagttttctgggatcccttataaaggtgctattaggttggtgcgtaagtaattgcggtttttgccattgcttttaattcacatggaagctgggctcatcagctcatcatacattacttttaatggcaaagactgcaattacttttgcaccaacctaataattctactcataaaagctctgtcctcagaacctaatcatctcccaaaggactcacctctgaagatgaggtttcaactatgaatggggagtggggacaaacatttagtctagggcagagggaaaggggaaaggtgaaaagaaaaggcttgcttaattttcagcatgactccaagatccagtgaaaatcaaaatcacttgcttttatttcccttacctttcttttctattctctgccactgttttcctcttggacagtaaagaaatcgtgcctcttcccactaggagagcaatatttcatgagcagcctgttttctgtgtgagcccaattatatttttaaataattgaattgcatttaaacaatgcagtctactgaacacctggtatgtgtcaggacggtgctaggtgctttacattttatactcagtttgcaaaacaaccctgcaaagcaggtcgcagtttctccattctacagggaagaaaataaagcaaagaggtggaataagtttcccaaagacatgcatgcagtaactggtggacttggacccaaactttgggctctcttgatgcaaagttctcattttctcccccattctggatctctagatggagaaaacaaaatctacatttcagtctagtggatgaactgcatttttttaagtggttccgggactttgaaacagtgtcatcgcatttaggcaatatgccccatgtttggaagttcatgccctgatttggttggcagtaacaataggctcctgagtgagaatgttcccccttgattcttttcttttaggttttaatttttattaaagtttatatatatgtgtctacttttaaaaattcaaatagttgttcaagtcttatcacacacacatacaaaaaacacttttctggctggttatacatttggttatagtctaggtcagtaagttcttagaatgagtgaattcattcaaaatctctattgcacacctgctcttagttaaatgctgaggacacatctttgggcagcctttcctcaggagttctcaataaaggatctgggtagcatcagctcccgttttctcctctggcaagaagtagatgccagctgtgttactttctgcttgcagaggaaagaaaaatcgggctgcccccttccactctttgcttcttctttttctcgtctccttttcttcctttcctccacaaacatttattgtgcacctactacattccaagcatgtggtgggcatggaagagacagcagtgaacaagctaggtggtaaagatctctgcccacatatagccttcgtctagacaggaagcaatcactggatgcgattatgatgcattgtgatgaacgcaatgctgggaaaagcacagggattctgcaggatctagcaggggcctgact
